United States Patent 11,446,398 (REGULATED BIOCIRCUIT SYSTEMS) - sequence listing, part 88

SEQ ID NO: 194773 - DNA, 3832 bp, Homo sapiens
  Payload ID: 18480
  Gene Name: tripartite motif containing 2
  Uniprot ID: Q9C040
  ENST ID: ENST00000437508
  CDS Start-End: 202-2436
agcattttgagtgagcttgcagaaaatgaggggctttcagctggtcgcctgcttgtcacctctcgctgcctgaaaggcagctctcagagccctttcctgtccttctaattacagcggcgggggcagtgcgcgcttcgggacgcaattggaaaccagcgtgcagggtcaaagacagccggccccccatgtcagtggtctaggatggccagtgaaggcaccaacatcccaagtcctgtggtgcgccagattgacaagcagtttctgatttgcagtatatgcctggaacggtacaagaatcccaaggttctcccctgtctgcacactttctgcgagaggtgcctgcagaactacattcctgcccacagtttaaccctctcctgcccagtgtgccgccagacctccatcctgcccgagaaaggggtggccgcgctccagaacaatttcttcatcacaaacctgatggacgtgctgcagcgaactccaggcagcaacgctgaggagtcttccatcctggagacagtcactgctgtggctgcgggaaagcctctctcttgcccaaaccacgatgggaatgtgatggaattttactgccagtcctgtgagactgccatgtgtcgggagtgcacggagggggagcacgcagagcaccccacagttccactcaaggatgtggtggaacagcacaaggcctcgctccaggtccagctggatgctgtcaacaaaaggctcccagaaatagattctgctcttcagttcatctctgaaatcattcatcagttaaccaaccaaaaggccagcatcgtggatgacattcattccacctttgatgagctccagaagactttaaatgtgcgcaagagtgtgctgcttatggaattggaggtcaactatggcctcaaacacaaagtcctccagtcgcagctggatactctgctccaggggcaggagagcattaagagctgcagcaacttcacagcgcaggccctcaaccatggcacggagaccgaggtcctactggtgaagaagcagatgagcgagaagctgaacgagctggccgaccaggacttccccttgcacccgcgggagaacgaccagctggatttcatcgtggaaaccgaggggctgaagaagtccatccacaacctcgggacgatcttaaccaccaacgccgttgcctcagagacagtggccacgggcgaggggctgcggcagaccatcatcgggcagcccatgtccgtcaccatcaccaccaaggacaaagacggtgagctgtgcaaaaccggcaacgcctacctcaccgccgaactgagcacccccgacgggagcgtggcagacggggagatcctggacaacaagaacggcacctatgagtttttgtacactgtccagaaggaaggggactttaccctgtctctgagactctatgaccagcacatccgaggcagcccgtttaagctgaaagtgatccgatccgctgatgtgtctcccaccacagaaggcgtgaagaggcgcgttaagtccccggggagcggccacgtcaagcagaaagctgtgaaaagacccgcaagcatgtacagcactggaaaacgaaaagagaatcccatcgaagacgatttgatctttcgagtgggtaccaaaggaagaaataaaggagagtttacaaatcttcagggggtagctgcatctacaaatggaaagatattaattgcagacagtaacaaccaatgtgtgcagatattttccaatgatggccagttcaaaagtcgttttggcatacggggacgctctccggggcagctgcagcggcccacaggagtggctgtacatcccagtggggacataatcattgccgattatgataataaatgggtcagcattttctcctccgatgggaaatttaagacaaaaattggatcaggaaagctgatgggacccaaaggagtttctgtggaccgcaatgggcacattattgttgtggacaacaaggcgtgctgcgtgtttatcttccagccaaacgggaaaatagtcaccaggtttggtagccgaggaaatggggacaggcagtttgcaggtccccattttgcagctgtaaatagcaataatgagattattattacagatttccataatcattctgtcaaggtgtttaatcaggaaggagaattcatgttgaagtttggctcaaatggagaaggaaatgggcagtttaatgctccaacaggtgtagcagtggattcaaatggaaacatcattgtggccgactggggaaacagcaggatccaggtttttgatgggagtggatcatttttgtcctacattaacacatctgctgacccactctatggcccccaaggcctggccctaacttcagatggtcatgttgtggttgcagactctggaaatcactgtttcaaagtctatcgatacttacagtaatggtgggcaggtggatacccgcttccatggtcttgcactataaactggaatggatttctcaatgcgggaccagattatgactagagtttttatgccagaaggaatcattggtgaactttccaaggttatttctgaatgtaacaatttccttaaaaatgacttatccaatttctgtatttcacctttagggttaaaaaaaactcttctactgaatctataaaaactgcagttttacatctgtgaactatggcttaagggacaggatttatgtagctaaactaattttgcaaatcaaacagacacttaaaaaactagcatatgtaaaggtattcgttaatcctgtgaatggtagcttttgcacagaacttccaaaagcaaaacaaaaacaaaatctattgtagttatatacttcatttaacctaggtcacaagacccagggaatcttctaacctcacttttacagtaggtattactcttgtgacatttttttggttatcaacaactaaatataaattactttggaaaaagtaaggctgtcttgcaaaatgatcccagctctgattagcagccctctggagttcagaacttaagtatcagtgcaaatttctcaacctttctgggttagacaaagatccttttttgtgtgttcttttcaccacccctttggctcaccttgtatcagcaaacaaagtacttcttcagggaaacctgaaatttctaatgccttgaaaagcatattacaaaagtaatgctaccttttgggaaacaaactgccccgttaactccagatcattgcactggaatgtaatcaagaaagttagtcatgttttatgtaccatgttttcacacgtgtctcttctcttcgacttcctgaaagcgaaagctttacctcctgcaaatgtcagcacatgtagtaggacaccagtatcctaggacagagagccataagtagccctttggaggactgatggtgtcaaccaaaggcatgtgattgattaatgattcccccttagaaagcaagtgttaccaaagttgtgttatcttgaaagcattacaggtaagggcatgttatggttatttatcattgtttaatgaatagtagaggtgtcaagggactatgtatacatgattagggtaagatagaatgtattatatatatatatatatacacacacacatatatatagctgaatctttggtgtattgaaataggcagcactctgaaagacagaagcttcgtccagccactcttcagcacattcctttactaagcagtttaaagccgtcctagtggagcaagccctaaagcagatttaatttttgccattttccaagaatgacggtggtggcttttagtcagaaaatggccttctgtgctttcaaaaaaaaaaacaaa

SEQ ID NO: 194774 - DNA, 773 bp, Homo sapiens
  Payload ID: 18480
  Gene Name: tripartite motif containing 2
  ENST ID: ENST00000482578
  CDS Start-End: 257-667
aaaagatgtcctgtaagatcaagaccgattggtgtgaatactgaagggggtcttccacttgttaatgacccagaaacattcctgccgacttccagccttctctcatttcctccatttttctcttcctctgttctgtgcatgaactggcacatcactacttagagcagaagatatgctgggcttctgatgatggctgcactgcatgcagcagcgtgcagggtcaaagacagccggccccccatgtcagtggtctaggatggccagtgaaggcaccaacatcccaagtcctgtggtgcgccagattgacaagcagtttctgatttgcagtatatgcctggaacggtacaagaatcccaaggttctcccctgtctgcacactttctgcgagaggtgcctgcagaactacattcctgcccacagtttaaccctctcctgcccagtgtgccgccagacctccatcctgcccgagaaaggggtggccgcgctccagaacaatttcttcatcacaaacctgatggacgtgctgcagcgaactccaggcagcaacgctgaggagtcttccatcctggagacagtcactgctgtggctgcgggaaagcctctctcttgcccaaaccacgatgggaatgtaagtggctgggatggcagatactgcccgggagcatgactactgtggccttggggaggctttgggtacatcagagattacagattgaaacagaactccatgtggaaaaatcagtaattaaaaaagatttttaccagccctcaga

SEQ ID NO: 194775 - DNA, 656 bp, Homo sapiens
  Payload ID: 18480
  Gene Name: tripartite motif containing 2
  ENST ID: ENST00000632856
  CDS Start-End: 147-557
ctggctgggcgcgcagcgaggcccaggcccgaggggtgaggcccaggccactccggagcgcgcgctgttcccgcgaagcgagtcgccgtctcgtacagcagcgtgcagggtcaaagacagccggccccccatgtcagtggtctaggatggccagtgaaggcaccaacatcccaagtcctgtggtgcgccagattgacaagcagtttctgatttgcagtatatgcctggaacggtacaagaatcccaaggttctcccctgtctgcacactttctgcgagaggtgcctgcagaactacattcctgcccacagtttaaccctctcctgcccagtgtgccgccagacctccatcctgcccgagaaaggggtggccgcgctccagaacaatttcttcatcacaaacctgatggacgtgctgcagcgaactccaggcagcaacgctgaggagtcttccatcctggagacagtcactgctgtggctgcgggaaagcctctctcttgcccaaaccacgatgggaatgtaagtggctgggatggcagatactgcccgggagcatgactactgtggccttggggaggctttgggtacatcagagattacagattgaaacagaactccatgtggaaaaatcagtaattaaaaaagatttttaccagc

SEQ ID NO: 194776 - DNA, 2202 bp, Homo sapiens
  Payload ID: 18480
  Gene Name: tripartite motif containing 2
  ENST ID: ENST00000494872
  CDS Start-End: 167-1747
agcttgatgactataatgggcccagttgtctgcgggctgcggggagctaagtccccagattggaggaggctggctctggtcttcgatgcacaggagtggccgttatggaacgcagcagcagcgtgcagggtcaaagacagccggccccccatgtcagtggtctaggatggccagtgaaggcaccaacatcccaagtcctgtggtgcgccagattgacaagcagtttctgatttgcagtatatgcctggaacggtacaagaatcccaaggttctcccctgtctgcacactttctgcgagaggtgcctgcagaactacattcctgcccacagtttaaccctctcctgcccagtgtgccgccagacctccatcctgcccgagaaaggggtggccgcgctccagaacaatttcttcatcacaaacctgatggacgtgctgcagcgaactccaggcagcaacgctgaggagtcttccatcctggagacagtcactgctgtggctgcgggaaagcctctctcttgcccaaaccacgatgggaatgtgatggaattttactgccagtcctgtgagactgccatgtgtcgggagtgcacggagggggagcacgcagagcaccccacagttccactcaaggatgtggtggaacagcacaaggcctcgctccaggtccagctggatgctgtcaacaaaaggctcccagaaatagattctgctcttcagttcatctctgaaatcattcatcagttaaccaaccaaaaggccagcatcgtggatgacattcattccacctttgatgagctccagaagactttaaatgtgcgcaagagtgtgctgcttatggaattggaggtcaactatggcctcaaacacaaagtcctccagtcgcagctggatactctgctccaggggcaggagagcattaagagctgcagcaacttcacagcgcaggccctcaaccatggcacggagaccgaggtcctactggtgaagaagcagatgagcgagaagctgaacgagctggccgaccaggacttccccttgcacccgcgggagaacgaccagctggatttcatcgtggaaaccgaggggctgaagaagtccatccacaacctcgggacgatcttaaccaccaacgccgttgcctcagagacagtggccacgggcgaggggctgcggcagaccatcatcgggcagcccatgtccgtcaccatcaccaccaaggacaaagacggtgagctgtgcaaaaccggcaacgcctacctcaccgccgaactgagcacccccgacgggagcgtggcagacggggagatcctggacaacaagaacggcacctatgagtttttgtacactgtccagaaggaaggggactttaccctgtctctgagactctatgaccagcacatccgaggcagcccgtttaagctgaaagtgatccgatccgctgatgtgtctcccaccacagaaggcgtgaagaggcgcgttaagtccccggggagcggccacgtcaagcagaaagctgtgaaaagacccgcaagcatgtacagcactggaaaacgaaaagagaatcccatcgaagacgatttgatctttcgagtggatggagtcttgcaggctgaagtacagtggcatgatctcagcccactgcaaccactgcctcctgggttcaaacaattctcctgcctcggcctcctgagtagctgggattacaggcatgcgccaccatgctcagctaattttttgtatttttagtagtagggatggggtttcattatgttggccaggctggtcttaaattcctgacctcaagtgatccacccaccttggcctcccaaagtgctgggattacaggtgtaagccattgtgcccggccagcattaatttcatattaagttggagtgggtggtgagaggaaatctgcatttattgatcccctatttcagtctaagggttcaccttatgtaatcttcctggaggggtaggtggaagtgaccaggaagaatatgggtgagaagctgttgaattaaaaattcattttgtgcttcataggctagacttgcatctggaaaaacaaaatgatttaattatggaattatagaataattgttaaattgattataattactttaaaaattcttgttattcattctactagctaatatgtaaccatcaaatgaaatcttttacattaaagtagatagaaaaat

SEQ ID NO: 194777 - DNA, 570 bp, Homo sapiens
  Payload ID: 18480
  Gene Name: tripartite motif containing 2
  ENST ID: ENST00000502281
  CDS Start-End: 437-570
cttttcaacagacgctcagtgagaaaaagatgtcctgtaagatcaagaccgattggtgtgaatactgaagggggtcttccacttgttaatgacccagaaacattcctgccgacttccagccttctctcatttcctccatttttctcttcctctgttctgtgcatgaactggcacatcactacttagagcagaagatatgctgggcttctgatgatggctgcactgcatggtagggaattttaaccagtctctttgcatggtgcttcccaacttgaagtgttagcagaaacgtgcgttgttcttttggattgccgcgtagctgcagcgacagacttgggaggatttaattctttgcctcgttggttagtctgtttgtcttcagaaatggcagcgtgcagggtcaaagacagccggccccccatgtcagtggtctaggatggccagtgaaggcaccaacatcccaagtcctgtggtgcgccagattgacaagcagtttctgatttgcagtatatgcctggaacggtacaagaatcccaaggttctcccctgtctgcacactttctgcgagag

SEQ ID NO: 194778 - DNA, 580 bp, Homo sapiens
  Payload ID: 18480
  Gene Name: tripartite motif containing 2
  ENST ID: ENST00000460908
  CDS Start-End: 1-343
aaaaattggatcaggaaagctgatgggacccaaaggagtttctgtggaccgcaatgggcacattattgttgtggacaacaaggcgtgctgcgtgtttatcttccagccaaacgggaaaatagtcaccaggtttggtagccgaggaaatggggacaggcagtttgcaggtccccattttgcagctgtaaatagcaataatgagattattattacagatttccataatcattctgtcaaggtactacaagcacatgagttgttgttaacttttaactgcttttatggagaaattggtctgcgagaaaataatgcaatacttacatatggcaccaaagggagttaaccagcagagtagactttgttctgctcaaagatgccggttttaacttggacttacagaccttggaaagtcaggaaattgaataaaatgtggtggcaataagttgcttaatttgaaactggtgcaaatgaagaggacttgaaaattaaattttaaaaagcaattcgttgaacttagaggcagaactttctgaagcttaatgttttgtggctagtcaataaattaaaatcactttttcaa

SEQ ID NO: 194779 - DNA, 1924 bp, Homo sapiens
  Payload ID: 18481
  Gene Name: tripartite motif containing 21
  Uniprot ID: P19474
  ENST ID: ENST00000254436
  CDS Start-End: 114-1541
gcttctgagcggaaactgaaagtgaaatagggagctggctaccagcgttgagtcccctgtaaagccaaaccccctaaaggtctccacactgctgtttaacggcacacttgacaatggcttcagcagcacgcttgacaatgatgtgggaggaggtcacatgccctatctgcctggaccccttcgtggagcctgtgagcatcgagtgtggccacagcttctgccaggaatgcatctctcaggttgggaaaggtgggggcagcgtctgtcctgtgtgccggcagcgctttctgctcaagaatctccggcccaatcgacagctagccaacatggtgaacaaccttaaagaaatcagccaggaggccagagagggcacacagggggaacggtgtgcagtgcatggagagagacttcacctgttctgtgagaaagatgggaaggccctttgctgggtatgtgcccagtctcggaaacaccgtgaccacgccatggtccctcttgaggaggctgcacaggagtaccaggagaagctccaggtggcattaggggaactgagaagaaagcaggagttggctgagaagttggaagtggaaattgcaataaagagagcagactggaagaaaacagtggaaacacagaaatctaggattcacgcagagtttgtgcagcaaaaaaacttcctggttgaagaagaacagaggcagctgcaggagctggagaaggatgagagggagcagctgagaatcctgggggagaaagaggccaagctggcccagcagagccaggccctacaggagctcatctcagagctagatcgaaggtgccacagctcagcactggaactgctgcaggaggtgataattgtcctggaaaggagtgagtcctggaacctgaaggacctggatattacctctccagaactcaggagtgtgtgccatgtgccagggctgaagaagatgctgaggacatgtgcagtccacatcactctggatccagacacagccaatccgtggctgatactttcagaagatcggagacaagtgaggcttggagacacccagcagagcatacctggaaatgaagagagatttgatagttatcctatggtcctgggtgcccagcactttcactctggaaaacattactgggaggtagatgtgacaggaaaggaggcctgggacctgggtgtctgcagagactctgtgcgcaggaaggggcactttttgcttagttccaagagtggcttctggacaatttggttgtggaacaaacaaaaatatgaggctggcacctacccccagactcccctccaccttcaggtgcctccatgccaagttgggattttcctggactatgaggctggcatggtctccttctacaacatcactgaccatggctccctcatctactccttctctgaatgtgcctttacaggacctctgcggcccttcttcagtcctggtttcaatgatggaggaaaaaacacagcccctctaaccctctgtccactgaatattggatcacaaggatccactgactattgatggctttctctggacactgccactctccccattggcaccgcttctcagccacaaaccctgcctcttttccccatgaactctgaaccacctttgtctctgcagaggcatccggatcccagcaagcgagctttagcagggaagtcacttcaccatcaacattcctgccccagatggctttgtgattccctccagtgaagcagcctccttatatttggcccaaactcatcttgatcaaccaaaaacatgtttctgccttctttatgggacttaagttttttttttctcctctccatctctaggatgtcgtctttggtgagatctctattatatcttgtatggtttgcaaaagggcttcctaaaaataaaaaataaaatttaaaaaa

SEQ ID NO: 194780 - DNA, 706 bp, Homo sapiens
  Payload ID: 18481
  Gene Name: tripartite motif containing 21
  ENST ID: ENST00000533692
  CDS Start-End: 1-271
agggctgaagaagatgctgaggacatgtgcagtccacatcactctggatccagacacagccaatccgtggctgatactttcagaagatcggagacaagtgaggcttggagacacccagcagagcatacctggaaatgaagagagatttgatagttatcctatggtcctgggtgcccagcactttcactctggaaaacattactgggaggacctctgcggcccttcttcagtcctggtttcaatgatggaggaaaaaacacagcccctctaaccctctgtccactgaatattggatcacaaggatccactgactattgatggctttctctggacactgccactctccccattggcaccgcttctcagccacaaaccctgcctcttttccccatgaactctgaaccacctttgtctctgcagaggcatccggatcccagcaagcgagctttagcagggaagtcacttcaccatcaacattcctgccccagatggctttgtgattccctccagtgaagcagcctccttatatttggcccaaactcatcttgatcaaccaaaaacatgtttctgccttctttatgggacttaagttttttttttctcctctccatctctaggatgtcgtctttggtgagatctctattatatcttgtatggtttgcaaaagggcttcctaaaaataaaaaataaaatttaaaaaactgtg

SEQ ID NO: 194781 - DNA, 2989 bp, Homo sapiens
  Payload ID: 18482
  Gene Name: tripartite motif containing 22
  Uniprot ID: Q8IYM9
  ENST ID: ENST00000379965
  CDS Start-End: 278-1774
cagggtttattgttatgtaagttcttgttcagcttcctttgttttctttcacttctgagaatttaactttcgtttctcactcagctcctgtggggaaactcatttgtggagaccagccctctggcttggtgagtgaatctggtttacaccggctcctgccctgccttcactcttctcccctgattcaagactcctctgctttggactgaagcactgcaggagtttgtgaccaagaacttcaagagtcaagacagaaggaagccaagggagcagtgcaatggatttctcagtaaaggtagacatagagaaggaggtgacctgccccatctgcctggagctcctgacagaacctctgagcctagattgtggccacagcttctgccaagcctgcatcactgcaaagatcaaggagtcagtgatcatctcaagaggggaaagcagctgtcctgtgtgtcagaccagattccagcctgggaacctccgacctaatcggcatctggccaacatagttgagagagtcaaagaggtcaagatgagcccacaggaggggcagaagagagatgtctgtgagcaccatggaaaaaaactccagatcttctgtaaggaggatggaaaagtcatttgctgggtttgtgaactgtctcaggaacaccaaggtcaccaaacattccgcataaacgaggtggtcaaggaatgtcaggaaaagctgcaggtagccctgcagaggctgataaaggaggatcaagaggctgagaagctggaagatgacatcagacaagagagaaccgcctggaagaattatatccagatcgagagacagaagattctgaaagggttcaatgaaatgagagtcatcttggacaatgaggagcagagagagctgcaaaagctggaggaaggtgaggtgaatgtgctggataacctggcagcagctacagaccagctggtccagcagaggcaggatgccagcacgctcatctcagatctccagcggaggttgaggggatcgtcagtagagatgctgcaggatgtgattgacgtcatgaaaaggagtgaaagctggacattgaagaagccaaaatctgtttccaagaaactaaagagtgtattccgagtaccagatctgagtgggatgctgcaagttcttaaagagctgacagatgtccagtactactgggtggacgtgatgctgaatccaggcagtgccacttcgaatgttgctatttctgtggatcagagacaagtgaaaactgtacgcacctgcacatttaagaattcaaatccatgtgatttttctgcttttggtgtcttcggctgccaatatttctcttcggggaaatattactgggaagtagatgtgtctggaaagattgcctggatcctgggcgtacacagtaaaataagtagtctgaataaaaggaagagctctgggtttgcttttgatccaagtgtaaattattcaaaagtttactccagatatagacctcaatatggctactgggttataggattacagaatacatgtgaatataatgcttttgaggactcctcctcttctgatcccaaggttttgactctctttatggctgtgcctccctgtcgtattggggttttcctagactatgaggcaggcattgtctcatttttcaatgtcacaaaccacggagcactcatctacaagttctctggatgtcgcttttctcgacctgcttatccgtatttcaatccttggaactgcctagtccccatgactgtgtgcccaccgagctcctgagtgttctcattcctttacccacttctgcatagtagcccttgtgctgagactcagattctgcacctgagttcatctctactgagaccatctcttcctttctttccccttcttttacttagaatgtctttgtattcatttgctagggcttccatagcaaagcatcatagattgctgatttaaactgtaattgtattgccgtactgtgggctggaaatcccaaatctagattccagcagagttggttctttctgaggtctgcaaggaagggctctgttccatgcctctctccttggcttgtagaaggcatcttgtccctatgactcttcacattgtctttatgtacatctctgtgcccaagttttccctttttattaagacaccagtcatactggctcagggcccaccgctaatgccttaatgaaatcattttaacattatattctctacaaagaccttatttccaaataagataatatttggaggtattgggaataaaaactccaacatataaatttgaggaaggcacgatttcactcataacaatcttaccctttcttgcaagagatgcttgtacattattttcctaataccttggtttcactagtagtaaacattattattttttttatatttgcaaaggaaacatatctaatccttcctatagaaagaacagtattgctgtaattccttttcttttcttcctcatttcctctgccccttaaaagattgaagaaagagaaacttgtcaactcatatccacgttatctagcaaagtacataagaatctatcactaagtaatgtatccttcagaatgtgttggtttaccagtgacaccccatattcatcacaaaattaaagcaagaagtccatagtaatttatttgctaatagtggatttttaatgctcagagtttctgaggtcaaattttatcttttcacttacaagctctatgatcttaaataatttacttaatgtattttggtgtattttcctcaaattaatattggtgttcaagactatatctaattcctctgatcactttgagaaacaaacttttattaaatgtaaggcacttttctatgaattttaaatataaaaataaatattgttctgattattactgaaaagatgtcagccatttcaatgtcttgggaaacaattttttgtttttgttctgttttctttttgcttcaataaaacaatagctggctcta

SEQ ID NO: 194782 - DNA, 655 bp, Homo sapiens
  Payload ID: 18482
  Gene Name: tripartite motif containing 22
  ENST ID: ENST00000414897
  CDS Start-End: 1-430
ggggcagaagagagatgtctgtgagcaccatggaaaaaaactccagatcttctgtaaggaggatggaaaagtcatttgctgggtttgtgaactgtctcaggaacaccaaggtcaccaaacattccgcataaacgaggtggtcaaggaatgtcaggaaaagctgcaggtagccctgcagaggctgataaaggaggatcaagaggctgagaagctggaagatgacatcagacaagagagaaccgcctggaagaattatatccagatcgagagacagaagattctgaaagggttcaatgaaatgagagtcatcttggacaatgaggagcagagagagctgcaaaagctggaggaaggatgccagcacgctcatctcagatctccagcggaggttgaggggatcgtcagtagagatgctgcaggatgtgattgacgtcatgaaaaggagtgaaagctggacattgaagaagccaaaatctgtttccaagaaactaaagagtgtattccgagtaccagatctgagtgggatgctgcaagttcttaaagagctgacagatgtccagtactactgggtggacgtgatgctgaatccaggcagtgccacttcgaatgttgctatttctgtggatcagagacaagtgaaaactgtacgcacctg

SEQ ID NO: 194783 - DNA, 1002 bp, Homo sapiens
  Payload ID: 18482
  Gene Name: tripartite motif containing 22
  ENST ID: ENST00000454828
  CDS Start-End: 87-1002
tcctctgctttggactgaagcactgcaggagtttgtgaccaagaacttcaagagtcaagacagaaggaagccaagggagcagtgcaatggatttctcagtaaaggtagacatagagaaggaggtgacctgccccatctgcctggagctcctgacagaacctctgagcctagattgtggccacagcttctgccaagcctgcatcactgcaaagatcaaggagtcagtgatcatctcaagaggggaaagcagctgtcctgtgtgtcagaccagattccagcctgggaacctccgacctaatcggcatctggccaacatagttgagagagtcaaagaggtcaagatgagcccacaggaggggcagaagagagatgtctgtgagcaccatggaaaaaaactccagatcttctgtaaggaggatggaaaagtcatttgctgggtttgtgaactgtctcaggaacaccaaggtcaccaaacattccgcataaacgaggtggtcaaggaatgtcagaattatatccagatcgagagacagaagattctgaaagggttcaatgaaatgagagtcatcttggacaatgaggagcagagagagctgcaaaagctggaggaaggtgaggtgaatgtgctggataacctggcagcagctacagaccagctggtccagcagaggcaggatgccagcacgctcatctcagatctccagcggaggttgaggggatcgtcagtagagatgctgcaggatgtgattgacgtcatgaaaaggagtgaaagctggacattgaagaagccaaaatctgtttccaagaaactaaagagtgtattccgagtaccagatctgagtgggatgctgcaagttcttaaagagctgacagatgtccagtactactgggtggacgtgatgctgaatccaggcagtgccacttcgaatgttgctatttctgtggatcagagacaagtgaaaactgtacgcacctgcacatttaagaattcaaatccatgtg

SEQ ID NO: 194784 - DNA, 897 bp, Homo sapiens
  Payload ID: 18482
  Gene Name: tripartite motif containing 22
  ENST ID: ENST00000414641
  CDS Start-End: 217-897
gacgggcagactgctgctcatctctgcagctccactttggtctcttgtctctgaaggtccagtcacagggaacttgttcttctgagtacccacagcttactcttcctttgtagcaggaccagccacagaaaaaactcctcagacaccgagcactgcaggagtttgtgaccaagaacttcaagagtcaagacagaaggaagccaagggagcagtgcaatggatttctcagtaaaggtagacatagagaaggaggtgacctgccccatctgcctggagctcctgacagaacctctgagcctagattgtggccacagcttctgccaagcctgcatcactgcaaagatcaaggagtcagtgatcatctcaagaggggaaagcagctgtcctgtgtgtcagaccagattccagcctgggaacctccgacctaatcggcatctggccaacatagttgagagagtcaaagaggtcaagatgagcccacaggaggggcagaagagagatgtctgtgagcaccatggaaaaaaactccagatcttctgtaaggaggatggaaaagtcatttgctgggtttgtgaactgtctcaggaacaccaaggtcaccaaacattccgcataaacgaggtggtcaaggaatgtcaggaaaagctgcaggtagccctgcagaggctgataaaggaggatcaagaggctgagaagctggaagatgacatcagacaagagagaaccgcctggaagaattatatccagatcgagagacagaagattctgaaagggttcaatgaaatgagagtcatcttggacaatgaggagcagagagagctgcaaaagctggaggaaggtgaggtgaatgtgctggataacctggcagcagctacagaccagctggtccagcagagg

SEQ ID NO: 194785 - DNA, 812 bp, Homo sapiens
  Payload ID: 18482
  Gene Name: tripartite motif containing 22
  ENST ID: ENST00000425490
  CDS Start-End: 202-812
attgttatctcctgtggggaaactcatttgtggagaccagccctctggcttggtgagtgaatctggtttacaccggctcctgccctgccttcactcttctcccctgattcaagactcctctgctttggactgaagcactgcaggagtttgtgaccaagaacttcaagagtcaagacagaaggaagccaagggagcagtgcaatggatttctcagtaaaggtagacatagagaaggaggtgacctgccccatctgcctggagctcctgacagaacctctgagcctagattgtggccacagcttctgccaagcctgcatcactgcaaagatcaaggagtcagtgatcatctcaagaggggaaagcagctgtcctgtgtgtcagaccagattccagcctgggaacctccgacctaatcggcatctggccaacatagttgagagagtcaaagaggtcaagatgagcccacaggaggggcagaagagagatgtctgtgagcaccatggaaaaaaactccagatcttctgtaaggaggatggaaaagtcatttgctgggtttgtgaactgtctcaggaacaccaaggtcaccaaacattccgcataaacgaggtggtcaaggaatgtcaggaaaagctgcaggtagccctgcagaggctgataaaggaggatcaagaggctgagaagctggaagatgacatcagacaagagagaaccgcctggaagaattatatccagatcgagagacagaagattctgaaagggttcaatgaaatgagagtcatcttggacaatgaggagcagagagagctgcaaaa

SEQ ID NO: 194786 - DNA, 1244 bp, Homo sapiens
  Payload ID: 18482
  Gene Name: tripartite motif containing 22
  ENST ID: ENST00000444844
  CDS Start-End: 1-116
tttccaagaaactaaagagtgtattccgagtaccagatctgagtgggatgctgcaagttcttaaagagctgacagatgtccagtactactgggtagaaaacttctgccacgcctaggatcccagactgtgagtctgtgttcataagcaaggttctctaagattcaactataaaaaaacttactaaggtatgtcttcattatatgacttctcatatggagaaattcagccataatcactaacttccttttaagctactcttttgcaacctcctcagaagtgcatacaaaatagaacatgaaagaaaactatccccaaatcctcaatataatttatttctggaaacctttacaagtccatgatatcaaaattttgaaaggctatgtaagacgttaatggacatctatatcaacttgaaatgatgtagctataaatttcatctcccataattcttcatttaaaaaatctagttattattagttaataaacctctgcatcaagtcaagtaacactgagataaatatgaagaaaacaagcacatccatttaatctatataatttctaaagagatgaagaaaggcttagaaaaatactacaattttatttctgtggtggttccaacctgtgataactgagaacaatacaaatagagatttgaaattcatgttgaatcatgaatcatatgtctgcatctctcaaaatctccaatagctccaaattccaggtctctgagttcatcctgctgggattcccgggcattcacagctggcaacactggctatctctgcccctggcactactgtatctctcagcacttgctgcaaacaccctcatcctcatcatcatctggcagaacccttctttacagcagcccatgtatattttccttggcatcctctgtatggtagacatgggtctggccactactatcatccctaagatcctggccatcttctggtttgatgccaaggttattagcctccctgagtgctttgctcagatttatgccattcacttctttgtgggcatggagtctggtatcctactctgcatggcttttgatagatatgtggctatttgtcaccctcttcgctatccatcaattgtcaccagttccttaatcttaaaagctaccctgttcatggtgctgagaaatggcttatttgtcactccagtgcctgtgcttgcagcacagcgtgattattgctccaagaatgaaattgaacactgcctgtgctctaacctt

SEQ ID NO: 194787 - DNA, 508 bp, Homo sapiens
  Payload ID: 18482
  Gene Name: tripartite motif containing 22
  ENST ID: ENST00000450670
  CDS Start-End: 1-192
gatgtgattgacgtcatgaaaaggagtgaaagctggacattgaagaagccaaaatctgtttccaagaaactaaagagtgtattccgagtaccagatctgagtgggatgctgcaagttcttaaagagctgacagatgtccagtactactgggtctaccatcagagaatactacaaacacctctatggaaataaactagaaaatctagaagaaatggataaattcctcgacacatacaccctcccaagactaaaccaggaagaagttgaatctctgaatagaccaataacaggagctgaaattgtggcaataatcaatagcttaccaaccaaaaagagtccaggaccagaaggattcacagctgaattctaccagaggtacaaggaggaactggtaccattccttctgaaactattccaatcaatagaaaaagagggaaacctccctaactcattttatgaggccagcatcatgctgataccaaagccgggcagagacacaaccaaaaaa

SEQ ID NO: 194788 - DNA, 1241 bp, Homo sapiens
  Payload ID: 18482
  Gene Name: tripartite motif containing 22
  ENST ID: ENST00000429063
  CDS Start-End: 1-113
tttccaagaaactaaagagtgtattccgagtaccagatctgagtgggatgctgcaagttcttaaagagctgacagatgtccagtactactgggaaaacttctgccacgcctaggatcccagactgtgagtctgtgttcataagcaaggttctctaagattcaactataaaaaaacttactaaggtatgtcttcattatatgacttctcatatggagaaattcagccataatcactaacttccttttaagctactcttttgcaacctcctcagaagtgcatacaaaatagaacatgaaagaaaactatccccaaatcctcaatataatttatttctggaaacctttacaagtccatgatatcaaaattttgaaaggctatgtaagacgttaatggacatctatatcaacttgaaatgatgtagctataaatttcatctcccataattcttcatttaaaaaatctagttattattagttaataaacctctgcatcaagtcaagtaacactgagataaatatgaagaaaacaagcacatccatttaatctatataatttctaaagagatgaagaaaggcttagaaaaatactacaattttatttctgtggtggttccaacctgtgataactgagaacaatacaaatagagatttgaaattcatgttgaatcatgaatcatatgtctgcatctctcaaaatctccaatagctccaaattccaggtctctgagttcatcctgctgggattcccgggcattcacagctggcaacactggctatctctgcccctggcactactgtatctctcagcacttgctgcaaacaccctcatcctcatcatcatctggcagaacccttctttacagcagcccatgtatattttccttggcatcctctgtatggtagacatgggtctggccactactatcatccctaagatcctggccatcttctggtttgatgccaaggttattagcctccctgagtgctttgctcagatttatgccattcacttctttgtgggcatggagtctggtatcctactctgcatggcttttgatagatatgtggctatttgtcaccctcttcgctatccatcaattgtcaccagttccttaatcttaaaagctaccctgttcatggtgctgagaaatggcttatttgtcactccagtgcctgtgcttgcagcacagcgtgattattgctccaagaatgaaattgaacactgcctgtgctctaacctt

SEQ ID NO: 194789 - DNA, 4186 bp, Homo sapiens
  Payload ID: 18483
  Gene Name: tripartite motif containing 23
  Uniprot ID: P36406
  ENST ID: ENST00000231524
  CDS Start-End: 373-2097
agatgcccgtaccccctcaccgccctcagttcacgccctggctggtttggattcgagaggaaaaatcattaaaggatctggagttttcaccccaaaactttaatcgttttgtcccttctttttttttcttgtctttcctccagcagctgcagactacataatgaaaaataacaaaagtgcccatgcgcgaggctgtgcaactaaccacccgacgattgcggggaggaggagtaagagtcggctaagcggcgcccagtgtcctactgcgcctgtgcgccggtggcgtgcgcagaggcctctgggtaggtggctcaaccccgcctctcagttgaggactctgaaggctgtttctgtggcgcttcccctgcgaggatggctaccctggttgtaaacaagctcggagcgggagtagacagtggccggcagggcagccgggggacagctgtagtgaaggtgctagagtgtggagtttgtgaagatgtcttttctttgcaaggagacaaagttccccgtcttttgctttgtggccataccgtctgtcatgactgtctcactcgcctacctcttcatggaagagcaatccgttgcccatttgatcgacaagtaacagacctaggtgattcaggtgtctggggattgaaaaaaaattttgctttattggagcttttggaacgactgcagaatgggcctattggtcagtatggagctgcagaagaatccattgggatatctggagagagcatcattcgttgtgatgaagatgaagctcaccttgcctctgtatattgcactgtgtgtgcaactcatttgtgctctgagtgttctcaagttactcattctacaaagacattagcaaagcacaggcgagttcctctagctgataaacctcatgagaaaactatgtgctctcagcaccaggtgcatgccattgagtttgtttgcttggaagaaggttgtcaaactagcccactcatgtgctgtgtctgcaaagaatatggaaaacaccagggtcacaagcattcagtattggaaccagaagctaatcagatccgagcatcaattttagatatggctcactgcatacggaccttcacagaggaaatctcagattattccagaaaattagttggaattgtgcagcacattgaaggaggagaacaaatcgtggaagatggaattggaatggctcacacagaacatgtaccagggactgcagagaatgcccggtcatgtattcgagcttatttttatgatctacatgaaactctgtgtcgtcaagaagaaatggctctaagtgttgttgatgctcatgttcgtgaaaaattgatttggctcaggcagcaacaagaagatatgactattttgttgtcagaggtttctgcagcctgcctccactgtgaaaagactttgcagcaggatgattgtagagttgtcttggcaaaacaggaaattacaaggttactggaaacattgcagaaacagcagcagcagtttacagaagttgcagatcacattcagttggatgccagcatccctgtcacttttacaaaggataatcgagttcacattggaccaaaaatggaaattcgggtcgttacgttaggattggatggtgctggaaaaactactatcttgtttaagttaaaacaggatgaattcatgcagcccattccaacaattggttttaacgtggaaactgtagaatataaaaatctaaaattcactatttgggatgtaggtggaaaacacaaattaagaccattgtggaaacattattacctcaatactcaagctgttgtgtttgttgtagatagcagtcatagagacagaattagtgaagcacacagcgaacttgcaaagttgttaacggaaaaagaactccgagatgctctgctcctgatttttgctaacaaacaggatgttgctggagcactgtcagtagaagaaatcactgaactactcagtctccataaattatgctgtggccgtagctggtatattcagggctgtgatgctcgaagtggtatgggactgtatgaagggttggactggctctcacggcaacttgtagctgctggagtattggatgttgcttgattttaaaggcagcagttgtttgaagttttgtggttaaaagtaactttgcacatagtatgttttaagaaattatacatctcaaaagatggtaatttaggatgcatatatatatatatatatataaaggaatcttggattgggaattcagtactttgctttaaaaaaattttgtggcagaattaaatttctaattgagcagattagattgaattaaatagaaacttattgaatatacattcttttaaaaagtatatttgttatttaagtttttcagataatatgtgaccaatatactgggaaagaggtagtcacagagaaagggtaagtgaaggtttattctttcagtgaaaaaagaatagccaattgagtgcctaatgagacctctgtgtgaagcaagtgaagtatagctgcttcttttaacctgccttttcactgaatgttggcagcatttagtagtagaaatgacagttgcttaatgaaatagaatccaaactacatatttggataataggattactttatgtttatgttcagagttaacagaacacctttaatgctaagaactataaggtacagaaaattaatactttatatagtgttttattaactttctcctacagcattttgtataaaacacaatgagggagtgaaatgttacccaattaggcttgtcaggttagtaataaactgaacagtaataaaactgtggaagtaattggatctgaatttatgaaagacccatttccaggactgaacctaggtcagagctctaaattggtccttctatttttcaacaaatttaaagtaatatttctttctaatataatattgcatcctttgtgggaatgactataggtaaaatgtagtaagtaacgcagaaccagggttggctttatttaaaagctagtgacctaaatagaaagcgaacttcaagagaagttgtaagtacagtggcaaatgcttattacttacttcaaactgtttcccaaaataagtgcatttattttgacaataaaacttaaggctgttcatgagaaggccttgaaaagttactctagaggaaaaatgtctaaagaaaaaaaaaattcaaaaagtttacattaattattcagtgttgtgagtaaataaaaatgtgtgctctttactgtttttcatttttaaagaatattattatggaagcacgatttatttaaataggtacattgagacttttttttttttaatgttctgatacattaggatgaagttaaatcttaaatcttattagttgaattgttgtaaggacagtgatgtctggtaacaagatgtgactttttggtagcactgttgtggttcattcttttcaaatctatttttgtttaaaaacaatacaagttttagaaaacaaagcattaaaaaaaaagcctatcagtattatgggcaatatgtaaataaataaatgtaatatttcatcctttatttttcaggtaaaaggtcatgctgttacaggtgtagtttgtgtgcataaataatacttccgaattaaattatttaatatttgactgatttcaataactgtgaaaaataaaaaaggtgttgtattgcttgtgagaacttgaactgtttactagttaattgaagaaaaagtgtaacactaaggtgaacttgcttcccttttcactaattttgctaaactttgtaatgcacattcttagcatataactgaacacagttgaaaaattgtgcctgattataatgtatgtataatggtaggtgtttgtgtgtgattcatttttaaagaaatatttttctcaagctcctattactatttgtggttgtattatttcactaatcattagttaagactgtgctagtcttccctgggaaactaagaagagagcttttttatatacagtatattagaattttcctagtagctgaatttctgtattaggtctaaatattactgtatgttatataaagcaggtatgtcaagtgtatagccgtagtctataattcaggaatgctttataaccatcagaagccattatttgcactacatatatgataagtatagacagcaataaaatgttaagatcatttttaagaa

SEQ ID NO: 194790 - DNA, 1829 bp, Homo sapiens
  Payload ID: 18483
  Gene Name: tripartite motif containing 23
  Uniprot ID: P36406
  ENST ID: ENST00000274327
  CDS Start-End: 26-1666
tttctgtggcgcttcccctgcgaggatggctaccctggttgtaaacaagctcggagcgggagtagacagtggccggcagggcagccgggggacagctgtagtgaaggtgctagagtgtggagtttgtgaagatgtcttttctttgcaaggagacaaagttccccgtcttttgctttgtggccataccgtctgtcatgactgtctcactcgcctacctcttcatggaagagcaatccgttgcccatttgatcgacaagtaacagacctaggtgattcaggtgtctggggattgaaaaaaaattttgctttattggagcttttggaacgactgcagaatgggcctattggtcagtatggagctgcagaagaatccattgggatatctggagagagcatcattcgttgtgatgaagatgaagctcaccttgcctctgtatattgcactgtgtgtgcaactcatttgtgctctgagtgttctcaagttactcattctacaaagacattagcaaagcacaggcgagttcctctagctgataaacctcatgagaaaactatgtgctctcagcaccaggtgcatgccattgagtttgtttgcttggaagaaggttgtcaaactagcccactcatgtgctgtgtctgcaaagaatatggaaaacaccagggtcacaagcattcagtattggaaccagaagctaatcagatccgagcatcaattttagatatggctcactgcatacggaccttcacagaggaaatctcagattattccagaaaattagttggaattgtgcagcacattgaaggaggagaacaaatcgtggaagatggaattggaatggctcacacagaacatgtaccagggactgcagagaatgcccggtcatgtattcgagcttatttttatgatctacatgaaactctgtgtcgtcaagaagaaatggctctaagtgttgttgatgctcatgttcgtgaaaaattgatttggctcaggcagcaacaagaagatatgactattttgttgtcagaggtttctgcagcctgcctccactgtgaaaagactttgcagcaggatgattgtagagttgtcttggcaaaacaggaaattacaaggttactggaaacattgcagaaacagcagcagcagtttacagaagttgcagatcacattcagttggatgccagcatccctgtcacttttacaaaggataatcgagttcacattggaccaaaaatggaaattcgggtcgttacgttaggattggatggtgctggaaaaactactatcttgtttaagttaaaacaggatgaattcatgcagcccattccaacaattggttttaacgtggaaactgtagaatataaaaatctaaaattcactatttgggatgtaggtggaaaacacaaattaagaccattgtggaaacattattacctcaatactcaagctgttgtgtttgttgtagatagcagtcatagagacagaattagtgaagcacacagcgaacttgcaaagttgttaacggaaaaagaactccgagatgctctgctcctgatttttgctaacaaacaggatgttgctggagcactgtcagtagaagaaatcactgaactactcagtctccataaattatgctgtggccgtagctgtttttcagataatatgtgaccaatatactgggaaagaggtagtcacagagaaagggtaaaaggtcatgctgttacaggtgtagtttgtgtgcataaataatacttccgaattaaattatttaatatttgactgatttcaataactgtgaaaaataaaaaaggtgttgtattgcttgtgagaa

SEQ ID NO: 194791 - DNA, 1855 bp, Homo sapiens
  Payload ID: 18483
  Gene Name: tripartite motif containing 23
  Uniprot ID: P36406
  ENST ID: ENST00000381018
  CDS Start-End: 23-1732
ctgtggcgcttcccctgcgaggatggctaccctggttgtaaacaagctcggagcgggagtagacagtggccggcagggcagccgggggacagctgtagtgaaggtgctagagtgtggagtttgtgaagatgtcttttctttgcaaggagacaaagttccccgtcttttgctttgtggccataccgtctgtcatgactgtctcactcgcctacctcttcatggaagagcaatccgttgcccatttgatcgacaagtaacagacctaggtgattcaggtgtctggggattgaaaaaaaattttgctttattggagcttttggaacgactgcagaatgggcctattggtcagtatggagctgcagaagaatccattgggatatctggagagagcatcattcgttgtgatgaagatgaagctcaccttgcctctgtatattgcactgtgtgtgcaactcatttgtgctctgagtgttctcaagttactcattctacaaagacattagcaaagcacaggcgagttcctctagctgataaacctcatgagaaaactatgtgctctcagcaccaggtgcatgccattgagtttgtttgcttggaagaaggttgtcaaactagcccactcatgtgctgtgtctgcaaagaatatggaaaacaccagggtcacaagcattcagtattggaaccagaagctaatcagatccgagcatcaattttagatatggctcactgcatacggaccttcacagaggaaatctcagattattccagaaaattagttggaattgtgcagcacattgaaggaggagaacaaatcgtggaagatggaattggaatggctcacacagaacatgtaccagggactgcagagaatgcccggtcatgtattcgagcttatttttatgatctacatgaaactctgtgtcgtcaagaagaaatggctctaagtgttgttgatgctcatgttcgtgaaaaattgatttggctcaggcagcaacaagaagatatgactattttgttgtcagaggtttctgcagcctgcctccactgtgaaaagactttgcagcaggatgattgtagagttgtcttggcaaaacaggaaattacaaggttactggaaacattgcagaaacagcagcagcagtttacagaagttgcagatcacattcagttggatgccagcatccctgtcacttttacaaaggataatcgagttcacattggaccaaaaatggaaattcgggtcgttacgttaggattggatggtgctggaaaaactactatcttgtttaagttaaaacaggatgaattcatgcagcccattccaacaattggttttaacgtggaaactgtagaatataaaaatctaaaattcactatttgggatgtaggtggaaaacacaaattaagaccattgtggaaacattattacctcaatactcaagctgttgtgtttgttgtagatagcagtcatagagacagaattagtgaagcacacagcgaacttgcaaagttgttaacggaaaaagaactccgagatgctctgctcctgatttttgctaacaaacaggatgttgctggagcactgtcagtagaagaaatcactgaactactcagtctccataaattatgctgtggccgtagctggtatattcagggctgtgatgctcgaagtgtttttcagataatatgtgaccaatatactgggaaagaggtagtcacagagaaagggtaaaaggtcatgctgttacaggtgtagtttgtgtgcataaataatacttccgaattaaattatttaatatttgactgatttcaataactgtgaaaaataaaaaaggtgttgtattgcttgtgagaa

SEQ ID NO: 194792 - DNA, 574 bp, Homo sapiens
  Payload ID: 18483
  Gene Name: tripartite motif containing 23
  ENST ID: ENST00000513794
  CDS Start-End: 470-574
gatgactacatcataatgggaaggataaggcgttcctcaaaatggatgccataagtaaagggaagctgaagcctgattaacttcgtcagtgccacaggaagaaacaagagacagaaggaaaaagcactttggatgcccgctgtaattcacagagatctccacggtaggagcgggacgtcagcttctgcggctaaaatctcgtgactgaagcagcacagatcagaaagaacgatttaccagcagctgcagactacataatgaaaaataacaaaagtgcccatgcgcgaggctgtgcaactaaccacccgacgattgcggggaggaggagtaagagtcggctaagcggcgcccagtgtcctactgcgcctgtgcgccggtggcgtgcgcagaggcctctgggtaggtggctcaaccccgcctctcagttgaggactctgaaggctgtttctgtggcgcttcccctgcgaggatggctaccctggttgtaaacaagctcggagcgggagtagacagtggccggcagggcagccgggggacagctgtagtgaaggtgctagagtgtggagtttgtgaa

SEQ ID NO: 194793 - DNA, 793 bp, Homo sapiens
  Payload ID: 18483
  Gene Name: tripartite motif containing 23
  ENST ID: ENST00000505205
  CDS Start-End: 87-467
gcgcagaggcctctgggtaggtggctcaaccccgcctctcagttgaggactctgaaggctgtttctgtggcgcttcccctgcgaggatggctaccctggttgtaaacaagctcggagcgggagtagacagtggccggcagggcagccgggggacagctgtagtgaaggtgctagagtgtggagtttgtgaagatgtcttttctttgcaaggagacaaagttccccgtcttttgctttgtggccataccgtctgtcatgactgtctcactcgcctacctcttcatggaagagcaatccgttgcccatttgatcgacaagtaacagacctaggtgattcaggtgtctggggattgaaaaaaaattttgctttattggagcttttggaacgactgcagaatgggcctattggtcagtatggagctgcagaagaatccattgggatatctggagagttctaccaagaataaagtgaaaagaggaagaagattatggaatagtaagaaagatatgtaagcaacagtagagaagaggatgcaaaagtagtcaacagtaaaactcaatgagagaaagaaaaactcgatagcatcattcgttgtgatgaagatgaagctcaccttgcctctgtatattgcactgtgtgtgcaactcatttgtgctctgagtgttctcaagttactcattctacaaagacattagcaaagcacaggcgagttcctctagctgataaacctcatgagaaaactatgtgctctcagcaccaggtgcatgccattgagtttgtttgcttggaaga

SEQ ID NO: 194794 - DNA, 556 bp, Homo sapiens
  Payload ID: 18483
  Gene Name: tripartite motif containing 23
  ENST ID: ENST00000506400
  CDS Start-End: 47-151
agttgaggactctgaaggctgtttctgtggcgcttcccctgcgaggatggctaccctggttgtaaacaagctcggagcgggagtagacagtggccggcagggcagccgggggacagctgtagtgaaggtgattcaggtgtctggggattgaaaaaaaattttgctttattggagcttttggaacgactgcagaatgggcctattggtcagtatggagctgcagaagaatccattgggatatctggagagagcatcattcgttgtgatgaagatgaagctcaccttgcctctgtatattgcactgtgtgtgcaactcatttgtgctctgagtgttctcaagttactcattctacaaagacattagcaaagcacagcattcagtattggaaccagaagctaatcagatccgagcatcaattttagatatggctcactgcatacggaccttcacagaggaaatctcagattattccagaaaattagttggaattgtgcagcacattgaaggaggagaacaaatcgtggaagatggaattggaatggctcacacagaaca

SEQ ID NO: 194795 - DNA, 8410 bp, Homo sapiens
  Payload ID: 18484
  Gene Name: tripartite motif containing 24
  Uniprot ID: O15164
  ENST ID: ENST00000343526
  CDS Start-End: 216-3368
gacagataccctccttccggccgcgccactcgggaggcggatcccgtgggcctgaggaggcttcccccgcccggtttgctttccctccctcgctggcgctgccgcgagtccaccgagcggcctctgaggagcagccgcaggaggaggaggaggtcgtcgggggcggcgggcggagaccgcgctctcgcttccccggcggcggcaagggcaggacaatggaggtggcggtggagaaggcggtggcggcggcggcagcggcctcggctgcggcctccggggggccctcggcggcgccgagcggggagaacgaggccgagagtcggcagggcccggactcggagcgcggcggcgaggcggcccggctcaacctgttggacacttgcgccgtgtgccaccagaacatccagagccgggcgcccaagctgctgccctgcctgcactctttctgccagcgctgcctgcccgcgccccagcgctacctcatgctgcccgcgcccatgctgggctcggccgagaccccgccacccgtccctgcccccggctcgccggtcagcggctcgtcgccgttcgccacccaagttggagtcattcgttgcccagtttgcagccaagaatgtgcagagagacacatcatagataacttttttgtgaaggacactactgaggttcccagcagtacagtagaaaagtcaaatcaggtatgtacaagctgtgaggacaacgcagaagccaatgggttttgtgtagagtgtgttgaatggctctgcaagacgtgtatcagagctcatcagagggtaaagttcacaaaagaccacactgtcagacagaaagaggaagtatctccagaggcagttggtgtcaccagccagcgaccagtgttttgtccttttcataaaaaggagcagctgaagctgtactgtgagacatgtgacaaactgacatgtcgagactgtcagttgttagaacataaagagcatagataccaatttatagaagaagcttttcagaatcagaaagtgatcatagatacactaatcaccaaactgatggaaaaaacaaaatacataaaattcacaggaaatcagatccaaaacagaattattgaagtaaatcaaaatcaaaagcaggtggaacaggatattaaagttgctatatttacactgatggtagaaataaataaaaaaggaaaagctctactgcatcagttagagagccttgcaaaggaccatcgcatgaaacttatgcaacaacaacaggaagtggctggactctctaaacaattggagcatgtcatgcatttttctaaatgggcagtttccagtggcagcagtacagcattactttatagcaaacgactgattacataccggttacggcacctccttcgtgcaaggtgtgatgcatccccagtgaccaacaacaccatccaatttcactgtgatcctagtttctgggctcaaaatatcatcaacttaggttctttagtaatcgaggataaagagagccagccacaaatgcctaagcagaatcctgtcgtggaacagaattcacagccaccaagtggtttatcatcaaaccagttatccaagttcccaacacagatcagcctagctcaattacggctccagcatatgcagcaacaggtaatggctcagaggcaacaggtgcaacggaggccagcacctgtgggtttaccaaaccctagaatgcaggggcccatccagcaaccttccatctctcatcagcaaccgcctccacgtttgataaactttcagaatcacagccccaaacccaatggaccagttcttcctcctcatcctcaacaactgagatatccaccaaaccagaacataccacgacaagcaataaagccaaaccccctacagatggctttcttggctcaacaagccataaaacagtggcagatcagcagtggacagggaaccccatcaactaccaacagcacatcctctactccttccagccccacgattactagtgcagcaggatatgatggaaaggcttttggttcacctatgatcgatttgagctcaccagtgggagggtcttataatcttccctctcttccggatattgactgttcaagtactattatgctggacaatattgtgaggaaagatactaatatagatcatggccagccaagaccaccctcaaacagaacggtccagtcaccaaattcatcagtgccatctccaggccttgcaggacctgttactatgactagtgtacaccccccaatacgttcacctagtgcctccagcgttggaagccgaggaagctctggctcttccagcaaaccagcaggagctgactctacacacaaagtcccagtggtcatgctggagccaattcgaataaaacaagaaaacagtggaccaccggaaaattatgatttccctgttgttatagtgaagcaagaatcagatgaagaatctaggcctcaaaatgccaattatccaagaagcatactcacctccctgctcttaaatagcagtcagagctctacttctgaggagactgtgctaagatcagatgcccctgatagtacaggagatcaacctggacttcaccaggacaattcctcaaatggaaagtctgaatggttggatccttcccagaagtcacctcttcatgttggagagacaaggaaagaggatgaccccaatgaggactggtgtgcagtttgtcaaaacggaggggaactcctctgctgtgaaaagtgccccaaagtattccatctttcttgtcatgtgcccacattgacaaattttccaagtggagagtggatttgcactttctgccgagacttatctaaaccagaagttgaatatgattgtgatgctcccagtcacaactcagaaaaaaagaaaactgaaggccttgttaagttaacacctatagataaaaggaagtgtgagcgcctacttttatttctttactgccatgaaatgagcctggcttttcaagaccctgttcctctaactgtgcctgattattacaaaataattaaaaatccaatggatttgtcaaccatcaagaaaagactacaagaagattattccatgtactcaaaacctgaagattttgtagctgattttagattgatctttcaaaactgtgctgaattcaatgagcctgattcagaagtagccaatgctggtataaaacttgaaaattattttgaagaacttctaaagaacctctatccagaaaaaaggtttcccaaaccagaattcaggaatgaatcagaagataataaatttagtgatgattcagatgatgactttgtacagccccggaagaaacgcctcaaaagcattgaagaacgccagttgcttaaataatatgcagcaccactagcttgtgctggtttttagatttttttgttttcaaaaaaacatttgtcagtaatttaacatcactacaaaaagaagagtttgtgactattctcatctctgttttggacgtttactagactttgatttccttaatagcccatttctgttaacctcttatcactaagaaagaaaggaaagaaggagatgaatagaagaaagaaaatggaaagaaggaaaaaaggaggatagaaaaaggatggaagaaagaagcattgaaaacaaagacattcttcccacttcttggatttttaaaccacagtctggagtgatagctactgtagaaaggaaatagactttgtatgaactctttaagttgaaaagtaaaaaatatatgtggtttggatgtgtgctttaattcagctttagaaattaataccactacccgtgaattatatggcctgacaatatgaattaggtgtactgtactgaagaacagtactccacaaacatgggtggtaacaagagttccatcccaggaggccaaacggtgcaacagaagggtaggttagatgctattaagaaggcacttaatagtacatcatgtaagatggcaactgtattaaagaaaaatccggaaaacaaatgtttgatttttgtttttgtttttatcttgtctgtagaggtattttggtatagcaggttttcaaggccattttttatacatttctagatctagattttcaacttcttccactgagggaagtatatacatttgggtttgctgtgtgtctatgtgaggtttaattgtacaggtgatccttttacaacaagcctcattgtttgcagtatagcttttagtggaactacccaaaatataaatacagcagcgtgcactgtatttgatgtgagggttcttcatcatataccctactgggcattaaatataagttcctctgaaagggactcgtttttgtggttttcatctgtctataatttggaatgaaaatgtgttgtaggattttgggagcaggcagctggggggaattaatagtgattttttttttttcctgaagcatctatctcatgtttttcttttgagagtcagaacatcaaacttaatctttgatctgacttctgattttattcttctgattgattgatagaggtacaaaagacttatcttctgaggacaagcatattcttaatgtgccagacctacccggttcagctgatatagatagatagatagatagaagaaaattgctgtgccatacattaatccagcatttgacacaatatctaaatggtttgccgaagttaatctgtatttataaaacattaactggagtaaatttttctccttaggatgatagaataaaaagagctcacttgaaagaaggctattatttgcattatatcacctgccataaatttaacatagaagacttggttttatctacatggctttacttcttaaagtggaaaatatcctgtggctaattcattgggttttcaggtactgctaaagataaaatacagggagaaaataacttgttagcaatagatccccattgtttatatatataggtcttgttcataatatgtcaattatgtattgttaaaaagtcctactcacttttcaaatatgtgttacatggtaatgtttgtcattgttgttttaaagttgcatttgacatttgttctccaaagagtgtttgaacagattttgataacagtgcatacaccttttgtctttttttgctccagcattttatttttagcacagcagctgtggagcttttgctgataattttattgttggtatcttagaatactgttcgtctgacagtttattcttccatacttgtctcccaagttaaaacagagcaaaacagataaattattttgagaatcatcacaaaagggagttagaacttgtgagactaaaactataatttcctaaatgtgactaatgaaccccaaactgtcactattacattcagtgccatatttatctttcaaaacagtatttgtttcaccctaaccatctttggctgaatgaaaggcagttgagaaccatcttttggtcatacataatataattatattaaaagtaaagatcggggctgggcgcagtggctcacacctgcaatcccaccagcactttgggaggccaaggtgggcggatcacaaagtcaagagttcgagatcagcctggccaacattgtgaaaccccgcctctacaaaaaatacaaaaattagccggacatggtggcgtgcaactgtaatcccaactactcaggaggctgagacaggagaatcacttgaacgcaggaggcagaagttgcagtgagccaagatctcaccattgcactccagcctgagtgacagagactcagtctcaaaaacaaaaagtaaaggtcttgggtttctctctgtaaatagcctttgtgtaatggtctttagattaatatcctttgactttattaataagtacctgtgtgcccaggtggatctcagctaagtcatccttaaattctgttcaaatagaaataaaccataaaatgagcctaactataacccacactcacttatcaagcattcccccaaaagttcagtgcgattcaggtaaccttgacctaaacttgtacactccggtgtacatctttgaccataaactctgggagatttccctctggatttgggatcaggagcccagtagggccccattgctgaatgtttatcacacttctggctagggcttatggatgagcagaccacgtaggagctaggatttactcagttccacctcactgacagcttttctaggtgccaagcaactgacttttcctgtgtaaggaagcccaagtacttgaccagtgatatatatggccatggcaaaagtataaatggatggatgtagaccatattcaacgcagaatacattttagatcggtatctggcattgtaatcattttgtcttttgaattaacatgccctgcttgtcttttctgaatggaagggtaggaaagtggaaggtactaaaaaggaaaatgtagttttagtttcttttctaagctaaagaactggctttactactgctatattttactaccacatagtagtgtagatgtagtataacttgcttaggaatgctttcaaaaaggttacctccatagtcaaaaaaagggggagtatacagctgattgttgcatttatgaaactgcatttcaatatgctatgctgttactgtgcttagacacttccttacgtttgagttccaaggagagagagtgagaagaggaactccttttgctgagctctggtccaaattaatgtgaatccccaaagtaaattgctgcatatgaacaacaggttttaggtttaaattgaagatacattcattttatatgtatttgttgtgaatgagagaaattgagtgatctgattggccattaaaattatggtgaatgggtcgggcgcagtggctcacgcctgtaatcccagcactttgggaggccgaggtgggtagatacctgaggtcaggagtttgagaccagcctgaccaacatggtgaaaccccatctctactaaaaataccaaaatcaccagggtgtggtggcccatgcctgtaatcctagctactcgggaggctgaggcaggagaatcggcttgaacccaggaggcagaggttgcagtgagctgagatcgcaccactgtagtccagcctgggtgtcagagcaagactctgtcacaaaaagaaaaattatggggaatggccgggcgcggtggctcacacctgtaatcccagcactttgggaggccgaggtgggtggatcacctgaagtcaggagctcaagaccagcctggccaacatggtgaaaccccacctcaacagaatatacaaaaaaattagctgggtgtggtggcgggtgcctgtaatctcagctactttgggatgctgaggcaggagaatagcttgaacccaggaggtggaggttgcagtgagtcgagattgcaccattgcactccagcctgggcaacaagagcaaaactctgtctcaaaaaaaaaaaaaaatggtgaccatgcgttcaaccatataatttcttactgaaattgagctcctccttttgaataaccatgtacatatttttaaaagtattttatagccctatgtaaattaatagttgatgtctttttataaatgtttattgcatattcatcttgaatgtgaatttactgttgtaattcacatactggtgtcatgtttctgagtgagaataatgctagtcagtcagatcacagatttttctccatgaaggttttacttattgagagggacatctgaggcagtagtcttcgtctttaatttttgggggcagattggtgctttggttttaataaaaactaactttgatggatttttactgtcaatattttaccacaaggattttttaatagaaaaattactgaatgttacttcagcagagttctatctactttgagtctccattactactactgttgttcccctagctgtaacattgatccatataggggcaagctactagtccataaatagctgtaataggaaaacagttttttaaaattctaacacgtgtatttcaccagccttaaaagatttaaaaaaaaatctgacaggaaggaaagcgggtggtaagtatcttggattattctgcctcataccagccactcccaaagtaggaggaccaaagatgccatgaagacttctagttgtctggaagttatttggggaaggggggaaagacacagagtggggacctttggaagtcattttaaaaatttagctatgttaattccacttgtaaagtttgaaaggttttgattcttgtaatttctgagaattactatgttttaaatttactattggatatttaacagatctttcatggggccaacctatttgcttccttaattttcaaattaagtcctaatttgagtcctaaaaaaatctttccttgttagttgcaagttaaacatttaataaaattattttcccacgttt

SEQ ID NO: 194796 - DNA, 3799 bp, Homo sapiens
  Payload ID: 18484
  Gene Name: tripartite motif containing 24
  Uniprot ID: O15164
  ENST ID: ENST00000415680
  CDS Start-End: 115-3165
ccgcgagtccaccgagcggcctctgaggagcagccgcaggaggaggaggaggtcgtcgggggcggcgggcggagaccgcgctctcgcttccccggcggcggcaagggcaggacaatggaggtggcggtggagaaggcggtggcggcggcggcagcggcctcggctgcggcctccggggggccctcggcggcgccgagcggggagaacgaggccgagagtcggcagggcccggactcggagcgcggcggcgaggcggcccggctcaacctgttggacacttgcgccgtgtgccaccagaacatccagagccgggcgcccaagctgctgccctgcctgcactctttctgccagcgctgcctgcccgcgccccagcgctacctcatgctgcccgcgcccatgctgggctcggccgagaccccgccacccgtccctgcccccggctcgccggtcagcggctcgtcgccgttcgccacccaagttggagtcattcgttgcccagtttgcagccaagaatgtgcagagagacacatcatagataacttttttgtgaaggacactactgaggttcccagcagtacagtagaaaagtcaaatcaggtatgtacaagctgtgaggacaacgcagaagccaatgggttttgtgtagagtgtgttgaatggctctgcaagacgtgtatcagagctcatcagagggtaaagttcacaaaagaccacactgtcagacagaaagaggaagtatctccagaggcagttggtgtcaccagccagcgaccagtgttttgtccttttcataaaaaggagcagctgaagctgtactgtgagacatgtgacaaactgacatgtcgagactgtcagttgttagaacataaagagcatagataccaatttatagaagaagcttttcagaatcagaaagtgatcatagatacactaatcaccaaactgatggaaaaaacaaaatacataaaattcacaggaaatcagatccaaaacagaattattgaagtaaatcaaaatcaaaagcaggtggaacaggatattaaagttgctatatttacactgatggtagaaataaataaaaaaggaaaagctctactgcatcagttagagagccttgcaaaggaccatcgcatgaaacttatgcaacaacaacaggaagtggctggactctctaaacaattggagcatgtcatgcatttttctaaatgggcagtttccagtggcagcagtacagcattactttatagcaaacgactgattacataccggttacggcacctccttcgtgcaaggtgtgatgcatccccagtgaccaacaacaccatccaatttcactgtgatcctagtttctgggctcaaaatatcatcaacttaggttctttagtaatcgaggataaagagagccagccacaaatgcctaagcagaatcctgtcgtggaacagaattcacagccaccaagtggtttatcatcaaaccagttatccaagttcccaacacagatcagcctagctcaattacggctccagcatatgcagcaacagcaaccgcctccacgtttgataaactttcagaatcacagccccaaacccaatggaccagttcttcctcctcatcctcaacaactgagatatccaccaaaccagaacataccacgacaagcaataaagccaaaccccctacagatggctttcttggctcaacaagccataaaacagtggcagatcagcagtggacagggaaccccatcaactaccaacagcacatcctctactccttccagccccacgattactagtgcagcaggatatgatggaaaggcttttggttcacctatgatcgatttgagctcaccagtgggagggtcttataatcttccctctcttccggatattgactgttcaagtactattatgctggacaatattgtgaggaaagatactaatatagatcatggccagccaagaccaccctcaaacagaacggtccagtcaccaaattcatcagtgccatctccaggccttgcaggacctgttactatgactagtgtacaccccccaatacgttcacctagtgcctccagcgttggaagccgaggaagctctggctcttccagcaaaccagcaggagctgactctacacacaaagtcccagtggtcatgctggagccaattcgaataaaacaagaaaacagtggaccaccggaaaattatgatttccctgttgttatagtgaagcaagaatcagatgaagaatctaggcctcaaaatgccaattatccaagaagcatactcacctccctgctcttaaatagcagtcagagctctacttctgaggagactgtgctaagatcagatgcccctgatagtacaggagatcaacctggacttcaccaggacaattcctcaaatggaaagtctgaatggttggatccttcccagaagtcacctcttcatgttggagagacaaggaaagaggatgaccccaatgaggactggtgtgcagtttgtcaaaacggaggggaactcctctgctgtgaaaagtgccccaaagtattccatctttcttgtcatgtgcccacattgacaaattttccaagtggagagtggatttgcactttctgccgagacttatctaaaccagaagttgaatatgattgtgatgctcccagtcacaactcagaaaaaaagaaaactgaaggccttgttaagttaacacctatagataaaaggaagtgtgagcgcctacttttatttctttactgccatgaaatgagcctggcttttcaagaccctgttcctctaactgtgcctgattattacaaaataattaaaaatccaatggatttgtcaaccatcaagaaaagactacaagaagattattccatgtactcaaaacctgaagattttgtagctgattttagattgatctttcaaaactgtgctgaattcaatgagcctgattcagaagtagccaatgctggtataaaacttgaaaattattttgaagaacttctaaagaacctctatccagaaaaaaggtttcccaaaccagaattcaggaatgaatcagaagataataaatttagtgatgattcagatgatgactttgtacagccccggaagaaacgcctcaaaagcattgaagaacgccagttgcttaaataatatgcagcaccactagcttgtgctggtttttagatttttttgttttcaaaaaaacatttgtcagtaatttaacatcactacaaaaagaagagtttgtgactattctcatctctgttttggacgtttactagactttgatttccttaatagcccatttctgttaacctcttatcactaagaaagaaaggaaagaaggagatgaatagaagaaagaaaatggaaagaaggaaaaaaggaggatagaaaaaggatggaagaaagaagcattgaaaacaaagacattcttcccacttcttggatttttaaaccacagtctggagtgatagctactgtagaaaggaaatagactttgtatgaactctttaagttgaaaagtaaaaaatatatgtggtttggatgtgtgctttaattcagctttagaaattaataccactacccgtgaattatatggcctgacaatatgaattaggtgtactgtactgaagaacagtactccacaaacatgggtggtaacaagagttccatcccaggaggccaaacggtgcaacagaagggtaggttagatgctattaagaaggcacttaatagtacatcatgtaagatggcaactgtattaaagaaaaatccggaaaac

SEQ ID NO: 194797 - DNA, 3039 bp, Homo sapiens
  Payload ID: 18484
  Gene Name: tripartite motif containing 24
  ENST ID: ENST00000620194
  CDS Start-End: 1-3039
atggaggtggcggtggagaaggcggtggcggcggcggcacggctcggctgccctccggggggccctcggggcagcggggagaacgaggccgagagtcggcagggcccggactcggagcgcggcggcgaggcggcccggctcaacctgttggacacttgcgccgtgtgccaccagaacatccagagccgggcgcccaagctgctgccctgcctgcactctttctgccagcgctgcctgcccgcgccccagcgctacctcatgctgcccgcgcccatgctgggctcggccgagaccccgccacccgtccctgccccggctcgccggtcagcgtcgtcgccgttcgccacccaagttggagtcattcgttgcccagtttgcagccaagaatgtgcagagagacacatcatagataacttttttgtgaaggacactactgaggttcccagcagtacagtagaaaagtcaaatcaggtatgtacaagctgtgaggacaacgcagaagccaatgggttttgtgtagagtgtgttgaatggctctgcaagacgtgtatcagagctcatcagagggtaaagttcacaaaagaccacactgtcagacagaaagaggaagtatctccagaggcagttggtgtcaccagccagcgaccagtgttttgtccttttcataaaaaggagcagctgaagctgtactgtgagacatgtgacaaactgacatgtcgagactgtcagttgttagaacataaagagcatagataccaatttatagaagaagcttttcagaatcagaaagtgatcatagatacactaatcaccaaactgatggaaaaaacaaaatacataaaattcacaggaaatcagatccaaaacagaattattgaagtaaatcaaaatcaaaagcaggtggaacaggatattaaagttgctatatttacactgatggtagaaataaataaaaaaggaaaagctctactgcatcagttagagagccttgcaaaggaccatcgcatgaaacttatgcaacaacaacaggaagtggctggactctctaaacaattggagcatgtcatgcatttttctaaatgggcagtttccagtggcagcagtacagcattactttatagcaaacgactgattacataccggttacggcacctccttcgtgcaaggtgtgatgcatccccagtgaccaacaacaccatccaatttcactgtgatcctagtttctgggctcaaaatatcatcaacttaggttctttagtaatcgaggataaagagagccagccacaaatgcctaagcagaatcctgtcgtggaacagaattcacagccaccaagtggtttatcatcaaaccagttatccaagttcccaacacagatcagcctagctcaattacggctccagcatatgcagcaacagcaaccgcctccacgtttgataaactttcagaatcacagccccaaacccaatggaccagttcttcctcctcatcctcaacaactgagatatccaccaaaccagaacataccacgacaagcaataaagccaaaccccctacagatggctttcttggctcaacaagccataaaacagtggcagatcagcagtggacagggaaccccatcaactaccaacagcacatcctctactccttccagccccacgattactagtgcagcaggatatgatggaaaggcttttggttcacctatgatcgatttgagctcaccagtgggagggtcttataatcttccctctcttccggatattgactgttcaagtactattatgctggacaatattgtgaggaaagatactaatatagatcatggccagccaagaccaccctcaaacagaacggtccagtcaccaaattcatcagtgccatctccaggccttgcaggacctgttactatgactagtgtacaccccccaatacgttcacctagtgcctccagcgttggaagccgaggaagctctggctcttccagcaaaccagcaggagctgactctacacacaaagtcccagtggtcatgctggagccaattcgaataaaacaagaaaacagtggaccaccggaaaattatgatttccctgttgttatagtgaagcaagaatcagatgaagaatctaggcctcaaaatgccaattatccaagaagcatactcacctccctgctcttaaatagcagtcagagctctacttctgaggagactgtgctaagatcagatgcccctgatagtacaggagatcaacctggacttcaccaggacaattcctcaaatggaaagtctgaatggttggatccttcccagaagtcacctcttcatgttggagagacaaggaaagaggatgaccccaatgaggactggtgtgcagtttgtcaaaacggaggggaactcctctgctgtgaaaagtgccccaaagtattccatctttcttgtcatgtgcccacattgacaaattttccaagtggagagtggatttgcactttctgccgagacttatctaaaccagaagttgaatatgattgtgatgctcccagtcacaactcagaaaaaaagaaaactgaaggccttgttaagttaacacctatagataaaaggaagtgtgagcgcctacttttatttctttactgccatgaaatgagcctggcttttcaagaccctgttcctctaactgtgcctgattattacaaaataattaaaaatccaatggatttgtcaaccatcaagaaaagactacaagaagattattccatgtactcaaaacctgaagattttgtagctgattttagattgatctttcaaaactgtgctgaattcaatgagcctgattcagaagtagccaatgctggtataaaacttgaaaattattttgaagaacttctaaagaacctctatccagaaaaaaggtttcccaaaccagaattcaggaatgaatcagaagataataaatttagtgatgattcagatgatgactttgtacagccccggaagaaacgcctcaaaagcattgaagaacgccagttgcttaaataa

SEQ ID NO: 194798 - DNA, 5734 bp, Homo sapiens
  Payload ID: 18485
  Gene Name: tripartite motif containing 25
  Uniprot ID: Q14258
  ENST ID: ENST00000316881
  CDS Start-End: 51-1943
cggcctcggagcgcgggtgcagcagttgtgtcccgacccctgggagcgccatggcagagctgtgccccctggccgaggagctgtcgtgctccatctgcctggagcccttcaaggagccggtcaccactccgtgcggccacaacttctgcgggtcgtgcctgaatgagacgtgggcagtccagggctcgccatacctgtgcccgcagtgccgcgccgtctaccaggcgcgaccgcagctgcacaagaacacggtgctgtgcaacgtggtggagcagttcctgcaggccgacctggcccgggagccacccgccgacgtctggacgccgcccgcccgcgcctctgcacccagcccgaatgcccaggtggcctgcgaccactgcctgaaggaggccgccgtgaagacgtgcttggtgtgcatggcctccttctgtcaggagcacctgcagccgcacttcgacagccccgccttccaggaccacccgctgcagccgcccgttcgcgacctgttgcgccgcaaatgttcccagcacaatcggctgcgggaatttttctgccccgagcacagcgagtgcatctgccacatctgcctggtggagcataagacctgctctcccgcgtccctgagccaggccagcgccgacctggaggccaccctgaggcacaaactaactgtcatgtacagtcagatcaacggggcgtcgagagcactggatgatgtgagaaacaggcagcaggatgtgcggatgactgcaaacagaaaggtggagcagctacaacaagaatacacggaaatgaaggctctcttggacgcctcagagaccacctcgacaaggaagataaaggaagaggagaagagggtcaacagcaagtttgacaccatttatcagattctcctcaagaagaagagtgagatccagaccttgaaggaggagattgaacagagcctgaccaagagggatgagttcgagtttctggagaaagcatcaaaactgcgaggaatctcaacaaagccagtctacatccccgaggtggaactgaaccacaagctgataaaaggcatccaccagagcaccatagacctcaaaaacgagctgaagcagtgcatcgggcggctccaggagcccacccccagttcaggtgaccctggagagcatgacccagcgtccacacacaaatccacacgccctgtgaagaaggtctccaaagaggaaaagaaatccaagaaacctccccctgtccctgccttacccagcaagcttcccacgtttggagccccggaacagttagtggatttaaaacaagctggcttggaggctgcagccaaagccaccagctcacatccgaactcaacatctctcaaggccaaggtgctggagaccttcctggccaagtccagacctgagctcctggagtattacattaaagtcatcctggactacaacaccgcccacaacaaagtggctctgtcagagtgctatacagtagcttctgtggctgagatgcctcagaactaccggccgcatccccagaggttcacatactgctctcaggtgctgggcctgcactgctacaagaaggggatccactactgggaggtggagctgcagaagaacaacttctgtggggtaggcatctgctacggaagcatgaaccggcagggcccagaaagcaggctcggccgcaacagcgcctcctggtgcgtggagtggttcaacaccaagatctctgcctggcacaataacgtggagaaaaccctgccctccaccaaggccacgcgggtgggcgtgcttctcaactgtgaccacggctttgtcatcttcttcgctgttgccgacaaggtccacctgatgtataagttcagggtggactttactgaggctttgtacccggctttctgggtattttctgctggtgccacactctccatctgctcccccaagtaggcaggctgtaggcacttgggctgactgcctgcagaagtcccaagaccctagtgaaaatacagcaggcagaactctccttggataattccccaagaggtcccaaggattgggagcatgggaggggagctggcgggagggtgggaggtgggatttagccaggaaaggggtgagagtgattgtgttgtgggcgaggaggcgtttccaccccctggtgcctatcagggcagggtgacctactccccattgttctggaaatctccaggctgctgggcagctgggcagagctctgggaagtgaagtcatgagtgcccgattcctcttagagaaaatccatagctactgtaggttctgtcttgggccacttggatctgaaggctgcccctttgctctctggggtagccttcagatcttggtgttttgaattcttactatagatgtttttaaagttccaaagtcattgagtttcaatgttacataaactccattacccgcatgttggggcttgatctcctggttattatctgtgcttgaggaaacacccacagcagtctctacccagaacagtttcctaaagaggcataccctcttcctccactggaaaatagtgcgttcccttcctaccctgcacacccatcgcccccacattgatggttttcaaacagcaaacttttcagctaaagcttcaaaccatgattggaatcagcctgtgttggatttgtgattcagggtcatggtgaccctgatccagtttgggtggaaatccttcctaagtatcataagaagcatcttggcagagatgctttggtggcagccatgagctttgctggaggccttgcttcccatagccttggctgtggggcaaggaactctgccaggcgagggggatgctgccctggatcaacagaagcctggtgggtttgctcgtgttagagtgtcctgccttcttactgacaactcttctcggtgatagcctctcttccctggattgtgacatatggaatgacagtgcaggtaccaccgaggctagcacagtcaagcctccagctaagctggatccctgaagcctgctatcatgcagacaggctatgcggctgcctcggaccatgctaggccacttgctggggtgtcaacctaccaccaaaggggtcttttagcaaacctcatggggaacaggaacattcctgttcatccctggccacaggctgcagacccagcactggcccttgcgtgagtcagagcctggggctggccctagccccttctactgacttcctcatttaagccaattatataagctcacattgatcagggagggagggaaagagctaaagagggtcacacaagtggctattttccctgcagtgtttctgtgtggtgaaaataacccagtccactaaggggcgggagtgaatggatggctggattttccccaagctccttatagcctaatgttgtcaggatgtgagtatgaggaatttagcctcttatagtgaaatgagtccaactctgggctttgcttagaggagagctcctgtcaggcttcctataatatgaaaagaagtcaccattggggaactagagaccccagaccttttcatatggatatttgagaatgtaatgcatctcaggcctcgtgctggaactctagggcactctaggcaggctcagaacacttgatattcctgacagctacacacctgacatgcaggtacatacctgatcggtgtcatctcctaacaaggattttcagttcctcgggagagcaataatctttgtaggaaagacatccctgcaataggtgatatgtggtccttagaagttttattcctttactacttggaagaaaagttctttggtgattcttctctgcttttgaagatgatcaaaagcatcttcattgattttctgaaacgaaagccttgtctgaaaccaattaatacttgggaaacagctgggcttggaggagtagaatgccagagataaatccatggctcctgctctggctctcttctgcagaaatgagggcaacagtgaggccacttccctggcaaatgtgcagctcaggatagggaagcataagaccctctgtttaaaagagagtcaagtaggtaaccaaagccaagctctgtgcaaggtgctttggagttgtaaattgaggagtgcatccttgctgtcttgaaccattctgtttgcaatggtgagaccttacataacctagccttgcagggccgccacacaaccctggagtcctagagttggaggaacctttgtatccatctgacttctcattttgcagaatatgatgagaaagtagaggatcgctctgttcaccactcttgctattccattagtggggagatgcctgctagcatgtgtgaggggaacactctgatacactgggaagtatcggaaattcccagaaacacaaacataaaataactctcctagacccaggtactggggactgtctcagtccgtgtggcatgataaataaaaggttaggatcaagtctttgtatttttcaagatgtggtagctgattattcctgttttaagtactctgaaattgatctgtgatcaataatactaatatgttatcttttaccgtattctgcctctcactattgattttaattagttaggagtatttgagctgttatttcttgagcttaatatttttttagagttaactctttaaggagataatcatggctgtagacaaggccagggctggctgacgtgccttagaaggtttgaatgcaataaagcggtgtttggcgttctcctgcattgtagtgcgggtacaaaatgctatttgttcgtcatactgttgtcagcagatgagccgcccactacagacggctactgcccagggacctgcccaggccccacccaagggctcccaagggttgagatttctgcagacctatagccagcacacttagtcctgccctatatagagttcctcttcgggaagcttttgataaggaattctcagaccgataggatgtctgtctgggctttgctgcgggacagtctaactgtgggggctaggggaaagcaggagagtatcgatcaaagagtaagccacacacggataatcagttactagggatggaggtgtgagggttcattatattattcattttactgttgtatatgtttgaaaatgtctataataaaaagctttaaaaaaaaaaaagaaacaaaaatagttcaggccagcaatgggccctccatgttcagtggattttatccttgtttcaattggggtaggagttccaggaggtgtggattggaggttgtctaaagaattgaactggcctttgtccctgcttcctgggagggagactttcagtccttgacatttccagggtaataggagtgtctttgttatttgtgaggccatgggatcacacctgagcttatgctaaaaggtgggatgactcagagctggggctggtcaccagacagactgaccatgtgattagaggtttgaggctttgagtcagcctgacctatggggcgggggactggaggctgagtttaatcatctggccagtgctttaatcagtacatcatgaaaccctaataaaaactctggacactaaagctcagcatagcttcctgggtggtgaagctgtggctatgccggcagggcagtgtgccctaattccacgaagagggggcatgggagcactgtgctcaagacccttccagacctttccctgtgtcttccttggcttgtggagctgatttgtatcctttataataaaactaatcataagtata

SEQ ID NO: 194799 - DNA, 2906 bp, Homo sapiens
  Payload ID: 18485
  Gene Name: tripartite motif containing 25
  Uniprot ID: Q14258
  ENST ID: ENST00000537230
  CDS Start-End: 45-1937
cggagcgcgggtgcagcagttgtgtcccgacccctgggagcgccatggcagagctgtgccccctggccgaggagctgtcgtgctccatctgcctggagcccttcaaggagccggtcaccactccgtgcggccacaacttctgcgggtcgtgcctgaatgagacgtgggcagtccagggctcgccatacctgtgcccgcagtgccgcgccgtctaccaggcgcgaccgcagctgcacaagaacacggtgctgtgcaacgtggtggagcagttcctgcaggccgacctggcccgggagccacccgccgacgtctggacgccgcccgcccgcgcctctgcacccagcccgaatgcccaggtggcctgcgaccactgcctgaaggaggccgccgtgaagacgtgcttggtgtgcatggcctccttctgtcaggagcacctgcagccgcacttcgacagccccgccttccaggaccacccgctgcagccgcccgttcgcgacctgttgcgccgcaaatgttcccagcacaatcggctgcgggaatttttctgccccgagcacagcgagtgcatctgccacatctgcctggtggagcataagacctgctctcccgcgtccctgagccaggccagcgccgacctggaggccaccctgaggcacaaactaactgtcatgtacagtcagatcaacggggcgtcgagagcactggatgatgtgagaaacaggcagcaggatgtgcggatgactgcaaacagaaaggtggagcagctacaacaagaatacacggaaatgaaggctctcttggacgcctcagagaccacctcgacaaggaagataaaggaagaggagaagagggtcaacagcaagtttgacaccatttatcagattctcctcaagaagaagagtgagatccagaccttgaaggaggagattgaacagagcctgaccaagagggatgagttcgagtttctggagaaagcatcaaaactgcgaggaatctcaacaaagccagtctacatccccgaggtggaactgaaccacaagctgataaaaggcatccaccagagcaccatagacctcaaaaacgagctgaagcagtgcatcgggcggctccaggagcccacccccagttcaggtgaccctggagagcatgacccagcgtccacacacaaatccacacgccctgtgaagaaggtctccaaagaggaaaagaaatccaagaaacctccccctgtccctgccttacccagcaagcttcccacgtttggagccccggaacagttagtggatttaaaacaagctggcttggaggctgcagccaaagccaccagctcacatccgaactcaacatctctcaaggccaaggtgctggagaccttcctggccaagtccagacctgagctcctggagtattacattaaagtcatcctggactacaacaccgcccacaacaaagtggctctgtcagagtgctatacagtagcttctgtggctgagatgcctcagaactaccggccgcatccccagaggttcacatactgctctcaggtgctgggcctgcactgctacaagaaggggatccactactgggaggtggagctgcagaagaacaacttctgtggggtaggcatctgctacggaagcatgaaccggcagggcccagaaagcaggctcggccgcaacagcgcctcctggtgcgtggagtggttcaacaccaagatctctgcctggcacaataacgtggagaaaaccctgccctccaccaaggccacgcgggtgggcgtgcttctcaactgtgaccacggctttgtcatcttcttcgctgttgccgacaaggtccacctgatgtataagttcagggtggactttactgaggctttgtacccggctttctgggtattttctgctggtgccacactctccatctgctcccccaagtaggcaggctgtaggcacttgggctgactgcctgcagaagtcccaagaccctagtgaaaatacagcaggcagaactctccttggataattccccaagaggtcccaaggattgggagcatgggaggggagctggcgggagggtgggaggtgggatttagccaggaaaggggtgagagtgattgtgttgtgggcgaggaggcgtttccaccccctggtgcctatcagggcagggtgacctactccccattgttctggaaatctccaggctgctgggcagctgggcagagctctgggaagtgaagtcatgagtgcccgattcctcttagagaaaatccatagccttcagatcttggtgttttgaattcttactatagatgtttttaaagttccaaagtcattgagtttcaatgttacataaactccattacccgcatgttggggcttgatctcctggttattatctgtgcttgaggaaacacccacagcagtctctacccagaacagtttcctaaagaggcataccctcttcctccactggaaaatagtgcgttcccttcctaccctgcacacccatcgcccccacattgatggttttcaaacagcaaacttttcagctaaagcttcaaaccatgattggaatcagcctgtgttggatttgtgattcagggtcatggtgaccctgatccagtttgggtggaaatccttcctaagtatcataagaagcatcttggcagagatgctttggtggcagccatgagctttgctggaggccttgcttcccatagccttggctgtggggcaaggaactctgccaggcgagggggatgctgccctggatcaacagaagcctggtgggtttgctcgtgttagagtgtcctgccttcttactgacaactcttctcggtgatagcctctcttccctggattgtgacatatggaatgacagtgcaggtaccaccgaggctagcacag

SEQ ID NO: 194800 - DNA, 1555 bp, Homo sapiens
  Payload ID: 18485
  Gene Name: tripartite motif containing 25
  ENST ID: ENST00000572021
  CDS Start-End: 1-132
gagtgcatctgccacatctgcctggtggagcataagacctgctctcccgcgtccctgagccaggccagcgccgacctggagcaccttcagggagaacaagacccgtcttcgtgttgtcagaggagacagtagcctgagcaaggccaccctgaggcacaaactaactgtcatgtacagtcagatcaacggggcgtcgagagcactggatgatgtgagaaacaggcagcaggatgtgcggatgactgcaaacagaaaggtggagcagctacaacaagaatacacggaaatgaaggctctcttggacgcctcagagaccacctcgacaaggaagataaaggaagaggagaagagggtcaacagcaagtttgacaccatttatcagattctcctcaagaagaagagtgagatccagaccttgaaggaggagattgaacagagcctgaccaagagggatgagttcgagtttctggagaaagcatcaaaactgcgaggaatctcaacaaagccagtctacatccccgaggtggaactgaaccacaagctgataaaaggcatccaccagagcaccatagacctcaaaaacgagctgaagcagtgcatcgggcggctccaggagcccacccccagttcaggtgaccctggagagcatgacccagcgtccacacacaaatccacacgccctgtgaagaaggtctccaaagaggaaaagaaatccaagaaacctccccctgtccctgccttacccagcaagcttcccacgtttggagccccggaacagttagtggatttaaaacaagctggcttggaggctgcagccaaagccaccagctcacatccgaactcaacatctctcaaggccaaggtgctggagaccttcctggccaagtccagacctgagctcctggagtattacattaaagtcatcctggactacaacaccgcccacaacaaagtggctctgtcagagtgctatacagtagcttctgtggctgagatgcctcagaactaccggccgcatccccagaggttcacatactgctctcaggtgctgggcctgcactgctacaagaaggggatccactactgggaggtggagctgcagaagaacaacttctgtggggtaggcatctgctacggaagcatgaaccggcagggcccagaaagcaggctcggccgcaacagcgcctcctggtgcgtggagtggttcaacaccaagatctctgcctggcacaataacgtggagaaaaccctgccctccaccaaggccacgcgggtgggcgtgcttctcaactgtgaccacggctttgtcatcttcttcgctgttgccgacaaggtccacctgatgtataagttcagggtggactttactgaggctttgtacccggctttctgggtattttctgctggtgccacactctccatctgctcccccaagtaggcaggctgtaggcacttgggctgactgcctgcagaagtcccaagaccctagtgaaaatacagcaggcagaactctccttggataattccccaagaggtcccaaggattgggagcatg

SEQ ID NO: 194801 - DNA, 3478 bp, Homo sapiens
  Payload ID: 18486
  Gene Name: tripartite motif containing 26
  Uniprot ID: Q12899
  ENST ID: ENST00000327357
  CDS Start-End: 438-2057
aacagaccgccgtgagagaggaggggtgccggccgggattcgcggcccggagctcgggaccggagtcaggaatggagagaagggtaatggttttacctcttattgtggaaacctgttgagatcacagagaatatactgacggcataaaagggcagaaccatagcagggtgcggttgcttcattccagcctcgcagtcacctctgtgccctgctggttgtcttcccagcgctgctgtagttgccttccatggatctataggagagcaagtcctccaggagctggtggtgtctgtcgattgactgagtgctggagctggcagccctgtgcaggctgccacctttgcccctttactgtgcttgctcctgactctatgtcgcgtcttcaaggagaagaagtcctcaccagtgaacggagacctctctgaactaaggataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtgatgtgccgggagtcccgggagcacaggccccacacggccgtcctcatggagaaggccgcccagccccacagggaaaaaatcctgaaccacctgagtaccctaaggagggacagagacaaaattcagggcttccaggcaaagggagaagctgatatcctggccgcgctgaagaagctccaggaccagaggcagtacattgtggctgagtttgagcagggtcatcagttcctgagggagcgggaggaacacctgctggaacagctggcgaagctggagcaggagctcacggagggcagggagaagttcaagagccggggcgtcggggagcttgcccggctggccctggtcatctccgaactggagggcaaggcgcagcagccagctgcagagctcatgcaggacacgagagacttcctaaacaggtatccacggaagaagttctgggttgggaaacccattgctcgagtggttaaaaaaaagaccggagaattctcagataaactcctctctctgcaacgaggcctgagggaattccaggggaagctgctgagagacttggaatataagacagtgagcgtcaccctggacccacagtcggccagtgggtacctgcagctgtcagaggactggaagtgcgtgacctacaccagcctgtacaagagtgcctacctgcacccccagcagtttgactgtgagcctggggtgctaggcagcaagggcttcacctggggcaaggtctactgggaagtggaagtggagagggagggctggtctgaggatgaagaagagggggatgaggaggaagagggagaagaggaggaggaggaagaggaggccggctatggggatggatatgacgactgggaaacggacgaagatgaggaatcgttgggcgatgaagaggaagaagaggaggaggaagaggaggaagttctggaaagctgcatggtgggggtggctagagactctgtgaagaggaagggagacctctccctgcggccagaggatggcgtgtgggcgctgcgcctctcctcctccggcatctgggccaacaccagccccgaggctgagcttttcccagcactgcggccccggagagtgggcatcgccctggattatgaagggggcaccgtgactttcaccaacgcagagtcacaggaactcatctacaccttcactgccaccttcacccggcgcctggtccccttcctgtggctcaagtggccaggaacacgcctcctgctaagaccctgagccctgacatctgcccccagccccaaccctcagatgcttcacttctttggaattccaggactctcaatggggggacgggatgcctggcctaagcacctggagcaggggaccccatatccactggtagccacctccccattgctgtggccccctgaaatctcactcagtgctgttgctccatctactgccctaatggggctcttttcccacctcctgctggtttcccgagggaacttctgaccctggagtccatgagggctcctttcctttttgaccacgaccttggccccagctctgcactctctggaataagggcccgatgcagcattttcttgcccagtgtggcaagacctcagaaaaaccagtcaattacgcctaagatcattttgctgtccttaaaccccccaggttccttcttgcacaaatccactctgctgcccaccttccctggcattttaaacagacctaccccaccccaactcagagttaagcatacatggcaatgctgaaaataaacaaaatccactgaggcttcccaggccatttaaagcctggagtaccagcgcatatcatctcatggggtccagagtggagtccaggcttctctgaaaccagggctgagcatatttccatagccaaggaggtgggactccctggagctatctgtggtcttagggaaggatccagacatacacggctttggggtacaagctgtgatcactgatcaataaattatctctagattggtccttgtgaggggagttttaagaatccagaacatcttgctcttgatcagcacatccaaaaacaccaagacaaacatccagtggagcagaacctctcctgcctcgggagttctgaccgggttccccagcagggtgttaagcctctgtctctggccctaccagcatccaggttccactttcctaggagagagtggagatgggaagacagggaaaggaaggcagcaggaggccacaagcccaccaggtcttcatgtcaagagagggagtaacatgtcttctcattgcccacggacccaacctctgtccaggtgcccctcatcatcacagtttaacacaagctcccctgctccagccaaattgatctcccagtcttgtccttacccattccaagtgctctgccagcccctgttcatccaagttttaagtcctccaccctgttctaagagactgttccaacggctctgggcctcagtggtcacttgaccaccattgtctcagagctgcccactttgtgtgtgtcacatgctgcctgagtcacatgtacatcttatttctgcctctagttttgtaagctcctggagggcggataacatcttatactactcttgtattctcatggcacctagtgcagtgctgggcacagagtaggtgctcaataaagacttgttgaatgaa

SEQ ID NO: 194802 - DNA, 3247 bp, Homo sapiens
  Payload ID: 18486
  Gene Name: tripartite motif containing 26
  Uniprot ID: Q12899
  ENST ID: ENST00000383607
  CDS Start-End: 207-1826
tcaggaatggagagaagggtaatggttttacctcttattgtggaaacctgttgagatcacagagaatatactgacggcataaaagggcagaaccatagcagggtgcgcgctgctgtagttgccttccatggatctataggagagcaagtcctccaggagaagaagtcctcaccagtgaacggagacctctctgaactaaggataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtgatgtgccgggagtcccgggagcacaggccccacacggccgtcctcatggagaaggccgcccagccccacagggaaaaaatcctgaaccacctgagtaccctaaggagggacagagacaaaattcagggcttccaggcaaagggagaagctgatatcctggccgcgctgaagaagctccaggaccagaggcagtacattgtggctgagtttgagcagggtcatcagttcctgagggagcgggaggaacacctgctggaacagctggcgaagctggagcaggagctcacggagggcagggagaagttcaagagccggggcgtcggggagcttgcccggctggccctggtcatctccgaactggagggcaaggcgcagcagccagctgcagagctcatgcaggacacgagagacttcctaaacaggtatccacggaagaagttctgggttgggaaacccattgctcgagtggttaaaaaaaagaccggagaattctcagataaactcctctctctgcaacgaggcctgagggaattccaggggaagctgctgagagacttggaatataagacagtgagcgtcaccctggacccacagtcggccagtgggtacctgcagctgtcagaggactggaagtgcgtgacctacaccagcctgtacaagagtgcctacctgcacccccagcagtttgactgtgagcctggggtgctaggcagcaagggcttcacctggggcaaggtctactgggaagtggaagtggagagggagggctggtctgaggatgaagaagagggggatgaggaggaagagggagaagaggaggaggaggaagaggaggccggctatggggatggatatgacgactgggaaacggacgaagatgaggaatcgttgggcgatgaagaggaagaagaggaggaggaagaggaggaagttctggaaagctgcatggtgggggtggctagagactctgtgaagaggaagggagacctctccctgcggccagaggatggcgtgtgggcgctgcgcctctcctcctccggcatctgggccaacaccagccccgaggctgagcttttcccagcactgcggccccggagagtgggcatcgccctggattatgaagggggcaccgtgactttcaccaacgcagagtcacaggaactcatctacaccttcactgccaccttcacccggcgcctggtccccttcctgtggctcaagtggccaggaacacgcctcctgctaagaccctgagccctgacatctgcccccagccccaaccctcagatgcttcacttctttggaattccaggactctcaatggggggacgggatgcctggcctaagcacctggagcaggggaccccatatccactggtagccacctccccattgctgtggccccctgaaatctcactcagtgctgttgctccatctactgccctaatggggctcttttcccacctcctgctggtttcccgagggaacttctgaccctggagtccatgagggctcctttcctttttgaccacgaccttggccccagctctgcactctctggaataagggcccgatgcagcattttcttgcccagtgtggcaagacctcagaaaaaccagtcaattacgcctaagatcattttgctgtccttaaaccccccaggttccttcttgcacaaatccactctgctgcccaccttccctggcattttaaacagacctaccccaccccaactcagagttaagcatacatggcaatgctgaaaataaacaaaatccactgaggcttcccaggccatttaaagcctggagtaccagcgcatatcatctcatggggtccagagtggagtccaggcttctctgaaaccagggctgagcatatttccatagccaaggaggtgggactccctggagctatctgtggtcttagggaaggatccagacatacacggctttggggtacaagctgtgatcactgatcaataaattatctctagattggtccttgtgaggggagttttaagaatccagaacatcttgctcttgatcagcacatccaaaaacaccaagacaaacatccagtggagcagaacctctcctgcctcgggagttctgaccgggttccccagcagggtgttaagcctctgtctctggccctaccagcatccaggttccactttcctaggagagagtggagatgggaagacagggaaaggaaggcagcaggaggccacaagcccaccaggtcttcatgtcaagagagggagtaacatgtcttctcattgcccacggacccaacctctgtccaggtgcccctcatcatcacagtttaacacaagctcccctgctccagccaaattgatctcccagtcttgtccttacccattccaagtgctctgccagcccctgttcatccaagttttaagtcctccaccctgttctaagagactgttccaacggctctgggcctcagtggtcacttgaccaccattgtctcagagctgcccactttgtgtgtgtcacatgctgcctgagtcacatgtacatcttatttctgcctctagttttgtaagctcctggagggcggataacatcttatactactcttgtattctcatggcacctagtgcagtgctgggcacagagtaggtgctcaataaagacttgttgaatgaa

SEQ ID NO: 194803 - DNA, 3318 bp, Homo sapiens
  Payload ID: 18486
  Gene Name: tripartite motif containing 26
  Uniprot ID: Q12899
  ENST ID: ENST00000396558
  CDS Start-End: 278-1897
gggagattacggggcggggacgagctgtcgcgctggttgctcgtgcaggagcgggacccggaacagaccgccgtgagagaggaggggtgccggccgggattcgcggcccggagctcgggaccggttgcttcattccagcctcgcagtcacctctgtgccctgctggttgtcttcccagcgctgctgtagttgccttccatggatctataggagagcaagtcctccaggagaagaagtcctcaccagtgaacggagacctctctgaactaaggataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtgatgtgccgggagtcccgggagcacaggccccacacggccgtcctcatggagaaggccgcccagccccacagggaaaaaatcctgaaccacctgagtaccctaaggagggacagagacaaaattcagggcttccaggcaaagggagaagctgatatcctggccgcgctgaagaagctccaggaccagaggcagtacattgtggctgagtttgagcagggtcatcagttcctgagggagcgggaggaacacctgctggaacagctggcgaagctggagcaggagctcacggagggcagggagaagttcaagagccggggcgtcggggagcttgcccggctggccctggtcatctccgaactggagggcaaggcgcagcagccagctgcagagctcatgcaggacacgagagacttcctaaacaggtatccacggaagaagttctgggttgggaaacccattgctcgagtggttaaaaaaaagaccggagaattctcagataaactcctctctctgcaacgaggcctgagggaattccaggggaagctgctgagagacttggaatataagacagtgagcgtcaccctggacccacagtcggccagtgggtacctgcagctgtcagaggactggaagtgcgtgacctacaccagcctgtacaagagtgcctacctgcacccccagcagtttgactgtgagcctggggtgctaggcagcaagggcttcacctggggcaaggtctactgggaagtggaagtggagagggagggctggtctgaggatgaagaagagggggatgaggaggaagagggagaagaggaggaggaggaagaggaggccggctatggggatggatatgacgactgggaaacggacgaagatgaggaatcgttgggcgatgaagaggaagaagaggaggaggaagaggaggaagttctggaaagctgcatggtgggggtggctagagactctgtgaagaggaagggagacctctccctgcggccagaggatggcgtgtgggcgctgcgcctctcctcctccggcatctgggccaacaccagccccgaggctgagcttttcccagcactgcggccccggagagtgggcatcgccctggattatgaagggggcaccgtgactttcaccaacgcagagtcacaggaactcatctacaccttcactgccaccttcacccggcgcctggtccccttcctgtggctcaagtggccaggaacacgcctcctgctaagaccctgagccctgacatctgcccccagccccaaccctcagatgcttcacttctttggaattccaggactctcaatggggggacgggatgcctggcctaagcacctggagcaggggaccccatatccactggtagccacctccccattgctgtggccccctgaaatctcactcagtgctgttgctccatctactgccctaatggggctcttttcccacctcctgctggtttcccgagggaacttctgaccctggagtccatgagggctcctttcctttttgaccacgaccttggccccagctctgcactctctggaataagggcccgatgcagcattttcttgcccagtgtggcaagacctcagaaaaaccagtcaattacgcctaagatcattttgctgtccttaaaccccccaggttccttcttgcacaaatccactctgctgcccaccttccctggcattttaaacagacctaccccaccccaactcagagttaagcatacatggcaatgctgaaaataaacaaaatccactgaggcttcccaggccatttaaagcctggagtaccagcgcatatcatctcatggggtccagagtggagtccaggcttctctgaaaccagggctgagcatatttccatagccaaggaggtgggactccctggagctatctgtggtcttagggaaggatccagacatacacggctttggggtacaagctgtgatcactgatcaataaattatctctagattggtccttgtgaggggagttttaagaatccagaacatcttgctcttgatcagcacatccaaaaacaccaagacaaacatccagtggagcagaacctctcctgcctcgggagttctgaccgggttccccagcagggtgttaagcctctgtctctggccctaccagcatccaggttccactttcctaggagagagtggagatgggaagacagggaaaggaaggcagcaggaggccacaagcccaccaggtcttcatgtcaagagagggagtaacatgtcttctcattgcccacggacccaacctctgtccaggtgcccctcatcatcacagtttaacacaagctcccctgctccagccaaattgatctcccagtcttgtccttacccattccaagtgctctgccagcccctgttcatccaagttttaagtcctccaccctgttctaagagactgttccaacggctctgggcctcagtggtcacttgaccaccattgtctcagagctgcccactttgtgtgtgtcacatgctgcctgagtcacatgtacatcttatttctgcctctagttttgtaagctcctggagggcggataacatcttatactactcttgtattctcatggcacctagtgcagtgctgggcacagagtaggtgctcaataaagacttgttgaatgaa

SEQ ID NO: 194804 - DNA, 603 bp, Homo sapiens
  Payload ID: 18486
  Gene Name: tripartite motif containing 26
  ENST ID: ENST00000418026
  CDS Start-End: 132-603
gtgcaggagcgggacccggaacagaccgccgtgagagaggaggggtgccggccgggattcgcggcccggagctcgggaccggagaagaagtcctcaccagtgaacggagacctctctgaactaaggataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtgatgtgccgggagtcccgggagcacaggccccacacggccgtcctcatggagaaggccgcccagccccacagggaaaaaatcctgaaccacctgagtaccctaagga

SEQ ID NO: 194805 - DNA, 582 bp, Homo sapiens
  Payload ID: 18486
  Gene Name: tripartite motif containing 26
  ENST ID: ENST00000431641
  CDS Start-End: 217-582
aacagaccgccgtgagagaggaggggcgccggccgggattcgcggcccggagctcgggaccggagtcaggaatggagagaagggtaatggtgttacctcttattgtggaaacctgttgagatcacagagaatatactgacggcataaaagggcagaaccatagcagggtgcgaagtcctcaccagtgaacggagacctctctgaactaaggataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtg

SEQ ID NO: 194806 - DNA, 3478 bp, Homo sapiens; identical to SEQ ID NO: 194801
  Payload ID: 18486
  Gene Name: tripartite motif containing 26
  Uniprot ID: Q12899
  ENST ID: ENST00000439094
  CDS Start-End: 438-2057

SEQ ID NO: 194807 - DNA, 1041 bp, Homo sapiens
  Payload ID: 18486
  Gene Name: tripartite motif containing 26
  ENST ID: ENST00000449136
  CDS Start-End: 297-1041
ggccgggattcgcggcccggagctcgggaccggagtcaggaatggagagaagggtaatggttttacctcttattgtggaaacctgttgagatcacagagaatatactgacggcataaaagggcagaaccatagcagggtgcggttgcttcattccagcctcgcagtcacctctgtgccctgctggttgtcttcccagcgctgctgtagttgccttccatggatctataggagagcaagtcctccaggagaagaagtcctcaccagtgaacggagacctctctgaactaaggataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtgatgtgccgggagtcccgggagcacaggccccacacggccgtcctcatggagaaggccgcccagccccacagggaaaaaatcctgaaccacctgagtaccctaaggagggacagagacaaaattcagggcttccaggcaaagggagaagctgatatcctggccgcgctgaagaagctccaggaccagaggcagtacattgtggctgagtttgagcagggtcatcagttcctgagggagcgggaggaacacctgctggaacagctggcgaagctggagcaggagctcacggagggcagggagaagttcaagagccggggcgtcggggagcttgcccggctggccctggtcatctccgaactggagggcaaggcgcagcagc

SEQ ID NO: 194808 - DNA, 3318 bp, Homo sapiens
  Payload ID: 18486
  Gene Name: tripartite motif containing 26
  Uniprot ID: Q12899
  ENST ID: ENST00000436219
  CDS Start-End: 278-1897
gggagattacggggcggggacgagctgtcgcgctggttgctcgtgcaggagcgggacccggaacagaccgccgtgagagaggaggggcgccggccgggattcgcggcccggagctcgggaccggttgcttcattccagcctcgcagtcacctctgtgccctgctggttgtcttcccagcgctgctgtagttgccttccatggatctataggagagcaagtcctccaggagaagaagtcctcaccagtgaacggagacctctctgaactaagaataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtgatgtgccgggagtcccgggagcacaggccccacacggccgtcctcatggagaaggccgcccagccccacagggaaaaaatcctgaaccacctgagtaccctaaggagagacagagacaaaattcagggcttccaggcaaagggagaagctgatatcctggccgcgctgaagaagctccaggaccagaggcagtacattgtggctgagtttgagcagggtcatcagttcctgagggagcgggaggaacacctgctggaacagctggcgaagctggagcaggagctcacggagggcagggagaagttcaagagccggggcgtcggggagcttgcccggctggccctggtcatctccgaactggagggcaaggcgcagcagccagctgcagagctcatgcaggacacgagagacttcctaaacaggtatccacggaagaagttctgggttgggaaacccattgctcgagtggttaaaaaaaagaccggagaattctcagataaactcctctctctgcaacgaggcctgagggaattccaggggaagctgctgagagacttggaatataagacagtgagcgtcaccctggacccacagtcggccagtgggtacctgcagctgtcagaggactggaagtgcgtgacctacaccagcctgtacaagagtgcctacctgcacccccagcagtttgactgtgagcctggggtgctgggcagcaagggcttcacctggggcaaggtctactgggaagtggaagtggagagggagggctggtctgaggatgaagaagagggggatgaggaggaagagggagaagaggaggaggaggaagaggaggccggctatggggatggatatgacgactgggaaacggacgaagatgaggaatcgttgggcgatgaagaggaagaagaggaggaggaagaggaggaagttctggaaagctgcatggtgggggtggctagagactctgtgaagaggaagggagacctctccctgcggccagaggatggcgtgtgggcgctgcgcctctcctcctccggcatctgggccaacaccagccccgaggctgagcttttcccagcactgcggccccggagagtgggcatcgccctggattatgaagggggcaccgtgactttcaccaacgcagagtcacaggaactcatctacaccttcactgccaccttcacccggcgcctggtccccttcctgtggctcaagtggccaggaacacgcctcctgctaagaccctgagccctgacatctgcccccagccccaaccctcagatgcttcacttctttggaattccaggactctcaatggggggacgggatgcctggcctaagcacctggagcaggggaccccatatccactggtagccacctccccattgctgtggccccctgaaatctcactcagtgctgttgctccatctactgccctaatggggctcttttcccacctcctgctggtttcccgagggaacttctgaccctggagtccatgagggctcctttcctttttgaccacgaccttggccctagctctgcactctctggaataagggcccgatgcagcattttcttgcccagtgtggcaagacctcagaaaaaccagtcaattacgcctaagatcattttgctgtccttaaaccccccaggttccttcttgcacaaatccactctgctgcccaccttccctggcattttaaacagacctaccccaccccaactcagagttaagcatacatggcaatgctgaaaataaacaaaatccactgaggcttcccaggccatttaaagcctggagtaccagcgcatatcatctcatggggtccagagtggagtccaggcttctctgaaaccagggctgagcatatttccatagccaaggaggtgggactccctggagctatctgtggtcttagggaaggatccagacatacacggctttggggtacaagctgtgatcactgatcaataaattatctctagattggtccttgtgaggggagttttaagaatccagaacatcttgctcttgatcagcacatccaaaaacaccaagacaaacatccagtggagcagaacctctcctgcctcgggagttctgaccgggttccccagcagggtgttaagcctctgtctctggccctaccagcatccaggttccactttcctaggagagagtggagatgggaagacagggaaaggaaggcagcaggaggccacaagcccaccaggtcttcatgtcaagagagggagtaacatgtcttctcattgcccacggacccaacctctgtccaggtgcccctcatcatcacagtttaacacaagctcccctgctccagccaaattgatctcccagtcttgtccttacccattccaagtgctctgccagcccctgttcatccaagttttaagtcctccaccctgttataagagactgttccaacggctctgggcctcagtggtcacttgaccaccattgtctcagagctgcccactttgtgtgtgtcacatgctgcctgagtcacatgtacatcttatttctgcctctagttttgtaagctcctggagggcggataacatcttatactactcttgtattctcatggcacctagtgcagtgctgggcacagagtaggtgctcaataaagacttgttgaatgaa

SEQ ID NO: 194809 - DNA, 1124 bp, Homo sapiens
  Payload ID: 18486
  Gene Name: tripartite motif containing 26
  ENST ID: ENST00000412755
  CDS Start-End: 380-1124
acggggcggggacgagctgtcgcgctggttgctcgtgcaggagcgggacccggaacagaccgccgtgagagaggaggggtgccggccgggattcgcggcccggagctcgggaccggagtcaggaatggagagaagggtaatggttttacctcttattgtggaaacctgttgagatcacagagaatatactgacggcataaaagggcagaaccatagcagggtgcggttgcttcattccagcctcgcagtcacctctgtgccctgctggttgtcttcccagcgctgctgtagttgccttccatggatctataggagagcaagtcctccaggagaagaagtcctcaccagtgaacggagacctctctgaactaaggataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtgatgtgccgggagtcccgggagcacaggccccacacggccgtcctcatggagaaggccgcccagccccacagggaaaaaatcctgaaccacctgagtaccctaaggagggacagagacaaaattcagggcttccaggcaaagggagaagctgatatcctggccgcgctgaagaagctccaggaccagaggcagtacattgtggctgagtttgagcagggtcatcagttcctgagggagcgggaggaacacctgctggaacagctggcgaagctggagcaggagctcacggagggcagggagaagttcaagagccggggcgtcggggagcttgcccggctggccctggtcatctccgaactggagggcaaggcgcagcagc

SEQ ID NO: 194810 - DNA, 603 bp, Homo sapiens
  Payload ID: 18486
  Gene Name: tripartite motif containing 26
  ENST ID: ENST00000433361
  CDS Start-End: 132-603
gtgcaggagcgggacccggaacagaccgccgtgagagaggaggggcgccggccgggattcgcggcccggagctcgggaccggagaagaagtcctcaccagtgaacggagacctctctgaactaaggataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtgatgtgccgggagtcccgggagcacaggccccacacggccgtcctcatggagaaggccgcccagccccacagggaaaaaatcctgaaccacctgagtaccctaagga

SEQ ID NO: 194811 - DNA, 1124 bp, Homo sapiens
  Payload ID: 18486
  Gene Name: tripartite motif containing 26
  ENST ID: ENST00000446540
  CDS Start-End: 380-1124
acggggcggggacgagctgtcgcgctggttgctcgtgcaggagcgggacccggaacagaccgccgtgagagaggaggggcgccggccgggattcgcggcccggagctcgggaccggagtcaggaatggagagaagggtaatggtgttacctcttattgtggaaacctgttgagatcacagagaatatactgacggcataaaagggcagaaccatagcagggtgcggttgcttcattccagcctcgcagtcacctctgtgccctgctggttgtcttcccagcgctgctgtagttgccttccatggatctataggagagcaagtcctccaggagaagaagtcctcaccagtgaacggagacctctctgaactaaggataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtgatgtgccgggagtcccgggagcacaggccccacacggccgtcctcatggagaaggccgcccagccccacagggaaaaaatcctgaaccacctgagtaccctaaggagagacagagacaaaattcagggcttccaggcaaagggagaagctgatatcctggccgcgctgaagaagctccaggaccagaggcagtacattgtggctgagtttgagcagggtcatcagttcctgagggagcgggaggaacacctgctggaacagctggcgaagctggagcaggagctcacggagggcagggagaagttcaagagccggggcgtcggggagcttgcccggctggccctggtcatctccgaactggagggcaaggcgcagcagc

SEQ ID NO: 194812 - DNA, 3318 bp, Homo sapiens; identical to SEQ ID NO: 194803
  Payload ID: 18486
  Gene Name: tripartite motif containing 26
  Uniprot ID: Q12899
  ENST ID: ENST00000453195
  CDS Start-End: 278-1897

SEQ ID NO: 194813 - DNA, 3478 bp, Homo sapiens
  Payload ID: 18486
  Gene Name: tripartite motif containing 26
  Uniprot ID: Q12899
  ENST ID: ENST00000455000
  CDS Start-End: 438-2057
aacagaccgccgtgagagaggaggggcgccggccgggattcgcggcccggagctcgggaccggagtcaggaatggagagaagggtaatggtgttacctcttattgtggaaacctgttgagatcacagagaatatactgacggcataaaagggcagaaccatagcagggtgcggttgcttcattccagcctcgcagtcacctctgtgccctgctggttgtcttcccagcgctgctgtagttgccttccatggatctataggagagcaagtcctccaggagctggtggtgtctgtcgattgactgagtgctggagctggcagccctgtgcaggctgccacctttgcccctttactgtgcttgctcctgactctatgtcgcgtctccaaggagaagaagtcctcaccagtgaacggagacctctctgaactaagaataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtgatgtgccgggagtcccgggagcacaggccccacacggccgtcctcatggagaaggccgcccagccccacagggaaaaaatcctgaaccacctgagtaccctaaggagagacagagacaaaattcagggcttccaggcaaagggagaagctgatatcctggccgcgctgaagaagctccaggaccagaggcagtacattgtggctgagtttgagcagggtcatcagttcctgagggagcgggaggaacacctgctggaacagctggcgaagctggagcaggagctcacggagggcagggagaagttcaagagccggggcgtcggggagcttgcccggctggccctggtcatctccgaactggagggcaaggcgcagcagccagctgcagagctcatgcaggacacgagagacttcctaaacaggtatccacggaagaagttctgggttgggaaacccattgctcgagtggttaaaaaaaagaccggagaattctcagataaactcctctctctgcaacgaggcctgagggaattccaggggaagctgctgagagacttggaatataagacagtgagcgtcaccctggacccacagtcggccagtgggtacctgcagctgtcagaggactggaagtgcgtgacctacaccagcctgtacaagagtgcctacctgcacccccagcagtttgactgtgagcctggggtgctgggcagcaagggcttcacctggggcaaggtctactgggaagtggaagtggagagggagggctggtctgaggatgaagaagagggggatgaggaggaagagggagaagaggaggaggaggaagaggaggccggctatggggatggatatgacgactgggaaacggacgaagatgaggaatcgttgggcgatgaagaggaagaagaggaggaggaagaggaggaagttctggaaagctgcatggtgggggtggctagagactctgtgaagaggaagggagacctctccctgcggccagaggatggcgtgtgggcgctgcgcctctcctcctccggcatctgggccaacaccagccccgaggctgagcttttcccagcactgcggccccggagagtgggcatcgccctggattatgaagggggcaccgtgactttcaccaacgcagagtcacaggaactcatctacaccttcactgccaccttcacccggcgcctggtccccttcctgtggctcaagtggccaggaacacgcctcctgctaagaccctgagccctgacatctgcccccagccccaaccctcagatgcttcacttctttggaattccaggactctcaatggggggacgggatgcctggcctaagcacctggagcaggggaccccatatccactggtagccacctccccattgctgtggccccctgaaatctcactcagtgctgttgctccatctactgccctaatggggctcttttcccacctcctgctggtttcccgagggaacttctgaccctggagtccatgagggctcctttcctttttgaccacgaccttggccctagctctgcactctctggaataagggcccgatgcagcattttcttgcccagtgtggcaagacctcagaaaaaccagtcaattacgcctaagatcattttgctgtccttaaaccccccaggttccttcttgcacaaatccactctgctgcccaccttccctggcattttaaacagacctaccccaccccaactcagagttaagcatacatggcaatgctgaaaataaacaaaatccactgaggcttcccaggccatttaaagcctggagtaccagcgcatatcatctcatggggtccagagtggagtccaggcttctctgaaaccagggctgagcatatttccatagccaaggaggtgggactccctggagctatctgtggtcttagggaaggatccagacatacacggctttggggtacaagctgtgatcactgatcaataaattatctctagattggtccttgtgaggggagttttaagaatccagaacatcttgctcttgatcagcacatccaaaaacaccaagacaaacatccagtggagcagaacctctcctgcctcgggagttctgaccgggttccccagcagggtgttaagcctctgtctctggccctaccagcatccaggttccactttcctaggagagagtggagatgggaagacagggaaaggaaggcagcaggaggccacaagcccaccaggtcttcatgtcaagagagggagtaacatgtcttctcattgcccacggacccaacctctgtccaggtgcccctcatcatcacagtttaacacaagctcccctgctccagccaaattgatctcccagtcttgtccttacccattccaagtgctctgccagcccctgttcatccaagttttaagtcctccaccctgttataagagactgttccaacggctctgggcctcagtggtcacttgaccaccattgtctcagagctgcccactttgtgtgtgtcacatgctgcctgagtcacatgtacatcttatttctgcctctagttttgtaagctcctggagggcggataacatcttatactactcttgtattctcatggcacctagtgcagtgctgggcacagagtaggtgctcaataaagacttgttgaatgaa

SEQ ID NO: 194814 - DNA, 3318 bp, Homo sapiens; identical to SEQ ID NO: 194803
  Payload ID: 18486
  Gene Name: tripartite motif containing 26
  Uniprot ID: Q12899
  ENST ID: ENST00000425523
  CDS Start-End: 278-1897

SEQ ID NO: 194815 - DNA, 682 bp, Homo sapiens
  Payload ID: 18486
  Gene Name: tripartite motif containing 26
  ENST ID: ENST00000451189
  CDS Start-End: 206-682
ggaaacctgttgagatcacagagaatatactgacggcataaaagggcagaaccatagcagggtgcgcctcgcagtcacctctgtgccctgctggttgtcttcccagcgctgctgtagttgccttccatggatctataggagagcaagtcctccaggagaagaagtcctcaccagtgaacggagacctctctgaactaagaataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggaaaaaatcctgaaccacctgagtaccctaaggagagacagagacaaaattcagggcttccaggcaaagggagaagctgatatcctggccgcgctgaagaagctccaggaccagaggcagtacattgtggctgagtttgagcagggtcatcagttcctgagggagcgggaggaacacctgctggaacagctggcgaagctggagcaggagctcacggagggcagggagaagttcaagagccggggcgtcggggagcttgcccgg

SEQ ID NO: 194816 - DNA, 582 bp, Homo sapiens
  Payload ID: 18486
  Gene Name: tripartite motif containing 26
  ENST ID: ENST00000429583
  CDS Start-End: 217-582
aacagaccgccgtgagagaggaggggtgccggccgggattcgcggcccggagctcgggaccggagtcaggaatggagagaagggtaatggttttacctcttattgtggaaacctgttgagatcacagagaatatactgacggcataaaagggcagaaccatagcagggtgcgaagtcctcaccagtgaacggagacctctctgaactaaggataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtg

SEQ ID NO: 194817 - DNA, 3227 bp, Homo sapiens
  Payload ID: 18486
  Gene Name: tripartite motif containing 26
  Uniprot ID: Q12899
  ENST ID: ENST00000425831
  CDS Start-End: 187-1806
ggccgggattcgcggcccggagctcgggaccggttgcttcattccagcctcgcagtcacctctgtgccctgctggttgtcttcccagcgctgctgtagttgccttccatggatctataggagagcaagtcctccaggagaagaagtcctcaccagtgaacggagacctctctgaactaaggataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtgatgtgccgggagtcccgggagcacaggccccacacggccgtcctcatggagaaggccgcccagccccacagggaaaaaatcctgaaccacctgagtaccctaaggagggacagagacaaaattcagggcttccaggcaaagggagaagctgatatcctggccgcgctgaagaagctccaggaccagaggcagtacattgtggctgagtttgagcagggtcatcagttcctgagggagcgggaggaacacctgctggaacagctggcgaagctggagcaggagctcacggagggcagggagaagttcaagagccggggcgtcggggagcttgcccggctggccctggtcatctccgaactggagggcaaggcgcagcagccagctgcagagctcatgcaggacacgagagacttcctaaacaggtatccacggaagaagttctgggttgggaaacccattgctcgagtggttaaaaaaaagaccggagaattctcagataaactcctctctctgcaacgaggcctgagggaattccaggggaagctgctgagagacttggaatataagacagtgagcgtcaccctggacccacagtcggccagtgggtacctgcagctgtcagaggactggaagtgcgtgacctacaccagcctgtacaagagtgcctacctgcacccccagcagtttgactgtgagcctggggtgctgggcagcaagggcttcacctggggcaaggtctactgggaagtggaagtggagagggagggctggtctgaggatgaagaagagggggatgaggaggaagagggagaagaggaggaggaggaagaggaggccggctatggggatggatatgacgactgggaaacggacgaagatgaggaatcgttgggcgatgaagaggaagaagaggaggaggaagaggaggaagttctggaaagctgcatggtgggggtggctagagactctgtgaagaggaagggagacctctccctgcggccagaggatggcgtgtgggcgctgcgcctctcctcctccggcatctgggccaacaccagccccgaggctgagcttttcccagcactgcggccccggagagtgggcatcgccctggattatgaagggggcaccgtgactttcaccaacgcagagtcacaggaactcatctacaccttcactgccaccttcacccggcgcctggtccccttcctgtggctcaagtggccaggaacacgcctcctgctaagaccctgagccctgacatctgcccccagccccaaccctcagatgcttcacttctttggaattccaggactctcaatggggggacgggatgcctggcctaagcacctggagcaggggaccccatatccactggtagccacctccccattgctgtggccccctgaaatctcactcagtgctgttgctccatctactgccctaatggggctcttttcccacctcctgctggtttcccgagggaacttctgaccctggagtccatgagggctcctttcctttttgaccacgaccttggccccagctctgcactctctggaataagggcccgatgcagcattttcttgcccagtgtggcaagacctcagaaaaaccagtcaattacgcctaagatcattttgctgtccttaaaccccccaggttccttcttgcacaaatccactctgctgcccaccttccctggcattttaaacagacctaccccaccccaactcagagttaagcatacatggcaatgctgaaaataaacaaaatccactgaggcttcccaggccatttaaagcctggagtaccagcgcatatcatctcatggggtccagagtggagtccaggcttctctgaaaccagggctgagcatatttccatagccaaggaggtgggactccctggagctatctgtggtcttagggaaggatccagacatacacggctttggggtacaagctgtgatcactgatcaataaattatctctagattggtccttgtgaggggagttttaagaatccagaacatcttgctcttgatcagcacatccaaaaacaccaagacaaacatccagtggagcagaacctctcctgcctcgggagttctgaccaggttccccagcagggtgttaagcctctgtctctggccctaccagcatccaggttccactttcctaggagagagtggagatgggaagacagggaaaggaaggcagcaggaggccacaagcccaccaggtcttcatgtcaagagagggagtaacatgtcttctcattgcccacggacccaacctctgtccaggtgcccctcatcatcacagtttaacacaagctcccctgctccagccaaattgatctcccagtcttgtccttacccattccaagtgctctgccagcccctgttcatccaagttttaagtcctccaccctgttctaagagactgttccaacggctctgggcctcagtggtcacttgaccaccattgtctcagagctgcccactttgtgtgtgtcacatgctgcctgagtcacacgtacatcttatttctgcctctagttttgtaagctcctggagggcggataacatcttatactactcttgtattctcatggcacctagtgcagtgctgggcacagagtaggtgctcaataaagacttgttgaatgaa

SEQ ID NO: 194818 - DNA, 3250 bp, Homo sapiens
  Payload ID: 18486
  Gene Name: tripartite motif containing 26
  Uniprot ID: Q12899
  ENST ID: ENST00000450392
  CDS Start-End: 210-1829
gagtcaggaatggagagaagggtaatggtgttacctcttattgtggaaacctgttgagatcacagagaatatactgacggcataaaagggcagaaccatagcagggtgcgcgctgctgtagttgccttccatggatctataggagagcaagtcctccaggagaagaagtcctcaccagtgaacggagacctctctgaactaaggataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtgatgtgccgggagtcccgggagcacaggccccacacggccgtcctcatggagaaggccgcccagccccacagggaaaaaatcctgaaccacctgagtaccctaaggagagacagagacaaaattcagggcttccaggcaaagggagaagctgatatcctggccgcgctgaagaagctccaggaccagaggcagtacattgtggctgagtttgagcagggtcatcagttcctgagggagcgggaggaacacctgctggaacagctggcgaagctggagcaggagctcacggagggcagggagaagttcaagagccggggcgtcggggagcttgcccggctggccctggtcatctccgaactggagggcaaggcgcagcagccagctgcagagctcatgcaggacacgagagacttcctaaacaggtatccacggaagaagttctgggttgggaaacccattgctcgagtggttaaaaaaaagaccggagaattctcagataaactcctctctctgcaacgaggcctgagggaattccaggggaagctgctgagagacttggaatataagacagtgagcgtcaccctggacccacagtcggccagtgggtacctgcagctgtcagaggactggaagtgcgtgacctacaccagcctgtacaagagtgcctacctgcacccccagcagtttgactgtgagcctggggtgctgggcagcaagggcttcacctggggcaaggtctactgggaagtggaagtggagagggagggctggtctgaggatgaagaagagggggatgaggaggaagagggagaagaggaggaggaggaagaggaggccggctatggggatggatatgacgactgggaaacggacgaagatgaggaatcgttgggcgatgaagaggaagaagaggaggaggaagaggaggaagttctggaaagctgcatggtgggggtggctagagactctgtgaagaggaagggagacctctccctgcggccagaggatggcgtgtgggcgctgcgcctctcctcctccggcatctgggccaacaccagccccgaggctgagcttttcccagcactgcggccccggagagtgggcatcgccctggattatgaagggggcaccgtgactttcaccaacgcagagtcacaggaactcatctacaccttcactgccaccttcacccggcgcctggtccccttcctgtggctcaagtggccaggaacacgcctcctgctaagaccctgagccctgacatctgcccccagccccaaccctcagatgcttcacttctttggaattccaggactctcaatggggggacgggatgcctggcctaagcacctggagcaggggaccccatatccactggtagccacctccccattgctgtggccccctgaaatctcactcagtgctgttgctccatctactgccctaatggggctcttttcccacctcctgctggtttcccgagggaacttctgaccctggagtccatgagggctcctttcctttttgaccacgaccttggccccagctctgcactctctggaataagggcccgatgcagcattttcttgcccagtgtggcaagacctcagaaaaaccagtcaattacgcctaagatcattttgctgtccttaaaccccccaggttccttcttgcacaaatccactctgctgcccaccttctctggcattttaaacagacctaccccaccccaactcagagttaagcatacatggcaatgctgaaaataaacaaaatccactgaggcttcccaggccatttaaagcctggagtaccagcgcatatcatctcatggggtccagagtggagtccaggcttctctgaaaccagggctgagcatatttccatagccaaggaggtgggactccctggagctatctgtggtcttagggaaggatccagacatacacggctttggggtacaagctgtgatcactgatcaataaattatctctagattggtccttgtgaggggagttttaagaatccagaacatcttgctcttgatcagcacatccaaaaacaccaagacaaacatccagtggagcagaacctctcctgcctcgggagttctgaccgggttccccagcagggtgttaagcctctgtctctggccctaccagcatccaggttccactttcctaggagagagtggagatgggaagacagggaaaggaaggcagcaggaggccacaagcccaccaggtcttcatgtcaagagagggagtaacatgtcttctcattgcccacggacccaacctctgtccaggtgcccctcatcatcacagtttaacacaagctcccctgctccagccaaattgatctcccagtcttgtccttacccattccaagtgctctgccagcccctgttcatccaagttttaagtcctccaccctgttctaagagactgttccaacggctctgggcctcagtggtcacttgaccaccattgtctcagagctgcccactttgtgtgtgtcacatgctgcctgagtcacatgtacatcttatttctgcctctagttttgtaagctcctggagggcggataacatcttatactactcttgtattctcatggcacctagtgcagtgctgggcacagagtaggtgctcaataaagacttgttgaatgaa

SEQ ID NO: 194819 - DNA, 3250 bp, Homo sapiens
  Payload ID: 18486
  Gene Name: tripartite motif containing 26
  Uniprot ID: Q12899
  ENST ID: ENST00000437089
  CDS Start-End: 210-1829
gagtcaggaatggagagaagggtaatggttttacctcttattgtggaaacctgttgagatcacagagaatatactgacggcataaaagggcagaaccatagcagggtgcgcgctgctgtagttgccttccatggatctataggagagcaagtcctccaggagaagaagtcctcaccagtgaacggagacctctctgaactaaggataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtgatgtgccgggagtcccgggagcacaggccccacacggccgtcctcatggagaaggccgcccagccccacagggaaaaaatcctgaaccacctgagtaccctaaggagggacagagacaaaattcagggcttccaggcaaagggagaagctgatatcctggccgcgctgaagaagctccaggaccagaggcagtacattgtggctgagtttgagcagggtcatcagttcctgagggagcgggaggaacacctgctggaacagctggcgaagctggagcaggagctcacggagggcagggagaagttcaagagccggggcgtcggggagcttgcccggctggccctggtcatctccgaactggagggcaaggcgcagcagccagctgcagagctcatgcaggacacgagagacttcctaaacaggtatccacggaagaagttctgggttgggaaacccattgctcgagtggttaaaaaaaagaccggagaattctcagataaactcctctctctgcaacgaggcctgagggaattccaggggaagctgctgagagacttggaatataagacagtgagcgtcaccctggacccacagtcggccagtgggtacctgcagctgtcagaggactggaagtgcgtgacctacaccagcctgtacaagagtgcctacctgcacccccagcagtttgactgtgagcctggggtgctaggcagcaagggcttcacctggggcaaggtctactgggaagtggaagtggagagggagggctggtctgaggatgaagaagagggggatgaggaggaagagggagaagaggaggaggaggaagaggaggccggctatggggatggatatgacgactgggaaacggacgaagatgaggaatcgttgggcgatgaagaggaagaagaggaggaggaagaggaggaagttctggaaagctgcatggtgggggtggctagagactctgtgaagaggaagggagacctctccctgcggccagaggatggcgtgtgggcgctgcgcctctcctcctccggcatctgggccaacaccagccccgaggctgagcttttcccagcactgcggccccggagagtgggcatcgccctggattatgaagggggcaccgtgactttcaccaacgcagagtcacaggaactcatctacaccttcactgccaccttcacccggcgcctggtccccttcctgtggctcaagtggccaggaacacgcctcctgctaagaccctgagccctgacatctgcccccagccccaaccctcagatgcttcacttctttggaattccaggactctcaatggggggacgggatgcctggcctaagcacctggagcaggggaccccatatccactggtagccacctccccattgctgtggccccctgaaatctcactcagtgctgttgctccatctactgccctaatggggctcttttcccacctcctgctggtttcccgagggaacttctgaccctggagtccatgagggctcctttcctttttgaccacgaccttggccccagctctgcactctctggaataagggcccgatgcagcattttcttgcccagtgtggcaagacctcagaaaaaccagtcaattacgcctaagatcattttgctgtccttaaaccccccaggttccttcttgcacaaatccactctgctgcccaccttccctggcattttaaacagacctaccccaccccaactcagagttaagcatacatggcaatgctgaaaataaacaaaatccactgaggcttcccaggccatttaaagcctggagtaccagcgcatatcatctcatggggtccagagtggagtccaggcttctctgaaaccagggctgagcatatttccatagccaaggaggtgggactccctggagctatctgtggtcttagggaaggatccagacatacacggctttggggtacaagctgtgatcactgatcaataaattatctctagattggtccttgtgaggggagttttaagaatccagaacatcttgctcttgatcagcacatccaaaaacaccaagacaaacatccagtggagcagaacctctcctgcctcgggagttctgaccgggttccccagcagggtgttaagcctctgtctctggccctaccagcatccaggttccactttcctaggagagagtggagatgggaagacagggaaaggaaggcagcaggaggccacaagcccaccaggtcttcatgtcaagagagggagtaacatgtcttctcattgcccacggacccaacctctgtccaggtgcccctcatcatcacagtttaacacaagctcccctgctccagccaaattgatctcccagtcttgtccttacccattccaagtgctctgccagcccctgttcatccaagttttaagtcctccaccctgttctaagagactgttccaacggctctgggcctcagtggtcacttgaccaccattgtctcagagctgcccactttgtgtgtgtcacatgctgcctgagtcacatgtacatcttatttctgcctctagttttgtaagctcctggagggcggataacatcttatactactcttgtattctcatggcacctagtgcagtgctgggcacagagtaggtgctcaataaagacttgttgaatgaa

SEQ ID NO: 194820 - DNA, 1124 bp, Homo sapiens
  Payload ID: 18486
  Gene Name: tripartite motif containing 26
  ENST ID: ENST00000423901
  CDS Start-End: 380-1124
acggggcggggacgagctgtcgcgctggttgctcgtgcaggagcgggacccggaacagaccgccgtgagagaggaggggcgccggccgggattcgcggcccggagctcgggaccggagtcaggaatggagagaagggtaatggttttacctcttattgtggaaacctgttgagatcacagagaatatactgacggcataaaagggcagaaccatagcagggtgcggttgcttcattccagcctcgcagtcacctctgtgccctgctggttgtcttcccagcgctgctgtagttgccttccatggatctataggagagcaagtcctccaggagaagaagtcctcaccagtgaacggagacctctctgaactaaggataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtgatgtgccgggagtcccgggagcacaggccccacacggccgtcctcatggagaaggccgcccagccccacagggaaaaaatcctgaaccacctgagtaccctaaggagggacagagacaaaattcagggcttccaggcaaagggagaagctgatatcctggccgcgctgaagaagctccaggaccagaggcagtacattgtggctgagtttgagcagggtcatcagttcctgagggagcgggaggaacacctgctggaacagctggcgaagctggagcaggagctcacggagggcagggagaagttcaagagccggggcgtcggggagcttgcccggctggccctggtcatctccgaactggagggcaaggcgcagcagc

SEQ ID NO: 194821 - DNA, 582 bp, Homo sapiens
  Payload ID: 18486
  Gene Name: tripartite motif containing 26
  ENST ID: ENST00000447942
  CDS Start-End: 217-582
aacagaccgccgtgagagaggaggggcgccggccgggattcgcggcccggagctcgggaccggagtcaggaatggagagaagggtaatggttttacctcttattgtggaaacctgttgagatcacagagaatatactgacggcataaaagggcagaaccatagcagggtgcgaagtcctcaccagtgaacggagacctctctgaactaaggataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtg

SEQ ID NO: 194822 - DNA, 3250 bp, Homo sapiens
  Payload ID: 18486
  Gene Name: tripartite motif containing 26
  Uniprot ID: Q12899
  ENST ID: ENST00000422349
  CDS Start-End: 210-1829
gagtcaggaatggagagaagggtaatggttttacctcttattgtggaaacctgttgagatcacagagaatatactgacggcataaaagggcagaaccatagcagggtgcgcgctgctgtagttgccttccatggatctataggagagcaagtcctccaggagaagaagtcctcaccagtgaacggagacctctctgaactaaggataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtgatgtgccgggagtcccgggagcacaggccccacacggccgtcctcatggagaaggccgcccagccccacagggaaaaaatcctgaaccacctgagtaccctaaggagggacagagacaaaattcagggcttccaggcaaagggagaagctgatatcctggccgcgctgaagaagctccaggaccagaggcagtacattgtggctgagtttgagcagggtcatcagttcctgagggagcgggaggaacacctgctggaacagctggcgaagctggagcaggagctcacggagggcagggagaagttcaagagccggggcgtcggggagcttgcccggctggccctggtcatctccgaactggagggcaaggcgcagcagccagctgcagagctcatgcaggacacgagagacttcctaaacaggtatccacggaagaagttctgggttgggaaacccattgctcgagtggttaaaaaaaagaccggagaattctcagataaactcctctctctgcaacgaggcctgagggaattccaggggaagctgctgagagacttggaatataagacagtgagcgtcaccctggacccacagtcggccagtgggtacctgcagctgtcagaggactggaagtgcgtgacctacaccagcctgtacaagagtgcctacctgcacccccagcagtttgactgtgagcctggggtgctgggcagcaagggcttcacctggggcaaggtctactgggaagtggaagtggagagggagggctggtctgaggatgaagaagagggggatgaggaggaagagggagaagaggaggaggaggaagaggaggccggctatggggatggatatgacgactgggaaacggacgaagatgaggaatcgttgggcgatgaagaggaagaagaggaggaggaagaggaggaagttctggaaagctgcatggtgggggtggctagagactctgtgaagaggaagggagacctctccctgcggccagaggatggcgtgtgggcgctgcgcctctcctcctccggcatctgggccaacaccagccccgaggctgagcttttcccagcactgcggccccggagagtgggcatcgccctggattatgaagggggcaccgtgactttcaccaacgcagagtcacaggaactcatctacaccttcactgccaccttcacccggcgcctggtccccttcctgtggctcaagtggccaggaacacgcctcctgctaagaccctgagccctgacatctgcccccagccccaaccctcagatgcttcacttctttggaattccaggactctcaatggggggacgggatgcctggcctaagcacctggagcaggggaccccatatccactggtagccacctccccattgctgtggccccctgaaatctcactcagtgctgttgctccatctactgccctaatggggctcttttcccacctcctgctggtttcccgagggaacttctgaccctggagtccatgagggctcctttcctttttgaccacgaccttggccccagctctgcactctctggaataagggcccgatgcagcattttcttgcccagtgtggcaagacctcagaaaaaccagtcaattacgcctaagatcattttgctgtccttaaaccccccaggttccttcttgcacaaatccactctgctgcccaccttccctggcattttaaacagacctaccccaccccaactcagagttaagcatacatggcaatgctgaaaataaacaaaatccactgaggcttcccaggccatttaaagcctggagtaccagcgcatatcatctcatggggtccagagtggagtccaggcttctctgaaaccagggctgagcatatttccatagccaaggaggtgggactccctggagctatctgtggtcttagggaaggatccagacatacacggctttggggtacaagctgtgatcactgatcaataaattatctctagattggtccttgtgaggggagttttaagaatccagaacatcttgctcttgatcagcacatccaaaaacaccaagacaaacatccagtggagcagaacctctcctgcctcgggagttctgaccaggttccccagcagggtgttaagcctctgtctctggccctaccagcatccaggttccactttcctaggagagagtggagatgggaagacagggaaaggaaggcagcaggaggccacaagcccaccaggtcttcatgtcaagagagggagtaacatgtcttctcattgcccacggacccaacctctgtccaggtgcccctcatcatcacagtttaacacaagctcccctgctccagccaaattgatctcccagtcttgtccttacccattccaagtgctctgccagcccctgttcatccaagttttaagtcctccaccctgttctaagagactgttccaacggctctgggcctcagtggtcacttgaccaccattgtctcagagctgcccactttgtgtgtgtcacatgctgcctgagtcacacgtacatcttatttctgcctctagttttgtaagctcctggagggcggataacatcttatactactcttgtattctcatggcacctagtgcagtgctgggcacagagtaggtgctcaataaagacttgttgaatgaa

SEQ ID NO: 194823 - DNA, 1124 bp, Homo sapiens; identical to SEQ ID NO: 194809
  Payload ID: 18486
  Gene Name: tripartite motif containing 26
  ENST ID: ENST00000438785
  CDS Start-End: 380-1124

SEQ ID NO: 194824 - DNA, 3318 bp, Homo sapiens
  Payload ID: 18486
  Gene Name: tripartite motif containing 26
  Uniprot ID: Q12899
  ENST ID: ENST00000427535
  CDS Start-End: 278-1897
gggagattacggggcggggacgagctgtcgcgctggttgctcgtgcaggagcgggacccggaacagaccgccgtgagagaggaggggcgccggccgggattcgcggcccggagctcgggaccggttgcttcattccagcctcgcagtcacctctgtgccctgctggttgtcttcccagcgctgctgtagttgccttccatggatctataggagagcaagtcctccaggagaagaagtcctcaccagtgaacggagacctctctgaactaaggataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtgatgtgccgggagtcccgggagcacaggccccacacggccgtcctcatggagaaggccgcccagccccacagggaaaaaatcctgaaccacctgagtaccctaaggagggacagagacaaaattcagggcttccaggcaaagggagaagctgatatcctggccgcgctgaagaagctccaggaccagaggcagtacattgtggctgagtttgagcagggtcatcagttcctgagggagcgggaggaacacctgctggaacagctggcgaagctggagcaggagctcacggagggcagggagaagttcaagagccggggcgtcggggagcttgcccggctggccctggtcatctccgaactggagggcaaggcgcagcagccagctgcagagctcatgcaggacacgagagacttcctaaacaggtatccacggaagaagttctgggttgggaaacccattgctcgagtggttaaaaaaaagaccggagaattctcagataaactcctctctctgcaacgaggcctgagggaattccaggggaagctgctgagagacttggaatataagacagtgagcgtcaccctggacccacagtcggccagtgggtacctgcagctgtcagaggactggaagtgcgtgacctacaccagcctgtacaagagtgcctacctgcacccccagcagtttgactgtgagcctggggtgctgggcagcaagggcttcacctggggcaaggtctactgggaagtggaagtggagagggagggctggtctgaggatgaagaagagggggatgaggaggaagagggagaagaggaggaggaggaagaggaggccggctatggggatggatatgacgactgggaaacggacgaagatgaggaatcgttgggcgatgaagaggaagaagaggaggaggaagaggaggaagttctggaaagctgcatggtgggggtggctagagactctgtgaagaggaagggagacctctccctgcggccagaggatggcgtgtgggcgctgcgcctctcctcctccggcatctgggccaacaccagccccgaggctgagcttttcccagcactgcggccccggagagtgggcatcgccctggattatgaagggggcaccgtgactttcaccaacgcagagtcacaggaactcatctacaccttcactgccaccttcacccggcgcctggtccccttcctgtggctcaagtggccaggaacacgcctcctgctaagaccctgagccctgacatctgcccccagccccaaccctcagatgcttcacttctttggaattccaggactctcaatggggggacgggatgcctggcctaagcacctggagcaggggaccccatatccactggtagccacctccccattgctgtggccccctgaaatctcactcagtgctgttgctccatctactgccctaatggggctcttttcccacctcctgctggtttcccgagggaacttctgaccctggagtccatgagggctcctttcctttttgaccacgaccttggccccagctctgcactctctggaataagggcccgatgcagcattttcttgcccagtgtggcaagacctcagaaaaaccagtcaattacgcctaagatcattttgctgtccttaaaccccccaggttccttcttgcacaaatccactctgctgcccaccttccctggcattttaaacagacctaccccaccccaactcagagttaagcatacatggcaatgctgaaaataaacaaaatccactgaggcttcccaggccatttaaagcctggagtaccagcgcatatcatctcatggggtccagagtggagtccaggcttctctgaaaccagggctgagcatatttccatagccaaggaggtgggactccctggagctatctgtggtcttagggaaggatccagacatacacggctttggggtacaagctgtgatcactgatcaataaattatctctagattggtccttgtgaggggagttttaagaatccagaacatcttgctcttgatcagcacatccaaaaacaccaagacaaacatccagtggagcagaacctctcctgcctcgggagttctgaccaggttccccagcagggtgttaagcctctgtctctggccctaccagcatccaggttccactttcctaggagagagtggagatgggaagacagggaaaggaaggcagcaggaggccacaagcccaccaggtcttcatgtcaagagagggagtaacatgtcttctcattgcccacggacccaacctctgtccaggtgcccctcatcatcacagtttaacacaagctcccctgctccagccaaattgatctcccagtcttgtccttacccattccaagtgctctgccagcccctgttcatccaagttttaagtcctccaccctgttctaagagactgttccaacggctctgggcctcagtggtcacttgaccaccattgtctcagagctgcccactttgtgtgtgtcacatgctgcctgagtcacacgtacatcttatttctgcctctagttttgtaagctcctggagggcggataacatcttatactactcttgtattctcatggcacctagtgcagtgctgggcacagagtaggtgctcaataaagacttgttgaatgaa

SEQ ID NO: 194825 - DNA, 682 bp, Homo sapiens
  Payload ID: 18486
  Gene Name: tripartite motif containing 26
  ENST ID: ENST00000424124
  CDS Start-End: 206-682
ggaaacctgttgagatcacagagaatatactgacggcataaaagggcagaaccatagcagggtgcgcctcgcagtcacctctgtgccctgctggttgtcttcccagcgctgctgtagttgccttccatggatctataggagagcaagtcctccaggagaagaagtcctcaccagtgaacggagacctctctgaactaaggataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggaaaaaatcctgaaccacctgagtaccctaaggagggacagagacaaaattcagggcttccaggcaaagggagaagctgatatcctggccgcgctgaagaagctccaggaccagaggcagtacattgtggctgagtttgagcagggtcatcagttcctgagggagcgggaggaacacctgctggaacagctggcgaagctggagcaggagctcacggagggcagggagaagttcaagagccggggcgtcggggagcttgcccgg

SEQ ID NO: 194826 - DNA, 582 bp, Homo sapiens; identical to SEQ ID NO: 194816
  Payload ID: 18486
  Gene Name: tripartite motif containing 26
  ENST ID: ENST00000434785
  CDS Start-End: 217-582

SEQ ID NO: 194827 - DNA, 1124 bp, Homo sapiens
  Payload ID: 18486
  Gene Name: tripartite motif containing 26
  ENST ID: ENST00000446196
  CDS Start-End: 380-1124
acggggcggggacgagctgtcgcgctggttgctcgtgcaggagcgggacccggaacagaccgccgtgagagaggaggggcgccggccgggattcgcggcccggagctcgggaccggagtcaggaatggagagaagggtaatggtgttacctcttattgtggaaacctgttgagatcacagagaatatactgacggcataaaagggcagaaccatagcagggtgcggttgcttcattccagcctcgcagtcacctctgtgccctgctggttgtcttcccagcgctgctgtagttgccttccatggatctataggagagcaagtcctccaggagaagaagtcctcaccagtgaacggagacctctctgaactaagaataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtgatgtgccgggagtcccgggagcacaggccccacacggccgtcctcatggagaaggccgcccagccccacagggaaaaaatcctgaaccacctgagtaccctaaggagagacagagacaaaattcagggcttccaggcaaagggagaagctgatatcctggccgcgctgaagaagctccaggaccagaggcagtacattgtggctgagtttgagcagggtcatcagttcctgagggagcgggaggaacacctgctggaacagctggcgaagctggagcaggagctcacggagggcagggagaagttcaagagccggggcgtcggggagcttgcccggctggccctggtcatctccgaactggagggcaaggcgcagcagc

SEQ ID NO: 194828 - DNA, 3250 bp, Homo sapiens; identical to SEQ ID NO: 194819
  Payload ID: 18486
  Gene Name: tripartite motif containing 26
  Uniprot ID: Q12899
  ENST ID: ENST00000433314
  CDS Start-End: 210-1829

SEQ ID NO: 194829 - DNA, 682 bp, Homo sapiens; identical to SEQ ID NO: 194825
  Payload ID: 18486
  Gene Name: tripartite motif containing 26
  ENST ID: ENST00000415966
  CDS Start-End: 206-682

SEQ ID NO: 194830 - DNA, 603 bp, Homo sapiens; identical to SEQ ID NO: 194804
  Payload ID: 18486
  Gene Name: tripartite motif containing 26
  ENST ID: ENST00000433836
  CDS Start-End: 132-603

SEQ ID NO: 194831 - DNA, 682 bp, Homo sapiens; identical to SEQ ID NO: 194825
  Payload ID: 18486
  Gene Name: tripartite motif containing 26
  ENST ID: ENST00000444979
  CDS Start-End: 206-682

SEQ ID NO: 194832 - DNA, 552 bp, Homo sapiens
  Payload ID: 18486
  Gene Name: tripartite motif containing 26
  ENST ID: ENST00000445457
  CDS Start-End: 187-552
ggccgggattcgcggcccggagctcgggaccggagtcaggaatggagagaagggtaatggttttacctcttattgtggaaacctgttgagatcacagagaatatactgacggcataaaagggcagaaccatagcagggtgcgaagtcctcaccagtgaacggagacctctctgaactaaggataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtg

SEQ ID NO: 194833 - DNA, 582 bp, Homo sapiens; identical to SEQ ID NO: 194816
  Payload ID: 18486
  Gene Name: tripartite motif containing 26
  ENST ID: ENST00000440149
  CDS Start-End: 217-582

SEQ ID NO: 194834 - DNA, 582 bp, Homo sapiens; identical to SEQ ID NO: 194816
  Payload ID: 18486
  Gene Name: tripartite motif containing 26
  ENST ID: ENST00000427612
  CDS Start-End: 217-582

SEQ ID NO: 194835 - DNA, 554 bp, Homo sapiens
  Payload ID: 18486
  Gene Name: tripartite motif containing 26
  ENST ID: ENST00000419401
  CDS Start-End: 83-554
ggccgggattcgcggcccggagctcgggaccggagaagaagtcctcaccagtgaacggagacctctctgaactaaggataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtgatgtgccgggagtcccgggagcacaggccccacacggccgtcctcatggagaaggccgcccagccccacagggaaaaaatcctgaaccacctgagtaccctaagga

SEQ ID NO: 194836 - DNA, 682 bp, Homo sapiens; identical to SEQ ID NO: 194825
  Payload ID: 18486
  Gene Name: tripartite motif containing 26
  ENST ID: ENST00000438064
  CDS Start-End: 206-682

SEQ ID NO: 194837 - DNA, 582 bp, Homo sapiens
  Payload ID: 18486
  Gene Name: tripartite motif containing 26
  ENST ID: ENST00000435387
  CDS Start-End: 217-582
aacagaccgccgtgagagaggaggggcgccggccgggattcgcggcccggagctcgggaccggagtcaggaatggagagaagggtaatggtgttacctcttattgtggaaacctgttgagatcacagagaatatactgacggcataaaagggcagaaccatagcagggtgcgaagtcctcaccagtgaacggagacctctctgaactaagaataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtg

SEQ ID NO: 194838 - DNA, 3318 bp, Homo sapiens; identical to SEQ ID NO: 194803
  Payload ID: 18486
  Gene Name: tripartite motif containing 26
  Uniprot ID: Q12899
  ENST ID: ENST00000456093
  CDS Start-End: 278-1897

SEQ ID NO: 194839 - DNA, 603 bp, Homo sapiens; identical to SEQ ID NO: 194810
  Payload ID: 18486
  Gene Name: tripartite motif containing 26
  ENST ID: ENST00000415789
  CDS Start-End: 132-603

SEQ ID NO: 194840 - DNA, 3478 bp, Homo sapiens
  Payload ID: 18486
  Gene Name: tripartite motif containing 26
  Uniprot ID: Q12899
  ENST ID: ENST00000445259
  CDS Start-End: 438-2057
aacagaccgccgtgagagaggaggggcgccggccgggattcgcggcccggagctcgggaccggagtcaggaatggagagaagggtaatggttttacctcttattgtggaaacctgttgagatcacagagaatatactgacggcataaaagggcagaaccatagcagggtgcggttgcttcattccagcctcgcagtcacctctgtgccctgctggttgtcttcccagcgctgctgtagttgccttccatggatctataggagagcaagtcctccaggagctggtggtgtctgtcgattgactgagtgctggagctggcagccctgtgcaggctgccacctttgcccctttactgtgcttgctcctgactctatgtcgcgtctccaaggagaagaagtcctcaccagtgaacggagacctctctgaactaaggataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtgatgtgccgggagtcccgggagcacaggccccacacggccgtcctcatggagaaggccgcccagccccacagggaaaaaatcctgaaccacctgagtaccctaaggagggacagagacaaaattcagggcttccaggcaaagggagaagctgatatcctggccgcgctgaagaagctccaggaccagaggcagtacattgtggctgagtttgagcagggtcatcagttcctgagggagcgggaggaacacctgctggaacagctggcgaagctggagcaggagctcacggagggcagggagaagttcaagagccggggcgtcggggagcttgcccggctggccctggtcatctccgaactggagggcaaggcgcagcagccagctgcagagctcatgcaggacacgagagacttcctaaacaggtatccacggaagaagttctgggttgggaaacccattgctcgagtggttaaaaaaaagaccggagaattctcagataaactcctctctctgcaacgaggcctgagggaattccaggggaagctgctgagagacttggaatataagacagtgagcgtcaccctggacccacagtcggccagtgggtacctgcagctgtcagaggactggaagtgcgtgacctacaccagcctgtacaagagtgcctacctgcacccccagcagtttgactgtgagcctggggtgctgggcagcaagggcttcacctggggcaaggtctactgggaagtggaagtggagagggagggctggtctgaggatgaagaagagggggatgaggaggaagagggagaagaggaggaggaggaagaggaggccggctatggggatggatatgacgactgggaaacggacgaagatgaggaatcgttgggcgatgaagaggaagaagaggaggaggaagaggaggaagttctggaaagctgcatggtgggggtggctagagactctgtgaagaggaagggagacctctccctgcggccagaggatggcgtgtgggcgctgcgcctctcctcctccggcatctgggccaacaccagccccgaggctgagcttttcccagcactgcggccccggagagtgggcatcgccctggattatgaagggggcaccgtgactttcaccaacgcagagtcacaggaactcatctacaccttcactgccaccttcacccggcgcctggtccccttcctgtggctcaagtggccaggaacacgcctcctgctaagaccctgagccctgacatctgcccccagccccaaccctcagatgcttcacttctttggaattccaggactctcaatggggggacgggatgcctggcctaagcacctggagcaggggaccccatatccactggtagccacctccccattgctgtggccccctgaaatctcactcagtgctgttgctccatctactgccctaatggggctcttttcccacctcctgctggtttcccgagggaacttctgaccctggagtccatgagggctcctttcctttttgaccacgaccttggccccagctctgcactctctggaataagggcccgatgcagcattttcttgcccagtgtggcaagacctcagaaaaaccagtcaattacgcctaagatcattttgctgtccttaaaccccccaggttccttcttgcacaaatccactctgctgcccaccttccctggcattttaaacagacctaccccaccccaactcagagttaagcatacatggcaatgctgaaaataaacaaaatccactgaggcttcccaggccatttaaagcctggagtaccagcgcatatcatctcatggggtccagagtggagtccaggcttctctgaaaccagggctgagcatatttccatagccaaggaggtgggactccctggagctatctgtggtcttagggaaggatccagacatacacggctttggggtacaagctgtgatcactgatcaataaattatctctagattggtccttgtgaggggagttttaagaatccagaacatcttgctcttgatcagcacatccaaaaacaccaagacaaacatccagtggagcagaacctctcctgcctcgggagttctgaccaggttccccagcagggtgttaagcctctgtctctggccctaccagcatccaggttccactttcctaggagagagtggagatgggaagacagggaaaggaaggcagcaggaggccacaagcccaccaggtcttcatgtcaagagagggagtaacatgtcttctcattgcccacggacccaacctctgtccaggtgcccctcatcatcacagtttaacacaagctcccctgctccagccaaattgatctcccagtcttgtccttacccattccaagtgctctgccagcccctgttcatccaagttttaagtcctccaccctgttctaagagactgttccaacggctctgggcctcagtggtcacttgaccaccattgtctcagagctgcccactttgtgtgtgtcacatgctgcctgagtcacacgtacatcttatttctgcctctagttttgtaagctcctggagggcggataacatcttatactactcttgtattctcatggcacctagtgcagtgctgggcacagagtaggtgctcaataaagacttgttgaatgaa

SEQ ID NO: 194841 - DNA, 3448 bp, Homo sapiens
  Payload ID: 18486
  Gene Name: tripartite motif containing 26
  Uniprot ID: Q12899
  ENST ID: ENST00000432326
  CDS Start-End: 408-2027
ggccgggattcgcggcccggagctcgggaccggagtcaggaatggagagaagggtaatggttttacctcttattgtggaaacctgttgagatcacagagaatatactgacggcataaaagggcagaaccatagcagggtgcggttgcttcattccagcctcgcagtcacctctgtgccctgctggttgtcttcccagcgctgctgtagttgccttccatggatctataggagagcaagtcctccaggagctggtggtgtctgtcgattgactgagtgctggagctggcagccctgtgcaggctgccacctttgcccctttactgtgcttgctcctgactctatgtcgcgtctccaaggagaagaagtcctcaccagtgaacggagacctctctgaactaaggataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtgatgtgccgggagtcccgggagcacaggccccacacggccgtcctcatggagaaggccgcccagccccacagggaaaaaatcctgaaccacctgagtaccctaaggagggacagagacaaaattcagggcttccaggcaaagggagaagctgatatcctggccgcgctgaagaagctccaggaccagaggcagtacattgtggctgagtttgagcagggtcatcagttcctgagggagcgggaggaacacctgctggaacagctggcgaagctggagcaggagctcacggagggcagggagaagttcaagagccggggcgtcggggagcttgcccggctggccctggtcatctccgaactggagggcaaggcgcagcagccagctgcagagctcatgcaggacacgagagacttcctaaacaggtatccacggaagaagttctgggttgggaaacccattgctcgagtggttaaaaaaaagaccggagaattctcagataaactcctctctctgcaacgaggcctgagggaattccaggggaagctgctgagagacttggaatataagacagtgagcgtcaccctggacccacagtcggccagtgggtacctgcagctgtcagaggactggaagtgcgtgacctacaccagcctgtacaagagtgcctacctgcacccccagcagtttgactgtgagcctggggtgctgggcagcaagggcttcacctggggcaaggtctactgggaagtggaagtggagagggagggctggtctgaggatgaagaagagggggatgaggaggaagagggagaagaggaggaggaggaagaggaggccggctatggggatggatatgacgactgggaaacggacgaagatgaggaatcgttgggcgatgaagaggaagaagaggaggaggaagaggaggaagttctggaaagctgcatggtgggggtggctagagactctgtgaagaggaagggagacctctccctgcggccagaggatggcgtgtgggcgctgcgcctctcctcctccggcatctgggccaacaccagccccgaggctgagcttttcccagcactgcggccccggagagtgggcatcgccctggattatgaagggggcaccgtgactttcaccaacgcagagtcacaggaactcatctacaccttcactgccaccttcacccggcgcctggtccccttcctgtggctcaagtggccaggaacacgcctcctgctaagaccctgagccctgacatctgcccccagccccaaccctcagatgcttcacttctttggaattccaggactctcaatggggggacgggatgcctggcctaagcacctggagcaggggaccccatatccactggtagccacctccccattgctgtggccccctgaaatctcactcagtgctgttgctccatctactgccctaatggggctcttttcccacctcctgctggtttcccgagggaacttctgaccctggagtccatgagggctcctttcctttttgaccacgaccttggccccagctctgcactctctggaataagggcccgatgcagcattttcttgcccagtgtggcaagacctcagaaaaaccagtcaattacgcctaagatcattttgctgtccttaaaccccccaggttccttcttgcacaaatccactctgctgcccaccttccctggcattttaaacagacctaccccaccccaactcagagttaagcatacatggcaatgctgaaaataaacaaaatccactgaggcttcccaggccatttaaagcctggagtaccagcgcatatcatctcatggggtccagagtggagtccaggcttctctgaaaccagggctgagcatatttccatagccaaggaggtgggactccctggagctatctgtggtcttagggaaggatccagacatacacggctttggggtacaagctgtgatcactgatcaataaattatctctagattggtccttgtgaggggagttttaagaatccagaacatcttgctcttgatcagcacatccaaaaacaccaagacaaacatccagtggagcagaacctctcctgcctcgggagttctgaccaggttccccagcagggtgttaagcctctgtctctggccctaccagcatccaggttccactttcctaggagagagtggagatgggaagacagggaaaggaaggcagcaggaggccacaagcccaccaggtcttcatgtcaagagagggagtaacatgtcttctcattgcccacggacccaacctctgtccaggtgcccctcatcatcacagtttaacacaagctcccctgctccagccaaattgatctcccagtcttgtccttacccattccaagtgctctgccagcccctgttcatccaagttttaagtcctccaccctgttctaagagactgttccaacggctctgggcctcagtggtcacttgaccaccattgtctcagagctgcccactttgtgtgtgtcacatgctgcctgagtcacacgtacatcttatttctgcctctagttttgtaagctcctggagggcggataacatcttatactactcttgtattctcatggcacctagtgcagtgctgggcacagagtaggtgctcaataaagacttgttgaatgaa

SEQ ID NO: 194842 - DNA, 3478 bp, Homo sapiens; identical to SEQ ID NO: 194801
  Payload ID: 18486
  Gene Name: tripartite motif containing 26
  Uniprot ID: Q12899
  ENST ID: ENST00000447711
  CDS Start-End: 438-2057

SEQ ID NO: 194843 - DNA, 3250 bp, Homo sapiens
  Payload ID: 18486
  Gene Name: tripartite motif containing 26
  Uniprot ID: Q12899
  ENST ID: ENST00000438908
  CDS Start-End: 210-1829
gagtcaggaatggagagaagggtaatggtgttacctcttattgtggaaacctgttgagatcacagagaatatactgacggcataaaagggcagaaccatagcagggtgcgcgctgctgtagttgccttccatggatctataggagagcaagtcctccaggagaagaagtcctcaccagtgaacggagacctctctgaactaagaataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtgatgtgccgggagtcccgggagcacaggccccacacggccgtcctcatggagaaggccgcccagccccacagggaaaaaatcctgaaccacctgagtaccctaaggagagacagagacaaaattcagggcttccaggcaaagggagaagctgatatcctggccgcgctgaagaagctccaggaccagaggcagtacattgtggctgagtttgagcagggtcatcagttcctgagggagcgggaggaacacctgctggaacagctggcgaagctggagcaggagctcacggagggcagggagaagttcaagagccggggcgtcggggagcttgcccggctggccctggtcatctccgaactggagggcaaggcgcagcagccagctgcagagctcatgcaggacacgagagacttcctaaacaggtatccacggaagaagttctgggttgggaaacccattgctcgagtggttaaaaaaaagaccggagaattctcagataaactcctctctctgcaacgaggcctgagggaattccaggggaagctgctgagagacttggaatataagacagtgagcgtcaccctggacccacagtcggccagtgggtacctgcagctgtcagaggactggaagtgcgtgacctacaccagcctgtacaagagtgcctacctgcacccccagcagtttgactgtgagcctggggtgctgggcagcaagggcttcacctggggcaaggtctactgggaagtggaagtggagagggagggctggtctgaggatgaagaagagggggatgaggaggaagagggagaagaggaggaggaggaagaggaggccggctatggggatggatatgacgactgggaaacggacgaagatgaggaatcgttgggcgatgaagaggaagaagaggaggaggaagaggaggaagttctggaaagctgcatggtgggggtggctagagactctgtgaagaggaagggagacctctccctgcggccagaggatggcgtgtgggcgctgcgcctctcctcctccggcatctgggccaacaccagccccgaggctgagcttttcccagcactgcggccccggagagtgggcatcgccctggattatgaagggggcaccgtgactttcaccaacgcagagtcacaggaactcatctacaccttcactgccaccttcacccggcgcctggtccccttcctgtggctcaagtggccaggaacacgcctcctgctaagaccctgagccctgacatctgcccccagccccaaccctcagatgcttcacttctttggaattccaggactctcaatggggggacgggatgcctggcctaagcacctggagcaggggaccccatatccactggtagccacctccccattgctgtggccccctgaaatctcactcagtgctgttgctccatctactgccctaatggggctcttttcccacctcctgctggtttcccgagggaacttctgaccctggagtccatgagggctcctttcctttttgaccacgaccttggccctagctctgcactctctggaataagggcccgatgcagcattttcttgcccagtgtggcaagacctcagaaaaaccagtcaattacgcctaagatcattttgctgtccttaaaccccccaggttccttcttgcacaaatccactctgctgcccaccttccctggcattttaaacagacctaccccaccccaactcagagttaagcatacatggcaatgctgaaaataaacaaaatccactgaggcttcccaggccatttaaagcctggagtaccagcgcatatcatctcatggggtccagagtggagtccaggcttctctgaaaccagggctgagcatatttccatagccaaggaggtgggactccctggagctatctgtggtcttagggaaggatccagacatacacggctttggggtacaagctgtgatcactgatcaataaattatctctagattggtccttgtgaggggagttttaagaatccagaacatcttgctcttgatcagcacatccaaaaacaccaagacaaacatccagtggagcagaacctctcctgcctcgggagttctgaccgggttccccagcagggtgttaagcctctgtctctggccctaccagcatccaggttccactttcctaggagagagtggagatgggaagacagggaaaggaaggcagcaggaggccacaagcccaccaggtcttcatgtcaagagagggagtaacatgtcttctcattgcccacggacccaacctctgtccaggtgcccctcatcatcacagtttaacacaagctcccctgctccagccaaattgatctcccagtcttgtccttacccattccaagtgctctgccagcccctgttcatccaagttttaagtcctccaccctgttataagagactgttccaacggctctgggcctcagtggtcacttgaccaccattgtctcagagctgcccactttgtgtgtgtcacatgctgcctgagtcacatgtacatcttatttctgcctctagttttgtaagctcctggagggcggataacatcttatactactcttgtattctcatggcacctagtgcagtgctgggcacagagtaggtgctcaataaagacttgttgaatgaa

SEQ ID NO: 194844 - DNA, 3478 bp, Homo sapiens
  Payload ID: 18486
  Gene Name: tripartite motif containing 26
  Uniprot ID: Q12899
  ENST ID: ENST00000454678
  CDS Start-End: 438-2057
aacagaccgccgtgagagaggaggggtgccggccgggattcgcggcccggagctcgggaccggagtcaggaatggagagaagggtaatggttttacctcttattgtggaaacctgttgagatcacagagaatatactgacggcataaaagggcagaaccatagcagggtgcggttgcttcattccagcctcgcagtcacctctgtgccctgctggttgtcttcccagcgctgctgtagttgccttccatggatctataggagagcaagtcctccaggagctggtggtgtctgtcgattgactgagtgctggagctggcagccctgtgcaggctgccacctttgcccctttactgtgcttgctcctgactctatgtcgcgtctccaaggagaagaagtcctcaccagtgaacggagacctctctgaactaaggataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtgatgtgccgggagtcccgggagcacaggccccacacggccgtcctcatggagaaggccgcccagccccacagggaaaaaatcctgaaccacctgagtaccctaaggagggacagagacaaaattcagggcttccaggcaaagggagaagctgatatcctggccgcgctgaagaagctccaggaccagaggcagtacattgtggctgagtttgagcagggtcatcagttcctgagggagcgggaggaacacctgctggaacagctggcgaagctggagcaggagctcacggagggcagggagaagttcaagagccggggcgtcggggagcttgcccggctggccctggtcatctccgaactggagggcaaggcgcagcagccagctgcagagctcatgcaggacacgagagacttcctaaacaggtatccacggaagaagttctgggttgggaaacccattgctcgagtggttaaaaaaaagaccggagaattctcagataaactcctctctctgcaacgaggcctgagggaattccaggggaagctgctgagagacttggaatataagacagtgagcgtcaccctggacccacagtcggccagtgggtacctgcagctgtcagaggactggaagtgcgtgacctacaccagcctgtacaagagtgcctacctgcacccccagcagtttgactgtgagcctggggtgctaggcagcaagggcttcacctggggcaaggtctactgggaagtggaagtggagagggagggctggtctgaggatgaagaagagggggatgaggaggaagagggagaagaggaggaggaggaagaggaggccggctatggggatggatatgacgactgggaaacggacgaagatgaggaatcgttgggcgatgaagaggaagaagaggaggaggaagaggaggaagttctggaaagctgcatggtgggggtggctagagactctgtgaagaggaagggagacctctccctgcggccagaggatggcgtgtgggcgctgcgcctctcctcctccggcatctgggccaacaccagccccgaggctgagcttttcccagcactgcggccccggagagtgggcatcgccctggattatgaagggggcaccgtgactttcaccaacgcagagtcacaggaactcatctacaccttcactgccaccttcacccggcgcctggtccccttcctgtggctcaagtggccaggaacacgcctcctgctaagaccctgagccctgacatctgcccccagccccaaccctcagatgcttcacttctttggaattccaggactctcaatggggggacgggatgcctggcctaagcacctggagcaggggaccccatatccactggtagccacctccccattgctgtggccccctgaaatctcactcagtgctgttgctccatctactgccctaatggggctcttttcccacctcctgctggtttcccgagggaacttctgaccctggagtccatgagggctcctttcctttttgaccacgaccttggccccagctctgcactctctggaataagggcccgatgcagcattttcttgcccagtgtggcaagacctcagaaaaaccagtcaattacgcctaagatcattttgctgtccttaaaccccccaggttccttcttgcacaaatccactctgctgcccaccttccctggcattttaaacagacctaccccaccccaactcagagttaagcatacatggcaatgctgaaaataaacaaaatccactgaggcttcccaggccatttaaagcctggagtaccagcgcatatcatctcatggggtccagagtggagtccaggcttctctgaaaccagggctgagcatatttccatagccaaggaggtgggactccctggagctatctgtggtcttagggaaggatccagacatacacggctttggggtacaagctgtgatcactgatcaataaattatctctagattggtccttgtgaggggagttttaagaatccagaacatcttgctcttgatcagcacatccaaaaacaccaagacaaacatccagtggagcagaacctctcctgcctcgggagttctgaccgggttccccagcagggtgttaagcctctgtctctggccctaccagcatccaggttccactttcctaggagagagtggagatgggaagacagggaaaggaaggcagcaggaggccacaagcccaccaggtcttcatgtcaagagagggagtaacatgtcttctcattgcccacggacccaacctctgtccaggtgcccctcatcatcacagtttaacacaagctcccctgctccagccaaattgatctcccagtcttgtccttacccattccaagtgctctgccagcccctgttcatccaagttttaagtcctccaccctgttctaagagactgttccaacggctctgggcctcagtggtcacttgaccaccattgtctcagagctgcccactttgtgtgtgtcacatgctgcctgagtcacatgtacatcttatttctgcctctagttttgtaagctcctggagggcggataacatcttatactactcttgtattctcatggcacctagtgcagtgctgggcacagagtaggtgctcaataaagacttgttgaatgaa

SEQ ID NO: 194845 - DNA, 603 bp, Homo sapiens; identical to SEQ ID NO: 194804
  Payload ID: 18486
  Gene Name: tripartite motif containing 26
  ENST ID: ENST00000419171
  CDS Start-End: 132-603

SEQ ID NO: 194846 - DNA, 603 bp, Homo sapiens
  Payload ID: 18486
  Gene Name: tripartite motif containing 26
  ENST ID: ENST00000422881
  CDS Start-End: 132-603
gtgcaggagcgggacccggaacagaccgccgtgagagaggaggggcgccggccgggattcgcggcccggagctcgggaccggagaagaagtcctcaccagtgaacggagacctctctgaactaagaataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtgatgtgccgggagtcccgggagcacaggccccacacggccgtcctcatggagaaggccgcccagccccacagggaaaaaatcctgaaccacctgagtaccctaagga

SEQ ID NO: 194847 - DNA, 1124 bp, Homo sapiens; identical to SEQ ID NO: 194809
  Payload ID: 18486
  Gene Name: tripartite motif containing 26
  ENST ID: ENST00000422802
  CDS Start-End: 380-1124

SEQ ID NO: 194848 - DNA, 1124 bp, Homo sapiens; identical to SEQ ID NO: 194809
  Payload ID: 18486
  Gene Name: tripartite motif containing 26
  ENST ID: ENST00000416596
  CDS Start-End: 380-1124

SEQ ID NO: 194849 - DNA, 3318 bp, Homo sapiens
  Payload ID: 18486
  Gene Name: tripartite motif containing 26
  Uniprot ID: Q12899
  ENST ID: ENST00000428486
  CDS Start-End: 278-1897
gggagattacggggcggggacgagctgtcgcgctggttgctcgtgcaggagcgggacccggaacagaccgccgtgagagaggaggggcgccggccgggattcgcggcccggagctcgggaccggttgcttcattccagcctcgcagtcacctctgtgccctgctggttgtcttcccagcgctgctgtagttgccttccatggatctataggagagcaagtcctccaggagaagaagtcctcaccagtgaacggagacctctctgaactaaggataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtgatgtgccgggagtcccgggagcacaggccccacacggccgtcctcatggagaaggccgcccagccccacagggaaaaaatcctgaaccacctgagtaccctaaggagagacagagacaaaattcagggcttccaggcaaagggagaagctgatatcctggccgcgctgaagaagctccaggaccagaggcagtacattgtggctgagtttgagcagggtcatcagttcctgagggagcgggaggaacacctgctggaacagctggcgaagctggagcaggagctcacggagggcagggagaagttcaagagccggggcgtcggggagcttgcccggctggccctggtcatctccgaactggagggcaaggcgcagcagccagctgcagagctcatgcaggacacgagagacttcctaaacaggtatccacggaagaagttctgggttgggaaacccattgctcgagtggttaaaaaaaagaccggagaattctcagataaactcctctctctgcaacgaggcctgagggaattccaggggaagctgctgagagacttggaatataagacagtgagcgtcaccctggacccacagtcggccagtgggtacctgcagctgtcagaggactggaagtgcgtgacctacaccagcctgtacaagagtgcctacctgcacccccagcagtttgactgtgagcctggggtgctgggcagcaagggcttcacctggggcaaggtctactgggaagtggaagtggagagggagggctggtctgaggatgaagaagagggggatgaggaggaagagggagaagaggaggaggaggaagaggaggccggctatggggatggatatgacgactgggaaacggacgaagatgaggaatcgttgggcgatgaagaggaagaagaggaggaggaagaggaggaagttctggaaagctgcatggtgggggtggctagagactctgtgaagaggaagggagacctctccctgcggccagaggatggcgtgtgggcgctgcgcctctcctcctccggcatctgggccaacaccagccccgaggctgagcttttcccagcactgcggccccggagagtgggcatcgccctggattatgaagggggcaccgtgactttcaccaacgcagagtcacaggaactcatctacaccttcactgccaccttcacccggcgcctggtccccttcctgtggctcaagtggccaggaacacgcctcctgctaagaccctgagccctgacatctgcccccagccccaaccctcagatgcttcacttctttggaattccaggactctcaatggggggacgggatgcctggcctaagcacctggagcaggggaccccatatccactggtagccacctccccattgctgtggccccctgaaatctcactcagtgctgttgctccatctactgccctaatggggctcttttcccacctcctgctggtttcccgagggaacttctgaccctggagtccatgagggctcctttcctttttgaccacgaccttggccccagctctgcactctctggaataagggcccgatgcagcattttcttgcccagtgtggcaagacctcagaaaaaccagtcaattacgcctaagatcattttgctgtccttaaaccccccaggttccttcttgcacaaatccactctgctgcccaccttctctggcattttaaacagacctaccccaccccaactcagagttaagcatacatggcaatgctgaaaataaacaaaatccactgaggcttcccaggccatttaaagcctggagtaccagcgcatatcatctcatggggtccagagtggagtccaggcttctctgaaaccagggctgagcatatttccatagccaaggaggtgggactccctggagctatctgtggtcttagggaaggatccagacatacacggctttggggtacaagctgtgatcactgatcaataaattatctctagattggtccttgtgaggggagttttaagaatccagaacatcttgctcttgatcagcacatccaaaaacaccaagacaaacatccagtggagcagaacctctcctgcctcgggagttctgaccgggttccccagcagggtgttaagcctctgtctctggccctaccagcatccaggttccactttcctaggagagagtggagatgggaagacagggaaaggaaggcagcaggaggccacaagcccaccaggtcttcatgtcaagagagggagtaacatgtcttctcattgcccacggacccaacctctgtccaggtgcccctcatcatcacagtttaacacaagctcccctgctccagccaaattgatctcccagtcttgtccttacccattccaagtgctctgccagcccctgttcatccaagttttaagtcctccaccctgttctaagagactgttccaacggctctgggcctcagtggtcacttgaccaccattgtctcagagctgcccactttgtgtgtgtcacatgctgcctgagtcacatgtacatcttatttctgcctctagttttgtaagctcctggagggcggataacatcttatactactcttgtattctcatggcacctagtgcagtgctgggcacagagtaggtgctcaataaagacttgttgaatgaa

SEQ ID NO: 194850 - DNA, 3250 bp, Homo sapiens; identical to SEQ ID NO: 194819
  Payload ID: 18486
  Gene Name: tripartite motif containing 26
  Uniprot ID: Q12899
  ENST ID: ENST00000456770
  CDS Start-End: 210-1829

SEQ ID NO: 194851 - DNA, 3478 bp, Homo sapiens
  Payload ID: 18486
  Gene Name: tripartite motif containing 26
  Uniprot ID: Q12899
  ENST ID: ENST00000415923
  CDS Start-End: 438-2057
aacagaccgccgtgagagaggaggggcgccggccgggattcgcggcccggagctcgggaccggagtcaggaatggagagaagggtaatggtgttacctcttattgtggaaacctgttgagatcacagagaatatactgacggcataaaagggcagaaccatagcagggtgcggttgcttcattccagcctcgcagtcacctctgtgccctgctggttgtcttcccagcgctgctgtagttgccttccatggatctataggagagcaagtcctccaggagctggtggtgtctgtcgattgactgagtgctggagctggcagccctgtgcaggctgccacctttgcccctttactgtgcttgctcctgactctacgtcgcgtctccaaggagaagaagtcctcaccagtgaacggagacctctctgaactaaggataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtgatgtgccgggagtcccgggagcacaggccccacacggccgtcctcatggagaaggccgcccagccccacagggaaaaaatcctgaaccacctgagtaccctaaggagagacagagacaaaattcagggcttccaggcaaagggagaagctgatatcctggccgcgctgaagaagctccaggaccagaggcagtacattgtggctgagtttgagcagggtcatcagttcctgagggagcgggaggaacacctgctggaacagctggcgaagctggagcaggagctcacggagggcagggagaagttcaagagccggggcgtcggggagcttgcccggctggccctggtcatctccgaactggagggcaaggcgcagcagccagctgcagagctcatgcaggacacgagagacttcctaaacaggtatccacggaagaagttctgggttgggaaacccattgctcgagtggttaaaaaaaagaccggagaattctcagataaactcctctctctgcaacgaggcctgagggaattccaggggaagctgctgagagacttggaatataagacagtgagcgtcaccctggacccacagtcggccagtgggtacctgcagctgtcagaggactggaagtgcgtgacctacaccagcctgtacaagagtgcctacctgcacccccagcagtttgactgtgagcctggggtgctgggcagcaagggcttcacctggggcaaggtctactgggaagtggaagtggagagggagggctggtctgaggatgaagaagagggggatgaggaggaagagggagaagaggaggaggaggaagaggaggccggctatggggatggatatgacgactgggaaacggacgaagatgaggaatcgttgggcgatgaagaggaagaagaggaggaggaagaggaggaagttctggaaagctgcatggtgggggtggctagagactctgtgaagaggaagggagacctctccctgcggccagaggatggcgtgtgggcgctgcgcctctcctcctccggcatctgggccaacaccagccccgaggctgagcttttcccagcactgcggccccggagagtgggcatcgccctggattatgaagggggcaccgtgactttcaccaacgcagagtcacaggaactcatctacaccttcactgccaccttcacccggcgcctggtccccttcctgtggctcaagtggccaggaacacgcctcctgctaagaccctgagccctgacatctgcccccagccccaaccctcagatgcttcacttctttggaattccaggactctcaatggggggacgggatgcctggcctaagcacctggagcaggggaccccatatccactggtagccacctccccattgctgtggccccctgaaatctcactcagtgctgttgctccatctactgccctaatggggctcttttcccacctcctgctggtttcccgagggaacttctgaccctggagtccatgagggctcctttcctttttgaccacgaccttggccccagctctgcactctctggaataagggcccgatgcagcattttcttgcccagtgtggcaagacctcagaaaaaccagtcaattacgcctaagatcattttgctgtccttaaaccccccaggttccttcttgcacaaatccactctgctgcccaccttctctggcattttaaacagacctaccccaccccaactcagagttaagcatacatggcaatgctgaaaataaacaaaatccactgaggcttcccaggccatttaaagcctggagtaccagcgcatatcatctcatggggtccagagtggagtccaggcttctctgaaaccagggctgagcatatttccatagccaaggaggtgggactccctggagctatctgtggtcttagggaaggatccagacatacacggctttggggtacaagctgtgatcactgatcaataaattatctctagattggtccttgtgaggggagttttaagaatccagaacatcttgctcttgatcagcacatccaaaaacaccaagacaaacatccagtggagcagaacctctcctgcctcgggagttctgaccgggttccccagcagggtgttaagcctctgtctctggccctaccagcatccaggttccactttcctaggagagagtggagatgggaagacagggaaaggaaggcagcaggaggccacaagcccaccaggtcttcatgtcaagagagggagtaacatgtcttctcattgcccacggacccaacctctgtccaggtgcccctcatcatcacagtttaacacaagctcccctgctccagccaaattgatctcccagtcttgtccttacccattccaagtgctctgccagcccctgttcatccaagttttaagtcctccaccctgttctaagagactgttccaacggctctgggcctcagtggtcacttgaccaccattgtctcagagctgcccactttgtgtgtgtcacatgctgcctgagtcacatgtacatcttatttctgcctctagttttgtaagctcctggagggcggataacatcttatactactcttgtattctcatggcacctagtgcagtgctgggcacagagtaggtgctcaataaagacttgttgaatgaa

SEQ ID NO: 194852 - DNA, 682 bp, Homo sapiens
  Payload ID: 18486
  Gene Name: tripartite motif containing 26
  ENST ID: ENST00000450103
  CDS Start-End: 206-682
ggaaacctgttgagatcacagagaatatactgacggcataaaagggcagaaccatagcagggtgcgcctcgcagtcacctctgtgccctgctggttgtcttcccagcgctgctgtagttgccttccatggatctataggagagcaagtcctccaggagaagaagtcctcaccagtgaacggagacctctctgaactaaggataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggaaaaaatcctgaaccacctgagtaccctaaggagagacagagacaaaattcagggcttccaggcaaagggagaagctgatatcctggccgcgctgaagaagctccaggaccagaggcagtacattgtggctgagtttgagcagggtcatcagttcctgagggagcgggaggaacacctgctggaacagctggcgaagctggagcaggagctcacggagggcagggagaagttcaagagccggggcgtcggggagcttgcccgg

SEQ ID NO: 194853 - DNA, 603 bp, Homo sapiens; identical to SEQ ID NO: 194804
  Payload ID: 18486
  Gene Name: tripartite motif containing 26
  ENST ID: ENST00000453442
  CDS Start-End: 132-603

SEQ ID NO: 194854 - DNA, 3250 bp, Homo sapiens; identical to SEQ ID NO: 194822
  Payload ID: 18486
  Gene Name: tripartite motif containing 26
  Uniprot ID: Q12899
  ENST ID: ENST00000438384
  CDS Start-End: 210-1829

SEQ ID NO: 194855 - DNA, 2686 bp, Homo sapiens
  Payload ID: 18487
  Gene Name: tripartite motif containing 27
  Uniprot ID: P14373
  ENST ID: ENST00000377194
  CDS Start-End: 357-1433
tttacgctgccgccggcatccgctcggacgcggccacgttgtcttgcgcgctttgcccgcctggccctgggactctgaccctcggctaccctttcctgccccactagcgtggccgcgagcctcggtgagccggccgtattcccgctctcgcttagggggcacaggcgcaggcatcggcccggccactccaagccttcggtgcgcgggcgcgtctgggatacgggcccgggaggcgccgccctccgtccgcccggtgcctctcaggaacagcgaaccggagagagcgccggagagttgggctcagtgcagagctcggcgccggggcccatgcccgtgcgcccccgcaggccggcgccatggcctccgggagtgtggccgagtgcctgcagcaggagaccacctgccccgtgtgcctgcagtacttcgcagagcccatgatgctcgactgcggccataacatctgttgcgcgtgcctcgcccgctgctggggcacggcagagactaacgtgtcgtgcccgcagtgccgggagaccttcccgcagaggcacatgcggcccaaccggcacctggccaacgtgacccaactggtaaagcagctgcgcaccgagcggccgtcggggcccggcggcgagatgggcgtgtgcgagaagcaccgcgagcccctgaagctgtactgcgaggaggaccagatgcccatctgcgtggtgtgcgaccgctcccgcgagcaccgcggccacagcgtgctgccgctcgaggaggcggtggagggcttcaaggagcaaatccagaaccagctcgaccatttaaaaagagtgaaagatttaaagaagagacgtcgggcccagggggaacaggcacgagctgaactcttgagcctaacccagatggagagggagaagattgtttgggagtttgagcagctgtatcactccttaaaggagcatgagtatcgcctcctggcccgccttgaggagctagacttggccatctacaatagcatcaatggtgccatcacccagttctcttgcaacatctcccacctcagcagcctgatcgctcagctagaagagaagcagcagcagcccaccagggagctcctgcaggacattggggacacattgagcagggctgaaagaatcaggattcctgaaccttggatcacacctccagatttgcaagagaaaatccacatttttgcccaaaaatgtctattcttgacggagagtctaaagcagttcacagaaaaaatgcagtcagatatggagaaaatccaagaattaagagaggctcagttatactcagtggacgtgactctggacccagacacggcctaccccagcctgatcctctctgataatctgcggcaagtgcggtacagttacctccaacaggacctgcctgacaaccccgagaggtctccttctacaacgtgacagagaggtgtcacaccttcactttctctcatgctaccttttgtgggcctgtccggccctacttcagtctgagttactcgggagggaaaagtgcagctcctctgatcatctgccccatgagtgggatagatgggttttctggccatgttgggaatcatggtcattccatggagacctccccttgaggaggtgaattcaggccaaaagggctgttggctgtaatcctacgccaggcacaaggcatcttgttgccttgccacgtcctgtcacagctgggtatccttaccatgttccacgcccttgcagtgggagacaggatgtccatgttctctaccatccttttccttcccatgcagattgtgaaatgtaatgagatgtatcaagatatcctagaaataaaaaccagatgtccacctccagtgtttcatactttctggttttacacatcgctggagggataaagagtatggataatctttggatttggagagccgttcaagatacttccagcttcttggctcagcctggcttcctctggttcagccccacataatgattatggctatttgctgtcatttctgggctagggctcctttctaacaacctagactggaataaggccctgtcagcatggctccctttatcccagttttccgtctgggaacagtacctctgcccctgattcccaatgtgccatagttttattaactccattaaagaagcctgtatgtgttttggttagttacagttattttacaataatggtgggtaatggccccacctctgttatgagataatgttctaatcaatgtctctgcctttgtatcttttctgagggctttgtctgttctcttcattctaatgaaaggtgtattctagtgctgggtgcatatcatccaggataatattctgcccaactccatcctctgttactagatcccttaccagtcacatttgtggactggtggccagtcgtataccatccctggaaggattctgggacaatattccagggattcattgacttcttggctccttttctccatttcctttgggggaagggggaattgaccatgcttaagtgcatcctatcaaggggcagctccgtccccatggccattggatcatgagacactctgaagtcagaaggctggggcagatcacttcaagcaagcccccatgatggttctcagtcctgcttctctgtgggtacgtgcccctctgtttaaaaataaactgaatatggatgttta

SEQ ID NO: 194856 - DNA, 2967 bp, Homo sapiens
  Payload ID: 18487
  Gene Name: tripartite motif containing 27
  Uniprot ID: P14373
  ENST ID: ENST00000377199
  CDS Start-End: 358-1899
gtttacgctgccgccggcatccgctcggacgcggccacgttgtcttgcgcgctttgcccgcctggccctgggactctgaccctcggctaccctttcctgccccactagcgtggccgcgagcctcggtgagccggccgtattcccgctctcgcttagggggcacaggcgcaggcatcggcccggccactccaagccttcggtgcgcgggcgcgtctgggatacgggcccgggaggcgccgccctccgtccgcccggtgcctctcaggaacagcgaaccggagagagcgccggagagttgggctcagtgcagagctcggcgccggggcccatgcccgtgcgcccccgcaggccggcgccatggcctccgggagtgtggccgagtgcctgcagcaggagaccacctgccccgtgtgcctgcagtacttcgcagagcccatgatgctcgactgcggccataacatctgttgcgcgtgcctcgcccgctgctggggcacggcagagactaacgtgtcgtgcccgcagtgccgggagaccttcccgcagaggcacatgcggcccaaccggcacctggccaacgtgacccaactggtaaagcagctgcgcaccgagcggccgtcggggcccggcggcgagatgggcgtgtgcgagaagcaccgcgagcccctgaagctgtactgcgaggaggaccagatgcccatctgcgtggtgtgcgaccgctcccgcgagcaccgcggccacagcgtgctgccgctcgaggaggcggtggagggcttcaaggagcaaatccagaaccagctcgaccatttaaaaagagtgaaagatttaaagaagagacgtcgggcccagggggaacaggcacgagctgaactcttgagcctaacccagatggagagggagaagattgtttgggagtttgagcagctgtatcactccttaaaggagcatgagtatcgcctcctggcccgccttgaggagctagacttggccatctacaatagcatcaatggtgccatcacccagttctcttgcaacatctcccacctcagcagcctgatcgctcagctagaagagaagcagcagcagcccaccagggagctcctgcaggacattggggacacattgagcagggctgaaagaatcaggattcctgaaccttggatcacacctccagatttgcaagagaaaatccacatttttgcccaaaaatgtctattcttgacggagagtctaaagcagttcacagaaaaaatgcagtcagatatggagaaaatccaagaattaagagaggctcagttatactcagtggacgtgactctggacccagacacggcctaccccagcctgatcctctctgataatctgcggcaagtgcggtacagttacctccaacaggacctgcctgacaaccccgagaggttcaatctgtttccctgtgtcttgggctctccatgcttcatcgccgggagacattattgggaggtagaggtgggagataaagccaagtggaccataggtgtctgtgaagactcagtgtgcagaaaaggtggagtaacctcagccccccagaatggattctgggcagtgtctttgtggtatgggaaagaatattgggctcttacctccccaatgactgccctacccctgcggaccccgctccagcgggtggggattttcttggactatgatgctggtgaggtctccttctacaacgtgacagagaggtgtcacaccttcactttctctcatgctaccttttgtgggcctgtccggccctacttcagtctgagttactcgggagggaaaagtgcagctcctctgatcatctgccccatgagtgggatagatgggttttctggccatgttgggaatcatggtcattccatggagacctccccttgaggaggtgaattcaggccaaaagggctgttggctgtaatcctacgccaggcacaaggcatcttgttgccttgccacgtcctgtcacagctgggtatccttaccatgttccacgcccttgcagtgggagacaggatgtccatgttctctaccatccttttccttcccatgcagattgtgaaatgtaatgagatgtatcaagatatcctagaaataaaaaccagatgtccacctccagtgtttcatactttctggttttacacatcgctggagggataaagagtatggataatctttggatttggagagccgttcaagatacttccagcttcttggctcagcctggcttcctctggttcagccccacataatgattatggctatttgctgtcatttctgggctagggctcctttctaacaacctagactggaataaggccctgtcagcatggctccctttatcccagttttccgtctgggaacagtacctctgcccctgattcccaatgtgccatagttttattaactccattaaagaagcctgtatgtgttttggttagttacagttattttacaataatggtgggtaatggccccacctctgttatgagataatgttctaatcaatgtctctgcctttgtatcttttctgagggctttgtctgttctcttcattctaatgaaaggtgtattctagtgctgggtgcatatcatccaggataatattctgcccaactccatcctctgttactagatcccttaccagtcacatttgtggactggtggccagtcgtataccatccctggaaggattctgggacaatattccagggattcattgacttcttggctccttttctccatttcctttgggggaagggggaattgaccatgcttaagtgcatcctatcaaggggcagctccgtccccatggccattggatcatgagacactctgaagtcagaaggctggggcagatcacttcaagcaagcccccatgatggttctcagtcctgcttctctgtgggtacgtgcccctctgtttaaaaataaactgaatatggatgttta

SEQ ID NO: 194857 - DNA, 2967 bp, Homo sapiens; identical to SEQ ID NO: 194856
  Payload ID: 18487
  Gene Name: tripartite motif containing 27
  Uniprot ID: P14373
  ENST ID: ENST00000400720
  CDS Start-End: 358-1899

SEQ ID NO: 194858 - DNA, 2686 bp, Homo sapiens
  Payload ID: 18487
  Gene Name: tripartite motif containing 27
  Uniprot ID: P14373
  ENST ID: ENST00000427689
  CDS Start-End: 357-1433
tttacgctgccgccggcatccgctcggacgcggccacgttgtcttgcgcgctttgcccgcctggccctgggactctgaccctcggctaccctttcctgccccactagcgtggccgcgagcctcggtgagccggccgtattcccgctctcgcttagggggcacaggcgcaggcatcggcccggccactccaagccttcggtgcgcgggcgcgtctgggatacgggcccgggaggcgccgccctccgtccgcccggtgcctctcaggaacagcgaaccggagagagcgccggagagttgggctcagtgcagagctcggcgccggggcccatgcccgtgcgcccccgcaggccggcgccatggcctccgggagtgtggccgagtgcctgcagcaggagaccacctgccccgtgtgcctgcagtacttcgcagagcccatgatgctcgactgcggccataacatctgttgcgcgtgcctcgcccgctgctggggcacggcagagactaacgtgtcgtgcccgcagtgccgggagaccttcccgcagaggcacatgcggcccaaccggcacctggccaacgtgacccaactggtgaagcagctgcgcaccgagcggccgtcggggcccggcggcgagatgggcgtgtgcgagaagcaccgcgagcccctgaagctgtactgcgaggaggaccagatgcccatctgcgtggtgtgcgaccgctcccgcgagcaccgcggccacagcgtgctgccgctcgaggaggcggtggagggcttcaaggagcaaatccagaaccagctcgaccatttaaaaagagtgaaagatttaaagaagagacgtcgggcccagggggaacaggcacgagctgaactcttgagcctaacccagatggagagggagaagattgtttgggagtttgagcagctgtatcactccttaaaggagcatgagtatcgcctcctggcccgccttgaggagctagacttggccatctacaatagcatcaatggtgccatcacccagttctcttgcaacatctcccacctcagcagcctgatcgctcagctagaagagaagcagcagcagcccaccagggagctcctgcaggacattggggacacattgagcagggctgaaagaatcaggattcctgaaccttggatcacacctccagatttgcaagagaaaatccacatttttgcccaaaaatgtctattcttgacggagagtctaaagcagttcacagaaaaaatgcagtcagatatggagaaaatccaagaattaagagaggctcagttatactcagtggacgtgactctggacccagacacggcctaccccagcctgatcctctctgataatctgcggcaagtgcggtacagttacctccaacaggacctgcctgacaaccccgagaggtctccttctacaacgtgacagagaggtgtcacaccttcactttctctcatgctaccttttgtgggcctgtccggccctacttcagtctgagttactcgggagggaaaagtgcagctcctctgatcatctgccccatgagtgggatagatgggttttctggccatgttgggaatcatggtcattccatggagacctccccttgaggaggtgaattcaggccaaaagggctgttggctgtaatcctacgccaggcacaaggcatcttgttgccttgccacgtcctgtcacagctgggtatccttaccatgttccacgcccttgcagtgggagacaggatgtccatgttctctaccatccttttccttcccatgcagattgtgaaatgtaatgagatgtatcaagatatcctagaaataaaaaccagatgtccacctccagtgtttcatactttctggttttacacatcgctggagggataaagagtatggataatctttggatttggagagccgttcaagatacttccagcttcttggctcagcctggcttcctctggttcagccccacataatgattatggctatttgctgtcatttctgggctagggctcctttctaacaacctagactggaataaggccctgtcagcatggctccctttatcccagttttccgtctgggaacagtacctctgcccctgattcccaatgtgccatagttttattaactccattaaagaagcctgtatgtgttttggttagttacagttattttacaataatggtgggtaatggccccacctctgttatgagataatgttctaatcaatgtctctgcctttgtatcttttctgagggctttgtctgttctcttcattctaatgaaaggtgtattctagtgctgggtgcatatcatccaggataatattctgcccaactccatcctctgttactagatcccttaccagtcacatttgtggactggtggccagtcgtataccatccctggaaggattctgggacaatattccagggattcattgacttcttggctccttttctccatttcctttgggggaagggggaattgaccatgcttaagtgcatcctatcaaggggcagctccgtccccatggccattggatcatgagacactctgaagtcagaaggctggggcagatcacttcaagcaagcccccatgatggttctcagtcctgcttctctgtgggtacgtgcccctctgtttaaaaataaactgaatatggatgttta

SEQ ID NO: 194859 - DNA, 2967 bp, Homo sapiens; identical to SEQ ID NO: 194856
  Payload ID: 18487
  Gene Name: tripartite motif containing 27
  Uniprot ID: P14373
  ENST ID: ENST00000437160
  CDS Start-End: 358-1899

SEQ ID NO: 194860 - DNA, 1813 bp, Homo sapiens
  Payload ID: 18487
  Gene Name: tripartite motif containing 27
  ENST ID: ENST00000453610
  CDS Start-End: 1-745
tctaaagcagttcacagaaaaaatgcagtcagatatggagaaaatccaagaatcagctgactcactggaaggtggaattcttgatcttggctcagttttatcccatattctaccagtctcagaattaagagaggctcagttatactcagtggacgtgactctggacccagacacggcctaccccagcctgatcctctctgataatctgcggcaagtgcggtacagttacctccaacaggacctgcctgacaaccccgagaggttcaatctgtttccctgtgtcttgggctctccatgcttcatcgccgggagacattattgggaggtagaggtgggagataaagccaagtggaccataggtgtctgtgaagactcagtgtgcagaaaaggtggagtaacctcagccccccagaatggattctgggcagtgtctttgtggtatgggaaagaatattgggctcttacctccccaatgactgccctacccctgcggaccccgctccagcgggtggggattttcttggactatgatgctggtgaggtctccttctacaacgtgacagagaggtgtcacaccttcactttctctcatgctaccttttgtgggcctgtccggccctacttcagtctgagttactcgggagggaaaagtgcagctcctctgatcatctgccccatgagtgggatagatgggttttctggccatgttgggaatcatggtcattccatggagacctccccttgaggaggtgaattcaggccaaaagggctgttggctgtaatcctacgccaggcacaaggcatcttgttgccttgccacgtcctgtcacagctgggtatccttaccatgttccacgcccttgcagtgggagacaggatgtccatgttctctaccatccttttccttcccatgcagattgtgaaatgtaatgagatgtatcaagatatcctagaaataaaaaccagatgtccacctccagtgtttcatactttctggttttacacatcgctggagggataaagagtatggataatctttggatttggagagccgttcaagatacttccagcttcttggctcagcctggcttcctctggttcagccccacataatgattatggctatttgctgtcatttctgggctagggctcctttctaacaacctagactggaataaggccctgtcagcatggctccctttatcccagttttccgtctgggaacagtacctctgcccctgattcccaatgtgccatagttttattaactccattaaagaagcctgtatgtgttttggttagttacagttattttacaataatggtgggtaatggccccacctctgttatgagataatgttctaatcaatgtctctgcctttgtatcttttctgagggctttgtctgttctcttcattctaatgaaaggtgtattctagtgctgggtgcatatcatccaggataatattctgcccaactccatcctctgttactagatcccttaccagtcacatttgtggactggtggccagtcgtataccatccctggaaggattctgggacaatattccagggattcattgacttcttggctccttttctccatttcctttgggggaagggggaattgaccatgcttaagtgcatcctatcaaggggcagctccgtccccatggccattggatcatgagacactctgaagtcagaaggctggggcagatcacttcaagcaagcccccatgatggttctcagtcctgcttctctgtgggtacgtgcccctctgtttaaaaataaactgaatatggatgttta

SEQ ID NO: 194861 - DNA, 1103 bp, Homo sapiens
  Payload ID: 18487
  Gene Name: tripartite motif containing 27
  ENST ID: ENST00000430891
  CDS Start-End: 357-1103
tttacgctgccgccggcatccgctcggacgcggccacgttgtcttgcgcgctttgcccgcctggccctgggactctgaccctcggctaccctttcctgccccactagcgtggccgcgagcctcggtgagccggccgtattcccgctctcgcttagggggcacaggcgcaggcatcggcccggccactccaagccttcggtgcgcgggcgcgtctgggatacgggcccgggaggcgccgccctccgtccgcccggtgcctctcaggaacagcgaaccggagagagcgccggagagttgggctcagtgcggagctcggcgccggggcccatgcccgtgcgcccccgcaggccggcgccatggcctccgggagtgtggccgagtgcctgcagcaggagaccacctgccccgtgtgcctgcagtacttcgcagagcccatgatgctcgactgcggccataacatctgttgcgcgtgcctcgcccgctgctggggcacggcagagactaacgtgtcgtgcccgcagtgccgggagaccttcccgcagaggcacatgcggcccaaccggcacctggccaacgtgacccaactggtaaagcagctgcgcaccgagcggccgtcggggcccggcggcgagatgggcgtgtgcgagaagcaccgcgagcccctgaagctgtactgcgaggaggaccagatgcccatctgcgtggtgtgcgaccgctcccgcgagcaccgcggccacagcgtgctgccgctcgaggaggcggtggagggcttcaaggagcaaatccagaaccagctcgaccatttaaaaagagtgaaagatttaaagaagagacgtcgggcccagggggaacaggcacgagctgaactcttgagcctaacccagatggagagggagaagattgtttgggagtttgagcagctgtatcactccttaaaggagcatgagtatcgcctcctggcccgccttgaggagctagacttggccatctacaatagcatcaatggtgccatcacccagttctcttgcaacatctcccacctcagcagcctgatcgctcagctagaagagaagcagcagcagcccaccagggagctcctgcag

SEQ ID NO: 194862 - DNA, 1813 bp, Homo sapiens; identical to SEQ ID NO: 194860
  Payload ID: 18487
  Gene Name: tripartite motif containing 27
  ENST ID: ENST00000417993
  CDS Start-End: 1-745

SEQ ID NO: 194863 - DNA, 1691 bp, Homo sapiens
  Payload ID: 18487
  Gene Name: tripartite motif containing 27
  ENST ID: ENST00000445968
  CDS Start-End: 1-623
aattaagagaggctcagttatactcagtggacgtgactctggacccagacacggcctaccccagcctgatcctctctgataatctgcggcaagtgcggtacagttacctccaacaggacctgcctgacaaccccgagaggttcaatctgtttccctgtgtcttgggctctccatgcttcatcgccgggagacattattgggaggtagaggtgggagataaagccaagtggaccataggtgtctgtgaagactcagtgtgcagaaaaggtggagtaacctcagccccccagaatggattctgggcagtgtctttgtggtatgggaaagaatattgggctcttacctccccaatgactgccctacccctgcggaccccgctccagcgggtggggattttcttggactatgatgctggtgaggtctccttctacaacgtgacagagaggtgtcacaccttcactttctctcatgctaccttttgtgggcctgtccggccctacttcagtctgagttactcgggagggaaaagtgcagctcctctgatcatctgccccatgagtgggatagatgggttttctggccatgttgggaatcatggtcattccatggagacctccccttgaggaggtgaattcaggccaaaagggctgttggctgtaatcctacgccaggcacaaggcatcttgttgccttgccacgtcctgtcacagctgggtatccttaccatgttccacgcccttgcagtgggagacaggatgtccatgttctctaccatccttttccttcccatgcagattgtgaaatgtaatgagatgtatcaagatatcctagaaataaaaaccagatgtccacctccagtgtttcatactttctggttttacacatcgctggagggataaagagtatggataatctttggatttggagagccgttcaagatacttccagcttcttggctcagcctggcttcctctggttcagccccacataatgattatggctatttgctgtcatttctgggctagggctcctttctaacaacctagactggaataaggccctgtcagcatggctccctttatcccagttttccgtctgggaacagtacctctgcccctgattcccaatgtgccatagttttattaactccattaaagaagcctgtatgtgttttggttagttacagttattttacaataatggtgggtaatggccccacctctgttatgagataatgttctaatcaatgtctctgcctttgtatcttttctgagggctttgtctgttctcttcattctaatgaaaggtgtattctagtgctgggtgcatatcatccaggataatattctgcccaactccatcctctgttactagatcccttaccagtcacatttgtggactggtggccagtcgtataccatccctggaaggattctgggacaatattccagggattcattgacttcttggctccttttctccatttcctttgggggaagggggaattgaccatgcttaagtgcatcctatcaaggggcagctccgtccccatggccattggatcatgagacactctgaagtcagaaggctggggcagatcacttcaagcaagcccccatgatggttctcagtcctgcttctctgtgggtacgtgcccctctgtttaaaaataaactgaatatggatgttta

SEQ ID NO: 194864 - DNA, 1813 bp, Homo sapiens; identical to SEQ ID NO: 194860
  Payload ID: 18487
  Gene Name: tripartite motif containing 27
  ENST ID: ENST00000414543
  CDS Start-End: 1-745

SEQ ID NO: 194865 - DNA, 1813 bp, Homo sapiens; identical to SEQ ID NO: 194860
  Payload ID: 18487
  Gene Name: tripartite motif containing 27
  ENST ID: ENST00000430208
  CDS Start-End: 1-745

SEQ ID NO: 194866 - DNA, 1104 bp, Homo sapiens
  Payload ID: 18487
  Gene Name: tripartite motif containing 27
  ENST ID: ENST00000455861
  CDS Start-End: 358-1104
gtttacgctgccgccggcatccgctcggacgcggccacgttgtcttgcgcgctttgcccgcctggccctgggactctgaccctcggctaccctttcctgccccactagcgtggccgcgagcctcggtgagccggccgtattcccgctctcgcttagggggcacaggcgcaggcatcggcccggccactccaagccttcggtgcgcgggcgcgtctgggatacgggcccgggaggcgccgccctccgtccgcccggtgcctctcaggaacagcgaaccggagagagcgccggagagttgggctcagtgcggagctcggcgccggggcccatgcccgtgcgcccccgcaggccggcgccatggcctccgggagtgtggccgagtgcctgcagcaggagaccacctgccccgtgtgcctgcagtacttcgcagagcccatgatgctcgactgcggccataacatctgttgcgcgtgcctcgcccgctgctggggcacggcagagactaacgtgtcgtgcccgcagtgccgggagaccttcccgcagaggcacatgcggcccaaccggcacctggccaacgtgacccaactggtaaagcagctgcgcaccgagcggccgtcggggcccggcggcgagatgggcgtgtgcgagaagcaccgcgagcccctgaagctgtactgcgaggaggaccagatgcccatctgcgtggtgtgcgaccgctcccgcgagcaccgcggccacagcgtgctgccgctcgaggaggcggtggagggcttcaaggagcaaatccagaaccagctcgaccatttaaaaagagtgaaagatttaaagaagagacgtcgggcccagggggaacaggcacgagctgaactcttgagcctaacccagatggagagggagaagattgtttgggagtttgagcagctgtatcactccttaaaggagcatgagtatcgcctcctggcccgccttgaggagctagacttggccatctacaatagcatcaatggtgccatcacccagttctcttgcaacatctcccacctcagcagcctgatcgctcagctagaagagaagcagcagcagcccaccagggagctcctgcag

SEQ ID NO: 194867 - DNA, 2967 bp, Homo sapiens
  Payload ID: 18487
  Gene Name: tripartite motif containing 27
  Uniprot ID: P14373
  ENST ID: ENST00000435528
  CDS Start-End: 358-1899
gtttacgctgccgccggcatccgctcggacgcggccacgttgtcttgcgcgctttgcccgcctggccctgggactctgaccctcggctaccctttcctgccccactagcgtggccgcgagcctcggtgagccggccgtattcccgctctcgcttagggggcacaggcgcaggcatcggcccggccactccaagccttcggtgcgcgggcgcgtctgggatacgggcccgggaggcgccgccctccgtccgcccggtgcctctcaggaacagcgaaccggagagagcgccggagagttgggctcagtgcagagctcggcgccggggcccatgcccgtgcgcccccgcaggccggcgccatggcctccgggagtgtggccgagtgcctgcagcaggagaccacctgccccgtgtgcctgcagtacttcgcagagcccatgatgctcgactgcggccataacatctgttgcgcgtgcctcgcccgctgctggggcacggcagagactaacgtgtcgtgcccgcagtgccgggagaccttcccgcagaggcacatgcggcccaaccggcacctggccaacgtgacccaactggtgaagcagctgcgcaccgagcggccgtcggggcccggcggcgagatgggcgtgtgcgagaagcaccgcgagcccctgaagctgtactgcgaggaggaccagatgcccatctgcgtggtgtgcgaccgctcccgcgagcaccgcggccacagcgtgctgccgctcgaggaggcggtggagggcttcaaggagcaaatccagaaccagctcgaccatttaaaaagagtgaaagatttaaagaagagacgtcgggcccagggggaacaggcacgagctgaactcttgagcctaacccagatggagagggagaagattgtttgggagtttgagcagctgtatcactccttaaaggagcatgagtatcgcctcctggcccgccttgaggagctagacttggccatctacaatagcatcaatggtgccatcacccagttctcttgcaacatctcccacctcagcagcctgatcgctcagctagaagagaagcagcagcagcccaccagggagctcctgcaggacattggggacacattgagcagggctgaaagaatcaggattcctgaaccttggatcacacctccagatttgcaagagaaaatccacatttttgcccaaaaatgtctattcttgacggagagtctaaagcagttcacagaaaaaatgcagtcagatatggagaaaatccaagaattaagagaggctcagttatactcagtggacgtgactctggacccagacacggcctaccccagcctgatcctctctgataatctgcggcaagtgcggtacagttacctccaacaggacctgcctgacaaccccgagaggttcaatctgtttccctgtgtcttgggctctccatgcttcatcgccgggagacattattgggaggtagaggtgggagataaagccaagtggaccataggtgtctgtgaagactcagtgtgcagaaaaggtggagtaacctcagccccccagaatggattctgggcagtgtctttgtggtatgggaaagaatattgggctcttacctccccaatgactgccctacccctgcggaccccgctccagcgggtggggattttcttggactatgatgctggtgaggtctccttctacaacgtgacagagaggtgtcacaccttcactttctctcatgctaccttttgtgggcctgtccggccctacttcagtctgagttactcgggagggaaaagtgcagctcctctgatcatctgccccatgagtgggatagatgggttttctggccatgttgggaatcatggtcattccatggagacctccccttgaggaggtgaattcaggccaaaagggctgttggctgtaatcctacgccaggcacaaggcatcttgttgccttgccacgtcctgtcacagctgggtatccttaccatgttccacgcccttgcagtgggagacaggatgtccatgttctctaccatccttttccttcccatgcagattgtgaaatgtaatgagatgtatcaagatatcctagaaataaaaaccagatgtccacctccagtgtttcatactttctggttttacacatcgctggagggataaagagtatggataatctttggatttggagagccgttcaagatacttccagcttcttggctcagcctggcttcctctggttcagccccacataatgattatggctatttgctgtcatttctgggctagggctcctttctaacaacctagactggaataaggccctgtcagcatggctccctttatcccagttttccgtctgggaacagtacctctgcccctgattcccaatgtgccatagttttattaactccattaaagaagcctgtatgtgttttggttagttacagttattttacaataatggtgggtaatggccccacctctgttatgagataatgttctaatcaatgtctctgcctttgtatcttttctgagggctttgtctgttctcttcattctaatgaaaggtgtattctagtgctgggtgcatatcatccaggataatattctgcccaactccatcctctgttactagatcccttaccagtcacatttgtggactggtggccagtcgtataccatccctggaaggattctgggacaatattccagggattcattgacttcttggctccttttctccatttcctttgggggaagggggaattgaccatgcttaagtgcatcctatcaaggggcagctccgtccccatggccattggatcatgagacactctgaagtcagaaggctggggcagatcacttcaagcaagcccccatgatggttctcagtcctgcttctctgtgggtacgtgcccctctgtttaaaaataaactgaatatggatgttta

SEQ ID NO: 194868 - DNA, 1763 bp, Homo sapiens
  Payload ID: 18487
  Gene Name: tripartite motif containing 27
  ENST ID: ENST00000443804
  CDS Start-End: 1-695
aatcagctgactcactggaaggtggaattcttgatcttggctcagttttatcccatattctaccagtctcagaattaagagaggctcagttatactcagtggacgtgactctggacccagacacggcctaccccagcctgatcctctctgataatctgcggcaagtgcggtacagttacctccaacaggacctgcctgacaaccccgagaggttcaatctgtttccctgtgtcttgggctctccatgcttcatcgccgggagacattattgggaggtagaggtgggagataaagccaagtggaccataggtgtctgtgaagactcagtgtgcagaaaaggtggagtaacctcagccccccagaatggattctgggcagtgtctttgtggtatgggaaagaatattgggctcttacctccccaatgactgccctacccctgcggaccccgctccagcgggtggggattttcttggactatgatgctggtgaggtctccttctacaacgtgacagagaggtgtcacaccttcactttctctcatgctaccttttgtgggcctgtccggccctacttcagtctgagttactcgggagggaaaagtgcagctcctctgatcatctgccccatgagtgggatagatgggttttctggccatgttgggaatcatggtcattccatggagacctccccttgaggaggtgaattcaggccaaaagggctgttggctgtaatcctacgccaggcacaaggcatcttgttgccttgccacgtcctgtcacagctgggtatccttaccatgttccacgcccttgcagtgggagacaggatgtccatgttctctaccatccttttccttcccatgcagattgtgaaatgtaatgagatgtatcaagatatcctagaaataaaaaccagatgtccacctccagtgtttcatactttctggttttacacatcgctggagggataaagagtatggataatctttggatttggagagccgttcaagatacttccagcttcttggctcagcctggcttcctctggttcagccccacataatgattatggctatttgctgtcatttctgggctagggctcctttctaacaacctagactggaataaggccctgtcagcatggctccctttatcccagttttccgtctgggaacagtacctctgcccctgattcccaatgtgccatagttttattaactccattaaagaagcctgtatgtgttttggttagttacagttattttacaataatggtgggtaatggccccacctctgttatgagataatgttctaatcaatgtctctgcctttgtatcttttctgagggctttgtctgttctcttcattctaatgaaaggtgtattctagtgctgggtgcatatcatccaggataatattctgcccaactccatcctctgttactagatcccttaccagtcacatttgtggactggtggccagtcgtataccatccctggaaggattctgggacaatattccagggattcattgacttcttggctccttttctccatttcctttgggggaagggggaattgaccatgcttaagtgcatcctatcaaggggcagctccgtccccatggccattggatcatgagacactctgaagtcagaaggctggggcagatcacttcaagcaagcccccatgatggttctcagtcctgcttctctgtgggtacgtgcccctctgtttaaaaataaactgaatatggatgttta

SEQ ID NO: 194869 - DNA, 1104 bp, Homo sapiens
  Payload ID: 18487
  Gene Name: tripartite motif containing 27
  ENST ID: ENST00000437415
  CDS Start-End: 358-1104
gtttacgctgccgccggcatccgctcggacgcggccacgttgtcttgcgcgctttgcccgcctggccctgggactctgaccctcggctaccctttcctgccccactagcgtggccgcgagcctcggtgagccggccgtattcccgctctcgcttagggggcacaggcgcaggcatcggcccggccactccaagccttcggtgcgcgggcgcgtctgggatacgggcccgggaggcgccgccctccgtccgcccggtgcctctcaggaacagcgaaccggagagagcgccggagagttgggctcagtgcagagctcggcgccggggcccatgcccgtgcgcccccgcaggccggcgccatggcctccgggagtgtggccgagtgcctgcagcaggagaccacctgccccgtgtgcctgcagtacttcgcagagcccatgatgctcgactgcggccataacatctgttgcgcgtgcctcgcccgctgctggggcacggcagagactaacgtgtcgtgcccgcagtgccgggagaccttcccgcagaggcacatgcggcccaaccggcacctggccaacgtgacccaactggtaaagcagctgcgcaccgagcggccgtcggggcccggcggcgagatgggcgtgtgcgagaagcaccgcgagcccctgaagctgtactgcgaggaggaccagatgcccatctgcgtggtgtgcgaccgctcccgcgagcaccgcggccacagcgtgctgccgctcgaggaggcggtggagggcttcaaggagcaaatccagaaccagctcgaccatttaaaaagagtgaaagatttaaagaagagacgtcgggcccagggggaacaggcacgagctgaactcttgagcctaacccagatggagagggagaagattgtttgggagtttgagcagctgtatcactccttaaaggagcatgagtatcgcctcctggcccgccttgaggagctagacttggccatctacaatagcatcaatggtgccatcacccagttctcttgcaacatctcccacctcagcagcctgatcgctcagctagaagagaagcagcagcagcccaccagggagctcctgcag

SEQ ID NO: 194870 - DNA, 1411 bp, Homo sapiens
  Payload ID: 18487
  Gene Name: tripartite motif containing 27
  ENST ID: ENST00000440169
  CDS Start-End: 1-158
aattaagagaggctcagttatactcagtggacgtgactctggacccagacacggcctaccccagcctgatcctctctgataatctgcggcaagtgcggtacagttacctccaacaggacctgcctgacaaccccgagaggtctccttctacaacgtgacagagaggtgtcacaccttcactttctctcatgctaccttttgtgggcctgtccggccctacttcagtctgagttactcgggagggaaaagtgcagctcctctgatcatctgccccatgagtgggatagatgggttttctggccatgttgggaatcatggtcattccatggagacctccccttgaggaggtgaattcaggccaaaagggctgttggctgtaatcctacgccaggcacaaggcatcttgttgccttgccacgtcctgtcacagctgggtatccttaccatgttccacgcccttgcagtgggagacaggatgtccatgttctctaccatccttttccttcccatgcagattgtgaaatgtaatgagatgtatcaagatatcctagaaataaaaaccagatgtccacctccagtgtttcatactttctggttttacacatcgctggagggataaagagtatggataatctttggatttggagagccgttcaagatacttccagcttcttggctcagcctggcttcctctggttcagccccacataatgattatggctatttgctgtcatttctgggctagggctcctttctaacaacctagactggaataaggccctgtcagcatggctccctttatcccagttttccgtctgggaacagtacctctgcccctgattcccaatgtgccatagttttattaactccattaaagaagcctgtatgtgttttggttagttacagttattttacaataatggtgggtaatggccccacctctgttatgagataatgttctaatcaatgtctctgcctttgtatcttttctgagggctttgtctgttctcttcattctaatgaaaggtgtattctagtgctgggtgcatatcatccaggataatattctgcccaactccatcctctgttactagatcccttaccagtcacatttgtggactggtggccagtcgtataccatccctggaaggattctgggacaatattccagggattcattgacttcttggctccttttctccatttcctttgggggaagggggaattgaccatgcttaagtgcatcctatcaaggggcagctccgtccccatggccattggatcatgagacactctgaagtcagaaggctggggcagatcacttcaagcaagcccccatgatggttctcagtcctgcttctctgtgggtacgtgcccctctgtttaaaaataaactgaatatggatgttta

SEQ ID NO: 194871 - DNA, 2686 bp, Homo sapiens; identical to SEQ ID NO: 194855
  Payload ID: 18487
  Gene Name: tripartite motif containing 27
  Uniprot ID: P14373
  ENST ID: ENST00000417660
  CDS Start-End: 357-1433

SEQ ID NO: 194872 - DNA, 2686 bp, Homo sapiens
  Payload ID: 18487
  Gene Name: tripartite motif containing 27
  Uniprot ID: P14373
  ENST ID: ENST00000452265
  CDS Start-End: 357-1433
tttacgctgccgccggcatccgctcggacgcggccacgttgtcttgcgcgctttgcccgcctggccctgggactctgaccctcggctaccctttcctgccccactagcgtggccgcgagcctcggtgagccggccgtattcccgctctcgcttagggggcacaggcgcaggcatcggcccggccactccaagccttcggtgcgcgggcgcgtctgggatacgggcccgggaggcgccgccctccgtccgcccggtgcctctcaggaacagcgaaccggagagagcgccggagagttgggctcagtgcggagctcggcgccggggcccatgcccgtgcgcccccgcaggccggcgccatggcctccgggagtgtggccgagtgcctgcagcaggagaccacctgccccgtgtgcctgcagtacttcgcagagcccatgatgctcgactgcggccataacatctgttgcgcgtgcctcgcccgctgctggggcacggcagagactaacgtgtcgtgcccgcagtgccgggagaccttcccgcagaggcacatgcggcccaaccggcacctggccaacgtgacccaactggtaaagcagctgcgcaccgagcggccgtcggggcccggcggcgagatgggcgtgtgcgagaagcaccgcgagcccctgaagctgtactgcgaggaggaccagatgcccatctgcgtggtgtgcgaccgctcccgcgagcaccgcggccacagcgtgctgccgctcgaggaggcggtggagggcttcaaggagcaaatccagaaccagctcgaccatttaaaaagagtgaaagatttaaagaagagacgtcgggcccagggggaacaggcacgagctgaactcttgagcctaacccagatggagagggagaagattgtttgggagtttgagcagctgtatcactccttaaaggagcatgagtatcgcctcctggcccgccttgaggagctagacttggccatctacaatagcatcaatggtgccatcacccagttctcttgcaacatctcccacctcagcagcctgatcgctcagctagaagagaagcagcagcagcccaccagggagctcctgcaggacattggggacacattgagcagggctgaaagaatcaggattcctgaaccttggatcacacctccagatttgcaagagaaaatccacatttttgcccaaaaatgtctattcttgacggagagtctaaagcagttcacagaaaaaatgcagtcagatatggagaaaatccaagaattaagagaggctcagttatactcagtggacgtgactctggacccagacacggcctaccccagcctgatcctctctgataatctgcggcaagtgcggtacagttacctccaacaggacctgcctgacaaccccgagaggtctccttctacaacgtgacagagaggtgtcacaccttcactttctctcatgctaccttttgtgggcctgtccggccctacttcagtctgagttactcgggagggaaaagtgcagctcctctgatcatctgccccatgagtgggatagatgggttttctggccatgttgggaatcatggtcattccatggagacctccccttgaggaggtgaattcaggccaaaagggctgttggctgtaatcctacgccaggcacaaggcatcttgttgccttgccacgtcctgtcacagctgggtatccttaccatgttccacgcccttgcagtgggagacaggatgtccatgttctctaccatccttttccttcccatgcagattgtgaaatgtaatgagatgtatcaagatatcctagaaataaaaaccagatgtccacctccagtgtttcatactttctggttttacacatcgctggagggataaagagtatggataatctttggatttggagagccgttcaagatacttccagcttcttggctcagcctggcttcctctggttcagccccacataatgattatggctatttgctgtcatttctgggctagggctcctttctaacaacctagactggaataaggccctgtcagcatggctccctttatcccagttttccgtctgggaacagtacctctgcccctgattcccaatgtgccatagttttattaactccattaaagaagcctgtatgtgttttggttagttacagttattttacaataatggtgggtaatggccccacctctgttatgagataatgttctaatcaatgtctctgcctttgtatcttttctgagggctttgtctgttctcttcattctaatgaaaggtgtattctagtgctgggtgcatatcatccaggataatattctgcccaactccatcctctgttactagatcccttaccagtcacatttgtggactggtggccagtcgtataccatccctggaaggattctgggacaatattccagggattcattgacttcttggctccttttctccatttcctttgggggaagggggaattgaccatgcttaagtgcatcctatcaaggggcagctccgtccccatggccattggatcatgagacactctgaagtcagaaggctggggcagatcacttcaagcaagcccccatgatggttctcagtcctgcttctctgtgggtacgtgcccctctgtttaaaaataaactgaatatggatgttta

SEQ ID NO: 194873 - DNA, 2901 bp, Homo sapiens
  Payload ID: 18487
  Gene Name: tripartite motif containing 27
  Uniprot ID: P14373
  ENST ID: ENST00000431123
  CDS Start-End: 292-1833
cctgggactctgaccctcggctaccctttcctgccccactagcgtggccgcgagcctcggtgagccggccgtattcccgctctcgcttagggggcacaggcgcaggcatcggcccggccactccaagccttcggtgcgcgggcgcgtctgggatacgggcccgggaggcgccgccctccgtccgcccggtgcctctcaggaacagcgaaccggagagagcgccggagagttgggctcagtgcggagctcggcgccggggcccatgcccgtgcgcccccgcaggccggcgccatggcctccgggagtgtggccgagtgcctgcagcaggagaccacctgccccgtgtgcctgcagtacttcgcagagcccatgatgctcgactgcggccataacatctgttgcgcgtgcctcgcccgctgctggggcacggcagagactaacgtgtcgtgcccgcagtgccgggagaccttcccgcagaggcacatgcggcccaaccggcacctggccaacgtgacccaactggtaaagcagctgcgcaccgagcggccgtcggggcccggcggcgagatgggcgtgtgcgagaagcaccgcgagcccctgaagctgtactgcgaggaggaccagatgcccatctgcgtggtgtgcgaccgctcccgcgagcaccgcggccacagcgtgctgccgctcgaggaggcggtggagggcttcaaggagcaaatccagaaccagctcgaccatttaaaaagagtgaaagatttaaagaagagacgtcgggcccagggggaacaggcacgagctgaactcttgagcctaacccagatggagagggagaagattgtttgggagtttgagcagctgtatcactccttaaaggagcatgagtatcgcctcctggcccgccttgaggagctagacttggccatctacaatagcatcaatggtgccatcacccagttctcttgcaacatctcccacctcagcagcctgatcgctcagctagaagagaagcagcagcagcccaccagggagctcctgcaggacattggggacacattgagcagggctgaaagaatcaggattcctgaaccttggatcacacctccagatttgcaagagaaaatccacatttttgcccaaaaatgtctattcttgacggagagtctaaagcagttcacagaaaaaatgcagtcagatatggagaaaatccaagaattaagagaggctcagttatactcagtggacgtgactctggacccagacacggcctaccccagcctgatcctctctgataatctgcggcaagtgcggtacagttacctccaacaggacctgcctgacaaccccgagaggttcaatctgtttccctgtgtcttgggctctccatgcttcatcgccgggagacattattgggaggtagaggtgggagataaagccaagtggaccataggtgtctgtgaagactcagtgtgcagaaaaggtggagtaacctcagccccccagaatggattctgggcagtgtctttgtggtatgggaaagaatattgggctcttacctccccaatgactgccctacccctgcggaccccgctccagcgggtggggattttcttggactatgatgctggtgaggtctccttctacaacgtgacagagaggtgtcacaccttcactttctctcatgctaccttttgtgggcctgtccggccctacttcagtctgagttactcgggagggaaaagtgcagctcctctgatcatctgccccatgagtgggatagatgggttttctggccatgttgggaatcatggtcattccatggagacctccccttgaggaggtgaattcaggccaaaagggctgttggctgtaatcctacgccaggcacaaggcatcttgttgccttgccacgtcctgtcacagctgggtatccttaccatgttccacgcccttgcagtgggagacaggatgtccatgttctctaccatccttttccttcccatgcagattgtgaaatgtaatgagatgtatcaagatatcctagaaataaaaaccagatgtccacctccagtgtttcatactttctggttttacacatcgctggagggataaagagtatggataatctttggatttggagagccgttcaagatacttccagcttcttggctcagcctggcttcctctggttcagccccacataatgattatggctatttgctgtcatttctgggctagggctcctttctaacaacctagactggaataaggccctgtcagcatggctccctttatcccagttttccgtctgggaacagtacctctgcccctgattcccaatgtgccatagttttattaactccattaaagaagcctgtatgtgttttggttagttacagttattttacaataatggtgggtaatggccccacctctgttatgagataatgttctaatcaatgtctctgcctttgtatcttttctgagggctttgtctgttctcttcattctaatgaaaggtgtattctagtgctgggtgcatatcatccaggataatattctgcccaactccatcctctgttactagatcccttaccagtcacatttgtggactggtggccagtcgtataccatccctggaaggattctgggacaatattccagggattcattgacttcttggctccttttctccatttcctttgggggaagggggaattgaccatgcttaagtgcatcctatcaaggggcagctccgtccccatggccattggatcatgagacactctgaagtcagaaggctggggcagatcacttcaagcaagcccccatgatggttctcagtcctgcttctctgtgggtacgtgcccctctgtttaaaaataaactgaatatggatgttta

SEQ ID NO: 194874 - DNA, 1812 bp, Homo sapiens
  Payload ID: 18487
  Gene Name: tripartite motif containing 27
  ENST ID: ENST00000437383
  CDS Start-End: 1-744
ctaaagcagttcacagaaaaaatgcagtcagatatggagaaaatccaagaatcagctgactcactggaaggtggaattcttgatcttggctcagttttatcccatattctaccagtctcagaattaagagaggctcagttatactcagtggacgtgactctggacccagacacggcctaccccagcctgatcctctctgataatctgcggcaagtgcggtacagttacctccaacaggacctgcctgacaaccccgagaggttcaatctgtttccctgtgtcttgggctctccatgcttcatcgccgggagacattattgggaggtagaggtgggagataaagccaagtggaccataggtgtctgtgaagactcagtgtgcagaaaaggtggagtaacctcagccccccagaatggattctgggcagtgtctttgtggtatgggaaagaatattgggctcttacctccccaatgactgccctacccctgcggaccccgctccagcgggtggggattttcttggactatgatgctggtgaggtctccttctacaacgtgacagagaggtgtcacaccttcactttctctcatgctaccttttgtgggcctgtccggccctacttcagtctgagttactcgggagggaaaagtgcagctcctctgatcatctgccccatgagtgggatagatgggttttctggccatgttgggaatcatggtcattccatggagacctccccttgaggaggtgaattcaggccaaaagggctgttggctgtaatcctacgccaggcacaaggcatcttgttgccttgccacgtcctgtcacagctgggtatccttaccatgttccacgcccttgcagtgggagacaggatgtccatgttctctaccatccttttccttcccatgcagattgtgaaatgtaatgagatgtatcaagatatcctagaaataaaaaccagatgtccacctccagtgtttcatactttctggttttacacatcgctggagggataaagagtatggataatctttggatttggagagccgttcaagatacttccagcttcttggctcagcctggcttcctctggttcagccccacataatgattatggctatttgctgtcatttctgggctagggctcctttctaacaacctagactggaataaggccctgtcagcatggctccctttatcccagttttccgtctgggaacagtacctctgcccctgattcccaatgtgccatagttttattaactccattaaagaagcctgtatgtgttttggttagttacagttattttacaataatggtgggtaatggccccacctctgttatgagataatgttctaatcaatgtctctgcctttgtatcttttctgagggctttgtctgttctcttcattctaatgaaaggtgtattctagtgctgggtgcatatcatccaggataatattctgcccaactccatcctctgttactagatcccttaccagtcacatttgtggactggtggccagtcgtataccatccctggaaggattctgggacaatattccagggattcattgacttcttggctccttttctccatttcctttgggggaagggggaattgaccatgcttaagtgcatcctatcaaggggcagctccgtccccatggccattggatcatgagacactctgaagtcagaaggctggggcagatcacttcaagcaagcccccatgatggttctcagtcctgcttctctgtgggtacgtgcccctctgtttaaaaataaactgaatatggatgttta

SEQ ID NO: 194875 - DNA, 2686 bp, Homo sapiens; identical to SEQ ID NO: 194855
  Payload ID: 18487
  Gene Name: tripartite motif containing 27
  Uniprot ID: P14373
  ENST ID: ENST00000412687
  CDS Start-End: 357-1433

SEQ ID NO: 194876 - DNA, 1103 bp, Homo sapiens
  Payload ID: 18487
  Gene Name: tripartite motif containing 27
  ENST ID: ENST00000436621
  CDS Start-End: 357-1103
tttacgctgccgccggcatccgctcggacgcggccacgttgtcttgcgcgctttgcccgcctggccctgggactctgaccctcggctaccctttcctgccccactagcgtggccgcgagcctcggtgagccggccgtattcccgctctcgcttagggggcacaggcgcaggcatcggcccggccactccaagccttcggtgcgcgggcgcgtctgggatacgggcccgggaggcgccgccctccgtccgcccggtgcctctcaggaacagcgaaccggagagagcgccggagagttgggctcagtgcagagctcggcgccggggcccatgcccgtgcgcccccgcaggccggcgccatggcctccgggagtgtggccgagtgcctgcagcaggagaccacctgccccgtgtgcctgcagtacttcgcagagcccatgatgctcgactgcggccataacatctgttgcgcgtgcctcgcccgctgctggggcacggcagagactaacgtgtcgtgcccgcagtgccgggagaccttcccgcagaggcacatgcggcccaaccggcacctggccaacgtgacccaactggtaaagcagctgcgcaccgagcggccgtcggggcccggcggcgagatgggcgtgtgcgagaagcaccgcgagcccctgaagctgtactgcgaggaggaccagatgcccatctgcgtggtgtgcgaccgctcccgcgagcaccgcggccacagcgtgctgccgctcgaggaggcggtggagggcttcaaggagcaaatccagaaccagctcgaccatttaaaaagagtgaaagatttaaagaagagacgtcgggcccagggggaacaggcacgagctgaactcttgagcctaacccagatggagagggagaagattgtttgggagtttgagcagctgtatcactccttaaaggagcatgagtatcgcctcctggcccgccttgaggagctagacttggccatctacaatagcatcaatggtgccatcacccagttctcttgcaacatctcccacctcagcagcctgatcgctcagctagaagagaagcagcagcagcccaccagggagctcctgcag

SEQ ID NO: 194877 - DNA, 2960 bp, Homo sapiens
  Payload ID: 18488
  Gene Name: tripartite motif containing 28
  Uniprot ID: Q13263
  ENST ID: ENST00000253024
  CDS Start-End: 290-2797
ggcgcgcgggcgagcggttgtgcttgtgcttgtggcgcgtggtgcgggtttcggcggcggctgaggaagaagcgcgggcggcgccttcgggaggcgagcaggcagcagttggccgtgccgtagcagcgtcccgcgcgcggcgggcagcggcccaggaggcgcgtggcggcgctcggcctcgcggcggcggcggcggcagcggcccagcagttggcggcgagcgcgtctgcgcctgcgcggcgggccccgcgcccctcctccccccctgggcgcccccggcggcgtgtgaatggcggcctccgcggcggcagcctcggcagcagcggcctcggccgcctctggcagcccgggcccgggcgagggctccgctggcggcgaaaagcgctccaccgccccttcggccgcagcctcggcctctgcctcagccgcggcgtcgtcgcccgcggggggcggcgccgaggcgctggagctgctggagcactgcggcgtgtgcagagagcgcctgcgacccgagagggagccccgcctgctgccctgtttgcactcggcctgtagtgcctgcttagggcccgcggcccccgccgccgccaacagctcgggggacggcggggcggcgggcgacggcaccgtggtggactgtcccgtgtgcaagcaacagtgcttctccaaagacatcgtggagaattatttcatgcgtgatagtggcagcaaggctgccaccgacgcccaggatgcgaaccagtgctgcactagctgtgaggataatgccccagccaccagctactgtgtggagtgctcggagcctctgtgtgagacctgtgtagaggcgcaccagcgggtgaagtacaccaaggaccatactgtgcgctctactgggccagccaagtctcgggatggtgaacgtactgtctattgcaacgtacacaagcatgaaccccttgtgctgttttgtgagagctgtgatactctcacctgccgagactgccagctcaatgcccacaaggaccaccagtaccagttcttagaggatgcagtgaggaaccagcgcaagctcctggcctcactggtgaagcgccttggggacaaacatgcaacattgcagaagagcaccaaggaggttcgcagctcaatccgccaggtgtctgacgtacagaagcgtgtgcaagtggatgtcaagatggccatcctgcagatcatgaaggagctgaataagcggggccgtgtgctggtcaatgatgcccagaaggtgactgaggggcagcaggagcgcctggagcggcagcactggaccatgaccaagatccagaagcaccaggagcacattctgcgctttgcctcttgggctctggagagtgacaacaacacagcccttttgctttctaagaagttgatctacttccagctgcaccgggccctcaagatgattgtggatcccgtggagccacatggcgagatgaagtttcagtgggacctcaatgcctggaccaagagtgccgaggcctttggcaagattgtggcagagcgtcctggcactaactcaacaggccctgcacccatggcccctccaagagccccagggcccctgagcaagcagggctctggcagcagccagcccatggaggtgcaggaaggctatggctttgggtcaggagatgatccctactcaagtgcagagccccatgtgtcaggtgtgaaacggtcccgctcaggtgagggcgaggtgagcggccttatgcgcaaggtgccacgagtgagccttgaacgcctggacctggacctcacagctgacagccagccacccgtcttcaaggtcttcccaggcagtaccactgaggactacaaccttattgttattgaacgtggcgctgccgctgcagctaccggccagccagggactgcgcctgcaggaacccctggtgccccacccctggctggcatggccattgtcaaggaggaggagacggaggctgccattggagcccctcctactgccactgagggccctgagaccaaacctgtgcttatggctcttgcggagggtcctggtgctgagggtccccgcctggcctcacctagtggcagcaccagctcagggctggaggtggtggctcctgagggtacctcagccccaggtggtggcccgggaaccctggatgacagtgccaccatttgccgtgtctgccagaagccaggcgatctggttatgtgcaaccagtgtgagttttgtttccacctggactgtcacctgccggccctgcaggatgtaccaggggaggagtggagctgctcactctgccatgtgctccctgacctgaaggaggaggatggcagcctcagcctggatggtgcagacagcactggcgtggtggccaagctctcaccagccaaccagcggaaatgtgagcgtgtactgctggccctattctgtcacgaaccctgccgccccctgcatcagctggctaccgactccaccttctccctggaccagcccggtggcaccctggatctgaccctgatccgtgcccgcctccaggagaagttgtcacctccctacagctccccacaggagtttgcccaggatgtgggccgcatgttcaagcaattcaacaagttaactgaggacaaggcagacgtgcagtccatcatcggcctgcagcgcttcttcgagacgcgcatgaacgaggccttcggtgacaccaagttctctgctgtgctggtggagcccccgccgatgagcctgcctggtgctggcctgagttcccaggagctgtctggtggccctggtgatggcccctgaggctggagcccccatggccagcccagcctggctctgttctctgtcctgtcaccccatccccactcccctggtggcctgactcccactccctggtggccccatcccccagttcctcacgatatggtttttacttctgtggatttaataaaaacttcaccagttc

SEQ ID NO: 194878 - DNA, 2709 bp, Homo sapiens
  Payload ID: 18488
  Gene Name: tripartite motif containing 28
  Uniprot ID: Q13263
  ENST ID: ENST00000341753
  CDS Start-End: 286-2547
cgcgggcgagcggttgtgcttgtgcttgtggcgcgtggtgcgggtttcggcggcggctgaggaagaagcgcgggcggcgccttcgggaggcgagcaggcagcagttggccgtgccgtagcagcgtcccgcgcgcggcgggcagcggcccaggaggcgcgtggcggcgctcggcctcgcggcggcggcggcggcagcggcccagcagttggcggcgagcgcgtctgcgcctgcgcggcgggccccgcgcccctcctccccccctgggcgcccccggcggcgtgtgaatggcggcctccgcggcggcagcctcggcagcagcggcctcggccgcctctggcagcccgggcccgggcgagggctccgctggcggcgaaaagcgctccaccgccccttcggccgcagcctcggcctctgcctcagccgcggcgtcgtcgcccgcggggggcggcgccgaggcgctggagctgctggagcactgcggcgtgtgcagagagcgcctgcgacccgagagggagccccgcctgctgccctgtttgcactcggcctgtagtgcctgcttagggcccgcggcccccgccgccgccaacagctcgggggacggcggggcggcgggcgacggcaccgggccagccaagtctcgggatggtgaacgtactgtctattgcaacgtacacaagcatgaaccccttgtgctgttttgtgagagctgtgatactctcacctgccgagactgccagctcaatgcccacaaggaccaccagtaccagttcttagaggatgcagtgaggaaccagcgcaagctcctggcctcactggtgaagcgccttggggacaaacatgcaacattgcagaagagcaccaaggaggttcgcagctcaatccgccaggtgtctgacgtacagaagcgtgtgcaagtggatgtcaagatggccatcctgcagatcatgaaggagctgaataagcggggccgtgtgctggtcaatgatgcccagaaggtgactgaggggcagcaggagcgcctggagcggcagcactggaccatgaccaagatccagaagcaccaggagcacattctgcgctttgcctcttgggctctggagagtgacaacaacacagcccttttgctttctaagaagttgatctacttccagctgcaccgggccctcaagatgattgtggatcccgtggagccacatggcgagatgaagtttcagtgggacctcaatgcctggaccaagagtgccgaggcctttggcaagattgtggcagagcgtcctggcactaactcaacaggccctgcacccatggcccctccaagagccccagggcccctgagcaagcagggctctggcagcagccagcccatggaggtgcaggaaggctatggctttgggtcaggagatgatccctactcaagtgcagagccccatgtgtcaggtgtgaaacggtcccgctcaggtgagggcgaggtgagcggccttatgcgcaaggtgccacgagtgagccttgaacgcctggacctggacctcacagctgacagccagccacccgtcttcaaggtcttcccaggcagtaccactgaggactacaaccttattgttattgaacgtggcgctgccgctgcagctaccggccagccagggactgcgcctgcaggaacccctggtgccccacccctggctggcatggccattgtcaaggaggaggagacggaggctgccattggagcccctcctactgccactgagggccctgagaccaaacctgtgcttatggctcttgcggagggtcctggtgctgagggtccccgcctggcctcacctagtggcagcaccagctcagggctggaggtggtggctcctgagggtacctcagccccaggtggtggcccgggaaccctggatgacagtgccaccatttgccgtgtctgccagaagccaggcgatctggttatgtgcaaccagtgtgagttttgtttccacctggactgtcacctgccggccctgcaggatgtaccaggggaggagtggagctgctcactctgccatgtgctccctgacctgaaggaggaggatggcagcctcagcctggatggtgcagacagcactggcgtggtggccaagctctcaccagccaaccagcggaaatgtgagcgtgtactgctggccctattctgtcacgaaccctgccgccccctgcatcagctggctaccgactccaccttctccctggaccagcccggtggcaccctggatctgaccctgatccgtgcccgcctccaggagaagttgtcacctccctacagctccccacaggagtttgcccaggatgtgggccgcatgttcaagcaattcaacaagttaactgaggacaaggcagacgtgcagtccatcatcggcctgcagcgcttcttcgagacgcgcatgaacgaggccttcggtgacaccaagttctctgctgtgctggtggagcccccgccgatgagcctgcctggtgctggcctgagttcccaggagctgtctggtggccctggtgatggcccctgaggctggagcccccatggccagcccagcctggctctgttctctgtcctgtcaccccatccccactcccctggtggcctgactcccactccctggtggccccatcccccagttcctcacgatatggtttttacttctgtggatttaataaaaacttcaccagtt

SEQ ID NO: 194879 - DNA, 504 bp, Homo sapiens
  Payload ID: 18488
  Gene Name: tripartite motif containing 28
  ENST ID: ENST00000597968
  CDS Start-End: 321-504
tgaggatgccacctgggcgagaggatgggggcccggacagggcacgggaaatactttctgggtcctgcatacgaacgtgggtttgtgctggccgctgagatgggacatctgactaaagttggagaaaagaaggctcggggaggggaggggctggttcgctgcgggataatggtcgggggcccacccagcaggggaatggtgggggccataacctgggtgggaacttgtaacagtctcccacatccctgcttctcgaagtggtggactgtcccgtgtgcaagcaacagtgcttctccaaagacatcgtggagaattatttcatgcgtgatagtggcagcaaggctgccaccgacgcccaggatgcgaaccagtgctgcactagctgtgaggataatgccccagccaccagctactgtgtggagtgctcggagcctctgtgtgagacctgtgtagaggcgcaccagcgggtgaagtacaccaaggaccatactgtgcgctctactg

SEQ ID NO: 194880 - DNA, 1552 bp, Homo sapiens
  Payload ID: 18488
  Gene Name: tripartite motif containing 28
  ENST ID: ENST00000597136
  CDS Start-End: 1-1383
atctacttccagctgcaccgggccctcaagatgattgtggatcccgtggagccacatggcgagatgaagtttcagtgggacctcaatgcctggaccaagagtgccgaggcctttggcaagattgtggcagagcgtcctggcactaactcaacaggccctgcacccatggcccctccaagagccccagggcccctgagcaagcagggctctggcagcagccagcccatggaggtgcaggaaggctatggctttgggtcagagccccatgtgtcaggtgtgaaacggtcccgctcaggtgagggcgaggtgagcggccttatgcgcaaggtgccacgagtgagccttgaacgcctggacctggacctcacagctgacagccagccacccgtcttcaaggtcttcccaggcagtaccactgaggactacaaccttattgttattgaacgtggcgctgccgctgcagctaccggccagccagggactgcgcctgcaggaacccctggtgccccacccctggctggcatggccattgtcaaggaggaggagacggaggctgccattggagcccctcctactgccactgagggccctgagaccaaacctgtgcttatggctcttgcggagggtcctggtgctgagggtccccgcctggcctcacctagtggcagcaccagctcagggctggaggtggtggctcctgagggtacctcagccccaggtggtggcccgggaaccctggatgacagtgccaccatttgccgtgtctgccagaagccaggcgatctggttatgtgcaaccagtgtgagttttgtttccacctggactgtcacctgccggccctgcaggatgtaccaggggaggagtggagctgctcactctgccatgtgctccctgacctgaaggaggaggatggcagcctcagcctggatggtgcagacagcactggcgtggtggccaagctctcaccagccaaccagcggaaatgtgagcgtgtactgctggccctattctgtcacgaaccctgccgccccctgcatcagctggctaccgactccaccttctccctggaccagcccggtggcaccctggatctgaccctgatccgtgcccgcctccaggagaagttgtcacctccctacagctccccacaggagtttgcccaggatgtgggccgcatgttcaagcaattcaacaagttaactgaggacaaggcagacgtgcagtccatcatcggcctgcagcgcttcttcgagacgcgcatgaacgaggccttcggtgacaccaagttctctgctgtgctggtggagcccccgccgatgagcctgcctggtgctggcctgagttcccaggagctgtctggtggccctggtgatggcccctgaggctggagcccccatggccagcccagcctggctctgttctctgtcctgtcaccccatccccactcccctggtggcctgactcccactccctggtggccccatcccccagttcctcacgatatggtttttacttctgtggatttaataaaaacttcaccagttcctcagg

SEQ ID NO: 194881 - DNA, 533 bp, Homo sapiens
  Payload ID: 18488
  Gene Name: tripartite motif containing 28
  ENST ID: ENST00000593582
  CDS Start-End: 46-533
acggcggcgaagagacgcgggttgaggaagagggacggattgcccatgcgcttgggcgcacagcggcccgcttctgtgtggtctggaggtggagctgagaggggaatcacactctataaagtggtggactgtcccgtgtgcaagcaacagtgcttctccaaagacatcgtggagaattatttcatgcgtgatagtggcagcaaggctgccaccgacgcccaggatgcgaaccagtgctgcactagctgtgaggataatgccccagccaccagctactgtgtggagtgctcggagcctctgtgtgagacctgtgtagaggcgcaccagcgggtgaagtacaccaaggaccatactgtgcgctctactgggccagccaagtctcgggatggtgaacgtactgtctattgcaacgtacacaagcatgaaccccttgtgctgttttgtgagagctgtgatactctcacctgccgagactgccagctcaatgcccacaaggaccaccagtaccagttcttagaggatgcagtgaggaa

SEQ ID NO: 194882 - DNA, 861 bp, Homo sapiens
  Payload ID: 18488
  Gene Name: tripartite motif containing 28
  ENST ID: ENST00000594806
  CDS Start-End: 328-861
tttctgcgagcgggcgcgcgggcgagcggttgtgcttgtgcttgtggcgcgtggtgcgggtttcggcggcggctgaggaagaagcgcgggcggcgccttcgggagctgctggagcactgcggcgtgtgcagagagcgcctgcgacccgagagggagccccgcctgctgccctgtttgcactcggcctgtagtgcctgcttagggcccgcggcccccgccgccgccaacagctcgggggacggcggggcggcgggcgacggcaccgtggtggactgtcccgtgtgcaagcaacagtgcttctccaaagacatcgtggagaattatttcatgcgtgatagtggcagcaaggctgccaccgacgcccaggatgcgaaccagtgctgcactagctgtgaggataatgccccagccaccagctactgtgtggagtgctcggagcctctgtgtgagacctgtgtagaggcgcaccagcgggtgaagtacaccaaggaccatactgtgcgctctactgggccagccaagtctcgggatggtgaacgtactgtctattgcaacgtacacaagcatgaaccccttgtgctgttttgtgagagctgtgatactctcacctgccgagactgccagctcaatgcccacaaggaccaccagtaccagttcttagaggatgcagtgaggaaccagcgcaagctcctggcctcactggtgaagcgccttggggacaaacatgcaacattgcagaagagcaccaaggaggttcgcagctcaatccgccaggtgtctgacgtacagaagcgtgtgcaagtggatgtcaagatggccatcctgcagatcatgaaggagctgaataagcggggccgtgtg

SEQ ID NO: 194883 - DNA, 3328 bp, Homo sapiens
  Payload ID: 18489
  Gene Name: tripartite motif containing 29
  Uniprot ID: Q14134
  ENST ID: ENST00000341846
  CDS Start-End: 423-2189
agtgaagcctgcccacttgtgaagacggagactccccgctccccggatgagaagcaagtgcgtcagagggaagcagcccaactggttgctgagttgtggaaaataagctgggggagaaaaaacacttcttttaaaaatcaggttagggatgaatgtgcagggcgtggttcctgtgcaattatctgctctgctggctgcggggctccctgcttctcccgggccgctgtgtcaggcttgtgcctgttgctcctcccctccactcctccccctcctcctcctccgcctcctccccctcctcctcctcacaggtgtgtctctagtcctcgtggttgcctgccccactccctgccgagacgcctgccagaaaggtcacctatcctgaaccccagcaagcctgaaacagctcagccaagcaccctgcgatggaagctgcagatgcctccaggagcaacgggtcgagcccagaagccagggatgcccggagcccgtcgggccccagtggcagcctggagaatggcaccaaggctgacggcaaggatgccaagaccaccaacgggcacggcggggaggcagctgagggcaagagcctgggcagcgccctgaagccaggggaaggtaggagcgccctgttcgcgggcaatgagtggcggcgacccatcatccagtttgtcgagtccggggacgacaagaactccaactacttcagcatggactctatggaaggcaagaggtcgccgtacgcagggctccagctgggggctgccaagaagccacccgttacctttgccgaaaagggcgagctgcgcaagtccattttctcggagtcccggaagcccacggtgtccatcatggagcccggggagacccggcggaacagctacccccgggccgacacgggccttttttcacggtccaagtccggctccgaggaggtgctgtgcgactcctgcatcggcaacaagcagaaggcggtcaagtcctgcctggtgtgccaggcctccttctgcgagctgcatctcaagccccacctggagggcgccgccttccgagaccaccagctgctcgagcccatccgggactttgaggcccgcaagtgtcccgtgcatggcaagacgatggagctcttctgccagaccgaccagacctgcatctgctacctttgcatgttccaggagcacaagaatcatagcaccgtgacagtggaggaggccaaggccgagaaggagacggagctgtcattgcaaaaggagcagctgcagctcaagatcattgagattgaggatgaagctgagaagtggcagaaggagaaggaccgcatcaagagcttcaccaccaatgagaaggccatcctggagcagaacttccgggacctggtgcgggacctggagaagcaaaaggaggaagtgagggctgcgctggagcagcgggagcaggatgctgtggaccaagtgaaggtgatcatggatgctctggatgagagagccaaggtgctgcatgaggacaagcagacccgggagcagctgcatagcatcagcgactctgtgttgtttctgcaggaatttggtgcattgatgagcaattactctctccccccacccctgcccacctatcatgtcctgctggagggggagggcctgggacagtcactaggcaacttcaaggacgacctgctcaatgtatgcatgcgccacgttgagaagatgtgcaaggcggacctgagccgtaacttcattgagaggaaccacatggagaacggtggtgaccatcgctatgtgaacaactacacgaacagcttcgggggtgagtggagtgcaccggacaccatgaagagatactccatgtacctgacacccaaaggtggggtccggacatcataccagccctcgtctcctggccgcttcaccaaggagaccacccagaagaatttcaacaatctctatggcaccaaaggtaactacacctcccgggtctgggagtactcctccagcattcagaactctgacaatgacctgcccgtcgtccaaggcagctcctccttctccctgaaaggctatccctccctcatgcggagccaaagccccaaggcccagccccagacttggaaatctggcaagcagactatgctgtctcactaccggccattctacgtcaacaaaggcaacgggattgggtccaacgaagccccatgagctcctggcggaaggaacgaggcgccacacccctgctcttcctcctgaccctgctgctcttgccttctaagctactgtgcttgtctgggtgggagggagcctggtcctgcacctgccctctgcagccctctgccagcctcttgggggcagttccggcctctccgacttccccactggccacactccattcagactcctttcctgccttgtgacctcagatggtcaccatcattcctgtgctcagaggccaacccatcacaggggtgagataggttggggcctgccctaacccgccagcctcctcctctcgggctggatctgggggctagcagtgagtacccgcatggtatcagcctgcctctcccgcccacgccctgctgtctccaggcctatagacgtttctctccaaggccctatcccccaatgttgtcagcagatgcctggacagcacagccacccatctcccattcacatggcccacctcctgcttcccagaggactggccctacgtgctctctctcgtcctacctatcaatgcccagcatggcagaacctgcagcccttggccactgcagatggaaacctctcagtgtcttgacatcaccctacccaggcggtgggtctccaccacagccactttgagtctgtggtccctggagggtggcttctcctgactggcaggatgaccttagccaagatattcctctgttccctctgctgagataaagaattcccttaacatgatataatccacccatgcaaatagctactggcccagctaccatttaccatttgcctacagaatttcattcagtctacactttggcattctctctggcgatggagtgtggctgggctgaccgcaaaaggtgccttacacactgcccccaccctcagccgttgccccatcagaggctgcctcctccttctgattaccccccatgttgcatatcagggtgctcaaggattggagaggagacaaaaccaggagcagcacagtggggacatctcccgtctcaacagccccaggcctatgggggctctggaaggatgggccagcttgcaggggttggggagggagacatccagcttgggctttcccctttggaataaaccattggtctgtcacttctcttgta

SEQ ID NO: 194884 - DNA, 549 bp, Homo sapiens
  Payload ID: 18489
  Gene Name: tripartite motif containing 29
  ENST ID: ENST00000529040
  CDS Start-End: 435-549
gaaattcagaacaggaggacacaagggcaggggaatgctgaggccaaggccttctcccaccacctgcctcctgcgggagtgattccacagtgcagagggagagccatttggaggtccggcacccgctctgcccatgcctatgcttcaggctctgtgagaaggctggactccttctggaacttcaggaccttggatgctcccctcctctgctcctgcctcccttcccccagccctggggtgtgtcagatgtgtgttttctcctggactcagctgaagcaaggtcagcccagctttcaaggggaggagcttccacactctaggtgtgtctctagtcctcgtggttgcctgccccactccctgccgagacgcctgccagaaaggtcacctatcctgaaccccagcaagcctgaaacagctcagccaagcaccctgcgatggaagctgcagatgcctccaggagcaacgggtcgagcccagaagccagggatgcccggagcccgtcgggccccagtggcagcctggagaatggcaccaaggctgacggcaagg

SEQ ID NO: 194885 - DNA, 535 bp, Homo sapiens
  Payload ID: 18489
  Gene Name: tripartite motif containing 29
  ENST ID: ENST00000531555
  CDS Start-End: 1-358
caactacacgaacagcttcgggggtgagtggagtgcaccggacaccatgaagagatactccatgtacctgacacccaaaggtggggtccggacatcataccagccctcgtctcctggccgcttcaccaaggagaccacccagaagaatttcaacaatctctatggcaccaaaggtaactacacctcccgggtctgggagtactcctccagcattcagaactctgacaatgacctgcccgtcgtccaaggcagctcctccttctccctgaaaggctatccctccctcatgcggagccaaagccccaaggcccagccccagacttggaaatctggcaagcagactatgctggtggtttaagcaaggtctgagcatccctcaagtcctgctgtggaccacacaaaggcaaggagctgaccaggaggtgtcagttccctgagagacagggccaaaggcagtgtacccttgagtctcactaccggccattctacgtcaacaaaggcaacgggattgggtccaacgaagccccatgagctc

SEQ ID NO: 194886 - DNA, 551 bp, Homo sapiens
  Payload ID: 18489
  Gene Name: tripartite motif containing 29
  ENST ID: ENST00000529495
  CDS Start-End: 267-551
gagaaattgggcctggcattttgagtgacttctgagattatctgaatctcacactttgctgacctctttttggagggcattgcctgtggcctggcccagagaggatgggcaggtgttttctgagtcacacagcagaccaagtgtggagacaggtgtgtctctagtcctcgtggttgcctgccccactccctgccgagacgcctgccagaaaggtcacctatcctgaaccccagcaagcctgaaacagctcagccaagcaccctgcgatggaagctgcagatgcctccaggagcaacgggtcgagcccagaagccagggatgcccggagcccgtcgggccccagtggcagcctggagaatggcaccaaggctgacggcaaggatgccaagaccaccaacgggcacggcggggaggcagctgagggcaagagcctgggcagcgccctgaagccaggggaaggtaggagcgccctgttcgcgggcaatgagtggcggcgacccatcatccagtttgtcgagtccggggacgacaagaactccaactacttcagc

SEQ ID NO: 194887 - DNA, 1702 bp, Homo sapiens
  Payload ID: 18489
  Gene Name: tripartite motif containing 29
  ENST ID: ENST00000475051
  CDS Start-End: 84-593
cactccctgccgagacgcctgccagaaaggtcacctatcctgaaccccagcaagcctgaaacagctcagccaagcaccctgcgatggaagctgcagatgcctccaggagcaacgggtcgagcccagaagccagggatgcccggagcccgtcgggccccagtggcagcctggagaatggcaccaaggctgacggcaaggatgccaagaccaccaacgggcacggcggggaggcagctgagggcaagagcctgggcagcgccctgaagccaggggaagaagccacccgttacctttgccgaaaagggcgagctgcgcaagtccattttctcggagtcccggaagcccacggtgtccatcatggagcccggggagacccggcggaacagctacccccgggccgacacgggccttttttcacggtccaagtccggctccgaggaggtgctgtgcgactcctgcatcggcaacaagcagaaggcggtcaagtcctgcctggtgtgccaggcctccttctgcgagctgcatctcaagccccacctggagggcgccgccttccgagaccaccagctgctcgagcccatccgggactttgaggcccgcaagtgtcccgtgcatggcaagacgatggagctcttctgccagaccgaccagacctgcatctgctacctttgcatgttccaggagcacaagaatcatagcaccgtgacagtggaggaggccaaggccgagaaggagacggagctgtcattgcaaaaggagcagctgcagctcaagatcattgagattgaggatgaagctgagaagtggcagaaggagaaggaccgcatcaagagcttcaccaccaatgagaaggccatcctggagcagaacttccgggacctggtgcgggacctggagaagcaaaaggaggaagtgagggctgcgctggagcagcgggagcaggatgctgtggaccaagtgaaggtgatcatggatgctctggatgagagagccaaggtgctgcatgaggacaagcagacccgggagcagctgcatagcatcagcgactctgtgttgtttctgcaggaatttggtgcattgatgagcaattactctctccccccacccctgcccacctatcatgtcctgctggagggggagggcctgggacagtcactaggcaacttcaaggacgacctgctcaatgtatgcatgcgccacgttgagaagatgtgcaaggcggacctgagccgtaacttcattgagaggaaccacatggagaacggtggtgaccatcgctatgtgaacaactacacgaacagcttcgggggtgagtggagtgcaccggacaccatgaagagatactccatgtacctgacacccaaaggtggggtccggacatcataccagccctcgtctcctggccgcttcaccaaggagaccacccagaagaatttcaacaatctctatggcaccaaaggtaactacacctcccgggtctgggagtactcctccagcattcagaactctgacaatgacctgcccgtcgtccaaggcagctcctccttctccctgaaaggctatccctccctcatgcggagccaaagccccaaggcccagccccagacttggaaatctggcaagcagactatgctgtctcactaccggccattctacgtcaacaaaggcaacgggattgggtccaacgaagccccatgagctc

SEQ ID NO: 194888 - DNA, 547 bp, Homo sapiens
  Payload ID: 18489
  Gene Name: tripartite motif containing 29
  ENST ID: ENST00000529011
  CDS Start-End: 256-547
agtgaagcctgcccacttgtgaagacggagactccccgctccccggatgagaagcaagtgcgtcagagggaagcagcccaactggttgctgagttgtggaaaataagctgggggagaaaaaacacttcttttaaaaatcaggtgtgtctctagtcctcgtggttgcctgccccactccctgccgagacgcctgccagaaaggtcacctatcctgaaccccagcaagcctgaaacagctcagccaagcaccctgcgatggaagctgcagatgcctccaggagcaacgggtcgagcccagaagccagggatgcccggagcccgtcgggccccagtggcagcctggagaatggcaccaaggctgacggcaaggatgccaagaccaccaacgggcacggcggggaggcagctgagggcaagagcctgggcagcgccctgaagccaggggaaggtaggagcgccctgttcgcgggcaatgagtggcggcgacccatcatccagtttgtcgagtccggggacgacaagaactccaactacttcagcatggact

SEQ ID NO: 194889 - DNA, 2217 bp, Homo sapiens
  Payload ID: 18489
  Gene Name: tripartite motif containing 29
  ENST ID: ENST00000528870
  CDS Start-End: 1848-2213
ccacccacccacccttcctcaggccgtttggactaggatacagggattctaaccctcctcctcctttgaacttgctgccaaagttatgcaactataggaagagacctccagagcagggacatcctgggcactggctccacaaatgcctcctctctgtgggttgtccatcaaactcagagactggtttcgttcagatctacatctaattgccgggcccagcccagcagctgtgtggatgctgccactagtatgggccagattccaaactggtggctttgcagactctagcagacgtgacctagaactgcagccatgcctggagggaggacttgcctgtcatcatggccatgctgagcagtgctgagcccagaggctggacttggcctgttgagctgggctggggacggtgggacacagtgtctctgtgactcaccagctcccttgaagtcagctcttcttctgagtcatgctgtcccctcagaggtcaactgaatcatctcacagaaaacctctgaacctgagaaacaacatcgtcaagtccttttccacccagtccctttagggcctgaagcctgggcactttccccaaggccccacccggtgtcccaggcgttgcacggggccttgagagtacagccttgttaatgactgctagacgtgaataccccaaaggaaaggacccctgattgctctccagacacagcatatgattctttgggggaggagaagggggtgagggggataaaagtgtgcagaagggttggggttcaggaggccatttgtgcaccttggcgatggcaatatcacatggtgtccctgtgaaatgtgggggacattcaatcacacacaaggacagataagccatttcagcaagacaatcatttggcttcaaacggcactcagatcccgaaatcctccttctaatgacaatagtgatgatgctaatggtgatggtgacagctgacaatgattgagtgctcgctcgatgccgggcatttcactgagcttctcacgcacattaccttattttccctgtggggtgtactgcattttacaggcgagaaggctgaggctcagagaagcatcctttcaaagggcgcactgctcggtagggggtacggcggggttgaacactctgctgttcagtctcccatgccctctcatctgagaagctgcggctggcggtggctgcagaagtggggttgaggagtgtgataatcatcgtccctggggtacaaactcggcagggcagcccctccggtgaggtccggccaggcctgggggatggcctagactggggtggggtgagccttgcagaaactgttcaggctcctggccgctcactgtcccatttctaggtcacaatgctggccacggcctctgtacaggtgtggccctgcgtcctgtacgaggtgtgtggcgaggtggcaagcaggagcagggatgggcactgctgattcagtagcccacacctgtgcctggggccgtgggggcggctcctctgcctctgtgttgttttttcgtgtggctgctgggagtgtgtctgctctaggaggtggtggccggtgagtcagacagtggagtgaccatccactcctccccgatgctagcctgcccaccagaccagggactcgtccacaccctcaaaggcccctgcgctaagagacaccaggccacttcatcctggactctgtggggcacagggctgggctaacacctaggagggcatttgtttattctttgagtatctgctgtgcaccaggacactgataggcgcaggtggtgaccatcgctatgtgaacaactacacgaacagcttcgggggtgagtggagtgcaccggacaccatgaagagatactccatgtacctgacacccaaaggtggggtccggacatcataccagccctcgtctcctggccgcttcaccaaggagaccacccagaagaatttcaacaatctctatggcaccaaaggtaactacacctcccgggtctgggagtactcctccagcattcagaactctgacaatgacctgcccgtcgtccaaggcagctcctccttctccctgaaaggctatccctccctcatgcggagccaaagccccaaggcccagccccagacttggaaatctggcaagcagactatgctgtctcactaccggccattctacgtcaacaaaggcaacgggattgggtccaacgaagccccatgagctc

SEQ ID NO: 194890 - DNA, 1233 bp, Homo sapiens
  Payload ID: 18489
  Gene Name: tripartite motif containing 29
  ENST ID: ENST00000529044
  CDS Start-End: 246-1229
gagacactccctgggctgggctgggctgagctgggctggatccccttcctttctcttcccattgtccccaggtccactgaaaagggcaagcaccctgtaaatgagtttccctcctgctcttgctgggtggaggagataggcagaggtttagcccttaaaaagacatggctaggatatccagccctagtggcctgagaatacagcaagatggtatttaacttactgctagatccttggcgactggcatggtgcctggcatatccgagacggagctgtcattgcaaaaggagcagctgcagctcaagatcattgagattgaggatgaagctgagaagtggcagaaggagaaggaccgcatcaagagcttcaccaccaatgagaaggccatcctggagcagaacttccgggacctggtgcgggacctggagaagcaaaaggaggaagtgagggctgcgctggagcagcgggagcaggatgctgtggaccaagtgaaggtgatcatggatgctctggatgagagagccaaggtgctgcatgaggacaagcagacccgggagcagctgcatagcatcagcgactctgtgttgtttctgcaggaatttggtgcattgatgagcaattactctctccccccacccctgcccacctatcatgtcctgctggagggggagggcctgggacagtcactaggcaacttcaaggacgacctgctcaatgtatgcatgcgccacgttgagaagatgtgcaaggcggacctgagccgtaacttcattgagaggaaccacatggagaacggtggtgaccatcgctatgtgaacaactacacgaacagcttcgggggtgagtggagtgcaccggacaccatgaagagatactccatgtacctgacacccaaaggtggggtccggacatcataccagccctcgtctcctggccgcttcaccaaggagaccacccagaagaatttcaacaatctctatggcaccaaaggtaactacacctcccgggtctgggagtactcctccagcattcagaactctgacaatgacctgcccgtcgtccaaggcagctcctccttctccctgaaaggctatccctccctcatgcggagccaaagccccaaggcccagccccagacttggaaatctggcaagcagactatgctgtctcactaccggccattctacgtcaacaaaggcaacgggattgggtccaacgaagccccatgagctc

SEQ ID NO: 194891 - DNA, 385 bp, Homo sapiens
  Payload ID: 18489
  Gene Name: tripartite motif containing 29
  ENST ID: ENST00000526881
  CDS Start-End: 103-385
ggcctctccaagtttatgctgatgctctctgcacggttactaacagagtccttctactctcaaaagcatgccaatttgggtgataaattagttgattgacttatgtcagacccaaaggacttctctcagtggtggaatccaggtggggtccggacatcataccagccctcgtctcctggccgcttcaccaaggagaccacccagaagaatttcaacaatctctatggcaccaaaggtaactacacctcccgggtctgggagtactcctccagcattcagaactctgacaatgacctgcccgtcgtccaaggcagctcctccttctccctgaaaggctatccctccctcatgcggagccaaagccccaaggcccagccccagactt

SEQ ID NO: 194892 - DNA, 555 bp, Homo sapiens
  Payload ID: 18489
  Gene Name: tripartite motif containing 29
  ENST ID: ENST00000532833
  CDS Start-End: 289-555
tttggaggtccggcacccgctctgcccatgcctatgcttcaggctctgtgagaaggctggactccttctggaacttcaggaccttggatgctcccctcctctgctcctgcctcccttcccccagccctggggtgtgtcagatgtgtgttttctcctggactcagctgaagcaaggtgtgtctctagtcctcgtggttgcctgccccactccctgccgagacgcctgccagaaaggtcacctatcctgaaccccagcaagcctgaaacagctcagccaagcaccctgcgatggaagctgcagatgcctccaggagcaacgggtcgagcccagaagccagggatgcccggagcccgtcgggccccagtggcagcctggagaatggcaccaaggctgacggcaaggatgccaagaccaccaacgggcacggcggggaggcagctgagggcaagagcctgggcagcgccctgaagccaggggaaggtaggagcgccctgttcgcgggcaatgagtggcggcgacccatcatccagtttgtcgagtccggggacgacaag

SEQ ID NO: 194893 - DNA, 514 bp, Homo sapiens
  Payload ID: 18489
  Gene Name: tripartite motif containing 29
  ENST ID: ENST00000533302
  CDS Start-End: 1-510
aactacacgaacagcttcgggggtgagtggagtgcaccggacaccatgaagagatactccatgtacctgacacccaaaggtggggtccggacatcataccagccctcgtctcctggccgcttcaccaaggagaccacccagaagaatttcaacaatctctatggcaccaaaggtaactacacctcccgggtctgggagtactcctccagcattcagaactctgacaatgacctgcccgtcgtccaaggcagctcctccttctccctgaaaggcactgggaaaaccccttatcagttcaccaccttgggacaggccactgcagagttttccaaaccactgggtcgcagtgggctgtctaaaaataatcccggctatccctccctcatgcggagccaaagccccaaggcccagccccagacttggaaatctggcaagcagactatgctgtctcactaccggccattctacgtcaacaaaggcaacgggattgggtccaacgaagccccatgagctc

SEQ ID NO: 194894 - DNA, 510 bp, Homo sapiens
  Payload ID: 18489
  Gene Name: tripartite motif containing 29
  ENST ID: ENST00000627238
  CDS Start-End: 1-510
atggaagctgcagatgcctccaggagcaacgggtcgagcccagaagccagggatgcccggagcccgtcgggccccagtggcagcctggagaatggcaccaaggctgacggcaaggatgccaagaccaccaacgggcacggcggggaggcagctgagggcaagagcctgggcagcgccctgaagccaggggaagaagccacccgttacctttgccgaaaagggcgagctgcgcaagtccattttctcggagtcccggaagcccacggtgtccatcatggagcccggggagacccggcggaacagctacccccgggccgacacgggccttttttcacggtccaagtccggctccgaggaggtgctgtgcgactcctgcatcggcaacaagcagaaggcggtcaagtcctgcctggtgtgccaggcctccttctgcgagctgcatctcaagccccacctggagggcgccgccttccgagaccaccagctgctcgagcccatccgggactttga

SEQ ID NO: 194895 - DNA, 2879 bp, Homo sapiens
  Payload ID: 18490
  Gene Name: tripartite motif containing 3
  Uniprot ID: O75382
  ENST ID: ENST00000345851
  CDS Start-End: 232-2466
cccccggccggtccgcagccccgccccggcccctccctccggcctgtgcggctagtccggcggcggcgccggcgcggggacaggcggaggcgcgggcagggccgggcggacgggcgctggcagcagtagcagcgccgcgggcccttcagagtggccgcagtccgagctttgccctcgcatcctgttccaacgcgaggctggtgtgagtggcgggagccatctgtgggcgccatggcaaagagggaggacagccctggcccagaggtccagccaatggacaagcagttcctggtatgcagcatctgcctggatcggtaccagtgccccaaggttcttccttgcctgcacaccttctgtgagagatgtctccaaaactatatccctgcccagagcctgacgctatcctgtccagtatgccggcagacgtccatcctcccagagcagggcgtctcggcactgcagaacaacttcttcatcagcagcctcatggaggcaatgcagcaggcacctgatggggcccacgacccggaggacccccaccccctcagtgtagtggctggccgccctctctcctgccccaaccatgaaggcaagacgatggagttttactgtgaggcctgtgagacggccatgtgtggtgagtgccgcgccggggagcatcgtgagcatggcacagtgctgctgagggatgtggtggagcagcacaaggcggccctgcagcgccagctcgaggctgtgcgtggccgattgccacagctgtccgcagcaattgccttagtcgggggcatcagccagcagctgcaggagcgcaaggcagaggccctggcccagatcagtgcagcgttcgaggacctggagcaagcactgcagcagcgcaagcaggctctggtcagcgacctggagaccatttgtggggccaaacagaaggtgttgcaaagccagctggacacactgcgccagggtcaggaacacatcggcagtagctgcagctttgcagagcaggcactgcgcctgggctcggccccggaggtgttgctggtgcgcaagcacatgcgagagcggctggctgcattggcggcacaggccttcccggagcggccacatgagaatgcacagctggaactggtccttgaggtggacggtctgcggcgatcggtgctcaatctgggcgcactgctcaccacgagcgccactgcacacgaaacggtggccacgggagagggcctgcgccaggcgctagtgggccagcctgcctcgctcactgtcactaccaaagacaaggacgggcggttggtgcgcacaggcagcgctgagctgcgtgcagagatcaccggcccggacggcacgcgccttccggtgccagtggtggaccacaagaatggcacatatgagctagtgtacacagcgcgcacggaaggcgagctgctcctctcggtgctgctctacggacagccagtgcgcggcagccccttccgcgtgcgtgccctgcgtccgggggacctgccaccttccccggacgatgtgaagcgccgtgtcaagtcccctggcggccccggcagccatgtgcgccagaaggcagtgcgtaggcccagctccatgtacagcacaggcggcaaacgaaaggacaacccaattgaggatgagctcgtcttccgtgttggcagtcgtggaagggagaaaggtgaattcaccaatttacaaggtgtgtccgcagccagcagcggccgcatcgtggtagcagacagcaacaaccagtgtattcaggttttctccaatgagggccagttcaagttccgttttggggtccgaggacgctcacctgggcagctgcagcgccccacaggtgtggcagtggacaccaatggagacataattgtggcagactatgacaaccgttgggtcagcatcttctcccctgagggcaagttcaagaccaagattggagctggccgcctcatgggccccaagggagtggccgtagaccggaatggacatatcattgtggtcgacaacaagtcttgctgcgtctttaccttccagcccaatggcaaactggttggccgttttgggggccgtggggccactgaccgccactttgcagggccccattttgtggctgtgaacaacaagaatgaaattgtagtaacggacttccataaccattcagtgaaggtgtacagtgccgatggagagttcctcttcaagtttggctcccatggcgagggcaatgggcagttcaatgcccccacaggagtagctgtggactccaatggaaacatcattgtggctgactggggcaacagccgcatccaggtattcgacagctctggctccttcctgtcctatatcaacacatctgcagaaccactgtatggtccacagggcctggcactgacctcggatggccatgtggtggtggctgatgctggcaaccactgctttaaagcctatcgctacctccagtagctgtacagaggccctgcctggcttgtggagggacagacattggggtgattggacaagagggtctggctgggaggtgggccagacctggcagcactgaatgtgggctgtgggcatgggtgcacccggtgccctccctctcctacccccacccccacggttgcactttatttattcggttcttgctttggtgactgggtgagcctggactgtggtcccaaggatgtgtgcagagcttcaccctacccttcttacacacctccccacccctgtcagtctgctccccatcccccagcctggggccagaacagcctaccccaggacaggagtccctctagttgtctccctaccaccctatacacactgacagagacagcaataccccaccccccatattaaataaatgtcttcaccaa

SEQ ID NO: 194896 - DNA, 3042 bp, Homo sapiens
  Payload ID: 18490
  Gene Name: tripartite motif containing 3
  Uniprot ID: O75382
  ENST ID: ENST00000359518
  CDS Start-End: 397-2631
cccccggccggtccgcagccccgccccggcccctccctccggcctgtgcggctagtccggcggcggcgccggcgcggggacaggcggaggcgcgggcagggccgggcggacgggcgctggcagcagtagcagcgccgcgggcccttcagagtggccgcagtccgagctttgccctcgcatcctgttccaacgcggaaaggacccctctggttctcctgtagcctgagccctgcctggaggaccccaggcccctccctggttctgacctcctcccttctgcaattggcttcagatcctgggctgcaaacctgcagggacagatggttgcaggttggaggggcaggctgcaccccagggagaggctggtgtgagtggcgggagccatctgtgggcgccatggcaaagagggaggacagccctggcccagaggtccagccaatggacaagcagttcctggtatgcagcatctgcctggatcggtaccagtgccccaaggttcttccttgcctgcacaccttctgtgagagatgtctccaaaactatatccctgcccagagcctgacgctatcctgtccagtatgccggcagacgtccatcctcccagagcagggcgtctcggcactgcagaacaacttcttcatcagcagcctcatggaggcaatgcagcaggcacctgatggggcccacgacccggaggacccccaccccctcagtgtagtggctggccgccctctctcctgccccaaccatgaaggcaagacgatggagttttactgtgaggcctgtgagacggccatgtgtggtgagtgccgcgccggggagcatcgtgagcatggcacagtgctgctgagggatgtggtggagcagcacaaggcggccctgcagcgccagctcgaggctgtgcgtggccgattgccacagctgtccgcagcaattgccttagtcgggggcatcagccagcagctgcaggagcgcaaggcagaggccctggcccagatcagtgcagcgttcgaggacctggagcaagcactgcagcagcgcaagcaggctctggtcagcgacctggagaccatttgtggggccaaacagaaggtgttgcaaagccagctggacacactgcgccagggtcaggaacacatcggcagtagctgcagctttgcagagcaggcactgcgcctgggctcggccccggaggtgttgctggtgcgcaagcacatgcgagagcggctggctgcattggcggcacaggccttcccggagcggccacatgagaatgcacagctggaactggtccttgaggtggacggtctgcggcgatcggtgctcaatctgggcgcactgctcaccacgagcgccactgcacacgaaacggtggccacgggagagggcctgcgccaggcgctagtgggccagcctgcctcgctcactgtcactaccaaagacaaggacgggcggttggtgcgcacaggcagcgctgagctgcgtgcagagatcaccggcccggacggcacgcgccttccggtgccagtggtggaccacaagaatggcacatatgagctagtgtacacagcgcgcacggaaggcgagctgctcctctcggtgctgctctacggacagccagtgcgcggcagccccttccgcgtgcgtgccctgcgtccgggggacctgccaccttccccggacgatgtgaagcgccgtgtcaagtcccctggcggccccggcagccatgtgcgccagaaggcagtgcgtaggcccagctccatgtacagcacaggcggcaaacgaaaggacaacccaattgaggatgagctcgtcttccgtgttggcagtcgtggaagggagaaaggtgaattcaccaatttacaaggtgtgtccgcagccagcagcggccgcatcgtggtagcagacagcaacaaccagtgtattcaggttttctccaatgagggccagttcaagttccgttttggggtccgaggacgctcacctgggcagctgcagcgccccacaggtgtggcagtggacaccaatggagacataattgtggcagactatgacaaccgttgggtcagcatcttctcccctgagggcaagttcaagaccaagattggagctggccgcctcatgggccccaagggagtggccgtagaccggaatggacatatcattgtggtcgacaacaagtcttgctgcgtctttaccttccagcccaatggcaaactggttggccgttttgggggccgtggggccactgaccgccactttgcagggccccattttgtggctgtgaacaacaagaatgaaattgtagtaacggacttccataaccattcagtgaaggtgtacagtgccgatggagagttcctcttcaagtttggctcccatggcgagggcaatgggcagttcaatgcccccacaggagtagctgtggactccaatggaaacatcattgtggctgactggggcaacagccgcatccaggtattcgacagctctggctccttcctgtcctatatcaacacatctgcagaaccactgtatggtccacagggcctggcactgacctcggatggccatgtggtggtggctgatgctggcaaccactgctttaaagcctatcgctacctccagtagctgtacagaggccctgcctggcttgtggagggacagacattggggtgattggacaagagggtctggctgggaggtgggccagacctggcagcactgaatgtgggctgtgggcatgggtgcacccggtgccctccctctcctacccccacccccacggttgcactttatttattcggttcttgctttggtgactgggtgagcctggactgtggtcccaaggatgtgtgcagagcttcaccctacccttcttacacacctccccacccctgtcagtctgctccccatcccccagcctggggccagaacagcctaccccaggacaggagtccctctagttgtctccctaccaccctatacacactgacagagacagcaataccccaccccccatattaaataaatgtcttcacc

SEQ ID NO: 194897 - DNA, 1117 bp, Homo sapiens
  Payload ID: 18490
  Gene Name: tripartite motif containing 3
  ENST ID: ENST00000528227
  CDS Start-End: 336-1117
ggcggcgccggcgcggggacaggcggaggcgcgggcagggccgggcggacgggcgctggcagcagtagcagcgccgcgggcccttcagagtggccgcagtccgagctttgccctcgcatcctgttccaacgcggaaaggacccctctggttctcctgtagcctgagccctgcctggaggaccccaggcccctccctggttctgacctcctcccttctgcaattggcttcagatcctgggctgcaaacctgcagggacagatggttgcaggttggaggggcaggctgcaccccagggagaggctggtgtgagtggcgggagccatctgtgggcgccatggcaaagagggaggacagccctggcccagaggtccagccaatggacaagcagttcctggtatgcagcatctgcctggatcggtaccagtgccccaaggttcttccttgcctgcacaccttctgtgagagatgtctccaaaactatatccctgcccagagcctgacgctatcctgtccagtatgccggcagacgtccatcctcccagagcagggcgtctcggcactgcagaacaacttcttcatcagcagcctcatggaggcaatgcagcaggcacctgatggggcccacgacccggaggacccccaccccctcagtgtagtggctggccgccctctctcctgccccaaccatgaaggcaagacgatggagttttactgtgaggcctgtgagacggccatgtgtggtgagtgccgcgccggggagcatcgtgagcatggcacagtgctgctgagggatgtggtggagcagcacaaggcggccctgcagcgccagctcgaggctgtgcgtggccgattgccacagctgtccgcagcaattgccttagtcgggggcatcagccagcagctgcaggagcgcaaggcagaggccctggcccagatcagtgcagcgttcgaggacctggagcaagcactgcagcagcgcaagcaggctctggtcagcgacctggagaccatttgtggggccaaacagaaggtgttgcaaagccagctggacacactgcgccagggtcaggaacacatcggcagtagctgcagctttgcagagcaggcactgcgcct

SEQ ID NO: 194898 - DNA, 3044 bp, Homo sapiens
  Payload ID: 18490
  Gene Name: tripartite motif containing 3
  Uniprot ID: O75382
  ENST ID: ENST00000525074
  CDS Start-End: 396-2630
ccttctcccagagttctgggtactgcccttctgccgcccagagatcgtgctgaggtacagacggtttctacgtcttcctggtcagccgatagactagcatattccataggagcactccaaggaagccggaaagggcgcctccaggaggcaggcggcccagacaggctcccagagtccgaaatccctgctgccccagctgccttttcttgacggagtctcatctcaatccctgagaccgactacaccgcccttcccggagccggaggcagctggcggagatccgggatccgagatccgggatccggctcgccggcccgccggctccctagcagcaccaaggaggcagcgtccgcaggagaggctggtgtgagtggcgggagccatctgtgggcgccatggcaaagagggaggacagccctggcccagaggtccagccaatggacaagcagttcctggtatgcagcatctgcctggatcggtaccagtgccccaaggttcttccttgcctgcacaccttctgtgagagatgtctccaaaactatatccctgcccagagcctgacgctatcctgtccagtatgccggcagacgtccatcctcccagagcagggcgtctcggcactgcagaacaacttcttcatcagcagcctcatggaggcaatgcagcaggcacctgatggggcccacgacccggaggacccccaccccctcagtgtagtggctggccgccctctctcctgccccaaccatgaaggcaagacgatggagttttactgtgaggcctgtgagacggccatgtgtggtgagtgccgcgccggggagcatcgtgagcatggcacagtgctgctgagggatgtggtggagcagcacaaggcggccctgcagcgccagctcgaggctgtgcgtggccgattgccacagctgtccgcagcaattgccttagtcgggggcatcagccagcagctgcaggagcgcaaggcagaggccctggcccagatcagtgcagcgttcgaggacctggagcaagcactgcagcagcgcaagcaggctctggtcagcgacctggagaccatttgtggggccaaacagaaggtgttgcaaagccagctggacacactgcgccagggtcaggaacacatcggcagtagctgcagctttgcagagcaggcactgcgcctgggctcggccccggaggtgttgctggtgcgcaagcacatgcgagagcggctggctgcattggcggcacaggccttcccggagcggccacatgagaatgcacagctggaactggtccttgaggtggacggtctgcggcgatcggtgctcaatctgggcgcactgctcaccacgagcgccactgcacacgaaacggtggccacgggagagggcctgcgccaggcgctagtgggccagcctgcctcgctcactgtcactaccaaagacaaggacgggcggttggtgcgcacaggcagcgctgagctgcgtgcagagatcaccggcccggacggcacgcgccttccggtgccagtggtggaccacaagaatggcacatatgagctagtgtacacagcgcgcacggaaggcgagctgctcctctcggtgctgctctacggacagccagtgcgcggcagccccttccgcgtgcgtgccctgcgtccgggggacctgccaccttccccggacgatgtgaagcgccgtgtcaagtcccctggcggccccggcagccatgtgcgccagaaggcagtgcgtaggcccagctccatgtacagcacaggcggcaaacgaaaggacaacccaattgaggatgagctcgtcttccgtgttggcagtcgtggaagggagaaaggtgaattcaccaatttacaaggtgtgtccgcagccagcagcggccgcatcgtggtagcagacagcaacaaccagtgtattcaggttttctccaatgagggccagttcaagttccgttttggggtccgaggacgctcacctgggcagctgcagcgccccacaggtgtggcagtggacaccaatggagacataattgtggcagactatgacaaccgttgggtcagcatcttctcccctgagggcaagttcaagaccaagattggagctggccgcctcatgggccccaagggagtggccgtagaccggaatggacatatcattgtggtcgacaacaagtcttgctgcgtctttaccttccagcccaatggcaaactggttggccgttttgggggccgtggggccactgaccgccactttgcagggccccattttgtggctgtgaacaacaagaatgaaattgtagtaacggacttccataaccattcagtgaaggtgtacagtgccgatggagagttcctcttcaagtttggctcccatggcgagggcaatgggcagttcaatgcccccacaggagtagctgtggactccaatggaaacatcattgtggctgactggggcaacagccgcatccaggtattcgacagctctggctccttcctgtcctatatcaacacatctgcagaaccactgtatggtccacagggcctggcactgacctcggatggccatgtggtggtggctgatgctggcaaccactgctttaaagcctatcgctacctccagtagctgtacagaggccctgcctggcttgtggagggacagacattggggtgattggacaagagggtctggctgggaggtgggccagacctggcagcactgaatgtgggctgtgggcatgggtgcacccggtgccctccctctcctacccccacccccacggttgcactttatttattcggttcttgctttggtgactgggtgagcctggactgtggtcccaaggatgtgtgcagagcttcaccctacccttcttacacacctccccacccctgtcagtctgctccccatcccccagcctggggccagaacagcctaccccaggacaggagtccctctagttgtctccctaccaccctatacacactgacagagacagcaataccccaccccccatattaaataaatgtcttcaccaag

SEQ ID NO: 194899 - DNA, 785 bp, Homo sapiens
  Payload ID: 18490
  Gene Name: tripartite motif containing 3
  ENST ID: ENST00000529529
  CDS Start-End: 496-785
ttctacgtcttcctggtcagccgatagactagcatattccataggagcactccaaggaagccggaaagggcgcctccaggaggcaggcggcccagacaggctcccagagtccgaaatccctgctgccccagctgccttttcttgacggagtctcatctcaatccctgagaccgactacaccgcccttcccggagccggaggcagctggcggagatccgggatccgagatccgggatccggctcgccggcccgccggctccctagcagcaccaaggaggcagcgtccgcaggaggaaaggacccctctggttctcctgtagcctgagccctgcctggaggaccccaggcccctccctggttctgacctcctcccttctgcaattggcttcagatcctgggctgcaaacctgcagggacagatggttgcaggttggaggggcaggctgcaccccagggagaggctggtgtgagtggcgggagccatctgtgggcgccatggcaaagagggaggacagccctggcccagaggtccagccaatggacaagcagttcctggtatgcagcatctgcctggatcggtaccagtgccccaaggttcttccttgcctgcacaccttctgtgagagatgtctccaaaactatatccctgcccagagcctgacgctatcctgtccagtatgccggcagacgtccatcctcccagagcagggcgtctcggcactgcagaacaacttcttcatcagcagcctcatggaggcaatgcagcaggcacctgatggggccca

SEQ ID NO: 194900 - DNA, 2704 bp, Homo sapiens
  Payload ID: 18490
  Gene Name: tripartite motif containing 3
  Uniprot ID: O75382
  ENST ID: ENST00000536344
  CDS Start-End: 416-2293
cccccggccggtccgcagccccgccccggcccctccctccggcctgtgcggctagtccggcggcggcgccggcgcggggacaggcggaggcgcgggcagggccgggcggacgggcgctggcagcagtagcagcgccgcgggcccttcagagtggccgcagtccgagctttgccctcgcatcctgttccaacgcgatgtctccaaaactatatccctgcccagagcctgacgctatcctgtccagtatgccggcagacgtccatcctcccagagcagggcgtctcggcactgcagaacaacttcttcatcagcagcctcatggaggcaatgcagcaggcacctgatggggcccacgacccggaggacccccaccccctcagtgtagtggctggccgccctctctcctgccccaaccatgaagacgatggagttttactgtgaggcctgtgagacggccatgtgtggtgagtgccgcgccggggagcatcgtgagcatggcacagtgctgctgagggatgtggtggagcagcacaaggcggccctgcagcgccagctcgaggctgtgcgtggccgattgccacagctgtccgcagcaattgccttagtcgggggcatcagccagcagctgcaggagcgcaaggcagaggccctggcccagatcagtgcagcgttcgaggacctggagcaagcactgcagcagcgcaagcaggctctggtcagcgacctggagaccatttgtggggccaaacagaaggtgttgcaaagccagctggacacactgcgccagggtcaggaacacatcggcagtagctgcagctttgcagagcaggcactgcgcctgggctcggccccggaggtgttgctggtgcgcaagcacatgcgagagcggctggctgcattggcggcacaggccttcccggagcggccacatgagaatgcacagctggaactggtccttgaggtggacggtctgcggcgatcggtgctcaatctgggcgcactgctcaccacgagcgccactgcacacgaaacggtggccacgggagagggcctgcgccaggcgctagtgggccagcctgcctcgctcactgtcactaccaaagacaaggacgggcggttggtgcgcacaggcagcgctgagctgcgtgcagagatcaccggcccggacggcacgcgccttccggtgccagtggtggaccacaagaatggcacatatgagctagtgtacacagcgcgcacggaaggcgagctgctcctctcggtgctgctctacggacagccagtgcgcggcagccccttccgcgtgcgtgccctgcgtccgggggacctgccaccttccccggacgatgtgaagcgccgtgtcaagtcccctggcggccccggcagccatgtgcgccagaaggcagtgcgtaggcccagctccatgtacagcacaggcggcaaacgaaaggacaacccaattgaggatgagctcgtcttccgtgttggcagtcgtggaagggagaaaggtgaattcaccaatttacaaggtgtgtccgcagccagcagcggccgcatcgtggtagcagacagcaacaaccagtgtattcaggttttctccaatgagggccagttcaagttccgttttggggtccgaggacgctcacctgggcagctgcagcgccccacaggtgtggcagtggacaccaatggagacataattgtggcagactatgacaaccgttgggtcagcatcttctcccctgagggcaagttcaagaccaagattggagctggccgcctcatgggccccaagggagtggccgtagaccggaatggacatatcattgtggtcgacaacaagtcttgctgcgtctttaccttccagcccaatggcaaactggttggccgttttgggggccgtggggccactgaccgccactttgcagggccccattttgtggctgtgaacaacaagaatgaaattgtagtaacggacttccataaccattcagtgaaggtgtacagtgccgatggagagttcctcttcaagtttggctcccatggcgagggcaatgggcagttcaatgcccccacaggagtagctgtggactccaatggaaacatcattgtggctgactggggcaacagccgcatccaggtattcgacagctctggctccttcctgtcctatatcaacacatctgcagaaccactgtatggtccacagggcctggcactgacctcggatggccatgtggtggtggctgatgctggcaaccactgctttaaagcctatcgctacctccagtagctgtacagaggccctgcctggcttgtggagggacagacattggggtgattggacaagagggtctggctgggaggtgggccagacctggcagcactgaatgtgggctgtgggcatgggtgcacccggtgccctccctctcctacccccacccccacggttgcactttatttattcggttcttgctttggtgactgggtgagcctggactgtggtcccaaggatgtgtgcagagcttcaccctacccttcttacacacctccccacccctgtcagtctgctccccatcccccagcctggggccagaacagcctaccccaggacaggagtccctctagttgtctccctaccaccctatacacactgacagagacagcaataccccaccccccatattaaataaatgtcttcacc

SEQ ID NO: 194901 - DNA, 2043 bp, Homo sapiens
  Payload ID: 18491
  Gene Name: tripartite motif containing 31
  Uniprot ID: Q9BZY9
  ENST ID: ENST00000357569
  CDS Start-End: 127-1404
attacacattcaaagtatccatttgttctcaagaggtagcaagaaacagtatccacagtggactccggggctcctacagacttggcacagcttcctacagtcttgaaacagccctgttgttctgtcatggccagtgggcagtttgtgaacaaactgcaagaggaagtgatctgccccatctgcctggacattctgcagaaacctgtcaccatcgactgtgggcacaatttctgcctcaaatgcatcactcagattggggaaacatcatgtggatttttcaaatgtcccctctgcaaaacttccgtaaggaagaacgcaatcaggttcaactcgctgttgcggaatctggtggagaaaatccaagctctacaagcctctgaggtgcagtccaaaaggaaagaggctacatgcccgaggcaccaggagatgttccactatttctgcgaggatgatgggaagttcctctgttttgtgtgttgtgaatccaaggaccacaaatcccataatgtcagcttgatcgaagaagctgcccagaattatcaggggcagattcaagagcagatccaagtcttgcagcaaaaggagaaggagacagtacaagtgaaggcacaaggtgtacacagggtcgatgtcttcacggaccaggtagaacatgagaagcaaaggatcctcacagaatttgaactcctgcatcaagtcctagaggaggagaagaatttcctgctatcacggatttactggctgggtcatgagggaacggaagcggggaaacactatgttgcctccactgagccacagttgaacgatctcaagaagctcgttgattccctgaagaccaagcagaacatgccacccaggcagctgctggaggatatcaaagtcgtcttgtgcagaagtgaagagtttcagtttctcaacccaacccctgttcctctggaactggagaaaaaactcagtgaagcaaaatcaagacacgactccatcacagggagcctgaaaaaattcaaagaccaactccaggctgataggaaaaaagatgaaaacagattcttcaaaagcatgaataaaaatgacatgaagagctggggcttgttacagaaaaataatcataaaatgaacaaaacctcagagcccgggtcatcttctgcaggcggcagaactacatcggggccaccaaatcaccactcttcagccccatcccactccctgtttcgggcctcgtctgctgggaaagtcacttttccagtatgtctcctggcctcttatgatgagatttctggtcaaggagcgagctctcaggatacgaagacatttgacgttgcgctgtccgaggagctccatgcggcactgagtgagtggctgacagcgatccgggcttggttttgtgaggttccttcaagctaagccagctcagagaacacggggagcggtggtgctacacggacttcggagcatagagtggcgctgagtgagtggctgagaccgaccacggttcttgacttagtggaattgggtcgaaggagtggagaatgggagggctcgggctactgagagtggagatgggggcgggggtggtggtgaagagagttggagaaggaatggacgagttcttgagcaaaaggaggggaagagacaatctccagccacccgccccacgcttgacttcttatcactttggctgtggtgccgcctagtggaaaaaggaagtccctgcagcagtccccgcactctttaagcagctgtttaccgaaggcaccagttcagccaggagtgaaatccggagaggagcaacgccagcctgggtcacagtccatcaaaccccatgagcccgaccactctcgctcttccttacattcccacgtcccccttctctcccaacccctcatatcagcaagggaaattaattaatgagatttgataaatcagtagatagaatgaggtccccattctgaaatatttagcagactggaaccaccacgcaagcctctgtagggggtggatggagacacttctaactttaataaactgcgactgaacgtggaa

SEQ ID NO: 194902 - DNA, 2043 bp, Homo sapiens
  Payload ID: 18491
  Gene Name: tripartite motif containing 31
  Uniprot ID: Q9BZY9
  ENST ID: ENST00000376734
  CDS Start-End: 127-1404
attacacattcaaagtatccatttgttctcaagaggtagcaagaaacagtatccacagtggactccggggctcctacagacttggcacagcttcctacagtcttgaaacagccctgttgttctgtcatggccagtgggcagtttgtgaacaaactgcaagaggaagtgatctgccccatctgcctggacattctgcagaaacctgtcaccatcgactgtgggcacaatttctgcctcaaatgcatcactcagattggggaaacatcatgtggatttttcaaatgtcccctctgcaaaacttccgtaaggaagaacgcaatcaggttcaactcgctgttgcggaatctggtggagaaaatccaagctctacaagcctctgaggtgcagtccaaaaggaaagaggctacatgcccgaggcaccaggagatgttccactatttctgcgaggatgatgggaagttcctctgttttgtgtgtcgtgaatccaaggaccacaaatcccataatgtcagcttgatcgaagaagctgcccagaattatcaggggcagattcaagagcagatccaagtcttgcagcaaaaggagaaggagacagtacaagtgaaggcacaaggtgtacacagggtcgatgtcttcacggaccaggtagaacatgagaagcaaaggatcctcacagaatttgaactcctgcatcaagtcctagaggaggagaagaatttcctgctatcacggatttactggctgggtcatgagggaacggaagcggggaaacactatgttgcctccactgagccacagttgaacgatctcaagaagctcgttgattccctgaagaccaagcagaacatgccacccaggcagctgctggaggatatcaaagtcgtcttgtgcagaagtgaagagtttcagtttctcaacccaacccctgttcctctggaactggagaaaaaactcagtgaagcaaaatcaagacatgactccatcacagggagcctaaaaaaattcaaagaccaactccaggctgataggaaaaaagatgaaaacagattcttcaaaagcatgaataaaaatgacatgaagagctggggcttgttacagaaaaataatcataaaatgaacaaaacctcagagcccgggtcatcttctgcaggcggcagaactacatcggggccaccaaatcaccactcttcagccccatcccactccctgtttcgggcctcgtctgctgggaaagtcacttttccagtatgtctcctggcctcttatgatgagatttctggtcaaggagcgagctctcaggatacgaagacatttgacgttgcgctgtccgaggagctccatgcggcactgagtgagtggctgacagcgatccgggcttggttttgtgaggttccttcaagctaagccagctcagagaacacggggagcggtggtgctacacggacttcggagcatagagtggcgctgagtgagtggctgagaccgaccacggttcttgacttagtggaattgggtcgaaggagtggagaatgggagggctcgggctactgagagtggagatgggggcgggggtggtggtgaagagagttggagaaggaatggacgaattcttgagcaaaaggaggggaagagacaatctccagccacccgccccacgcttgacttcttatcactttggctgtggtgccgcctagtggaaaaaggaagtccctgcagcagtccccgcactctttaagcagctgtttaccgaaggcaccagttcagccaggagtgaaatccggagaggagcaacgccagcctgggtcacagtccatcaaaccccatgagcccgaccactctcgctcttccttacattcccacgtcccccttctctcccaacccctcatatcagcaagggaaattaattaatgagatttgataaatcagtagatagaatgaggtccccattctgaaatatttagcagactggaaccaccacgcaagcctctgtagggggtggatggagacacttctaactttaataaactgcgactgaacgtggaa

SEQ ID NO: 194903 - DNA, 2043 bp, Homo sapiens
  Payload ID: 18491
  Gene Name: tripartite motif containing 31
  Uniprot ID: Q9BZY9
  ENST ID: ENST00000433864
  CDS Start-End: 127-1404
attacacattcaaagtatccatttgttctcaagaggtagcaagaaacagtatccacagtggactccggggctcctacagacttggcacagcttcctacagtcttgaaacagccctgttgttctgtcatggccagtgggcagtttgtgaacaaactgcaagaggaagtgatctgccccatctgcctggacattctgcagaaacctgtcaccatcgactgtgggcacaatttctgcctcaaatgcatcactcagattggggaaacatcatgtggatttttcaaatgtcccctctgcaaaacttccgtaaggaagaacgcaatcaggttcaactcgctgttgcggaatctggtggagaaaatccaagctctacaagcctctgaggtgcagtccaaaaggaaagaggctacatgcccgaggcaccaggagatgttccactatttctgcgaggatgatgggaagttcctctgttttgtgtgtcgtgaatccaaggaccacaaatcccataatgtcagcttgatcgaagaagctgcccagaattatcaggggcagattcaagagcagatccaagtcttgcagcaaaaggagaaggagacagtacaagtgaaggcacaaggtgtacacagggtcgatgtcttcacggaccaggtagaacatgagaagcaaaggatcctcacagaatttgaactcctgcatcaagtcctagaggaggagaagaatttcctgctatcacggatttactggctgggtcatgagggaacggaagcggggaaacactatgttgcctccactgagccacagttgaacgatctcaagaagctcgttgattccctgaagaccaagcagaacatgccacccaggcagctgctggaggatatcaaagtcgtcttgtgcagaagtgaagagtttcagtttctcaacccaacccctgttcctctggaactggagaaaaaactcagtgaagcaaaatcaagacacgactccatcacagggagcctgaaaaaattcaaagaccaactccaggctgataggaaaaaagatgaaaacagattcttcaaaagcatgaataaaaatgacatgaagagctggggcttgttacagaaaaataatcataaaatgaacaaaacctcagagcccgggtcatcttctgcaggcggcagaactacatcggggccaccaaatcaccactcttcagccccatcccactccctgtttcgggcctcgtctgctgggaaagtcacttttccagtatgtctcctggcctcttatgatgagatttctggtcaaggagcgagctctcaggatacgaagacatttgacgttgcgctgtccgaggagctccatgcggcactgagtgagtggctgacagcgatccgggcttggttttgtaaggttccttcaagctaagccagctcagagaacacggggagcggtggtgctccacggacttcggagcatagagtggcgctgagtgagtggctgagaccgaccacggttcttgacttagtggaattgggtcgaaggagtggagaatgggagggctcgggctactgagagtggagatgggggcgggggtggtggtgaagagagttggagaaggaatggacgagttcttgagcaaaaggaggggaagagacaatctccagccacccgccccacgcttgacttcttatcactttggctgtggtgccgcctagtggaaaaaggaagtccctgcagcagtccccgcactctttaagcagctgtttaccgaaggcaccagttcagccaggagtgaaatccagagacgagcaacgccagcctgggtcacagtccatcaaaccccatgagcccgaccactctcgctcttccttacattcccacgtcccccttctctcccaacccctcatatcagcaagggaaattaattaatgagatttgataaatcagtagatagaatgaggtccccattctgaaatatttagcagactggaaccaccacgcaagcctctgtagggggtggatggagacacttctaactttaataaactgcgactgaacgtggaa

SEQ ID NO: 194904 - DNA, 2043 bp, Homo sapiens
  Payload ID: 18491
  Gene Name: tripartite motif containing 31
  Uniprot ID: Q9BZY9
  ENST ID: ENST00000453266
  CDS Start-End: 127-1404
attacacattcaaagtatccatttgttctcaagaggtagcaagaaacagtatccacagtggactccggggctcctacagacttggcacagcttcctacagtcttgaaacagccctgttgttctgtcatggccagtgggcagtttgtgaacaaactgcaagaggaagtgatctgccccatctgcctggacattctgcagaaacctgtcaccatcgactgtgggcacaatttctgcctcaaatgcatcactcagattggggaaacatcatgtggatttttcaaatgtcccctctgcaaaacttccgtaaggaagaacgcaatcaggttcaactcgctgttgcggaatctggtggagaaaatccaagctctacaagcctctgaggtgcagtccaaaaggaaagaggctacatgcccgaggcaccaggagatgttccactatttctgcgaggatgatgggaagttcctctgttttgtgtgtcgtgaatccaaggaccacaaatcccataatgtcagcttgatcgaagaagctgcccagaattatcaggggcagattcaagagcagatccaagtcttgcagcaaaaggagaaggagacagtacaagtgaaggcacaaggtgtacacagggtcgatgtcttcacggaccaggtagaacatgagaagcaaaggatcctcacagaatttgaactcctgcatcaagtcctagaggaggagaagaatttcctgctatcacggatttactggctgggtcatgagggaacggaagcggggaaacactatgttgcctccactgagccacagttgaacgatctcaagaagctcgttgattccctgaagaccaagcagaacatgccacccaggcagctgctggaggatatcaaagtcgtcttgtgcagaagtgaagagtttcagtttctcaacccaacccctgttcctctggaactggagaaaaaactcagtgaagcaaaatcaagacacgactccatcacagggagcctgaaaaaattcaaagaccaactccaggctgataggaaaaaagatgaaaacagattcttcaaaagcatgaataaaaatgacatgaagagctggggcttgttacagaaaaataatcataaaatgaacaaaacctcagagcccgggtcatcttctgcaggcggcagaactacatcggggccaccaaatcaccactcttcagccccatcccactccctgtttcgggcctcgtctgctgggaaagtcacttttccagtatgtctcctggcctcttatgatgagatttctggtcaaggagcgagctctcaggatacgaagacatttgacgttgcgctgtccgaggagctccatgcggcactgagtgagtggctgacagcgatccgggcttggttttgtgaggttccttcaagctaagccagctcagagaacacggggagcggtggtgctacacggacttcggagcatagagtggcgctgagtgagtggctgagaccgaccacggttcttgacttagtggaattgggtcgaaggagtggagaatgggagggctcgggctactgagagtggagatgggggcgggggtggtggtgaagagagttggagaaggaatggacgagttcttgagcaaaaggaggggaagagacaatctccagccacccgccccacgcttgacttcttatcactttggctgtggtgccgcctagtggaaaaaggaagtccctgcagcagtccccgcactctttaagcagctgtttaccgaaggcaccagttcagccaggagtgaaatccggagaggagcaacgccagcctgggtcacagtccatcaaaccccatgagcccgaccactctcgctcttccttacattcccacgtcccccttctctcccaacccctcatatcagcaagggaaattaattaatgagatttgataaatcagtagatagaatgaggtccccattctgaaatatttagcagactggaaccaccacgcaagcctctgtagggggtggatggagacacttctaactttaataaactgcgactgaacgtggaa

SEQ ID NO: 194905 - DNA, 2043 bp, Homo sapiens
  Payload ID: 18491
  Gene Name: tripartite motif containing 31
  Uniprot ID: Q9BZY9
  ENST ID: ENST00000449412
  CDS Start-End: 127-1404
attacacattcaaagtatccatttgttctcaagaggtagcaagaaacagtatccacagtggactccggggctcctacagacttggcacagcttcctacagtcttgaaacagccctgttgttctgtcatggccagtgggcagtttgtgaacaaactgcaagaggaagtgatctgccccatctgcctggacattctgcagaaacctgtcaccatcgactgtgggcacaatttctgcctcaaatgcatcactcagattggggaaacatcatgtggatttttcaaatgtcccctctgcaaaacttccgtaaggaagaacgcaatcaggttcaactcgctgttgcggaatctggtggagaaaatccaagctctacaagcctctgaggtgcagtccaaaaggaaagaggctacatgcccgaggcaccaggagatgttccactatttctgcgaggatgatgggaagttcctctgttttgtgtgtcgtgaatccaaggaccacaaatcccataatgtcagcttgatcgaagaagctgcccagaattatcaggggcagattcaagagcagatccaagtcttgcagcaaaaggagaaggagacagtacaagtgaaggcacaaggtgtacacagggtcgatgtcttcacggaccaggtagaacatgagaagcaaaggatcctcacagaatttgaactcctgcatcaagtcctagaggaggagaagaatttcctgctatcacggatttactggctgggtcatgagggaacggaagcggggaaacactatgttgcctccactgagccacagttgaacgatctcaagaagctcgttgattccctgaagaccaagcagaacatgccacccaggcagctgctggaggatatcaaagtcgtcttgtgcagaagtgaagagtttcagtttctcaacccaacccctgttcctctagaactggagaaaaaactcagtgaagcaaaatcaagacacgactccatcacagggagcctgaaaaaattcaaagaccaactccaggctgataggaaaaaagatgaaaacagattcttcaaaagcatgaataaaaatgacatgaagagctggggcttgttacagaaaaataatcataaaatgaacaaaacctcagagcccgggtcatcttctgcaggcggcagaactacatcggggccaccaaatcaccactcttcagccccatcccactccctgtttcgggcctcgtctgctgggaaagtcacttttccagtatgtctcctggcctcttatgatgagatttctggtcaaggagcgagctctcaggatacgaagacatttgacgttgcgctgtccgaggagctccatgcggcactgagtgagtggctgacagcgatccgggcttggttttgtgaggttccttcaagctaagccagctcagagaacacggggagcggtggtgctacacggacttcggagcatagagtggcgctgagtgagtggctgagaccgaccacggttcttgacttagtggaattgggtcgaaggagtggagaatgggagggctcgggctactgagagtggagatgggggcgggggtggtggtgaagagagttggagaaggaatggacgaattcttgagcaaaaggaggggaagagacaatctccagccacccgccccacgcttgacttcttatcactttggctgtggtgccgcctagtggaaaaaggaagtccctgcagcagtccccgcactctttaagcagctgtttaccgaaggcaccagttcagccaggagtgaaatccggagaggagcaacgccagcctgggtcacagtccatcaaaccccatgagcccgaccactctcgctcttccttacattcccacgtcccccttctctcccaacccctcatatcagcaagggaaattaattaatgagatttgataaatcagtagatagaatgaggtccccattctgaaatatttagcagactggaaccaccacgcaagcctctgtagggggtggatggagacacttctaactttaataaactgcgactgaacgtggaa

SEQ ID NO: 194906 - DNA, 870 bp, Homo sapiens
  Payload ID: 18491
  Gene Name: tripartite motif containing 31
  ENST ID: ENST00000422484
  CDS Start-End: 127-870
attacacattcaaagtatccatttgttctcaagaggtagcaagaaacagtatccacagtggactccggggctcctacagacttggcacagcttcctacagtcttgaaacagccctgttgttctgtcatggccagtgggcagtttgtgaacaaactgcaagaggaagtgatctgccccatctgcctggacattctgcagaaacctgtcaccatcgactgtgggcacaatttctgcctcaaatgcatcactcagattggggaaacatcatgtggatttttcaaatgtcccctctgcaaaacttccgtaaggaagaacgcaatcaggttcaactcgctgttgcggaatctggtggagaaaatccaagctctacaagcctctgaggtgcagtccaaaaggaaagaggctacatgcccgaggcaccaggagatgttccactatttctgcgaggatgatgggaagttcctctgttttgtgtgtcgtgaatccaaggaccacaaatcccataatgtcagcttgatcgaagaagctgcccagaattatcaggggcagattcaagagcagatccaagtcttgcagcaaaaggagaaggagacagtacaagtgaaggcacaaggtgtacacagggtcgatgtcttcacggaccaggtagaacatgagaagcaaaggatcctcacagaatttgaactcctgcatcaagtcctagaggaggagaagaatttcctgctatcacggatttactggctgggtcatgagggaacggaagcggggaaacactatgttgcctccactgagccacagttgaacgatctcaagaagctcgttgattccctgaagaccaagcagaacatgccacccaggcagctgctggag

SEQ ID NO: 194907 - DNA, 2043 bp, Homo sapiens
  Payload ID: 18491
  Gene Name: tripartite motif containing 31
  Uniprot ID: Q9BZY9
  ENST ID: ENST00000445679
  CDS Start-End: 127-1404
attacacattcaaagtatccatttgttctcaagaggtagcaagaaacagtatccacagtggactccggggctcctacagacttggcacagcttcctacagtcttgaaacagccctgttgttctgtcatggccagtgggcagtttgtgaacaaactgcaagaggaagtgatctgccccatctgcctggacattctgcagaaacctgtcaccatcgactgtgggcacaatttctgcctcaaatgcatcactcagattggggaaacatcatgtggatttttcaaatgtcccctctgcaaaacttccgtaaggaagaacgcaatcaggttcaactcgctgttgcggaatctggtggagaaaatccaagctctacaagcctctgaggtgcagtccaaaaggaaagaggctacatgcccgaggcaccaggagatgttccactatttctgcgaggatgatgggaagttcctctgttttgtgtgtcgtgaatccaaggaccacaaatcccataatgtcagcttgatcgaagaagctgcccagaattatcaggggcagattcaagagcagatccaagtcttgcagcaaaaggagaaggagacagtacaagtgaaggcacaaggtgtacacagggtcgatgtcttcacggaccaggtagaacatgagaagcaaaggatcctcacagaatttgaactcctgcatcaagtcctagaggaggagaagaatttcctgctatcacggatttactggctgggtcatgagggaacggaagcggggaaacactatgttgcctccactgagccacagttgaacgatctcaagaagctcgttgattccctgaagaccaagcagaacatgccacccaggcagctgctggaggatatcaaagtcgtcttgtgcagaagtgaagagtttcagtttctcaacccaacccctgttcctctagaactggagaaaaaactcagtgaagcaaaatcaagacacgactccatcacagggagcctgaaaaaattcaaagaccaactccaggctgataggaaaaaagatgaaaacagattcttcaaaagcatgaataaaaatgacatgaagagctggggcttgttacagaaaaataatcataaaatgaacaaaacctcagagcccgggtcatcttctgcaggcggcagaactacatcggggccaccaaatcaccactcttcagccccatcccactccctgtttcgggcctcgtctgctgggaaagtcacttttccagtatgtctcctggcctcttatgatgagatttctggtcaaggagcgagctctcaggatacgaagacatttgacgttgcgctgtccgaggagctccatgcggcactgagtgagtggctgacagcgatccgggcttggttttgtgaggttccttcaagctaagccagctcagagaacacggggagcggtggtgctacacggacttcggagcatagagtggcgctgagtgagtggctgagaccgaccacggttcttgacttagtggaattgggtcgaaggagtggagaatgggagggctcgggctactgagagtggagatgggggcgggggtggtggtgaagagagttggagaaggaatggacgagttcttgagcaaaaggaggggaagagacaatctccagccacccgccccacgcttgacttcttatcactttggctgtggtgccgcctagtggaaaaaggaagtccctgcagcagtccccgcactctttaagcagctgtttaccgaaggcaccagttcagccaggagtgaaatccggagaggagcaacgccagcctgggtcacagtccatcaaaccccatgagcccgaccactctcgctcttccttacattcccacgtcccccttctctcccaacccctcatatcagcaagggaaattaattaatgagatttgataaatcagtagatagaatgaggtccccattctgaaatatttagcagactggaaccaccacgcaagcctctgtagggggtggatggagacacttctaactttaataaactgcgactgaacgtggaa

SEQ ID NO: 194908 - DNA, 2043 bp, Homo sapiens
  Payload ID: 18491
  Gene Name: tripartite motif containing 31
  ENST ID: ENST00000455349
  CDS Start-End: 127-1404
attacacattcaaagtatccatttgttctcaagaggtagcaagaaacagtatccacagtggactccggggctcctacagacttggcacagcttcctacagtcttgaaacagccctgttgttctgtcatggccagtgggcagtttgtgaacaaactgcaagaggaagtgatctgccccatctgcctggacattctgcagaaacctgtcaccattgactgtgggcacaatttctgcctcaaatgcatcactcagattggggaaacatcatgtggatttttcaaatgtcccctctgcaaaacttccgtaaggaagaacgcaatcaggttcaactcgctgttgcggaatctggtggagaaaatccaagctctacaagcctctgaggtgcagtccaaaaggaaagaggctacatgcccgaggcaccaggagatgttccattatttctgcgaggatgatgggaagttcctctgttttgtgtgtcgtgaatccaaggaccacaaatcccataatgtcagcttgatcgaagaagctgcccagaattatcaggggcagattcaagagcagatccaagtcttgcagcaaaaggagaaggagacagtacaagtgaaggcacaaggtgtacacagggtcgatgtcttcacggaccaggtagaacatgagaagcaaaggatcctcacagaatttgaactcctgcatcaagtcctagaggaggagaagaatttcctgctatcacggatttactggctgggtcatgagggaacggaagcagggaaacactatgttgcctccactgagccacagttgaacgatctcaagaagctcattgattccctgaagaccaagcagaacatgccacccaggcagctgctggaggatatcaaagtcgtcttgtgcagaagtgaagagtttcagtttctcaacccaacccctgttcctctggaactggagaaaaaactcagtgaagcaaaatcaagacatgactccatcacagggagcctgaaaaaattcaaagaccaactccaggctgataggaaaaaagatgaaaacagattcttcaaaagcatgaataaaaatgacatgaagagctggggcttgttacagaaaaataatcataaaatgaacaaaacctcagagcccgggtcatcttctgcaggcggcagaactacatcggggccaccaaatcaccactcttcagccccatcccactccctgtttcgggcctcgtctgctgggaaagtcacttttccagtatgtctcctggcctcttatgatgagatttctggtcaaggagcgagctctcaggatacgaagacatttgacgttgcgctgtccgaggagctccatgcggcactgagtgagtggctgacagcgatccgggcttggttttgtaaggttccttcaagctaagccagctcagagaacacggggagcggtggtgctccacggacttcggagcatagagtggcgctgagtgagtggctgagaccgaccacggttcttgacttagtggaattgggtcgaaggagtggagaatgggagggctcgggctactgagagtggagatgggggcgggggtggtggtgaagagagttggagaaggaatggacgagttcttgagcaaaaggaggggaagagacaatctccagccacccgccccacgcttgacttcttatcactttggctgtggtgccgcctagtggaaaaaggaagtccctgcagcagtccccgcactctttaagcagctgtttaccgaaggcaccagttcagccaggagtgaaatccagagacgagcaacgccagcctgggtcacagtccatcaaaccccatgagcccgaccactctcgctcttccttacattcccacgtcccccttctctcccaacccctcatatcagcaagggaaattaattaatgagatttgataaatcagtagatagaatgaggtccccattctgaaatatttagcagactggaaccaccacgcaagcctctgtagggggtggatggagacacttctaactttaataaactgcgactgaacgtggaa

SEQ ID NO: 194909 - DNA, 3688 bp, Homo sapiens
  Payload ID: 18492
  Gene Name: tripartite motif containing 32
  Uniprot ID: Q13049
  ENST ID: ENST00000373983
  CDS Start-End: 131-2092
ggcaggcgggtgggctgccggcggtggactcgtcggagccgcgggcggtcaggaatttgaccctctagggcatgaatactgtgctgttcagttctgagctgtgctagcaatacccttcaaaggaagagcaatggctgcagcagcagcttctcacctgaacctggatgccctccgggaagtgctagaatgccccatctgcatggagtccttcacagaagagcagctgcgtcccaagcttctgcactgtggccataccatctgccgccagtgcctggagaagctattggccagtagcatcaatggtgtccgctgtcccttttgcagcaagattacccgcataaccagcttgacccagctgacagacaatctgacagtgctaaagatcattgatacagctgggctcagcgaggctgtggggctgctcatgtgtcggtcctgtgggcggcgtctgccccggcaattctgccggagctgtggtttggtgttatgtgagccctgccgggaggcagaccatcagcctcctggccactgtacactccctgtcaaagaagcagctgaggagcggcgtcgggactttggagagaagttaactcgtctgcgggaacttatgggggagctgcagcggcggaaggcagccttggaaggtgtctccaaggaccttcaggcaaggtataaagcagttctccaggagtatgggcatgaggagcgcagggtccaggatgagctggctcgctctcggaagttcttcacaggctctttggctgaagttgagaagtccaatagtcaagtggtagaggagcagagttacctgcttaacattgcagaggtgcaggctgtgtctcgctgtgactacttcctggccaagatcaagcaggcagatgtagcactactggaggagacagctgatgaggaggagccagagctcactgccagcttgcctcgggagctcaccctgcaagatgtggagctccttaaggtaggtcatgttggccccctccaaattggacaagctgttaagaagccccggacagttaacgtggaagattcctgggccatggaggccacagcgtctgctgcctctacctctgttacttttagagagatggacatgagcccggaggaagtggttgccagccctagggcctcacctgctaaacagcggggtcctgaggcagcctccaatatccagcagtgcctctttctcaagaagatgggggccaaaggcagcactccaggaatgttcaatcttccagtcagtctctacgtgaccagtcaaggtgaagtactagtcgctgaccgtggtaactatcgtatacaagtctttacccgcaaaggctttttgaaggaaatccgccgcagccccagtggcattgatagctttgtgctaagcttccttggggcagatctacccaacctcactcctctctcagtggcaatgaactgccaggggctgattggtgtgactgacagctatgataactccctcaaggtatataccttggatggccactgcgtggcctgtcacaggagccagctgagcaaaccatggggtatcacagccttgccatctggccagtttgtagtaaccgatgtggaaggtggaaagctttggtgtttcacagttgatcgaggatcaggggtggtcaaatacagctgcctatgtagtgctgtgcggcccaaatttgtcacctgtgatgctgagggcaccgtctacttcacccagggcttaggcctcaatctggagaatcggcagaatgagcaccacctggagggtggcttttccattggctctgtaggccctgatgggcagctgggtcgccagattagccacttcttctcggagaatgaggatttccgctgcattgctggcatgtgtgtggatgctcgtggtgatctcatcgtggctgacagtagtcgcaaggaaattctccattttcctaagggtgggggctatagtgtccttattcgagagggacttacctgtccggtgggcatagccctaactcctaaggggcagctgctggtcttggactgttgggatcattgcatcaagatctacagctaccatctgagaagatattccaccccataggggatgagaaattatcagtttcttctgctcccaagccaacttcccttcccttagttcttggttgttagtggcacatgcagaatagactcagcctatgtcctgattccagctgggtagttctagaacttcagaagctccatcttttaatgtttttatttgttatgtccccctccccgcttcccacctaaatttagagctttaaaagatgcactgcccaaataggacacacgatggtgttagctgaagtttgattagcaattaggcacttccaaggctttagtagagagagccactttagccctttgtgccatgtttgaaatttgcccttgtattaaatccttgattttttcccatttggctttgatgcccttgatccattgtttccttcctactataatgtgcttcatctgtgacactttctcttgaactctgattggattcactgtgcatgcttcagtgggatctgctccacctttcagtgacatttaagacatcatattcccgtaacattatgtctcagtctgatcgtctttaccagtatgaaagtcattcatttagtgctaccaaaggggatacacaagccctttaggaagcagtacctctcgcctggaggatctgtgccatcttggattgagaattgcagatgtgacagaatggattgaccctagttggttggtattgatgacttcagcctggaaattgcttgccttttaaagaagcatatatgggttggaattatgccaaagcataggaagctgggaataagcaaacaaatgctgatatagtcagcaaatttggatagtctctagggctcatcatttttcatactacctctctcttctggcctgtgtctaaggaattgtacaacataggccagggccaacaaagtggagaggtggacacattttcatgttcattactaaaacaaacagcaaaactattggtttgttattctgtgttttcctcaagtcagtacatactatttggtttcaggatttctttccatttctctatcaagcattaaataattgagaactgtttcttcatctctggtgttcatgtcttttaattaaatacggaattttggagatgataagagggataacctgcgctatgccattttgcttccttatctcactgtgttctttcagagtgtagatatctacccaggtcaaaattcagccaaaagcactattatgtaaagataataatccaaatctttctcccaaatacatgtgtacagaatcatcccccaaggtttagagtcaccaataccctattctgagcttctgctgtatgttttatgtttataattacagttcacaaaaaggaagttagtcttgtttttaagatcagaagtgggtgagaggacctgtgatgaggttcctgagggtttggtgtttactaagtaatatatcttactctaggtgcagggctgatggcaagccaaagagcaactgccttactttgatgtaaacaaaatttgctaaactgagctgctcaaaattgtttttatggtagtagtgtttctttggattgtatcataatagctgccaaaggataggtaaagaggtcattaaaatgatgttgaactag

SEQ ID NO: 194910 - DNA, 3717 bp, Homo sapiens
  Payload ID: 18492
  Gene Name: tripartite motif containing 32
  Uniprot ID: Q13049
  ENST ID: ENST00000450136
  CDS Start-End: 162-2123
ggtgctcaacggcgcgtgcgcagagggaggcaggcgggtgggctgccggcggtggactcgtcggagccgcgggcggtcagcaggaatttgaccctctagggcatgaatactgtgctgttcagttctgagctgtgctagcaatacccttcaaaggaagagcaatggctgcagcagcagcttctcacctgaacctggatgccctccgggaagtgctagaatgccccatctgcatggagtccttcacagaagagcagctgcgtcccaagcttctgcactgtggccataccatctgccgccagtgcctggagaagctattggccagtagcatcaatggtgtccgctgtcccttttgcagcaagattacccgcataaccagcttgacccagctgacagacaatctgacagtgctaaagatcattgatacagctgggctcagcgaggctgtggggctgctcatgtgtcggtcctgtgggcggcgtctgccccggcaattctgccggagctgtggtttggtgttatgtgagccctgccgggaggcagaccatcagcctcctggccactgtacactccctgtcaaagaagcagctgaggagcggcgtcgggactttggagagaagttaactcgtctgcgggaacttatgggggagctgcagcggcggaaggcagccttggaaggtgtctccaaggaccttcaggcaaggtataaagcagttctccaggagtatgggcatgaggagcgcagggtccaggatgagctggctcgctctcggaagttcttcacaggctctttggctgaagttgagaagtccaatagtcaagtggtagaggagcagagttacctgcttaacattgcagaggtgcaggctgtgtctcgctgtgactacttcctggccaagatcaagcaggcagatgtagcactactggaggagacagctgatgaggaggagccagagctcactgccagcttgcctcgggagctcaccctgcaagatgtggagctccttaaggtaggtcatgttggccccctccaaattggacaagctgttaagaagccccggacagttaacgtggaagattcctgggccatggaggccacagcgtctgctgcctctacctctgttacttttagagagatggacatgagcccggaggaagtggttgccagccctagggcctcacctgctaaacagcggggtcctgaggcagcctccaatatccagcagtgcctctttctcaagaagatgggggccaaaggcagcactccaggaatgttcaatcttccagtcagtctctacgtgaccagtcaaggtgaagtactagtcgctgaccgtggtaactatcgtatacaagtctttacccgcaaaggctttttgaaggaaatccgccgcagccccagtggcattgatagctttgtgctaagcttccttggggcagatctacccaacctcactcctctctcagtggcaatgaactgccaggggctgattggtgtgactgacagctatgataactccctcaaggtatataccttggatggccactgcgtggcctgtcacaggagccagctgagcaaaccatggggtatcacagccttgccatctggccagtttgtagtaaccgatgtggaaggtggaaagctttggtgtttcacagttgatcgaggatcaggggtggtcaaatacagctgcctatgtagtgctgtgcggcccaaatttgtcacctgtgatgctgagggcaccgtctacttcacccagggcttaggcctcaatctggagaatcggcagaatgagcaccacctggagggtggcttttccattggctctgtaggccctgatgggcagctgggtcgccagattagccacttcttctcggagaatgaggatttccgctgcattgctggcatgtgtgtggatgctcgtggtgatctcatcgtggctgacagtagtcgcaaggaaattctccattttcctaagggtgggggctatagtgtccttattcgagagggacttacctgtccggtgggcatagccctaactcctaaggggcagctgctggtcttggactgttgggatcattgcatcaagatctacagctaccatctgagaagatattccaccccataggggatgagaaattatcagtttcttctgctcccaagccaacttcccttcccttagttcttggttgttagtggcacatgcagaatagactcagcctatgtcctgattccagctgggtagttctagaacttcagaagctccatcttttaatgtttttatttgttatgtccccctccccgcttcccacctaaatttagagctttaaaagatgcactgcccaaataggacacacgatggtgttagctgaagtttgattagcaattaggcacttccaaggctttagtagagagagccactttagccctttgtgccatgtttgaaatttgcccttgtattaaatccttgattttttcccatttggctttgatgcccttgatccattgtttccttcctactataatgtgcttcatctgtgacactttctcttgaactctgattggattcactgtgcatgcttcagtgggatctgctccacctttcagtgacatttaagacatcatattcccgtaacattatgtctcagtctgatcgtctttaccagtatgaaagtcattcatttagtgctaccaaaggggatacacaagccctttaggaagcagtacctctcgcctggaggatctgtgccatcttggattgagaattgcagatgtgacagaatggattgaccctagttggttggtattgatgacttcagcctggaaattgcttgccttttaaagaagcatatatgggttggaattatgccaaagcataggaagctgggaataagcaaacaaatgctgatatagtcagcaaatttggatagtctctagggctcatcatttttcatactacctctctcttctggcctgtgtctaaggaattgtacaacataggccagggccaacaaagtggagaggtggacacattttcatgttcattactaaaacaaacagcaaaactattggtttgttattctgtgttttcctcaagtcagtacatactatttggtttcaggatttctttccatttctctatcaagcattaaataattgagaactgtttcttcatctctggtgttcatgtcttttaattaaatacggaattttggagatgataagagggataacctgcgctatgccattttgcttccttatctcactgtgttctttcagagtgtagatatctacccaggtcaaaattcagccaaaagcactattatgtaaagataataatccaaatctttctcccaaatacatgtgtacagaatcatcccccaaggtttagagtcaccaataccctattctgagcttctgctgtatgttttatgtttataattacagttcacaaaaaggaagttagtcttgtttttaagatcagaagtgggtgagaggacctgtgatgaggttcctgagggtttggtgtttactaagtaatatatcttactctaggtgcagggctgatggcaagccaaagagcaactgccttactttgatgtaaacaaaatttgctaaactgagctgctcaaaattgtttttatggtagtagtgtttctttggattgtatcataatagctgccaaaggataggtaaagaggtcattaaaatgatgttgaact

SEQ ID NO: 194911 - DNA, 699 bp, Homo sapiens
  Payload ID: 18492
  Gene Name: tripartite motif containing 32
  ENST ID: ENST00000411410
  CDS Start-End: 182-699
gctgccggcggtggactcgtcggagccgcgggcggtcagatgagtgatggggaaagagcttttggaagtttgagttaattccttatggtcatgcagctaacaggaatttgaccctctagggcatgaatactgtgctgttcagttctgagctgtgctagcaatacccttcaaaggaagagcaatggctgcagcagcagcttctcacctgaacctggatgccctccgggaagtgctagaatgccccatctgcatggagtccttcacagaagagcagctgcgtcccaagcttctgcactgtggccataccatctgccgccagtgcctggagaagctattggccagtagcatcaatggtgtccgctgtcccttttgcagcaagattacccgcataaccagcttgacccagctgacagacaatctgacagtgctaaagatcattgatacagctgggctcagcgaggctgtggggctgctcatgtgtcggtcctgtgggcggcgtctgccccggcaattctgccggagctgtggtttggtgttatgtgagccctgccgggaggcagaccatcagcctcctggccactgtacactccctgtcaaagaagcagctgaggagcggcgtcgggactttggagagaagttaactcgtctgcgggaacttatgggggagctgcagcggcggaaggcagccttggaaggtgt

SEQ ID NO: 194912 - DNA, 8339 bp, Homo sapiens
  Payload ID: 18493
  Gene Name: tripartite motif containing 33
  Uniprot ID: Q9UPN9
  ENST ID: ENST00000358465
  CDS Start-End: 85-3468
ctgcggctggggctgggggcggcggcggcggcgacgcgggcggcgggcggcgcggggcggtccggcgggttcaaagaggaaaacatggcggaaaacaaaggcggcggcgaggctgagagcggcggcgggggcagcggcagcgcgccggtaactgccggggccgccgggcccgccgcgcaggaggcggagccgcctctcaccgcggtgctggtggaggaggaggaggaggaaggcggcagggccggcgctgagggcggcgcggccgggcccgacgacgggggggtggccgcggcctcctcgggctcggcccaggctgcttcatctcctgcggcctcagtgggcactggagttgccgggggcgcagtatcgacgccggctccagctccagcctcggctcccgctccgggtccctcggcagggccgcctcctggaccgccagcctcgctcctggacacctgcgccgtgtgtcagcagagcttgcagagccggcgtgaggcggagcccaagctgctgccctgtcttcactccttctgcctgcgctgcctgcccgagccggagcgccagctcagcgtgcccatcccggggggcagcaacggcgacatccagcaagttggtgtaatacggtgcccagtatgccgccaagaatgcagacagatagaccttgtggataattattttgtgaaagacacatctgaagctcctagcagttctgatgaaaaatcagaacaggtatgtactagttgtgaagacaatgcaagtgcagttggcttttgtgtagaatgtggagagtggctatgtaagacatgtatcgaagcacatcaaagagtaaaatttactaaagatcacttgatcaggaagaaagaagatgtctcagagtctgttggagcatctggtcaacgccctgttttctgccctgtacacaaacaagaacagttgaaacttttctgtgaaacatgtgatagattgacatgtagagactgtcagctattggaacacaaagaacataggtatcagtttttggaagaagcttttcaaaatcagaagggtgcaattgagaatctactggcgaaacttcttgagaagaagaattatgttcattttgcagctactcaggtgcagaataggataaaagaagtaaatgagactaacaaacgagtagaacaggaaattaaagtggccattttcacccttatcaatgaaattaataagaaaggaaaatctctcttacaacagctagagaatgttacaaaggaaagacagatgaagttactacagcagcagaatgacatcacaggcctttcccggcaggtgaagcatgttatgaacttcacaaattgggcaattgcaagtggcagcagcacagcactactatacagcaagcgactgattactttccagttgcgtcatattttgaaagcacggtgtgatcctgtccctgctgctaatggagcaatacgtttccattgtgatcccaccttctgggcaaagaatgtagtcaatttaggtaatctagtaatagagagtaaaccagctcctggttatactcctaatgttgtagttgggcaagttcctccagggacaaaccacattagtaaaacccctggacagattaacttagcacagcttcgactccagcacatgcaacaacaagtatatgcacagaaacatcagcagttgcaacagatgaggatgcagcaaccaccagcacctgtaccaactacaacaacaacaacacaacagcatcctagacaagcagcccctcagatgttacaacaacagcctcctcgattgatcagtgtgcaaacaatgcaaagaggcaacatgaactgtggagcttttcaagcccatcagatgagactggctcagaatgctgccagaataccagggatacccaggcacagcggccctcaatattccatgatgcagccacacctccaaagacaacactcaaacccagggcatgctggaccctttcccgtagtatcggtacacaacaccacaatcaacccaacgagccctactacagcaactatggcaaatgcaaaccgaggtcccaccagcccatctgttacagcaatagagctaatcccctcagttaccaatccagaaaaccttccatcgctgccagatattccacccatacagttggaagatgctggctcaagtagtttagataatctactaagtagatacatctcaggcagtcacctacccccacagcctacaagcaccatgaatccttctccaggtccctctgccctttctccgggatcatcaggtttatccaattctcacacacctgtgagacccccaagtacttctagtactggcagtcgaggcagctgtgggtcatcaggaagaactgctgagaagacaagtcttagtttcaaatctgatcaggtgaaggtcaagcaagaacctgggactgaagatgaaatatgtagcttttcaggaggtgtaaaacaagaaaaaacagaggatggcaggaggagtgcttgcatgttgagcagtcctgagagtagcttgacaccacctctctcaaccaacctgcatctagaaagtgaattggatgcattggcaagcctggaaaaccatgtgaaaattgaacctgcagatatgaatgaaagctgcaaacagtcagggctcagcagccttgttaatggaaagtccccaattcgaagcctcatgcacaggtcggcaaggattggaggagatggcaacaataaagatgatgacccaaatgaagactggtgtgctgtctgccaaaacggaggagatctcttgtgctgcgaaaaatgtccaaaggtctttcatctaacttgtcatgttccaacactacttagctttccaagtggggactggatatgcacattttgtagagatattggaaagccagaagttgaatatgattgtgataatttgcaacatagtaagaaggggaaaactgcgcaggggttaagccccgtggaccaaaggaaatgtgaacgtcttctgctttacctctattgccatgaattaagtattgaattccaggagcctgttcctgcttcgataccaaactactataaaattataaagaaaccaatggatttatccaccgtgaaaaagaagcttcagaaaaaacattcccaacactaccaaatcccggatgactttgtggccgatgtccgtttgatcttcaagaactgtgaaaggtttaatgaaatgatgaaagttgttcaagtttatgcagacacacaagagattaatttgaaggctgattcagaagtagctcaggcagggaaagcagttgcattgtactttgaagataaactcacagagatctactcagacaggaccttcgcacctttgccagagtttgagcaggaagaggatgatggtgaggtaactgaggactctgatgaagactttatacagccccgcagaaaacgcctaaagtcagatgagagaccagtacatataaagtaaaatgacatggatttaaatcaattgtttaaaaaaaaaaaaacgaaaaaaaaaaaaaaaacacaaaaaacccagaaaacttttaagtgttgctggaatatcctgcctacagtgggcacctccttgaagaagctgatagcttttacacagtattagattgaaataatggacagaaacacattcttgtcaagaaagggggagagaagtctgtttgcaagtttcaaagcaaaaagcaaaagtgaaatgatttgaggatttctgttctaatggagatgattctctgattgttagaaatggcaaatattgatgattgtgtgctattgattggtgcaggatacttggtatacgagtaaatacttgagactcgtgtcacttgataaattttctttttggactaggtcgcacagttattaaaacaacttttaaccctcccccttcacacacatacatatcaggttgttttctagttaaaaacccaagtagctcagattctactttaatgtcagtgcagatttgcattgaatcatgccattatgttttttctcatttttatgctgttgggtcttagtttttaaattgatataaagaactcagcaatggttttattttctactcatacttagggtttaggaaacactaccactagttatcatttaatcaacttcaatggtctactgaaacaaaaatggtaacttttcattagtggattatttagagttatagtagttgtttccagaaaacacttcctcacaattgtacttcccaatcaaatcatgtgatcatacagttattcccatgaaaggcagaatgtttgtttcaaaattaatctagttttctgtacatttaaatttgagaaggtgacaactggctcttttccagtcttccttcatgtcagttttctgatagaccactattggcaaacagtatctgtcaactaccaaatgtgtaaaattttctgtatttcactttgtcttatttgtaaatagtgaactaaaacttttggcagatcagcaacatttgctgagcctgttttttaagctaatgtgtattcttactaatgttcctatcaagaatggatttgtaatatatgctgtctatttctaatgttcacattcatattttgaggttctatcttattttaatagagaacagacttctcaaaaaatcttcagaagcagcttattattgaaatatcgaaatattgaaataaacccggtggggttagattactcatctgtccaccaagtgggacatttgcatggactgggggcttaaaggacttagaagagacctgtaagtaaatcctgaaaatgagccaatccccacttgaatggttactggagtaaacccacctttaccaccccaattacagcacccgaggccgataaaccaacttggctctggttcatttttcttttcttcatttgtgatgctcagattcaaaatgtgtgttctacactgttacaggcttctcttttgtttgattaaagattttagtcctacttttgtatggacacattagaatattcagagaccaaaatagaagaatttgctgttagatatttttcagaagtcagcagatttgtggcaaatcatttatttgcctttttaaaaattcatttaagcagttcagagagtagactactcagaaaattatttcacgtaattgtctaagaggtcaatattttttaatgcatattgaatcaaataaagtgctctaaagaaattattatacaaattcctttgggttgtttttcttttcttaacaaggggtgggggtaaacaggaatatgattcaggctttctggttgtgtatttaaagagtattgattttattattactattgatttactttattcctggcttccttttcacttttctttcaatttttaaaaaataatttaagccgttgaaaatataccaaactgttgaaacattttactcaaattttaaattcctaaaaatgttttttaataagagggagaaaattatttaaaaatacttatgcctatgccaatttccctcttttttcacaaaatccatgatttcagtttgtaagtagacatatatctaagggcacatttttggaaagtgaggaatagcagcagtataacttcattttgtcaggcctttgagttctaatattttgtattgctcttcaaatggatccttttaaaaaaattgtagataatgagtcataaatagattctgccaactgaggggagaaacattttaagtaaatatttttcagtatttggggccttaaaaaataattgtgtttccttaaaattacatgttagatagagtttttaggtttttttggttttaagattggttaaagcaatttaaaagccacttttttgtcaacatttaatagcctccacttctgttaagataatgtatactgctgaggaattactattaatagctatcaacataccaccattaaattaaggtattcactttagattttttattaaagcttttttcttgcacactgatcgttgtgtttctaagctgattttttcagctctaatatacctatggttaaaaagtataaaaacttaaattgatatttagatatatgttttcctattagtttatgttttaaaaagacaaaattgtatctgtcagtccctgaaggcagtttgtttttatactctctcacatttgtatttgttttttaaatggcagtattttagaagatttggagaaaagtccacataataatgttttcttaaaagcttttaaagtttttgctgtacttcaatttacttcttccatcagaaaactaagaacaaagtgttgctcagtctgttccgctgacctaaatttgtgttttcagcacttggctcagccaattcactgagtgaaggaattgctttatgaggcaaagcatgtgaaagttctaaagtatggttagattgtaggtcgtgctctatatggaaacatcaaaccattactacagagaaatgataaggcattggatccactattgaaattattatttttggatcaacaagttggtactttctgacttctgtatcttaacataagggaattttaggtaatgctaagtcagttgtctcattttttgtgataagttttggaatttttagttaattgaaataaataatgcttttaaatagaagtaaaaggtttataagtgtgcaaattgtagatttatcaattacctcagcaggtatcctgccatgtaattattagtgattagtgttaataagataatagattcaggtcttccaactatgcccttggattgtggcctactgtatgttattaaatggtctcttactatccaaaatgggagtagatgctgtggccccgtctcccttggcttttacgtcccatatccacccccattcatgtacaacatgtgaaatataaaaatctcatttcttgtcaaaatcagcactgcttatttgcatactcagcatcggatcagtgagtagttttataaaaaatccacgcacccaactcccttagttaaaacagattcttaattcataccatgaattcttaatttctgtaccatctatgttaatgatctgctgaaggtgactcaagattttcaaggtgtaatacagtttgatcatgtaccggacctggatatttaattttttttccctcacagttaatctcctccttgataaagcaataacactgctttgagtctgttgcctaatagcatgtcagaatcctctcctggatggtgattttataggaaagtttgtatgcatatcacccagtctatcttttaaaaattaagaaatttaaatgtatgctggaagtaatgacactatattgtggcattttattttaaaaattggggaaagttgcatatttttttaaaagtaagtgtttgagtaaaaaaattgaaggtacttttttaaggaaaaaaatttatatgccacagtttacatagacatttcagattcaacacgtactcttgaatataatggtttcttttacttggtcaaaatgcatgtatagcatttctttcatcttagttccttgtgtttgcctatgtggtcctttatatattttttattgtatcgaagaaacaaaactatcttcaaaaataagttaatttggatatatttgtcatatcaaactacaaagtgtacaaagttaagtttagcccttttctagaaagtgatctttaaaattaaaaatgctcctcttttaaattcaccaaatttatgtgtgggaaggcaccaaaatgattttgtaagtgccactgcaatattccctttcaagtgtggcctaaatttcaatcttaaggatggaatgcatgtctgctccttgttctgaaaaatgtaggcatctactacattttaaaacacagtgaaacatatacataagcctataaaaaaagatttgtgcaatttgaaagcctgttaattttttatgtagacatacctacacacgaaagggttaaattcacagccttactagttccttgcttccagtatttcaattggtctcctcccctcattattattattactactagtactattatttttgcacatagttaactgcccttcaatatgattcttaaaaagtgctgtttctgtggtatcgtattctctaaataatcatatttaattttttaaaacaaggttgcagtttctaattgtttcgttcctgtgtttttgctggtgtgtaataaaagcaagttttttcttttcatggttatttaatacattagctgcctgtaaataattcttgttataatgctctggaatgtgttgtagaagttgtattagattagttttaaacccttgtttgaaagccacattgttttggttatttctattaaattagaaaattgaaaaagttttcaaatgaa

SEQ ID NO: 194913 - DNA, 3457 bp, Homo sapiens
  Payload ID: 18493
  Gene Name: tripartite motif containing 33
  Uniprot ID: Q9UPN9
  ENST ID: ENST00000369543
  CDS Start-End: 85-3417
ctgcggctggggctgggggcggcggcggcggcgacgcgggcggcgggcggcgcggggcggtccggcgggttcaaagaggaaaacatggcggaaaacaaaggcggcggcgaggctgagagcggcggcgggggcagcggcagcgcgccggtaactgccggggccgccgggcccgccgcgcaggaggcggagccgcctctcaccgcggtgctggtggaggaggaggaggaggaaggcggcagggccggcgctgagggcggcgcggccgggcccgacgacgggggggtggccgcggcctcctcgggctcggcccaggctgcttcatctcctgcggcctcagtgggcactggagttgccgggggcgcagtatcgacgccggctccagctccagcctcggctcccgctccgggtccctcggcagggccgcctcctggaccgccagcctcgctcctggacacctgcgccgtgtgtcagcagagcttgcagagccggcgtgaggcggagcccaagctgctgccctgtcttcactccttctgcctgcgctgcctgcccgagccggagcgccagctcagcgtgcccatcccggggggcagcaacggcgacatccagcaagttggtgtaatacggtgcccagtatgccgccaagaatgcagacagatagaccttgtggataattattttgtgaaagacacatctgaagctcctagcagttctgatgaaaaatcagaacaggtatgtactagttgtgaagacaatgcaagtgcagttggcttttgtgtagaatgtggagagtggctatgtaagacatgtatcgaagcacatcaaagagtaaaatttactaaagatcacttgatcaggaagaaagaagatgtctcagagtctgttggagcatctggtcaacgccctgttttctgccctgtacacaaacaagaacagttgaaacttttctgtgaaacatgtgatagattgacatgtagagactgtcagctattggaacacaaagaacataggtatcagtttttggaagaagcttttcaaaatcagaagggtgcaattgagaatctactggcgaaacttcttgagaagaagaattatgttcattttgcagctactcaggtgcagaataggataaaagaagtaaatgagactaacaaacgagtagaacaggaaattaaagtggccattttcacccttatcaatgaaattaataagaaaggaaaatctctcttacaacagctagagaatgttacaaaggaaagacagatgaagttactacagcagcagaatgacatcacaggcctttcccggcaggtgaagcatgttatgaacttcacaaattgggcaattgcaagtggcagcagcacagcactactatacagcaagcgactgattactttccagttgcgtcatattttgaaagcacggtgtgatcctgtccctgctgctaatggagcaatacgtttccattgtgatcccaccttctgggcaaagaatgtagtcaatttaggtaatctagtaatagagagtaaaccagctcctggttatactcctaatgttgtagttgggcaagttcctccagggacaaaccacattagtaaaacccctggacagattaacttagcacagcttcgactccagcacatgcaacaacaagtatatgcacagaaacatcagcagttgcaacagatgaggatgcagcaaccaccagcacctgtaccaactacaacaacaacaacacaacagcatcctagacaagcagcccctcagatgttacaacaacagcctcctcgattgatcagtgtgcaaacaatgcaaagaggcaacatgaactgtggagcttttcaagcccatcagatgagactggctcagaatgctgccagaataccagggatacccaggcacagcggccctcaatattccatgatgcagccacacctccaaagacaacactcaaacccagggcatgctggaccctttcccgtagtatcggtacacaacaccacaatcaacccaacgagccctactacagcaactatggcaaatgcaaaccgaggtcccaccagcccatctgttacagcaatagagctaatcccctcagttaccaatccagaaaaccttccatcgctgccagatattccacccatacagttggaagatgctggctcaagtagtttagataatctactaagtagatacatctcaggcagtcacctacccccacagcctacaagcaccatgaatccttctccaggtccctctgccctttctccgggatcatcaggtttatccaattctcacacacctgtgagacccccaagtacttctagtactggcagtcgaggcagctgtgggtcatcaggaagaactgctgagaagacaagtcttagtttcaaatctgatcaggtgaaggtcaagcaagaacctgggactgaagatgaaatatgtagcttttcaggaggtgtaaaacaagaaaaaacagaggatggcaggaggagtgcttgcatgttgagcagtcctgagagtagcttgacaccacctctctcaaccaacctgcatctagaaagtgaattggatgcattggcaagcctggaaaaccatgtgaaaattgaacctgcagatatgaatgaaagctgcaaacagtcagggctcagcagccttgttaatggaaagtccccaattcgaagcctcatgcacaggtcggcaaggattggaggagatggcaacaataaagatgatgacccaaatgaagactggtgtgctgtctgccaaaacggaggagatctcttgtgctgcgaaaaatgtccaaaggtctttcatctaacttgtcatgttccaacactacttagctttccaagtggggactggatatgcacattttgtagagatattggaaagccagaagttgaatatgattgtgataatttgcaacatagtaagaaggggaaaactgcgcaggggttaagccccgtggaccaaaggaaatgtgaacgtcttctgctttacctctattgccatgaattaagtattgaattccaggagcctgttcctgcttcgataccaaactactataaaattataaagaaaccaatggatttatccaccgtgaaaaagaagcttcagaaaaaacattcccaacactaccaaatcccggatgactttgtggccgatgtccgtttgatcttcaagaactgtgaaaggtttaatgaagctgattcagaagtagctcaggcagggaaagcagttgcattgtactttgaagataaactcacagagatctactcagacaggaccttcgcacctttgccagagtttgagcaggaagaggatgatggtgaggtaactgaggactctgatgaagactttatacagccccgcagaaaacgcctaaagtcagatgagagaccagtacatataaagtaaaatgacatggatttaaatcaattgtttaaaaaaaaaaaaa

SEQ ID NO: 194914 - DNA, 2706 bp, Homo sapiens
  Payload ID: 18493
  Gene Name: tripartite motif containing 33
  ENST ID: ENST00000448034
  CDS Start-End: 1-2666
agtctgttggagcatctggtcaacgccctgttttctgccctgtacacaaacaagaacagttgaaacttttctgtgaaacatgtgatagattgacatgtagagactgtcagctattggaacacaaagaacataggtatcagtttttggaagaagcttttcaaaatcagaagggtgcaattgagaatctactggcgaaacttcttgagaagaagaattatgttcattttgcagctactcaggtgcagaataggataaaagaagtaaatgagactaacaaacgagtagaacaggaaattaaagtggccattttcacccttatcaatgaaattaataagaaaggaaaatctctcttacaacagctagagaatgttacaaaggaaagacagatgaagttactacagcagcagaatgacatcacaggcctttcccggcaggtgaagcatgttatgaacttcacaaattgggcaattgcaagtggcagcagcacagcactactatacagcaagcgactgattactttccagttgcgtcatattttgaaagcacggtgtgatcctgtccctgctgctaatggagcaatacgtttccattgtgatcccaccttctgggcaaagaatgtagtcaatttaggtaatctagtaatagagagtaaaccagctcctggttatactcctaatgttgtagttgggcaagttcctccagggacaaaccacattagtaaaacccctggacagattaacttagcacagcttcgactccagcacatgcaacaacaagtatatgcacagaaacatcagcagttgcaacagatgaggatgcagcaaccaccagcacctgtaccaactacaacaacaacaacacaacagcatcctagacaagcagcccctcagatgttacaacaacagcctcctcgattgatcagtgtgcaaacaatgcaaagaggcaacatgaactgtggagcttttcaagcccatcagatgagactggctcagaatgctgccagaataccagggatacccaggcacagcggccctcaatattccatgatgcagccacacctccaaagacaacactcaaacccagggcatgctggaccctttcccgtagtatcggtacacaacaccacaatcaacccaacgagccctactacagcaactatggcaaatgcaaaccgaggtcccaccagcccatctgttacagcaatagagctaatcccctcagttaccaatccagaaaaccttccatcgctgccagatattccacccatacaggcaaacgttgttccgatgatgcactcctggtatgagtttggagccagagagaagacccaggaccaaaatgtgttggaagatgctggctcaagtagtttagataatctactaagtagatacatctcaggcagtcacctacccccacagcctacaagcaccatgaatccttctccaggtccctctgccctttctccgggatcatcaggtttatccaattctcacacacctgtgagacccccaagtacttctagtactggcagtcgaggcagctgtgggtcatcaggaagaactgctgagaagacaagtcttagtttcaaatctgatcaggtgaaggtcaagcaagaacctgggactgaagatgaaatatgtagcttttcaggaggtgtaaaacaagaaaaaacagaggatggcaggaggagtgcttgcatgttgagcagtcctgagagtagcttgacaccacctctctcaaccaacctgcatctagaaagtgaattggatgcattggcaagcctggaaaaccatgtgaaaattgaacctgcagatatgaatgaaagctgcaaacagtcagggctcagcagccttgttaatggaaagtccccaattcgaagcctcatgcacaggtcggcaaggattggaggagatggcaacaataaagatgatgacccaaatgaagactggtgtgctgtctgccaaaacggaggagatctcttgtgctgcgaaaaatgtccaaaggtctttcatctaacttgtcatgttccaacactacttagctttccaagtggggactggatatgcacattttgtagagatattggaaagccagaagttgaatatgattgtgataatttgcaacatagtaagaaggggaaaactgcgcaggggttaagccccgtggaccaaaggaaatgtgaacgtcttctgctttacctctattgccatgaattaagtattgaattccaggagcctgttcctgcttcgataccaaactactataaaattataaagaaaccaatggatttatccaccgtgaaaaagaagcttcagaaaaaacattcccaacactaccaaatcccggatgactttgtggccgatgtccgtttgatcttcaagaactgtgaaaggtttaatgaaatgatgaaagttgttcaagtttatgcagacacacaagagattaatttgaaggctgattcagaagtagctcaggcagggaaagcagttgcattgtactttgaagataaactcacagagatctactcagacaggaccttcgcacctttgccagagtttgagcaggaagaggatgatggtgaggtaactgaggactctgatgaagactttatacagccccgcagaaaacgcctaaagtcagatgagagaccagtacatataaagtaaaatgacatggatttaaatcaattgtttaaaaaaaaaaaaa

SEQ ID NO: 194915 - DNA, 3493 bp, Homo sapiens
  Payload ID: 18493
  Gene Name: tripartite motif containing 33
  ENST ID: ENST00000450349
  CDS Start-End: 85-3444
ctgcggctggggctgggggcggcggcggcggcgacgcgggcggcgggcggcgcggggcggtccggcgggttcaaagaggaaaacatggcggaaaacaaaggcggcggcgaggctgagagcggcggcgggggcagcggcagcgcgccggtaactgccggggccgccgggcccgccgcgcaggaggcggagccgcctctcaccgcggtgctggtggaggaggaggaggaggaaggcggcagggccggcgctgagggcggcgcggccgggcccgacgacgggggggtggccgcggcctcctcgggctcggcccaggctgcttcatctcctgcggcctcagtgggcactggagttgccgggggcgcagtatcgacgccggctccagctccagcctcggctcccgctccgggtccctcggcagggccgcctcctggaccgccagcctcgctcctggacacctgcgccgtgtgtcagcagagcttgcagagccggcgtgaggcggagcccaagctgctgccctgtcttcactccttctgcctgcgctgcctgcccgagccggagcgccagctcagcgtgcccatcccggggggcagcaacggcgacatccagcaagttggtgtaatacggtgcccagtatgccgccaagaatgcagacagatagaccttgtggataattattttgtgaaagacacatctgaagctcctagcagttctgatgaaaaatcagaacaggtatgtactagttgtgaagacaatgcaagtgcagttggcttttgtgtagaatgtggagagtggctatgtaagacatgtatcgaagcacatcaaagagtaaaatttactaaagatcacttgatcaggaagaaagaagatgtctcagagtctgttggagcatctggtcaacgccctgttttctgccctgtacacaaacaagaacagttgaaacttttctgtgaaacatgtgatagattgacatgtagagactgtcagctattggaacacaaagaacataggtatcagtttttggaagaagcttttcaaaatcagaagggtgcaattgagaatctactggcgaaacttcttgagaagaagaattatgttcattttgcagctactcaggtgcagaataggataaaagaagtaaatgagactaacaaacgagtagaacaggaaattaaagtggccattttcacccttatcaatgaaattaataagaaaggaaaatctctcttacaacagctagagaatgttacaaaggaaagacagatgaagttactacagcagcagaatgacatcacaggcctttcccggcaggtgaagcatgttatgaacttcacaaattgggcaattgcaagtggcagcagcacagcactactatacagcaagcgactgattactttccagttgcgtcatattttgaaagcacggtgtgatcctgtccctgctgctaatggagcaatacgtttccattgtgatcccaccttctgggcaaagaatgtagtcaatttaggtaatctagtaatagagagtaaaccagctcctggttatactcctaatgttgtagttgggcaagttcctccagggacaaaccacattagtaaaacccctggacagattaacttagcacagcttcgactccagcacatgcaacaacaagtatatgcacagaaacatcagcagttgcaacagatgaggatgcagcaaccaccagcacctgtaccaactacaacaacaacaacacaacagcatcctagacaagcagcccctcagatgttacaacaacagcctcctcgattgatcagtgtgcaaacaatgcaaagaggcaacatgaactgtggagcttttcaagcccatcagatgagactggctcagaatgctgccagaataccagggatacccaggcacagcggccctcaatattccatgatgcagccacacctccaaagacaacactcaaacccagggcatgctggaccctttcccgtagtatcggtacacaacaccacaatcaacccaacgagccctactacagcaactatggcaaatgcaaaccgaggtcccaccagcccatctgttacagcaatagagctaatcccctcagttaccaatccagaaaaccttccatcgctgccagatattccacccatacagttggaagatgctggctcaagtagtttagataatctactaagtagatacatctcaggcagtcacctacccccacagcctacaagcaccatgaatccttctccaggtccctctgccctttctccgggatcatcaggtttatccaattctcacacacctgtgagacccccaagtacttctagtactggcagtcgaggcagctgtgggtcatcaggaagaactgctgagaagacaagtcttagtttcaaatctgatcaggtgaaggtcaagcaagaacctgggactgaagatgaaatatgtagcttttcaggaggtgtaaaacaagaaaaaacagaggatggcaggaggagtgcttgcatgttgagcagtcctgagagtagcttgacaccacctctctcaaccaacctgcatctagaaagtgaattggatgcattggcaagcctggaaaaccatgtgaaaattgaacctgcagatatgaatgaaagctgcaaacagtcagggctcagcagccttgttaatggaaagtccccaattcgaagcctcatgcacaggtcggcaaggattggaggagatggcaacaataaagatgatgacccaaatgaagactggtgtgctgtctgccaaaacggaggagatctcttgtgctgcgaaaaatgtccaaaggtctttcatctaacttgtcatgttccaacactacttagctttccaagtggggactggatatgcacattttgtagagatattggaaagccagaagttgaatatgattgtgataatttgcaacatagtaagaaggggaaaactgcgcaggggttaagccccgtggaccaaaggaaatgtgaacgtcttctgctttacctctattgccatgaattaagtattgaattccaggagcctgttcctgcttcgataccaaactactataaaattataaagaaaccaatggatttatccaccgtgaaaaagaagcttcagaaaaaacattcccaacactaccaaatcccggatgactttgtggccgatgtccgtttgatcttcaagaactgtgaaaggtttaatgaaatgatgaaagttgttcaagtttatgcagacacacaagagattaatttgaaggctgattcagaagtagctcaggcagggaaagcagttgcattgtactttgaagataaactcacagagatctactcagacaggaccttcgcacctttgccagagtttgagcaggaagaggatgatggtgaggtaactgaggactctgatgaagactttatacagccccgcagaacgcctaaagtcagatgagagaccagtacatataaagtaaaatgacatggatttaaatcaattgttt

SEQ ID NO: 194916 - DNA, 2311 bp, Homo sapiens
  Payload ID: 18494
  Gene Name: tripartite motif containing 34
  Uniprot ID: Q9BYJ4
  ENST ID: ENST00000429814
  CDS Start-End: 156-1622
tgaatgaatcctgaccacacccaccctggcttttcttcacctcttcaaccaggagccgagatttctgttgctctgaagccatccaggggtctttaaccagaagagagaggagagcctcaggagttaggaccagaagaagccagggaagcagtgcaatggcttcaaaaatcttgcttaacgtacaagaggaggtgacctgtcccatctgcctggagctgttgacagaacccttgagtctagactgtggccacagcctctgccgagcctgcatcactgtgagcaacaaggaggcagtgaccagcatgggaggaaaaagcagctgtcctgtgtgtggtatcagttactcatttgaacatctacaggctaatcagcatctggccaacatagtggagagactcaaggaggtcaagttgagcccagacaatgggaagaagagagatctctgtgatcatcatggagagaaactcctactcttctgtaaggaggataggaaagtcatttgctggctttgtgagcggtctcaggagcaccgtggtcaccacacagtcctcacggaggaagtattcaaggaatgtcaggagaaactccaggcagtcctcaagaggctgaagaaggaagaggaggaagctgagaagctggaagctgacatcagagaagagaaaacttcctggaagtatcaggtacaaactgagagacaaaggatacaaacagaatttgatcagcttagaagcatcctaaataatgaggagcagagagagctgcaaagattggaagaagaagaaaagaagacgctggataagtttgcagaggctgaggatgagctagttcagcagaagcagttggtgagagagctcatctcagatgtggagtgtcggagtcagtggtcaacaatggagctgctgcaggacatgagtggaatcatgaaatggagtgagatctggaggctgaaaaagccaaaaatggtttccaagaaactgaagactgtattccatgctccagatctgagtaggatgctgcaaatgtttagagaactgacagctgtccggtgctactgggtggatgtcacactgaattcagtcaacctaaatttgaatcttgtcctttcagaagatcagagacaagtgatatctgtgccaatttggccttttcagtgttataattatggtgtcttgggatcccaatatttctcctctgggaaacattactgggaagtggacgtgtccaagaaaactgcctggatcctgggggtatactgtagaacatattcccgccatatgaagtatgttgttagaagatgtgcaaatcgtcaaaatctttacaccaaatacagacctctatttggctactgggttatagggttacagaataaatgtaagtatggtgtctttgaagagtctttgtcctctgatcccgaggttttgactctctccatggctgtgcctccctgccgtgttggggttttcctcgactatgaagcaggcattgtctcatttttcaatgtcacaagccatggctccctcatttacaagttctctaaatgttgcttttctcagcctgtttatccatatttcaatccttggaactgtccagctcccatgactctatgcccaccaagctcttgaattttctcatttcttcacctacaaccctttgtcttgacttatctcctgcaactgactcatctgcaacattcacaccattgcttccttgtggtttcccttctttagaacttttactcatccttgagatgtatggtgtatttggcttgagttatgagagatgcttatttattcatttactctttttcatattttcagagaaagttacctaatccctcctaaagacacagcagtatgggtataacatccttgccttcccatttatccatgtttcactttatcactgatatgaagaggcccaaagcctgttagccaccatccatgctacctaggtagtccataggaaccacccccatgaccaccaccaacatcaactaaaggttcttggagggtatgtcagtgtgttgctcaggataccccaggtacatcaaggaatcaaggagaggaaaatatgagcaatatgtgtattcagagtgaagattttatgtccagagtatttgagctcaaaccttgcctgttgttttctaatcatgatgaatactttctcagtttctttttcctgaaatataaattgggatttaagactgtacctaactattaagatcactgtgtaaaactaagtgtctctaaatgtaatgcatcgatttagtgtctggaacataataaatatttgctctcatgattgctaaaaa

SEQ ID NO: 194917 - DNA, 2493 bp, Homo sapiens
  Payload ID: 18494
  Gene Name: tripartite motif containing 34
  Uniprot ID: Q9BYJ4
  ENST ID: ENST00000514226
  CDS Start-End: 338-1804
gtgatctcggctcactgcaacctctgtctcctgggttcaagcgatcctcctgtctcagcctcccgagtaactgggattacaggcgcccaccaccatgcccggctaatttttgtatttttgtagacagggtttcgacatgttggccaggctggtctcaaactcctgacctcaagtgatccacccgcctcagcctcccaaagtgctgggattacaggtgtgagccactgcgcccgtcctgactcatgcaacttctgcttcagccatccaggggtctttaaccagaagagagaggagagcctcaggagttaggaccagaagaagccagggaagcagtgcaatggcttcaaaaatcttgcttaacgtacaagaggaggtgacctgtcccatctgcctggagctgttgacagaacccttgagtctagactgtggccacagcctctgccgagcctgcatcactgtgagcaacaaggaggcagtgaccagcatgggaggaaaaagcagctgtcctgtgtgtggtatcagttactcatttgaacatctacaggctaatcagcatctggccaacatagtggagagactcaaggaggtcaagttgagcccagacaatgggaagaagagagatctctgtgatcatcatggagagaaactcctactcttctgtaaggaggataggaaagtcatttgctggctttgtgagcggtctcaggagcaccgtggtcaccacacagtcctcacggaggaagtattcaaggaatgtcaggagaaactccaggcagtcctcaagaggctgaagaaggaagaggaggaagctgagaagctggaagctgacatcagagaagagaaaacttcctggaagtatcaggtacaaactgagagacaaaggatacaaacagaatttgatcagcttagaagcatcctaaataatgaggagcagagagagctgcaaagattggaagaagaagaaaagaagacgctggataagtttgcagaggctgaggatgagctagttcagcagaagcagttggtgagagagctcatctcagatgtggagtgtcggagtcagtggtcaacaatggagctgctgcaggacatgagtggaatcatgaaatggagtgagatctggaggctgaaaaagccaaaaatggtttccaagaaactgaagactgtattccatgctccagatctgagtaggatgctgcaaatgtttagagaactgacagctgtccggtgctactgggtggatgtcacactgaattcagtcaacctaaatttgaatcttgtcctttcagaagatcagagacaagtgatatctgtgccaatttggccttttcagtgttataattatggtgtcttgggatcccaatatttctcctctgggaaacattactgggaagtggacgtgtccaagaaaactgcctggatcctgggggtatactgtagaacatattcccgccatatgaagtatgttgttagaagatgtgcaaatcgtcaaaatctttacaccaaatacagacctctatttggctactgggttatagggttacagaataaatgtaagtatggtgtctttgaagagtctttgtcctctgatcccgaggttttgactctctccatggctgtgcctccctgccgtgttggggttttcctcgactatgaagcaggcattgtctcatttttcaatgtcacaagccatggctccctcatttacaagttctctaaatgttgcttttctcagcctgtttatccatatttcaatccttggaactgtccagctcccatgactctatgcccaccaagctcttgaattttctcatttcttcacctacaaccctttgtcttgacttatctcctgcaactgactcatctgcaacattcacaccattgcttccttgtggtttcccttctttagaacttttactcatccttgagatgtatggtgtatttggcttgagttatgagagatgcttatttattcatttactctttttcatattttcagagaaagttacctaatccctcctaaagacacagcagtatgggtataacatccttgccttcccatttatccatgtttcactttatcactgatatgaagaggcccaaagcctgttagccaccatccatgctacctaggtagtccataggaaccacccccatgaccaccaccaacatcaactaaaggttcttggagggtatgtcagtgtgttgctcaggataccccaggtacatcaaggaatcaaggagaggaaaatatgagcaatatgtgtattcagagtgaagattttatgtccagagtatttgagctcaaaccttgcctgttgttttctaatcatgatgaatactttctcagtttctttttcctgaaatataaattgggatttaagactgtacctaactattaagatcactgtgtaaaactaagtgtctctaaatgtaatgcatcgatttagtgtctggaacataataaatatttgctctcatgattgctaaaaa

SEQ ID NO: 194918 - DNA, 4229 bp, Homo sapiens
  Payload ID: 18495
  Gene Name: tripartite motif containing 35
  Uniprot ID: Q9UPQ4
  ENST ID: ENST00000305364
  CDS Start-End: 85-1566
cactcgggtcgcgggcgttggcagccgggcgggtgggaggggccggagcaaaagttccgggcgcccgagccggctgctcgtgccatggagcggagtcccgacgtgtcccccgggccttcccgctccttcaaggaggagttgctctgcgccgtctgctacgaccccttccgcgacgcagtcactctgcgctgcggccacaacttctgccgcgggtgcgtgagccgctgctgggaggtgcaggtgtcgcccacctgcccagtgtgcaaagaccgcgcgtcacccgccgacctgcgcaccaaccacaccctcaacaacctggtggagaagctgctgcgcgaggaggccgagggcgcgcgctggaccagctaccgcttctcgcgtgtctgccgcctgcaccgcggacagctcagcctcttctgcctcgaggacaaggagctgctgtgctgctcctgccaggccgacccccgacaccaggggcaccgcgtgcagccggtgaaggacactgcccacgactttcgggccaagtgcaggaacatggagcatgcactgcgggagaaggccaaggccttctgggccatgcggcgctcctatgaggccatcgccaagcacaatcaggtggaggctgcatggctggaaggccggatccggcaggagtttgataagcttcgcgagttcttgagagtggaggagcaggccattctggatgccatggccgaggagacaaggcagaagcaacttctggccgacgagaagatgaagcagctcacagaggagacggaggtgctggcacatgagatcgagcggctgcagatggagatgaaggaggacgacgtttcttttctcatgaaacacaagagccgaaaacgccgactcttctgcaccatggagccagagccagtccagcccggcatgcttatcgatgtctgcaagtacctgggctccctgcagtaccgcgtctggaagaagatgcttgcatctgtggaatctgtacccttcagctttgaccccaacaccgcagctggctggctctccgtgtctgacgacctcaccagcgtcaccaaccatggctaccgcgtgcaggtggagaacccggaacgcttctcctcggcgccctgcctgctgggctcccgtgtcttctcacagggctcgcacgcctgggaggtggcccttggggggctgcagagctggagggtgggcgtggtacgtgtgcgccaggactcgggcgctgagggccactcacacagctgctaccacgacacacgctcgggcttctggtatgtctgccgcacgcagggcgtggagggggaccactgcgtgacctcggacccagccacgtcgcccctggtcctggccatcccacgccgcctgcgtgtggagctggagtgtgaggagggcgagctgtctttctatgacgcggagcgccactgccacctgtacaccttccacgcccgctttggggaggttcgcccctacttctacctggggggtgcacggggcgccgggcctccagagcctttgcgcatctgccccttgcacatcagtgtcaaggaagaactggatggctgagctggcccggggctgccccggtcttgtgccacagcactgttttctttctgccctcttcctaatgcccacactgcttgggcactattgcgcccctgcctccttgccaggctcttcctcctgtcctgcctggtccttttccatgactccaggctgtgcctctctccatgtttggtcccttctgtgcccatggtcaggagctattcgggtggcacctcgctggccaggctctcccgagtcgtggcacctccacaatgtgaattttctgaatccctattccaggatttctgggaataatgtttacttctagaatgggcctgttgtaaaccatctcatcgaggtgtggtaaagccattggatgaggaggggactgccatggaaaggagagtttgttacttacggttctgagaggaggggccacataggaaagccccacggtgggtcagaaggcggaaggagggaggggaacgtgtgggcaagagacttcctctggtttcctcaggaggaaatgggcaaggcagagtaagcaggggagacaggtttaagggtagctggcttgagtaatttcagtggctctcaggataggggctgccctttttgtctgatacctggccccgggatagtcaggacaggtgaatgttggcctggggtgtgacagccctgggagagccatgtgaaggaggcagctggcgccatcgctccggattagttggtttccataggaaaggcatgctttcagccagatgcttgccatctctagggattgggggattggctagcctgggaggatcagtctgtccaggtcagcgaggccccagataccagagcatcaagagtacaggaaatacagttaatgcagggcctctgtgtggctggatcctccgtctccatcagatcagctctgattgatctattcttgcacgatttcctctgaacacagggttccagagtacttaaacacaacattttttaaatcgtgatttcggcctatttccttgccaggcctgtttccccaccaggaaatgagataggaggactggatgaggatgtcctgttatagttgctgtggaggaagttcctctggttaattctcatcagcgtctgcagaaaagaaggaaagagggcacccttttcagttgggaagaaaggagaggggtggcgccatggacgtggccctaaacgctgtgggagagggaagaggaggctgggcctcgctgccctcttgtctctgctgacttcagcctggtcatgcttgctctgccacttgcgatttcatccctaatttcttcctccaccatgcctgcagacttttccctgggcttgttttttctcgcacatctctgaagagtttttaatcttcagctcatcatgtcccaggaagtggcatcataaaaggaaatatttttttttcctaggagcagtgttaaaatctgggtcacattcctgaccaaggacagcatcctgccttctgcccatccccttcagttcacaaaagctgacattttaaacaaatcatgactcacacgtattaattggttataaatatgttgtgtacactggttagataaaacttaaggccacaaggagggcccaggtaggcgatgtcagtgtgtgaaggggctggattgggcgtggtgaggatgttggcaaaccagtgcatgcacctggttggaagatgctcagcctcacaaaagctccaagccctttgggagccaaagtgtctgagagtgtgaccctctcctgtaaagtatttatcccacccattaatataatttctgtataataaacttgacctgaaattatttcattctttatattaaacttttaaaaatgttttttattttcaccttagatatgggaagagttttttttttttttttttttttaacaggataacttgagcaggctaggcctcttaaaaaaaaatttgagctaaaactcatttttcttttggcattttcttttcaatgttcttataagcaaagttcatccatgttgtagcatgtgttcaactttattttttcatcgggtaatattccattgtatggaatggtagtactacattttatttatcatgcatcgattggtggacatttggatcgtttctacttcttgactattatacataatgctgctaggaacttttgtgtatgagtttttgtgtggacatatgttttcatttctctttggtatatgcctgggagcagatttgctggatcatatgaaactctatttaacccttgagggactcccaaactgttttccaatgtggtgacacaattttatatcccatcaacagggcatgagggttctgatgactccacatccctcagtgctttttattatctatcttttaacttagccatcctagtaggggtaatgtggcatctcattgtgattttggtttgcatttccctgatggcgaatgatattgagcatcttttcatgagcttattggccatttgcatatcttcttaggacagctatctttagatcacttgctcattttttaattgggttatttgtctttttattattgagttgtaagagtccttttatagcctggcacaagtccctttaactggtatatgattataaaatttttctccgtgagctgtttcatttccttgatgatgtcctttgaaatactaaagcttttaattttg

SEQ ID NO: 194919 - DNA, 1215 bp, Homo sapiens
  Payload ID: 18495
  Gene Name: tripartite motif containing 35
  ENST ID: ENST00000521253
  CDS Start-End: 4-804
gccatggagcggagtcccgacgtgtcccccgggccttcccgctccttcaaggaggagttgctctgcgccgtctgctacgaccccttccgcgacgcagtcactctgcgctgcggccacaacttctgccgcgggtgcgtgagccgctgctgggaggtgcaggtgtcgcccacctgcccagtgtgcaaagaccgcgcgtcacccgccgacctgcgcaccaaccacaccctcaacaacctggtggagaagctgctgcgcgaggaggccgagggcgcgcgctggaccagctaccgcttctcgcgtgtctgccgcctgcaccgcggacagctcagcctcttctgcctcgaggacaaggagctgctgtgctgctcctgccaggccgacccccgacaccaggggcaccgcgtgcagccggtgaaggacactgcccacgactttcgggtggaggctgcatggctggaaggccggatccggcaggagtttgataagcttcgcgagttcttgagagtggaggagcaggccattctggatgccatggccgaggagacaaggcagaagcaacttctggccgacgagaagatgaagcagctcacagaggagacggaggtgctggcacatgagatcgagcggctgcagatggagatgaaggaggacgacgtttcttttctcatgactcttctgcaccatggagccagagccagtccagcccggcatgcttatcgatgtctgcaagtacctgggctccctgcagtaccgcgtctggaagaagatgcttgcatctgtggaatctgtacccttcagctttgaccccaacaccgcagctggctggctctccgtgtctgacgacctcaccagcgtcaccaaccatggctaccgcgtgcaggtggagaacccggaacgcttctcctcggcgccctgcctgctgggctcccgtgtcttctcacagggctcgcacgcctgggaggtggcccttggggggctgcagagctggagggtgggcgtggtacgtgtgcgccaggactcgggcgctgagggccactcacacagctgctaccacgacacacgctcgggcttctggtatgtctgccgcacgcagggcgtggagggggaccactgcgtgacctcggacccagccacgtcgcccctggtcctggccatcccacgccgcctgcgtgtggagctggagtgtgaggagggcgagctgtctttctatgacgc

SEQ ID NO: 194920 - DNA, 619 bp, Homo sapiens
  Payload ID: 18495
  Gene Name: tripartite motif containing 35
  ENST ID: ENST00000521283
  CDS Start-End: 1-302
atgagatcgagcggctgcagatggagatgaaggaggacgacgtttcttttctcatgaaacacaagagccgaaaacgccgactcttctgcaccatggagccagagccagtccagcccggcatgcttatcgatgtctgcaagtacctgggctccctgcagtaccgcgtctggaagaagatgcttgcatctgtggaatctgtacccttcagctttgaccccaacaccgcagctggctggctctccgtgtctgacgacctcaccagcgtcaccaaccatggctaccgcgtgcaggagcagtgttaaaatctgggtcacattcctgaccaaggacagcatcctgccttctgcccatccccttcagttcacaaaagctgacattttaaacaaatcatgactcacacgtattaattggttataaatatgttgtgtacactggttagataaaacttaaggccacaaggagggcccaggtaggcgatgtcagtgtgtgaaggggctggattgggcgtggtgaggatgttggcaaaccagtgcatgcacctggttggaagatgctcagcctcacaaaagctccaagccctttgggagccaaagtgtctgagagtgtgaccctctcctgt

SEQ ID NO: 194921 - DNA, 4050 bp, Homo sapiens
  Payload ID: 18496
  Gene Name: tripartite motif containing 36
  Uniprot ID: Q9NQ86
  ENST ID: ENST00000282369
  CDS Start-End: 123-2309
tggttaacagcttatgggcggggagctcggcaaaactcagactaaaaacagaaaaagagaaaagaaaggacaaattcgatacacccgcgtcggtcctccagagtttgtgaaggggtgtaaacatgtcggagtctggggagatgagtgaatttggctacatcatggaattgatagctaaaggcaaggttaccattaagaatatcgaaagggagctcatttgcccagcatgcaaggagctgtttacccacccattgattctcccttgccaacatagtatctgtcataaatgtgtaaaagaactcctgctgactctcgatgattcattcaacgatgtgggatcagacaactccaatcaaagcagtcctcgacttcggctcccctcccctagtatggataaaattgaccgaattaacagaccaggctggaagcgcaattcattgaccccgaggacaactgttttcccttgccctggctgtgagcatgatgtggatcttggagaacgaggaatcaatggtctgtttcgaaacttcactttggaaactattgtggaaagatatcgtcaagcagctagggcagccacagccattatgtgtgacctttgtaaaccaccacctcaagaatccacaaaaagctgcatggactgtagtgcaagttactgcaatgaatgcttcaaaattcatcacccttggggtactataaaagctcaacatgagtatgttggtccaactactaacttcagacccaagattttaatgtgcccagaacatgaaacagagagaataaacatgtactgtgaattatgtaggaggccagtttgccatctgtgtaagttgggtggtaatcatgccaaccaccgtgtaaccactatgagcagtgcctacaaaaccttaaaggaaaagctttcaaaggatattgattaccttattggtaaggaaagccaggtgaagagtcaaatatctgaactaaacttgttaatgaaagaaacagagtgtaatggagagagggctaaagaagaagcaattacacattttgaaaagctctttgaagttctggaagagaggaaatcatctgttttgaaagcaattgactcctctaagaaactaagattagacaaatttcagactcaaatggaagagtaccagggacttctagagaacaatggacttgtgggatatgctcaagaagtgctaaaggagacagatcagtcttgctttgtgcagacagcaaagcagctccacctcagaatacagaaagccacagaatctttgaagagctttagacctgcagctcagacttcttttgaagactatgttgttaatacctctaaacaaacagaacttcttggagaattatcctttttctctagtggcatagacgtgccagagatcaatgaggaacagagcaaagtttataacaatgccttgataaattggcaccatccagaaaaggataaagctgatagctatgttcttgaatatcggaaaatcaatagagatgatgaaatgtcatggaatgagatagaagtgtgtggaacaagtaaaataattcaagacttggaaaacagtagtacctatgctttcagagtaagagcttacaagggttcaatctgtagtccttgcagcagagaattgattcttcatactcctccagctccagttttcagcttcctctttgatgaaaaatgtggctataataatgaacacctcctgctgaacttgaagagagaccgtgtagagagtagagctggatttaatcttctgcttgctgcagaacgcatccaagtgggttattacacaagcttagactacatcattggagatactggcattacaaaaggaaaacacttctgggccttccgtgtggaaccatattcatacctggtaaaagtgggagttgcttctagcgataaactacaagaatggctccgttctccccgggatgcagttagtccaagatatgagcaagacagtgggcatgacagtggaagtgaggatgcctgttttgattcttcacaaccatttaccttagttactataggcatgcagaaattttttatacccaagtcacctacttcttctaatgaacctgaaaatagagttctccctatgccaacaagtattgggattttccttgactgtgataaaggcaaagtagatttctatgatatggatcagatgaaatgcctttatgaacgccaagtggactgttcacatacactgtatccagcatttgcattaatgggcagtggaggaattcagcttgaagaacccatcacagcaaaatatctggaataccaagaggacatgtagttgaaacatctgatgtgactcaggataaaaactgtaaacaaagcaatgccttagcgttaaccttcgtaactaattacatatcgctgagtgttctgtcaccccacttgtgtttgagtatgattcttcttgaaatacagaaaatctaaacagccttgtgtcttcatgtcgttgttctgcctttcacaaatgatgaaagtgaagatgttctttccaagttaatactgaagtggttaactttgcaactggactgtcttttactttatgtacaggatatctaatttatttctgtcagctggtgttgctgacactttccttatggtgggggggatacaaaagtatttattatgattctcttctgtttgacttttcatttttatatcatgtttatgtcctaagagaagatattttttaaatgccttatggataggaattagtactaagcaatgtgtcttgcatttgttttcaataggaaaacaaagttctagataggttaaaagaaaaacaccataaaagtggtagtatatttaagtggaaaattatgtattttaaagtgtgtaactattaaaaatatattgcctggaaaaggaatactactgttttgttttgttaagaccacaaactgtattgctaaggacattttaagagtctgcttagccataacactcatttaacagcatgggtagtaagcatggtttcttgcagaaaacacaaagttctcagctaacacattaaacttctcactttatatactttttttcagagaaatttatctttagtttttcttattctgtgaaaatatttgttcttatgtcaaagaattatttttcagatatattggtaaagatggactgatattaaaagtcatatttattcttttacccccttactgtgttttgtgattttcatttttggcccaattattacatatcaggttttcctgatttatatttacatgtttgaaaagttcattatatattttagtagcgttacatatattataaatttttgtaacatttaaatgttcacttatgtggcattttctgtttctcattggtaataagcatttctaatataagcaagtaaaaatacaaatttaattacttagaaatgataactaagatcacaatgactgtgtaccctttaaaatatcttttaatttgaggaattacattctatctaaattgtgtgtctgtttttgaaaggtgttgctttcaagtaggtggtttttatttaaagtacttatttttttgaggttaaaatattcagaaactacttttatgcattgtagcagtaatcatttatggaatgcttttgacatgttttaacagggtaaccaaaacttttaggcctgttttttttggttgtccttgttgttatatttttaatggaaatctgttactcaggctggtagcattaaattagctttttaccctcaactcaagtagcaaatatcatggagaacttcagtgtttagcaggctgttaatttcccatctatgaatagcactttatgatgtaggctaaactaagcaaataatgcagcgttatgtggatcattatgcaataaagctgctaaagtcacatttgtggttgatactcaagccttgtacaagcacatatgatgtagacatttttaaatgtgaagctttaacaggaataggatagctgtttcaaaccttgtgcaattgtaaataaattgtttagctgtgtttctttcatttttaataaaaaattaaaaagaa

SEQ ID NO: 194922 - DNA, 1322 bp, Homo sapiens
  Payload ID: 18496
  Gene Name: tripartite motif containing 36
  Uniprot ID: Q9NQ86
  ENST ID: ENST00000379617
  CDS Start-End: 510-695
gatggggcttttttccagatcttcgcgccgagagccggggacggccaacctgccggcatgcgataaaggccggggaatgtctagctggggccgcgctgagccgagtgcggacccgctttgtgtgcgcgtttgtttgtctccgctgcggtccgaaccgctgccgcgacccccgaggaggcggggcctccgcgcgcccggctccgcctggtgagggtttcacggcctctgctgccgccgccgccgccctcgtttgttccgttagatcgcgcagccccgaccgctgcacccggatcctagcaagccgggcgaggctgcccgggagccctcgatggccttcatttcacccaagcccgcttcttgctttccccggcgcttcccctcttttcctggttaacagcttatgggcggggagctcggcaaaactcagactaaaaacagaaaaagagaaaagaaaggacaaattcgatacacccgcgtcggtcctccagagtttgtgaaggggtgtaaacatgtcggagtctggggagatgagtgaatttggctacatcatggaattgatagctaaaggcaaggcttcagcaatgggcctgcagcaaacccatgagcattcccggttgacttctaaaggtggagaggcccgctgtccctttgaaatctctgaggttggaaagcagtctctcccaagaagaacttaggacaattcctctctctgttttgtgggggttggagggggagagttggtctggagtaggctcctaaccatttcaacgtaagcttatttcctaccactctcctcaggctcaaatcctgccccgccccgcagccccagcactagcccatttaagacccctgttttgtgtgtgattatacaggatttgaacactgaatattaaccatggaatagcagacctttgagactgacttgctttattttcctctgtggggttcggttccactttgtagttcgggtttgtaatgtaaagaataatgggaaactggtctaattatgagagttaagagagtagaggcctgtagttggcctgccctccgccccaccatccctcaaagttgagaccactgagttaaccatcctcttaatttctctcacttttcccccagatttgtttcatccttgtactggacttctcaagctctgtacataattaaaaatacatagctttacatttttacaaacttaatacctggaatatatgcttgttgtaaagtattcaaacttcacagaaaggttcacagagtaaaaagtctaagttcatgcccacctccaatctcattccttccccagtggcagcagtttgtgtgtc

SEQ ID NO: 194923 - DNA, 693 bp, Homo sapiens
  Payload ID: 18496
  Gene Name: tripartite motif containing 36
  Uniprot ID: Q9NQ86
  ENST ID: ENST00000379618
  CDS Start-End: 510-692
gatggggcttttttccagatcttcgcgccgagagccggggacggccaacctgccggcatgcgataaaggccggggaatgtctagctggggccgcgctgagccgagtgcggacccgctttgtgtgcgcgtttgtttgtctccgctgcggtccgaaccgctgccgcgacccccgaggaggcggggcctccgcgcgcccggctccgcctggtgagggtttcacggcctctgctgccgccgccgccgccctcgtttgttccgttagatcgcgcagccccgaccgctgcacccggatcctagcaagccgggcgaggctgcccgggagccctcgatggccttcatttcacccaagcccgcttcttgctttccccggcgcttcccctcttttcctggttaacagcttatgggcggggagctcggcaaaactcagactaaaaacagaaaaagagaaaagaaaggacaaattcgatacacccgcgtcggtcctccagagtttgtgaaggggtgtaaacatgtcggagtctggggagatgagtgaatttggctacatcatggaattgatagctaaaggcaagatgccggattggagacgaggctaccgctgcagacagggctgtgggaagacgacggaacttgccacagcgacagacttctcccaaacaggaaataaaagtgggaagcattttaaaacctaaa

SEQ ID NO: 194924 - DNA, 4218 bp, Homo sapiens
  Payload ID: 18496
  Gene Name: tripartite motif containing 36
  Uniprot ID: Q9NQ86
  ENST ID: ENST00000513154
  CDS Start-End: 328-2478
gtccacgccccgcggtgccccgcccaggtctctgcgcggcgccgttcccagccgcagtccgcaggagccgctgctgcagccggcagctgggcgggattcccggggtagtcgctgggagcaaagctcgcttctcccgcgcctgtgcttttgcctgccccggcttacttctccccgcgtcggtccgctggccacgtacagctgaccagctcatcttccagcttcggaccgaggctccacggccgccgcagggacccgcccaccagaccctgcgctcggtagccggtgtgagtggaacgtgccgctgatgacacctggcagaaggcagccatggagggcgatggctcagattcgccggttaccattaagaatatcgaaagggagctcatttgcccagcatgcaaggagctgtttacccacccattgattctcccttgccaacatagtatctgtcataaatgtgtaaaagaactcctgctgactctcgatgattcattcaacgatgtgggatcagacaactccaatcaaagcagtcctcgacttcggctcccctcccctagtatggataaaattgaccgaattaacagaccaggctggaagcgcaattcattgaccccgaggacaactgttttcccttgccctggctgtgagcatgatgtggatcttggagaacgaggaatcaatggtctgtttcgaaacttcactttggaaactattgtggaaagatatcgtcaagcagctagggcagccacagccattatgtgtgacctttgtaaaccaccacctcaagaatccacaaaaagctgcatggactgtagtgcaagttactgcaatgaatgcttcaaaattcatcacccttggggtactataaaagctcaacatgagtatgttggtccaactactaacttcagacccaagattttaatgtgcccagaacatgaaacagagagaataaacatgtactgtgaattatgtaggaggccagtttgccatctgtgtaagttgggtggtaatcatgccaaccaccgtgtaaccactatgagcagtgcctacaaaaccttaaaggaaaagctttcaaaggatattgattaccttattggtaaggaaagccaggtgaagagtcaaatatctgaactaaacttgttaatgaaagaaacagagtgtaatggagagagggctaaagaagaagcaattacacattttgaaaagctctttgaagttctggaagagaggaaatcatctgttttgaaagcaattgactcctctaagaaactaagattagacaaatttcagactcaaatggaagagtaccagggacttctagagaacaatggacttgtgggatatgctcaagaagtgctaaaggagacagatcagtcttgctttgtgcagacagcaaagcagctccacctcagaatacagaaagccacagaatctttgaagagctttagacctgcagctcagacttcttttgaagactatgttgttaatacctctaaacaaacagaacttcttggagaattatcctttttctctagtggcatagacgtgccagagatcaatgaggaacagagcaaagtttataacaatgccttgataaattggcaccatccagaaaaggataaagctgatagctatgttcttgaatatcggaaaatcaatagagatgatgaaatgtcatggaatgagatagaagtgtgtggaacaagtaaaataattcaagacttggaaaacagtagtacctatgctttcagagtaagagcttacaagggttcaatctgtagtccttgcagcagagaattgattcttcatactcctccagctccagttttcagcttcctctttgatgaaaaatgtggctataataatgaacacctcctgctgaacttgaagagagaccgtgtagagagtagagctggatttaatcttctgcttgctgcagaacgcatccaagtgggttattacacaagcttagactacatcattggagatactggcattacaaaaggaaaacacttctgggccttccgtgtggaaccatattcatacctggtaaaagtgggagttgcttctagcgataaactacaagaatggctccgttctccccgggatgcagttagtccaagatatgagcaagacagtgggcatgacagtggaagtgaggatgcctgttttgattcttcacaaccatttaccttagttactataggcatgcagaaattttttatacccaagtcacctacttcttctaatgaacctgaaaatagagttctccctatgccaacaagtattgggattttccttgactgtgataaaggcaaagtagatttctatgatatggatcagatgaaatgcctttatgaacgccaagtggactgttcacatacactgtatccagcatttgcattaatgggcagtggaggaattcagcttgaagaacccatcacagcaaaatatctggaataccaagaggacatgtagttgaaacatctgatgtgactcaggataaaaactgtaaacaaagcaatgccttagcgttaaccttcgtaactaattacatatcgctgagtgttctgtcaccccacttgtgtttgagtatgattcttcttgaaatacagaaaatctaaacagccttgtgtcttcatgtcgttgttctgcctttcacaaatgatgaaagtgaagatgttctttccaagttaatactgaagtggttaactttgcaactggactgtcttttactttatgtacaggatatctaatttatttctgtcagctggtgttgctgacactttccttatggtgggggggatacaaaagtatttattatgattctcttctgtttgacttttcatttttatatcatgtttatgtcctaagagaagatattttttaaatgccttatggataggaattagtactaagcaatgtgtcttgcatttgttttcaataggaaaacaaagttctagataggttaaaagaaaaacaccataaaagtggtagtatatttaagtggaaaattatgtattttaaagtgtgtaactattaaaaatatattgcctggaaaaggaatactactgttttgttttgttaagaccacaaactgtattgctaaggacattttaagagtctgcttagccataacactcatttaacagcatgggtagtaagcatggtttcttgcagaaaacacaaagttctcagctaacacattaaacttctcactttatatactttttttcagagaaatttatctttagtttttcttattctgtgaaaatatttgttcttatgtcaaagaattatttttcagatatattggtaaagatggactgatattaaaagtcatatttattcttttacccccttactgtgttttgtgattttcatttttggcccaattattacatatcaggttttcctgatttatatttacatgtttgaaaagttcattatatattttagtagcgttacatatattataaatttttgtaacatttaaatgttcacttatgtggcattttctgtttctcattggtaataagcatttctaatataagcaagtaaaaatacaaatttaattacttagaaatgataactaagatcacaatgactgtgtaccctttaaaatatcttttaatttgaggaattacattctatctaaattgtgtgtctgtttttgaaaggtgttgctttcaagtaggtggtttttatttaaagtacttatttttttgaggttaaaatattcagaaactacttttatgcattgtagcagtaatcatttatggaatgcttttgacatgttttaacagggtaaccaaaacttttaggcctgttttttttggttgtccttgttgttatatttttaatggaaatctgttactcaggctggtagcattaaattagctttttaccctcaactcaagtagcaaatatcatggagaacttcagtgtttagcaggctgttaatttcccatctatgaatagcactttatgatgtaggctaaactaagcaaataatgcagcgttatgtggatcattatgcaataaagctgctaaagtcacatttgtggttgatactcaagccttgtacaagcacatatgatgtagacatttttaaatgtgaagctttaacaggaataggatagctgtttcaaaccttgtgcaattgtaaataaattgtttagctgtgtttctttcatttttaataaaaaattaaaaaga

SEQ ID NO: 194925 - DNA, 1952 bp, Homo sapiens
  Payload ID: 18496
  Gene Name: tripartite motif containing 36
  ENST ID: ENST00000514154
  CDS Start-End: 231-1952
atgtcggagtctggggagatgagtgaatttggctacatcatggaattgatagctaaaggcaaggctggaagcgcaattcattgaccccgaggacaactgttttcccttgccctggctgtgagcatgatgtggatcttggagaacgaggaatcaatggtctgtttcgaaacttcactttggaaactattgtggaaagatatcgtcaagcagctagggcagccacagccattatgtgtgacctttgtaaaccaccacctcaagaatccacaaaaagctgcatggactgtagtgcaagttactgcaatgaatgcttcaaaattcatcacccttggggtactataaaagctcaacatgagtatgttggtccaactactaacttcagacccaagattttaatgtgcccagaacatgaaacagagagaataaacatgtactgtgaattatgtaggaggccagtttgccatctgtgtaagttgggtggtaatcatgccaaccaccgtgtaaccactatgagcagtgcctacaaaaccttaaaggaaaagctttcaaaggatattgattaccttattggtaaggaaagccaggtgaagagtcaaatatctgaactaaacttgttaatgaaagaaacagagtgtaatggagagagggctaaagaagaagcaattacacattttgaaaagctctttgaagttctggaagagaggaaatcatctgttttgaaagcaattgactcctctaagaaactaagattagacaaatttcagactcaaatggaagagtaccagggacttctagagaacaatggacttgtgggatatgctcaagaagtgctaaaggagacagatcagtcttgctttgtgcagacagcaaagcagctccacctcagaatacagaaagccacagaatctttgaagagctttagacctgcagctcagacttcttttgaagactatgttgttaatacctctaaacaaacagaacttcttggagaattatcctttttctctagtggcatagacgtgccagagatcaatgaggaacagagcaaagtttataacaatgccttgataaattggcaccatccagaaaaggataaagctgatagctatgttcttgaatatcggaaaatcaatagagatgatgaaatgtcatggaatgagatagaagtgtgtggaacaagtaaaataattcaagacttggaaaacagtagtacctatgctttcagagtaagagcttacaagggttcaatctgtagtccttgcagcagagaattgattcttcatactcctccagctccagttttcagcttcctctttgatgaaaaatgtggctataataatgaacacctcctgctgaacttgaagagagaccgtgtagagagtagagctggatttaatcttctgcttgctgcagaacgcatccaagtgggttattacacaagcttagactacatcattggagatactggcattacaaaaggaaaacacttctgggccttccgtgtggaaccatattcatacctggtaaaagtgggagttgcttctagcgataaactacaagaatggctccgttctccccgggatgcagttagtccaagatatgagcaagacagtgggcatgacagtggaagtgaggatgcctgttttgattcttcacaaccatttaccttagttactataggcatgcagaaattttttatacccaagtcacctacttcttctaatgaacctgaaaatagagttctccctatgccaacaagtattgggattttccttgactgtgataaaggcaaagtagatttctatgatatggatcagatgaaatgcctttatgaacgccaagtggactgttcacatacactgtatccagcatttgcattaatgggcagtggaggaattcagcttgaagaacccatcacagcaaaatatctggaataccaagaggacatgtag

SEQ ID NO: 194926 - DNA, 786 bp, Homo sapiens
  Payload ID: 18496
  Gene Name: tripartite motif containing 36
  ENST ID: ENST00000508894
  CDS Start-End: 276-786
cgcagtccgcaggagccgctgctgcagccggcagctgggcgggattcccggggtagtcgctgggagcaaagctcgcttctcccgcgcctgtgcttttgcctgccccggcttacttctccccgcgtcggtccgctggccacgtacagctgaccagctcatcttccagcttcggaccgaggctccacggccgccgcagggacccgcccaccagaccctgcgctcggtagccggtgtgagtggaacgtgccgctgatgacacctggcagaaggcagccatggagggcgatggctcagattcgccggttaccattaagaatatcgaaagggagctcatttgcccagcatgcaaggagctgtttacccacccattgattctcccttgccaacatagtatctgtcataaatgtgtaaaagaactcctgctgactctcgatgattcattcaacgatgtgggatcagacaactccaatcaaagcagtcctcgacttcggctcccctcccctagtatggataaaattgaccgaattaacagaccagcatcacaacggagatctgtggggtggagaggctggaagcgcaattcattgaccccgaggacaactgttttcccttgccctggctgtgagcatgatgtggatcttggagaacgaggaatcaatggtctgtttcgaaacttcactttggaaactattgtggaaagatatcgtcaagcagctagggcagccacagccattatgtgtgacctttgtaaaccaccacctcaagaatccacaaaaagctgcatgg

SEQ ID NO: 194927 - DNA, 4330 bp, Homo sapiens
  Payload ID: 18497
  Gene Name: tripartite motif containing 37
  Uniprot ID: O94972
  ENST ID: ENST00000262294
  CDS Start-End: 261-3155
agccgggagaaaggagctgcggccaccgttcgccctacttctgcgcctcggggcgggcgcgccggtaaaaatggcgaaatgggggtaggcggcgctggacctgaagagatggggcgcgcaggtggggcggttgtcagagccccctgacgtgggcgccgggcttttatcggcgatttgatctggcgacctcgggccggcgcctaagaggtcagactgcggagcctgcgggtcgccagcggccccgccgagagccggaggcaatggatgaacagagcgtggagagcattgctgaggttttccgatgtttcatttgtatggagaaattgcgggatgcacgcctgtgtcctcattgctccaaactgtgttgtttcagctgtattaggcgctggctgacagagcagagagctcaatgtcctcattgccgtgctccactccagctacgagaactagtaaattgtcgttgggcagaagaagtaacacaacagcttgatactcttcaactctgcagtctcaccaaacatgaagaaaatgaaaaggacaaatgtgaaaatcaccatgaaaaacttagtgtattttgctggacttgtaagaagtgtatctgccatcagtgtgcactttggggaggaatgcatggcggacatacctttaaacctttggcagaaatttatgagcaacacgtcactaaagtgaatgaagaggtagccaaacttcgtcggcgtctcatggaactgatcagcttagttcaagaagtggaaaggaatgtagaagctgtaagaaatgcaaaagatgagcgtgttcgggaaattaggaatgcagtggagatgatgattgcacggttagacacacagctgaagaataagcttataacactgatgggtcagaagacatctctaacccaagaaacagagcttttggaatccttacttcaggaggtggagcaccagttgcggtcttgtagtaagagtgagttgatatctaagagctcagagatccttatgatgtttcagcaagttcatcggaagcccatggcatcttttgttaccactcctgttccaccagactttaccagtgaattagtgccatcttacgattcagctacttttgttttagagaatttcagcactttgcgtcagagagcagatcctgtttacagtccacctcttcaagtttcaggactttgctggaggttaaaagtttacccagatggaaatggagttgtgcgaggttactacttatctgtgtttctggagctctcagctggcttgcctgaaacttctaaatatgaatatcgtgtagagatggttcaccagtcctgtaatgatcctacaaaaaatatcattcgagaatttgcatctgactttgaagttggagaatgctggggctataatagatttttccgtttggacttactcgcaaatgaaggatacttgaatccacaaaatgatacagtgattttaaggtttcaggtacgttcaccaactttctttcaaaaatcccgggaccagcattggtacattactcagttggaagctgcacagactagttatatccaacaaataaacaaccttaaagagagacttactattgagctgtctcgaactcagaagtcaagagatttgtcaccaccagataaccatcttagcccccaaaatgatgatgctctggagacacgagctaagaagtctgcatgctctgacatgcttctcgaaggtggtcctactacagcttctgtaagagaggccaaagaggatgaagaagatgaggagaagattcagaatgaagattatcatcacgagctttcagatggagatctggatctggatcttgtttatgaggatgaagtaaatcagctcgatggcagcagttcctctgctagttccacagcaacaagtaatacagaagaaaatgatattgatgaagaaactatgtctggagaaaatgatgtggaatataacaacatggaattagaagagggagaactcatggaagatgcagctgctgcaggacccgcaggtagtagccatggttatgtgggttccagtagtagaatatcaagaagaacacatttatgctccgctgctaccagtagtttactagacattgatccattaattttaatacatttgttggaccttaaggaccggagcagtatagaaaatttgtggggcttacagcctcgcccacctgcttcacttctgcagcccacagcatcatattctcgaaaagataaagaccaaaggaagcaacaggcaatgtggcgagtgccctctgatttaaagatgctaaaaagactcaaaactcaaatggccgaagttcgatgtatgaaaactgatgtaaagaatacactttcagaaataaaaagcagcagtgctgcttctggagacatgcagacaagccttttttctgctgaccaggcagctctggctgcatgtggaactgaaaactctggcagattgcaggatttgggaatggaactcctggcaaagtcatcagttgccaattgttacatacgaaactccacaaataagaagagtaattcgcccaagccagctcgatccagtgtagcaggtagtctatcacttcgaagagcagtggaccctggagaaaatagtcgttcaaagggagactgtcagactctgtctgaaggctccccaggaagctctcagtctgggagcaggcacagttctccccgagccttgatacatggcagtatcggtgatattctgccaaaaactgaagaccggcagtgtaaagctttggattcagatgctgttgtggttgcagttttcagtggcttgcctgcggttgagaaaaggaggaaaatggtcaccttgggggctaatgctaaaggaggtcatctggaaggactgcagatgactgatttggaaaataattctgaaactggagagttacagcctgtactacctgaaggagcttcagctgcccctgaagaaggaatgagtagcgacagtgacattgaatgtgacactgagaatgaggagcaggaagagcataccagtgtgggcgggtttcacgactccttcatggtcatgacacagcccccggatgaagatacacattccagttttcctgatggtgaacaaataggccctgaagatctcagcttcaatacagatgaaaatagtggaaggtaattgccaaatcaagagaactgacttgcaagctaccttgaccctgaattttgctgtagttggtgctcaaatttgtcatcagtcagataatcagatttggtcttatttcttcattatctcgacctgaaatagtaatttggaaactgttggaaggtggcacagtttagtctaagacagcagtagtacatgggaaaaacagtatgggaagagttctttgtaatgtaaggaaataacaatgtagttctctattaatttagcaaatttgtacattcacaaaaggcagtttgtctactacagcagaaggctggttaactgccagaaaatgtacctccaggccctgcatgccgtcagtaacccgcccggcattggtgctctactgtctttggctagagcttagttgtgtttaaataatcatctttatatttggggttttaattacagttccattagtgcctgtagattagtgaacagaaaattgctttggaagagattctgccctgtagacactatgtgaataactgaagtaacactagactgaatctcctttttggagtatgtatcttctctcacttgttcaagtacaggcacactgttcaaccgcatggtatctttctgttgtgtgacttctacaaatgtaattttaaatgaaattaagttaacatggattcattacgttcctggccctgtagacacgtgtaagattatttaaaattctttcatttttttctgcctcttactatacgactgtagtgcaacaaatattttaaagcccccttttcttctttattttcattagttgtacattgatttcagtgtcaacacatttaaagattcattcatgttgcacagtggcttacatgaacgtgaaactgtgatataaggttttctttcatactcataattagcccaaaacagttgccaaactttgccattgtgctcctgcatttgtgtttgagctgctatatatttgtggaaattacactgaaagttgactaagagactattgaaaaagcatgaataattaaatatacatgtgagagacatctcatctgctgtattttacttagtgaatattgttcactcttccgtgtctgatgtcttgctgaatgctgtgactcatagtttacttttgttcaaaatagtttgcactttttgttaataaaatcaacttgagaaaa

SEQ ID NO: 194928 - DNA, 3548 bp, Homo sapiens
  Payload ID: 18497
  Gene Name: tripartite motif containing 37
  Uniprot ID: O94972
  ENST ID: ENST00000393065
  CDS Start-End: 366-3158
gaattctctgcggcaccttcttcgctgaactccaccgtcagttccataggcgcgcgcccgcgtcacgtgggccgaggttccggcgcggctgctggccggcggctgagccgggagaaaggagctgcggccaccgttcgccctacttctgcgcctcggggcgggcgcgccggtaaaaatggcgaaatgggggtaggcggcgctggacctgaagagatggggcgcgcaggtggggcggttgtcagagccccctgacgtgggcgccgggcttttatcggcgatttgatctggcgacctcgggccggcgcctaagaggtcagactgcggagcctgcgggtcgccagcggccccgccgagagccggaggcaatggatgaacagagcgtggagcgctggctgacagagcagagagctcaatgtcctcattgccgtgctccactccagctacgagaactagtaaattgtcgttgggcagaagaagtaacacaacagcttgatactcttcaactctgcagtctcaccaaacatgaagaaaatgaaaaggacaaatgtgaaaatcaccatgaaaaacttagtgtattttgctggacttgtaagaagtgtatctgccatcagtgtgcactttggggaggaatgcatggcggacatacctttaaacctttggcagaaatttatgagcaacacgtcactaaagtgaatgaagaggtagccaaacttcgtcggcgtctcatggaactgatcagcttagttcaagaagtggaaaggaatgtagaagctgtaagaaatgcaaaagatgagcgtgttcgggaaattaggaatgcagtggagatgatgattgcacggttagacacacagctgaagaataagcttataacactgatgggtcagaagacatctctaacccaagaaacagagcttttggaatccttacttcaggaggtggagcaccagttgcggtcttgtagtaagagtgagttgatatctaagagctcagagatccttatgatgtttcagcaagttcatcggaagcccatggcatcttttgttaccactcctgttccaccagactttaccagtgaattagtgccatcttacgattcagctacttttgttttagagaatttcagcactttgcgtcagagagcagatcctgtttacagtccacctcttcaagtttcaggactttgctggaggttaaaagtttacccagatggaaatggagttgtgcgaggttactacttatctgtgtttctggagctctcagctggcttgcctgaaacttctaaatatgaatatcgtgtagagatggttcaccagtcctgtaatgatcctacaaaaaatatcattcgagaatttgcatctgactttgaagttggagaatgctggggctataatagatttttccgtttggacttactcgcaaatgaaggatacttgaatccacaaaatgatacagtgattttaaggtttcaggtacgttcaccaactttctttcaaaaatcccgggaccagcattggtacattactcagttggaagctgcacagactagttatatccaacaaataaacaaccttaaagagagacttactattgagctgtctcgaactcagaagtcaagagatttgtcaccaccagataaccatcttagcccccaaaatgatgatgctctggagacacgagctaagaagtctgcatgctctgacatgcttctcgaaggtggtcctactacagcttctgtaagagaggccaaagaggatgaagaagatgaggagaagattcagaatgaagattatcatcacgagctttcagatggagatctggatctggatcttgtttatgaggatgaagtaaatcagctcgatggcagcagttcctctgctagttccacagcaacaagtaatacagaagaaaatgatattgatgaagaaactatgtctggagaaaatgatgtggaatataacaacatggaattagaagagggagaactcatggaagatgcagctgctgcaggacccgcaggtagtagccatggttatgtgggttccagtagtagaatatcaagaagaacacatttatgctccgctgctaccagtagtttactagacattgatccattaattttaatacatttgttggaccttaaggaccggagcagtatagaaaatttgtggggcttacagcctcgcccacctgcttcacttctgcagcccacagcatcatattctcgaaaagataaagaccaaaggaagcaacaggcaatgtggcgagtgccctctgatttaaagatgctaaaaagactcaaaactcaaatggccgaagttcgatgtatgaaaactgatgtaaagaatacactttcagaaataaaaagcagcagtgctgcttctggagacatgcagacaagccttttttctgctgaccaggcagctctggctgcatgtggaactgaaaactctggcagattgcaggatttgggaatggaactcctggcaaagtcatcagttgccaattgttacatacgaaactccacaaataagaagagtaattcgcccaagccagctcgatccagtgtagcaggtagtctatcacttcgaagagcagtggaccctggagaaaatagtcgttcaaagggagactgtcagactctgtctgaaggctccccaggaagctctcagtctgggagcaggcacagttctccccgagccttgatacatggcagtatcggtgatattctgccaaaaactgaagaccggcagtgtaaagctttggattcagatgctgttgtggttgcagttttcagtggcttgcctgcggttgagaaaaggaggaaaatggtcaccttgggggctaatgctaaaggaggtcatctggaaggactgcagatgactgatttggaaaataattctgaaactggagagttacagcctgtactacctgaaggagcttcagctgcccctgaagaaggaatgagtagcgacagtgacattgaatgtgacactgagaatgaggagcaggaagagcataccagtgtgggcgggtttcacgactccttcatggtcatgacacagcccccggatgaagatacacattccagttttcctgatggtgaacaaataggccctgaagatctcagcttcaatacagatgaaaatagtggaaggtaattgccaaatcaagagaactgacttgcaagctaccttgaccctgaattttgctgtagttggtgctcaaatttgtcatcagtcagataatcagatttggtcttatttcttcattatctcgacctgaaatagtaatttggaaactgttggaaggtggcacagtttagtctaagacagcagtagtacatgggaaaaacagtatgggaagagttctttgtaatgtaaggaaataacaatgtagttctctattaatttagcaaatttgtacattcacaaaaggcagtttgtctactacagcagaaggctggttaactgccagaaaatgtacctccaggccctgcatgccgtcagtaacccgcccggcattggtgctctactgtctttggctagagc

SEQ ID NO: 194929 - DNA, 3622 bp, Homo sapiens
  Payload ID: 18497
  Gene Name: tripartite motif containing 37
  Uniprot ID: O94972
  ENST ID: ENST00000393066
  CDS Start-End: 461-3355
cctcctttcccctcccacagcgtcctgcgcgcatgcgcttcgcagcttctctcgccgccgcgcccccagctgctctggttacggttggtgtttgcgaattctctgcggcaccttcttcgctgaactccaccgtcagttccataggcgcgcgcccgcgtcacgtgggccgaggttccggcgcggctgctggccggcggctgagccgggagaaaggagctgcggccaccgttcgccctacttctgcgcctcggggcgggcgcgccggtaaaaatggcgaaatgggggtaggcggcgctggacctgaagagatggggcgcgcaggtggggcggttgtcagagccccctgacgtgggcgccgggcttttatcggcgatttgatctggcgacctcgggccggcgcctaagaggtcagactgcggagcctgcgggtcgccagcggccccgccgagagccggaggcaatggatgaacagagcgtggagagcattgctgaggttttccgatgtttcatttgtatggagaaattgcgggatgcacgcctgtgtcctcattgctccaaactgtgttgtttcagctgtattaggcgctggctgacagagcagagagctcaatgtcctcattgccgtgctccactccagctacgagaactagtaaattgtcgttgggcagaagaagtaacacaacagcttgatactcttcaactctgcagtctcaccaaacatgaagaaaatgaaaaggacaaatgtgaaaatcaccatgaaaaacttagtgtattttgctggacttgtaagaagtgtatctgccatcagtgtgcactttggggaggaatgcatggcggacatacctttaaacctttggcagaaatttatgagcaacacgtcactaaagtgaatgaagaggtagccaaacttcgtcggcgtctcatggaactgatcagcttagttcaagaagtggaaaggaatgtagaagctgtaagaaatgcaaaagatgagcgtgttcgggaaattaggaatgcagtggagatgatgattgcacggttagacacacagctgaagaataagcttataacactgatgggtcagaagacatctctaacccaagaaacagagcttttggaatccttacttcaggaggtggagcaccagttgcggtcttgtagtaagagtgagttgatatctaagagctcagagatccttatgatgtttcagcaagttcatcggaagcccatggcatcttttgttaccactcctgttccaccagactttaccagtgaattagtgccatcttacgattcagctacttttgttttagagaatttcagcactttgcgtcagagagcagatcctgtttacagtccacctcttcaagtttcaggactttgctggaggttaaaagtttacccagatggaaatggagttgtgcgaggttactacttatctgtgtttctggagctctcagctggcttgcctgaaacttctaaatatgaatatcgtgtagagatggttcaccagtcctgtaatgatcctacaaaaaatatcattcgagaatttgcatctgactttgaagttggagaatgctggggctataatagatttttccgtttggacttactcgcaaatgaaggatacttgaatccacaaaatgatacagtgattttaaggtttcaggtacgttcaccaactttctttcaaaaatcccgggaccagcattggtacattactcagttggaagctgcacagactagttatatccaacaaataaacaaccttaaagagagacttactattgagctgtctcgaactcagaagtcaagagatttgtcaccaccagataaccatcttagcccccaaaatgatgatgctctggagacacgagctaagaagtctgcatgctctgacatgcttctcgaaggtggtcctactacagcttctgtaagagaggccaaagaggatgaagaagatgaggagaagattcagaatgaagattatcatcacgagctttcagatggagatctggatctggatcttgtttatgaggatgaagtaaatcagctcgatggcagcagttcctctgctagttccacagcaacaagtaatacagaagaaaatgatattgatgaagaaactatgtctggagaaaatgatgtggaatataacaacatggaattagaagagggagaactcatggaagatgcagctgctgcaggacccgcaggtagtagccatggttatgtgggttccagtagtagaatatcaagaagaacacatttatgctccgctgctaccagtagtttactagacattgatccattaattttaatacatttgttggaccttaaggaccggagcagtatagaaaatttgtggggcttacagcctcgcccacctgcttcacttctgcagcccacagcatcatattctcgaaaagataaagaccaaaggaagcaacaggcaatgtggcgagtgccctctgatttaaagatgctaaaaagactcaaaactcaaatggccgaagttcgatgtatgaaaactgatgtaaagaatacactttcagaaataaaaagcagcagtgctgcttctggagacatgcagacaagccttttttctgctgaccaggcagctctggctgcatgtggaactgaaaactctggcagattgcaggatttgggaatggaactcctggcaaagtcatcagttgccaattgttacatacgaaactccacaaataagaagagtaattcgcccaagccagctcgatccagtgtagcaggtagtctatcacttcgaagagcagtggaccctggagaaaatagtcgttcaaagggagactgtcagactctgtctgaaggctccccaggaagctctcagtctgggagcaggcacagttctccccgagccttgatacatggcagtatcggtgatattctgccaaaaactgaagaccggcagtgtaaagctttggattcagatgctgttgtggttgcagttttcagtggcttgcctgcggttgagaaaaggaggaaaatggtcaccttgggggctaatgctaaaggaggtcatctggaaggactgcagatgactgatttggaaaataattctgaaactggagagttacagcctgtactacctgaaggagcttcagctgcccctgaagaaggaatgagtagcgacagtgacattgaatgtgacactgagaatgaggagcaggaagagcataccagtgtgggcgggtttcacgactccttcatggtcatgacacagcccccggatgaagatacacattccagttttcctgatggtgaacaaataggccctgaagatctcagcttcaatacagatgaaaatagtggaagataatttgatttgaaactgacactgcacctgatgggttaacaagatctaggcttcagaaggtgacagatatgagtgaggaccatgtgtggggcaaagcctcagaatgatgaaaaggttccggcactatagttggggccatgttgactccttttcaaccatttgtcacagacgtgagaagaagaaatgacttcaaaatcaagagaaaacaaatactgaaagtctctacttacatccaaattttaaaaaataaaatctgtagattaacaatct

SEQ ID NO: 194930 - DNA, 4310 bp, Homo sapiens
  Payload ID: 18497
  Gene Name: tripartite motif containing 37
  ENST ID: ENST00000577554
  CDS Start-End: 280-483
ggctgctggccggcggctgagccgggagaaaggagctgcggccaccgttcgccctacttctgcgcctcggggcgggcgcgccggtaaaaatggcgaaatgggggtaggcggcgctggacctgaagagatggggcgcgcaggtggggcggttgtcagagccccctgacgtgggcgccgggcttttatcggcgatttgatctggcgacctcgggccggcgcctaagaggtcagactgcggagcctgcgggtcgccagcggccccgccgagagccggaggcaatggatgaacagagcgtggagagcattgctgaggttttccgatgtttcatttgtatggagaaattgcgggatgcacgcctgtgtcctcattgctccaaactgtgttgtttcagctgtattaggcgctggctgacagagcagagagctcaatgtcctcattgccgagtctcgctctgtcgtccaggccggagtgcaatggcgtgatttcagctcactgcagcctcgacctcctgggctcagtgctccactccagctacgagaactagtaaattgtcgttgggcagaagaagtaacacaacagcttgatactcttcaactctgcagtctcaccaaacatgaagaaaatgaaaaggacaaatgtgaaaatcaccatgaaaaacttagtgtattttgctggacttgtaagaagtgtatctgccatcagtgtgcactttggggaggaatgcatggcggacatacctttaaacctttggcagaaatttatgagcaacacgtcactaaagtgaatgaagaggtagccaaacttcgtcggcgtctcatggaactgatcagcttagttcaagaagtggaaaggaatgtagaagctgtaagaaatgcaaaagatgagcgtgttcgggaaattaggaatgcagtggagatgatgattgcacggttagacacacagctgaagaataagcttataacactgatgggtcagaagacatctctaacccaagaaacagagcttttggaatccttacttcaggaggtggagcaccagttgcggtcttgtagtaagagtgagttgatatctaagagctcagagatccttatgatgtttcagcaagttcatcggaagcccatggcatcttttgttaccactcctgttccaccagactttaccagtgaattagtgccatcttacgattcagctacttttgttttagagaatttcagcactttgcgtcagagagcagatcctgtttacagtccacctcttcaagtttcaggactttgctggaggttaaaagtttacccagatggaaatggagttgtgcgaggttactacttatctgtgtttctggagctctcagctggcttgcctgaaacttctaaatatgaatatcgtgtagagatggttcaccagtcctgtaatgatcctacaaaaaatatcattcgagaatttgcatctgactttgaagttggagaatgctggggctataatagatttttccgtttggacttactcgcaaatgaaggatacttgaatccacaaaatgatacagtgattttaaggtttcaggtacgttcaccaactttctttcaaaaatcccgggaccagcattggtacattactcagttggaagctgcacagactagttatatccaacaaataaacaaccttaaagagagacttactattgagctgtctcgaactcagaagtcaagagatttgtcaccaccagataaccatcttagcccccaaaatgatgatgctctggagacacgagctaagaagtctgcatgctctgacatgcttctcgaaggtggtcctactacagcttctgtaagagaggccaaagaggatgaagaagatgaggagaagattcagaatgaagattatcatcacgagctttcagatggagatctggatctggatcttgtttatgaggatgaagtaaatcagctcgatggcagcagttcctctgctagttccacagcaacaagtaatacagaagaaaatgatattgatgaagaaactatgtctggagaaaatgatgtggaatataacaacatggaattagaagagggagaactcatggaagatgcagctgctgcaggacccgcaggtagtagccatggttatgtgggttccagtagtagaatatcaagaagaacacatttatgctccgctgctaccagtagtttactagacattgatccattaattttaatacatttgttggaccttaaggaccggagcagtatagaaaatttgtggggcttacagcctcgcccacctgcttcacttctgcagcccacagcatcatattctcgaaaagataaagaccaaaggaagcaacaggcaatgtggcgagtgccctctgatttaaagatgctaaaaagactcaaaactcaaatggccgaagttcgatgtatgaaaactgatgtaaagaatacactttcagaaataaaaagcagcagtgctgcttctggagacatgcagacaagccttttttctgctgaccaggcagctctggctgcatgtggaactgaaaactctggcagattgcaggatttgggaatggaactcctggcaaagtcatcagttgccaattgttacatacgaaactccacaaataagaagagtaattcgcccaagccagctcgatccagtgtagcaggtagtctatcacttcgaagagcagtggaccctggagaaaatagtcgttcaaagggagactgtcagactctgtctgaaggctccccaggaagctctcagtctgggagcaggcacagttctccccgagccttgatacatggcagtatcggtgatattctgccaaaaactgaagaccggcagtgtaaagctttggattcagatgctgttgtggttgcagttttcagtggcttgcctgcggttgagaaaaggaggaaaatggtcaccttgggggctaatgctaaaggaggtcatctggaaggactgcagatgactgatttggaaaataattctgaaactggagagttacagcctgtactacctgaaggagcttcagctgcccctgaagaagatacacattccagttttcctgatggtgaacaaataggccctgaagatctcagcttcaatacagatgaaaatagtggaaggtaattgccaaatcaagagaactgacttgcaagctaccttgaccctgaattttgctgtagttggtgctcaaatttgtcatcagtcagataatcagatttggtcttatttcttcattatctcgacctgaaatagtaatttggaaactgttggaaggtggcacagtttagtctaagacagcagtagtacatgggaaaaacagtatgggaagagttctttgtaatgtaaggaaataacaatgtagttctctattaatttagcaaatttgtacattcacaaaaggcagtttgtctactacagcagaaggctggttaactgccagaaaatgtacctccaggccctgcatgccgtcagtaacccgcccggcattggtgctctactgtctttggctagagcttagttgtgtttaaataatcatctttatatttggggttttaattacagttccattagtgcctgtagattagtgaacagaaaattgctttggaagagattctgccctgtagacactatgtgaataactgaagtaacactagactgaatctcctttttggagtatgtatcttctctcacttgttcaagtacaggcacactgttcaaccgcatggtatctttctgttgtgtgacttctacaaatgtaattttaaatgaaattaagttaacatggattcattacgttcctggccctgtagacacgtgtaagattatttaaaattctttcatttttttctgcctcttactatacgactgtagtgcaacaaatattttaaagcccccttttcttctttattttcattagttgtacattgatttcagtgtcaacacatttaaagattcattcatgttgcacagtggcttacatgaacgtgaaactgtgatataaggttttctttcatactcataattagcccaaaacagttgccaaactttgccattgtgctcctgcatttgtgtttgagctgctatatatttgtggaaattacactgaaagttgactaagagactattgaaaaagcatgaataattaaatatacatgtgagagacatctcatctgctgtattttacttagtgaatattgttcactcttccgtgtctgatgtcttgctgaatgctgtgactcatagtttacttttgttcaaaatagtttgcactttttgttaataaaatcaacttgagaaaata

SEQ ID NO: 194931 - DNA, 430 bp, Homo sapiens
  Payload ID: 18497
  Gene Name: tripartite motif containing 37
  ENST ID: ENST00000583945
  CDS Start-End: 1-163
gactgatttggaaaataattctgaaactggagagttacagcctgtactacctgaaggagcttcagctgcccctgaagaagatacacattccagttttcctgatggtgaacaaataggccctgaagatctcagcttcaatacagatgaaaatagtggaagataatttgatttgaaactgacactgcacctgatgggttaacaagatctaggcttcagaaggtgacagatatgagtgaggaccatgtgtggggcaaagcctcagaatgatgaaaaggttccggcactatagttggggccatgttgactccttttcaaccatttgtcacagacgtgagaagaagaaatgacttcaaaatcaagagaaaacaaatactgaaagtctctacttacatccaaattttaaaaaataaaatctgtagattaacaatct

SEQ ID NO: 194932 - DNA, 584 bp, Homo sapiens
  Payload ID: 18497
  Gene Name: tripartite motif containing 37
  ENST ID: ENST00000581468
  CDS Start-End: 1-584
gtgaatgaagaggtagccaaacttcgtcggcgtctcatggaactgatcagcttagttcaagaagtggaaaggaatgtagaagctgtaagaaatgcaaaagatgagcgtgttcgggaaattaggaatgcagtggagatgatgattgcacggttagacacacagctgaagaataagcttataacactgatgggtcagaagacatctctaacccaagaaacagagcttttggaatccttacttcaggaggtggagcaccagggagcaagttgcttttggaagaaatggtgtcaaggaaggatatacacattgcggtcttgtagtaagagtgagttgatatctaagagctcagagatccttatgatgtttcagcaagttcatcggaagcccatggcatcttttgttaccactcctgttccaccagactttaccagtgaattagtgccatcttacgattcagctacttttgttttagagaatttcagcactttgcgtcagagagcagatcctgtttacagtccacctcttcaagtttcaggactttgctggaggttaaaagtttacccagatggaaatggagttgtgcg

SEQ ID NO: 194933 - DNA, 353 bp, Homo sapiens
  Payload ID: 18497
  Gene Name: tripartite motif containing 37
  ENST ID: ENST00000584889
  CDS Start-End: 8-319
ggaggcaatggatgaacagagcgtggagagcattgctgaggttttccgatgtttcatttgtatggagaaattgcgggatgcacgcctgtgtcctcattgctccaaactgtgttgtttcagctgtattaggcgctggctgacagagcagagagctcaatgtcctcattgccgtgctccactccagctacgagaactagtaaattgtcgttgggcagaagaagtaacacaacagcttgatactcttcaactctgcagtctcaccaaacatgaagaaaatgaaaaggacaagtatgtcctcaatttctttgttcaatattgaatggattttgcctttgtattgtttaatgacacta

SEQ ID NO: 194934 - DNA, 573 bp, Homo sapiens
  Payload ID: 18497
  Gene Name: tripartite motif containing 37
  ENST ID: ENST00000580973
  CDS Start-End: 255-431
gagaaaggagctgcggccaccgttcgccctacttctgcgcctcggggcgggcgcgccggtaaaaatggcgaaatgggggtaggcggcgctggacctgaagagatggggcgcgcaggtggggcggttgtcagagccccctgacgtgggcgccgggcttttatcggcgatttgatctggcgacctcgggccggcgcctaagaggtcagactgcggagcctgcgggtcgccagcggccccgccgagagccggaggcaatggatgaacagagcgtggagagcattgctgaggttttccgatgtttcatttgtatggagaaattgcgggatgcacgcctgtgtcctcattgctccaaactgtgttgtttcagctgtattaggcgctggctgacagagcagagagctcaatgtcctcattgccggaaaggaatgtagaagctgtaagaaatgcaaaagatgagcgtgttcgggaaattaggaatgcagtggagatgatgattgcacggttagacacacagctgaagaataagcttataacactgatgggtcagaagacatctctaacccaagaaacaga

SEQ ID NO: 194935 - DNA, 634 bp, Homo sapiens
  Payload ID: 18497
  Gene Name: tripartite motif containing 37
  ENST ID: ENST00000585287
  CDS Start-End: 1-354
accttgggggctaatgctaaaggaggtcatctggaaggactgcagatgactgatttggaaaataattctgaaactggagagttacagcctgtactacctgaaggagcttcagctgcccctgaagaagaaacatgttctccttccttcctgccaggaatgagtagcgacagtgacattgaatgtgacactgagaatgaggagcaggaagagcataccagtgtgggcgggtttcacgactccttcatggtcatgacacagcccccggatgaagatacacattccagttttcctgatggtgaacaaataggccctgaagatctcagcttcaatacagatgaaaatagtggaagataatttgatttgaaactgacactgcacctgatgggttaacaagatctaggcttcagaaggtgacagatatgagtgaggaccatgtgtggggcaaagcctcagaatgatgaaaaggttccggcactatagttggggccatgttgactccttttcaaccatttgtcacagacgtgagaagaagaaatgacttcaaaatcaagagaaaacaaatactgaaagtctctacttacatccaaattttaaaaaataaaatctgtagattaacaatctgatcattgctaaa

SEQ ID NO: 194936 - DNA, 482 bp, Homo sapiens
  Payload ID: 18497
  Gene Name: tripartite motif containing 37
  ENST ID: ENST00000580122
  CDS Start-End: 1-340
ggatgaacagagcgtggagagcattgctgaggttttccgatgtttcatttgtatggagaaattgcgggatgcacgcctgtgtcctcattgctccaaactgtgttgtttcagctgtattaggcgctggctgacagagcagagagctcaatgtcctcattgccgtgctccactccagctacgagaactagtaaattgtcgttgggcagaagaagtaacacaacagcttgatactcttcaactctgcagtctcaccaaacatgaagaaaatgaaaaggacaacatggcggacatacctttaaacctttggcagaaatttatgagcaacacgtcactaaagtgaatgaagaggtagccaaacttcgtcggcgtctcatggaactgatcagcttagttcaagaagtggaaaggaatgtagaagctgtaagaaatgcaaaagatgagcgtgttcgggaaattaggaatgcagtggagatgatgattgc

SEQ ID NO: 194937 - DNA, 204 bp, Homo sapiens
  Payload ID: 18497
  Gene Name: tripartite motif containing 37
  ENST ID: ENST00000625984
  CDS Start-End: 1-204
atggatgaacagagcgtggagagcattgctgaggttttccgatgtttcatttgtatggagaaattgcgggatgcacgcctgtgtcctcattgctccaaactgtgttgtttcagctgtattaggcgctggctgacagagcagagagctcaatgtcctcattgccgagtctcgctctgtcgtccaggccggagtgcaatggcgtga

SEQ ID NO: 194938 - DNA, 9413 bp, Homo sapiens
  Payload ID: 18498
  Gene Name: tripartite motif containing 38
  Uniprot ID: O00635
  ENST ID: ENST00000357085
  CDS Start-End: 477-1874
gttaacttcctgacccaggaagtggcagcaacagaggggactagcagcgaatatactttacaccaaatctcagaagattcagaacttagatgagtggggcccaggacaggaaccctggagccttggaaggaggggagccccatctccccagaagagcagtgaccccagcagagaggggcctggtgtatcactggaggaaatagcctgccaaggaatacacgtcttcagaagaaattctgtgtggcttcaagagactgatcaaattgtgagaggaaaacagcctacccggtcctcttttcttcaatacaaaatgagataataggggttggaaggaaaaccttcaagacctatggaagtcagttgcagccagctcatcacatagaggtgcaggtgaggtgtattttcatcacggtggaaaattctggctgcttcatctccatctctagagccaatattggagcttttcaataaaagctatggcctcaaccaccagcaccaagaagatgatggaggaagccacctgctccatctgcctgagcctgatgacgaacccagtaagcatcaactgtggacacagctactgccacttgtgtataacagacttctttaaaaacccaagccaaaagcaactgaggcaggagacattctgctgtccccagtgtcgggctccatttcatatggatagcctccgacccaacaagcagctgggaagcctcattgaagccctcaaagagacggatcaagaaatgtcatgtgaggaacacggagagcagttccacctgttctgcgaagacgaggggcagctcatctgctggcgctgtgagcgggcaccacagcacaaagggcacaccacagctcttgttgaagacgtatgccagggctacaaggaaaagctccagaaagctgtgacaaaactgaagcaacttgaagacagatgtacggagcagaagctgtccacagcaatgcgaataactaaatggaaagagaaggtacagattcagagacaaaaaatccggtctgactttaagaatctccagtgtttcctacatgaggaagagaagtcttatctctggaggctggagaaagaagaacaacagactctgagtagactgagggactatgaggctggtctggggctgaagagcaatgaactcaagagccacatcctggaactggaggaaaaatgtcagggctcagcccagaaattgctgcagaatgtgaatgacactttgagcaggagttgggctgtgaagctggaaacatcagaggctgtctccttggaacttcatactatgtgcaatgtttccaagctttacttcgatgtgaagaaaatgttaaggagtcatcaagttagtgtgactctggatccagatacagctcatcacgaactaattctctctgaggatcggagacaagtgactcgtggatacacccaggagaatcaggacacatcttccaggagatttactgccttcccctgtgtcttgggttgtgaaggcttcacctcaggaagacgttactttgaagtggatgttggcgaaggaaccggatgggatttaggagtttgtatggaaaatgtgcagaggggcactggcatgaagcaagagcctcagtctggattctggaccctcaggctgtgcaaaaagaaaggctatgtagcacttacttctcccccaacttcccttcatctgcatgagcagcccctgcttgtgggaatttttctggactatgaggccggagttgtatccttttataacgggaatactggctgccacatctttactttcccgaaggcttccttctctgatactctccggccctatttccaggtttatcaatattctcctttgtttctgcctcccccaggtgactaaggaaaagagcagaagctccttggtttaaccagcacagagaaaataatataaatcccataagggcagacgtttggtctgttttcttcgctgtcatttccttagtagttagactagtgctgagattttagtggatatataattgatttatgttgaatatatggacttagcaactaaaaataccacagatggttaacctggactggggcaaagcaagataatagtgatgatcgtatgttgctgtctccatccgtctttaatgggtcagggctttgatttccaagggtcttcaggtgatgagtaggggtacccacaagtcagaaggtctgcgttctcctagtttgtttgctgccatttgaactcatgtagggaatgaaagaaagctgcaattatccgccaactgcatttaaaacaaaacaaaacagaaaaatcaaaataacattgactcttccaaccactgacatgttgtttaataatctaagcggcagtcctggaggctaccagacttactgagttctacctgagaaacagccaagcaaagtgtgagagaagggttaagactggcttacaatgagatgcttcaaatgaaaagggaattatgagtaaaattgaactttgatgggggattcagttctggaaaagaatttggtattttccagtctgctaggaccaattaccttgaaatattttaaaatctcagtaaatagttattgctgaaatggctgttggcagttcttattatgattcagagaagagcaaatagaccttaacttcattttgaaaaagaccaaattaccatacccgagtgagtaatgacaggactacaactaaaacataaacaacattaatgatgaccataaaaagtcacaaaattgctaaatgttataatttagagttgacataaaaattgatggccaggcatggtggctcacgcctgtaatcccagaactatgtgaggctgaggcaggtggatcacttgaggtcaggagttcaacaccagcctggccaacatggtgaaaccctgtctctactaaaaatacaaaaattagccgggcatggtggtaggggcctgtaacccagctactcgtgaggccaaggcaggagaattgcttgagcctgcagcagctgcagtaagccaagatcatgctgtgcctcaaggaaaaaaaaaattaatgtttactgatatttgttgaagtcctacaacatcacctctgagaataggagaaatgaagcaacagttgtgtctagatgtcagaggcatggctgggcctccatctctgcctaagggagatataaaagagttcaaactattgcccatgttccccagggtcagaagttctaattatgatgatagaggctgggttgtaagtagtaagtgaagggtagcagaatatgccatctttggcataagaagtattttgagttgaagacaattgagaaaaaaaatagattaaaaacaaacaaacacctctgccctctccctatttgcctaaaagcaggatatgaaattgtgaaggtgtcttcttactcggggaagaacaaaagttagtcaccagagactttagactcttatcagcctggacatagcaccagagaagtctttttttttaaaaaaaaaaaaaaaaaaagggaaagaaaaagttgccttcccacaatttactgcactagaaactcaaagtccttttcgtcttccttgtcacttaaaaaatgtattcttttcttaaaatgctatataagcccaagttctaaatcctcttttgagtattcatctcagtactcccctgtgtttgtacaatgcacatgctttgtttctgtcttgtcaatctgtcttttgttagtctacttgatagggccacagatggagaacctaagatgaatagaaaaaaaagatttttctccccaacagaaggattatcgccagttgcacttgttctatatacccgtagtctcggtatgctgacccagacttgggtaataggacccagtgggtaaccgaggaaccccacctttgtgcaggatcagtgaagatgtaatctggatattcataagctcttctctacctcttggcatcccacagtcctgtgttaatgtaagtgtggtcttccccagaaaggggaggcctccctaacattgttaaagcctagcatatgctgcttagaggaaattctatatccctaagcacttagattgctgaataagaaagaatgataataaaataaacaattaaataaaagttttaaaaaatgaataaaataaacctgtggaaactataaggaaggccagaagaaatataaaattggagattaattggggtgcaggaaagttatggaaagaatataagtcctgctagataaatcattagctattttaataaagaatacagaagaaaataggaacaaaagaatatatactggaataattttgagagtaatttgaagaattagatgcaaataaatttgaaaacctttaaaaagaaaccaatggcctaactgacccaagaagggaaagaaaatctaaacagactgataaatacaaaatgaaattcagacacttacagagcagccaggcatggtggctcacacctgtaatcctgtcactttgggaggctgagatgggaggatcacttgaggctaggagtttgagactagcctgggcaaggctcccatctctaaaagaaaagaaattagctgggcatggtggcatgtgccttagtttcagctactcaggaggctgagacgaggattgcttgagcctaggagggcaaggctgcagtgagccatggtcatgccactgaattccagcctaagtgacagagcaagaccttgtctcaaaaaaaaaaaaaaaaaaagttacagagctccaactaaataatgtggggaacaaaagaaaaaagaagatgattttatggctgattttttttttaaggaaaagcaattcatgtacccttgaagattagattaagttctataaaatagcccaaaatgacagtggctgaaacaagtttatttctctcccatttaaagcaagtctagatgtggaagtctgggaagcccagaaaatccaggtcttgtttgtgtatggaaactccagaaaatcacagattccttccagccacccctcaattacccctgggatccaagagagccactaaagttccagccatcatactcacaacccaagttgtaggatggaaaaaaggacacaaaagtagggtgaagagcatgtgtgcaacagctctcttttactctagtgtcctaaaacctatcataaaacctttggcttgccttgcattagccagaatttagtacatggccacacttaagaagtcagaaagattagctttttttccagggtagttggctgaaaatcaggagttctcatattaaaaaacagagaagggacatcgaatagatgaccaacaatctccttcacactcatactatttaaactgtcctagtcaatgaccaaaaaagaaaagcctacaaactcattgatataaaagcttaacaaaggtactccccgccccccgcccgccacacaccatccccaaaaggaaatttctaatccaattaacagtcttaggttgggctgctgaaacaaaataccacagcctgagtgacttaaacaacgacaatttatctctcactgttctgaggtctgagttgattctttgtgaaggccctttcctagcttgcagatggctaccttcctgctatgtcttcacatggcaaagagagagctagctttctggtcttttcttataagggaccagtcccatcatgcccatcatgaagactcgatctgctaggatctcaactaaacctaactatcacccaaagagcccacctccaaagaccatcacattgaatgtgagagtttctacatatgcattgtgggaaacacaaacatttacttcaactgtaactattgaagcaaaaatgtccccccaccatagacatccagcaccacagtagtacatttattacaattgaacttacattgacacgtcattatcaacgaaagtctgtaatttacattagggtttattcttggtgttgtgctttctatgggttttgacaaatgtataatgtcatgtattcaccattatagtatcacagaagtttcactgccctaaaaatcctgtgttctgccttttcaacacttcctgtcacccaatttctatcaactaatcttttgactgtgtccatagttactgtcttttctagagtgtcatacagttgtgaagcaggaagcaggagtgaactccggaggcagggactttactccggaccagattgaagactagccgaaacagggacgaggttaaagcacctctccataagacacgcccaccagcgccatgtcagtttttcgttgccatggcaacaacaggacattatcgacttctttcctctgtacctactccgaagttaccactctttttctagaaatttctgcataatcccccttaacatgcacttaactaaaagcaggtatattactgcagaactgcccctgagctgctactctgggcacattacttatgggttagccctgctcagcaaggagcagtacctgttctgctgttgtacactgctgcttcagtaaaagttgctaacaccaccacttcacccttgaattcttcccgggctaagccctaatttttggcttgcttgccctgcatcagttggagtcatatagtatgcagtcttttcaggttggctttttagtaacatacatttaagtttccttcatgtgttttcatggcttgatcgtttcttttctttttctttttcttttttcttttctttctttttttttttttttttgagacagaggagtcttgctctgttgcccaggctgaagtgcagtggcactggctcactgcaacctccatctcccaggttcaaacgattctcatatctcagcctcccgagtagctgggattacaggctcacgccactatgcccggctaattggggttttcccatgttgaccaggctggtctcaaactcctggcctcaagcaatccacccacttcggcctcccaaagtgaatgcatttctttttaactctaaataacattccattattcagaagtaccacagttatccacttacctactgaaagacatcttgtttccaagttttggataaattatgaataaagctgctataaacatctatgtgcaggtttttgtgtggagataagttttcaattcctttggataaatactaaggagtgtgattggtgaatcttatggtaaaagtatggttacttttgtaagaaaccaccaaactgtcttccaaagtgattgcacattttgcattctcaccagtaatgaacaagttactattgctacatatctttgcaacctttggtgctgacagtgttctaaattttggtcattctactaggtatgcagtggtatctacttgttttaatttgcagttccctaatgacatgatgtcaagcatcttttcatatgcatacttgcatctgtgtatcttctttggtgaacagatgttcaggtcattggcctgctttaaatcaggttattttcttactgttgagttttaagtattctttgtatattctaaaaatattgttcttcatcagatctgtcttttgcaaacattacctgccaatgtgtggcttttcttcaacacttctttgtaaatttgcaagtcctttgagaaaagaaatgcacccaaagtattaatttggcaatctcatatcacgagagtactctaaagctaaataaattacagtttttcaaattttgaattaattgatctttgctattgttagcaaggtcttgtattcttttttttttttttttttttttttaatagagacgggtcttgctacagtgcccaggctggtctcgaactccaggcctaaaatgatcctcctgccttggccttccaaagtactgggattacaggcataagtcaccacgctcagccatctggtattctttagcaactgtttggtaacttaatctttcactttttgaaaacaaaaaatagtttttttctcatagttttctaacaaaatcttcataactgaaataatttctctttatcacctcttcttataaatatggttttctttttttaaataaaaatttaagacattttataactggccaaatttactagcttagatactattagatagtcaatattttttgttggatatttgatttttatttcaggcaactaatatctattcatttttgcactgttggaagaaaattactgatcaaattcactatgtatttgcagaaaatggctttcaatattgtctactttatcatcctttttttttttttctttcttcctttttagatacagggtctcactatgttgcccaggctggtctccaacttctgggctcaaacaatcctccctccttggccttccaaagggttggatatgttttatctacagttttgttgttttgttctgctacaggatatttgcaattgccatttatcatgaaattcatgacataccttcttccactctcctttttatctttattgttctggttataggactagctttgcatctctactcaattctgtatcagtagtatgctttcattttaaattttaagtttgtccatatgtatattgacacagggtcttgctctgttgcccagactggagtgcagtggcaagatcagggctcactgcagccttgactgcctaggctcaagtcatcctcccacctcagcctccagaatggctgggactacaggcacgcaccaccacacatggctcatttttttgtattgagacagggtttctccatgttgcccaggctggtcttgaactactgggctcaagcaatcctcccaccttagcctcccaaagtgttgggattacaggcttgagccaccatgcctcgcttctacacttatttttaattctaaaataatttataataataaatattaacaattagatttaattactgataaatattaaatgttaaataggttttattaaataattaaataaaaatgaaaataatcagtatttcaatttaattactaattataattcacagttatccttgtaactcctaatgtctatataaaagatttttatattttttaattcttaaaattttattatttatttcacaccaggccatcactgtgatacattttttaaaacacattaaattatcaccagaaaagtgctgtgatggaaaatataaattgaaataccttttctggttaggagagtaattctgtttttctgatagagaatagaagagtccttcaggcccctccaaactgtcatattccgggcatcgggtgtccccatcctcacttcagtccacaggcagggtcctcagtcttcagcgctccttctctttcccctttgtcttgtgtctccttgggtctcttttctccaagacctaaactccctgaggacaggactattttttacatcttgatgtcactcctgagcacttgctttaatgtgttggacactgggtccattaaagattgtatgtgaaatta

SEQ ID NO: 194939 - DNA, 3338 bp, Homo sapiens
  Payload ID: 18499
  Gene Name: tripartite motif containing 39
  Uniprot ID: Q9HCM9
  ENST ID: ENST00000376656
  CDS Start-End: 313-1869
cccagcttccactgacacgagcctcggcgcggcttccgcttccggcgagtattgtgtgtcgcgccgcggggcgggggcgaggggaggaggaaggagggaggcagcgctccggcggctccgcgccccgcactcccggacccgaagccgggaagattcctttcttgtctgttagaaacgtatgtcaaacgaggatacagtgtctggaactattggttctaagatataagtggaatgagcctggatcaggagaagtatgctgagctagagttgaaggaagcttctctttctaacaagagaaagcagagttaaattatggcagagacaagtctgttagaggctggggcctctgcagcctctacagctgcggctttggagaacttacaggtggaggcgagctgctctgtgtgcctggagtatctgaaggaacctgtcatcattgagtgtgggcacaacttctgcaaagcttgcatcacccgctggtgggaggacctagagagggacttcccttgtcctgtctgtcgaaagacatcccgctaccgcagtctccgacctaatcggcaactaggcagtatggtggaaattgccaagcagctccaggccgtcaagcggaagatccgggatgagagcctctgcccccaacaccatgaggccctcagccttttctgttatgaggaccaggaggctgtatgcttgatatgtgcaatttcccacacccaccgggcccacaccgttgtgccactggacgatgctacacaggagtacaaggaaaaactgcagaagtgtctggagcccctggaacagaagctgcaggagatcactcgctgcaagtcctctgaggagaagaagcctggtgagctcaagagactagtggaaagtcgccgacagcagatcttgagggagtttgaagagcttcataggcggctggatgaagagcagcaggtgttgctttcacgactggaagaagaggaacaggacattctgcagcgactccgagaaaatgctgctcaccttggggacaagcgccgggacctggcccacttggctgccgaggtggagggcaagtgcttacagtcaggcttcgagatgcttaaggatgtcaaaagtaccctggaaaagaatattcctagaaagttcggaggctcactctcaacgatctgtccacgggatcataaggctctccttggattagtaaaagaaatcaacagatgtgaaaaggtgaagaccatggaggtgacttcagtatccatagagctggaaaagaacttcagcaattttccccgacagtactttgccctaaggaaaatccttaaacagctaattgcggatgtgaccctggaccctgagacagctcatcctaacctagtcctgtcagaggatcgtaagagcgtcaagttcgtggagacaagactccgggatctccctgacacaccaaggcgtttcaccttctacccttgcgtcctggctactgagggtttcacctcaggtcgacactactgggaggtggaggtgggcgacaagacccactgggcagtgggtgtatgccgggactccgtgagccgaaagggcgagttgactccactccctgagactggctactggcgggtgcggctatggaatggggacaaatatgcagccaccaccacaccttttacccctttgcacatcaaggtgaaacccaagcgggtaggcatattcctagactatgaggccggcacactgtctttctacaatgtcacagaccgctctcatatctacaccttcactgatacttttactgagaaactttggcccctcttctacccaggcatccgggctggacggaagaatgctgcaccacttaccatcaggcccccaacagattgggagtgacaggttgggatgtgggaatgactggggtgaggcagggtcaagtgctacgggcctccttcccgtgtcctgctggaacgtcttcgtgtccacctgggtccagtcctgaatcatcttggagaaacaccttggtttctaggatggttttgtgtggagggggaggtaggactgggctggatgagagagcacagctgtgacttcctcctaactgtcagggtggggagctggttcccagaggattgtctaccctgaagtccatcaggttttctgttgcacaaggacgggtcaggaaggaaggagaggcttttccagaaacaaaaaatctgtgagggtctgacttgctcaaaccagaggaggaaacagaaacccctgcacatctttttagggggttctttgacccaggatagtcttgcttcttgaggtagatcacaggggtctgtgtacctctgaattcatgagagatgaatgacagatgctctcatgggtctagatattgaggagtttttctgagggcagagattggacatcaacaaggctagaagggtcagggaagtgggctaaaggaacagattcctagagattaatgaagaggagggaggtttctttggtcttctattccaagggtaaggttgcgattatgggtaagattggccagaggtaggaatgtggggagaaggagaggctgaaaagaaagcagaggagaacccaggtccctgcctcagccttcagcagagttggcttattgcctgcctctataccaataagtcagtcaccttgctcctctccagaggcaaagtggaagagatcctgcaagacacatctatcctttcacagtgttcccaagggaacttggaaaggagagtcaggtattagaggaaagagaagggtatttgtatacaaagccctggccttaaagaatgttacttagtagctactcccaaattgtcagccttcttacctggccaaggtgtccaagccagaaaggaaaaaaggttatggagtctttctcaccctaaggacagggtggaagagggtggtatatagggaagggccagataggcaacttcatttggcttgtgtgcatctggcctggaactggtgttaagccaggcttttgcttgtttgttgccatccctcaccctttgccatttcccttttcagagaatgtaaatgattttcatgttaggccaaaataaacaacttatagggtacatatgttgtcataaaaggtaaaagtgatgcatgccaaaccaaactaaaccaatttggattatctgctattcgggtaatcttcacagaaatgactgagagaagaatctgcagtttactgagggcatttcagttcctcctaccacctcaacaggactttgtccagactctcctcctcttacctttgtgccttgactgtggttctttgtggcaagatactttggttggttaaaataatatggaacaaaggatccactgaagtg

SEQ ID NO: 194940 - DNA, 3535 bp, Homo sapiens
  Payload ID: 18499
  Gene Name: tripartite motif containing 39
  Uniprot ID: Q9HCM9
  ENST ID: ENST00000376659
  CDS Start-End: 599-2065
cggcagcgtcatagcggcgggcatcccatctgcacgtcacacctctttctcacctggacacgcatcccttcctaccctgccagccacgacgtttcctctttcccctctccaatgccccagccccagatctggcggaagaagatggagaacgggggtgggacagagttgtggacaacctctcaggagagggtcgcaaggtgggaccctgaacagtggtagaaacaaaatgagattgtccctgaagtttgcccttcagctgagacacaaggagtagaggaagaggaaggactaacgcagaggcactcaaggtctcactatgactgtagttgagagtcctctcccttcttccctaaccctttccccatttctctcaccacttctttgccagtctagatccgtcctggtgccttactgtgcatacagttctactcgtctcagattcctttcttgtctgttagaaacgtatgtcaaacgaggatacagtgtctggaactattggttctaagatataagtggaatgagcctggatcaggagaagtatgctgagctagagttgaaggaagcttctctttctaacaagagaaagcagagttaaattatggcagagacaagtctgttagaggctggggcctctgcagcctctacagctgcggctttggagaacttacaggtggaggcgagctgctctgtgtgcctggagtatctgaaggaacctgtcatcattgagtgtgggcacaacttctgcaaagcttgcatcacccgctggtgggaggacctagagagggacttcccttgtcctgtctgtcgaaagacatcccgctaccgcagtctccgacctaatcggcaactaggcagtatggtggaaattgccaagcagctccaggccgtcaagcggaagatccgggatgagagcctctgcccccaacaccatgaggccctcagccttttctgttatgaggaccaggaggctgtatgcttgatatgtgcaatttcccacacccaccgggcccacaccgttgtgccactggacgatgctacacaggagtacaaggaaaaactgcagaagtgtctggagcccctggaacagaagctgcaggagatcactcgctgcaagtcctctgaggagaagaagcctggtgagctcaagagactagtggaaagtcgccgacagcagatcttgagggagtttgaagagcttcataggcggctggatgaagagcagcaggtgttgctttcacgactggaagaagaggaacaggacattctgcagcgactccgagaaaatgctgctcaccttggggacaagcgccgggacctggcccacttggctgccgaggtggagggcaagtgcttacagtcaggcttcgagatgcttaaggatgtcaaaagtaccctggaaaaatgtgaaaaggtgaagaccatggaggtgacttcagtatccatagagctggaaaagaacttcagcaattttccccgacagtactttgccctaaggaaaatccttaaacagctaattgcggatgtgaccctggaccctgagacagctcatcctaacctagtcctgtcagaggatcgtaagagcgtcaagttcgtggagacaagactccgggatctccctgacacaccaaggcgtttcaccttctacccttgcgtcctggctactgagggtttcacctcaggtcgacactactgggaggtggaggtgggcgacaagacccactgggcagtgggtgtatgccgggactccgtgagccgaaagggcgagttgactccactccctgagactggctactggcgggtgcggctatggaatggggacaaatatgcagccaccaccacaccttttacccctttgcacatcaaggtgaaacccaagcgggtaggcatattcctagactatgaggccggcacactgtctttctacaatgtcacagaccgctctcatatctacaccttcactgatacttttactgagaaactttggcccctcttctacccaggcatccgggctggacggaagaatgctgcaccacttaccatcaggcccccaacagattgggagtgacaggttgggatgtgggaatgactggggtgaggcagggtcaagtgctacgggcctccttcccgtgtcctgctggaacgtcttcgtgtccacctgggtccagtcctgaatcatcttggagaaacaccttggtttctaggatggttttgtgtggagggggaggtaggactgggctggatgagagagcacagctgtgacttcctcctaactgtcagggtggggagctggttcccagaggattgtctaccctgaagtccatcaggttttctgttgcacaaggacgggtcaggaaggaaggagaggcttttccagaaacaaaaaatctgtgagggtctgacttgctcaaaccagaggaggaaacagaaacccctgcacatctttttagggggttctttgacccaggatagtcttgcttcttgaggtagatcacaggggtctgtgtacctctgaattcatgagagatgaatgacagatgctctcatgggtctagatattgaggagtttttctgagggcagagattggacatcaacaaggctagaagggtcagggaagtgggctaaaggaacagattcctagagattaatgaagaggagggaggtttctttggtcttctattccaagggtaaggttgcgattatgggtaagattggccagaggtaggaatgtggggagaaggagaggctgaaaagaaagcagaggagaacccaggtccctgcctcagccttcagcagagttggcttattgcctgcctctataccaataagtcagtcaccttgctcctctccagaggcaaagtggaagagatcctgcaagacacatctatcctttcacagtgttcccaagggaacttggaaaggagagtcaggtattagaggaaagagaagggtatttgtatacaaagccctggccttaaagaatgttacttagtagctactcccaaattgtcagccttcttacctggccaaggtgtccaagccagaaaggaaaaaaggttatggagtctttctcaccctaaggacagggtggaagagggtggtatatagggaagggccagataggcaacttcatttggcttgtgtgcatctggcctggaactggtgttaagccaggcttttgcttgtttgttgccatccctcaccctttgccatttcccttttcagagaatgtaaatgattttcatgttaggccaaaataaacaacttatagggtacatatgttgtcataaaaggtaaaagtgatgcatgccaaaccaaactaaaccaatttggattatctgctattcgggtaatcttcacagaaatgactgagagaagaatctgcagtttactgagggcatttcagttcctcctaccacctcaacaggactttgtccagactctcctcctcttacctttgtgccttgactgtggttctttgtggcaagatactttggttggttaaaataatatggaacaaaggatccactgaagtga

SEQ ID NO: 194941 - DNA, 3198 bp, Homo sapiens
  Payload ID: 18499
  Gene Name: tripartite motif containing 39
  Uniprot ID: Q9HCM9
  ENST ID: ENST00000383601
  CDS Start-End: 262-1728
gcgaggggaggaggaaggagggaggcagcgctccggcggctccgcgccccgcactcccggacccgaagccgggaagatccgtcctggtgccttactgtgcatacagttctactcgtctcagaaacgtatgtcaaacgaggatacagtgtctggaactattggttctaagatataagtggaatgagcctggatcaggagaagtatgctgagctagagttgaaggaagcttctctttctaacaagagaaagcagagttaaattatggcagagacaagtctgttagaggctggggcctctgcagcctctacagctgcggctttggagaacttacaggtggaggcgagctgctctgtgtgcctggagtatctgaaggaacctgtcatcattgagtgtgggcacaacttctgcaaagcttgcatcacccgctggtgggaggacctagagagggacttcccttgtcctgtctgtcgaaagacatcccgctaccgcagtctccgacctaatcggcaactaggcagtatggtggaaattgccaagcagctccaggccgtcaagcggaagatccgggatgagagcctctgcccccaacaccatgaggccctcagccttttctgttatgaggaccaggaggctgtatgcttgatatgtgcaatttcccacacccaccgggctcacaccgttgtgccactggacgatgctacacaggagtacaaggaaaaactgcagaagtgtctggagcccctggaacagaagctgcaggagatcactcgctgcaagtcctctgaggagaagaagcctggtgagctcaagagactagtggaaagtcgccgacagcagatcttgagggagtttgaagagcttcataggcggctggatgaagagcagcaggtgttgctttcacgactggaagaagaggaacaggacattctgcagcgactccgagaaaatgctgctcaccttggggacaagcgccgggacctggcccacttggctgccgaggtggagggcaagtgcttacagtcaggcttcgagatgcttaaggatgtcaaaagtaccctggaaaaatgtgaaaaggtgaagaccatggaggtgacttcagtatccatagagctggaaaagaacttcagcaattttccccgacagtactttgccctaaggaaaatccttaaacagctaattgcggatgtgaccctggaccctgagacagctcatcctaacctagtcctgtcagaggatcgtaagagcgtcaagttcgtggagacaagactccgggatctccctgacacaccaaggcgtttcaccttctacccttgcgtcctggctactgagggtttcacctcaggtcgacactactgggaggtggaggtgggcgacaagacccactgggcagtgggtgtatgccgggactccgtgagccgaaagggcgagttgactccactccctgagactggctactggcgggtgcggctatggaatggggacaaatatgcagccaccaccacaccttttacccctttgcacatcaaggtgaaacccaagcgggtaggcatattcctagactatgaggccggcacactgtctttctacaatgtcacagaccgctctcatatctacaccttcactgatacttttactgagaaactttggcccctcttctacccaggcatccgggctggacggaagaatgctgcaccacttaccatcaggcccccaacagattgggagtgacaggttgggatgtgggaatgactggggtgaggcagggtcaagtgctacgggcctccttcccgtgtcctgctggaacgtcttcgtgtccacctgggtccagtcctgaatcatcttggagaaacaccttggtttctaggatggttttgtgtggagggggaggtaggactgggctggatgagagagcacagctgtgacttcctcctaactgtcagggtggggagctggttcccagaggattgtctaccctgaagtccatcaggttttctgttgcacaaggacgggtcaggaaggaaggagaggcttttccagaaacaaaaaatctgtgagggtctgacttgctcaaaccagaggaggaaacagaaacccctgcacatctttttagggggttctttgacccaggatagtcttgcttcttgaggtagatcacaggggtctgtgtacctctgaattcatgagagatgaatgacagatgctctcatgggtctagatattgaggagtttttctgagggcagagattggacatcaacaaggctagaagggtcagggaagtgggctaaaggaacagattcctagagattaatgaagaggagggaggtttctttggtcttctattccaagggtaaggttgcgattatgggtaagattggccagaggtaggaatgtggggagaaggagaggctgaaaagaaagcagaggagaacccaggtccctgcctcagccttcagcagagttggcttattgcctgcctctataccaataagtcagtcaccttgctcctctccagaggcaaagtggaagagatcctgcaagacacatctatcctttcacagtgttcccaagggaacttggaaaggagagtcaggtattagaggaaagagaagggtatttgtatacaaagccctggccttaaagaatgttacttagtagctactcccaaattgtcagccttcttacctggccaaggtgtccaagccagaaaggaaaaaaggttatggagtctttctcaccctaaggacagggtggaagagggtggtatatagggaagggccagataggcaacttcatttggcttgtgtgcatctggcctggaactggtgttaagccaggcttttgcttgtttgttgccatccctcaccctttgccatttcccttttcagagaatgtaaatgattttcatgttaggccaaaataaacaacttatagggtacatatgttgtcataaaaggtaaaagtgatgcatgccaaaccaaactaaaccaatttggattatctgctattcgggtaatcttcacagaaatgactgagagaagaatctgcagtttactgagggcatttcagttcctcctaccacctcaacaggactttgtccagactctcctcctcttacctttgtgccttgactgtggttctttgtggcaagatactttggttggttaaaataatatggaacaaaggatccactgaagtga

SEQ ID NO: 194942 - DNA, 3187 bp, Homo sapiens
  Payload ID: 18499
  Gene Name: tripartite motif containing 39
  Uniprot ID: Q9HCM9
  ENST ID: ENST00000383602
  CDS Start-End: 161-1717
attcctttcttgtctgttagaaacgtatgtcaaacgaggatacagtgtctggaactattggttctaagatataagtggaatgagcctggatcaggagaagtatgctgagctagagttgaaggaagcttctctttctaacaagagaaagcagagttaaattatggcagagacaagtctgttagaggctggggcctctgcagcctctacagctgcggctttggagaacttacaggtggaggcgagctgctctgtgtgcctggagtatctgaaggaacctgtcatcattgagtgtgggcacaacttctgcaaagcttgcatcacccgctggtgggaggacctagagagggacttcccttgtcctgtctgtcgaaagacatcccgctaccgcagtctccgacctaatcggcaactaggcagtatggtggaaattgccaagcagctccaggccgtcaagcggaagatccgggatgagagcctctgcccccaacaccatgaggccctcagccttttctgttatgaggaccaggaggctgtatgcttgatatgtgcaatttcccacacccaccgggctcacaccgttgtgccactggacgatgctacacaggagtacaaggaaaaactgcagaagtgtctggagcccctggaacagaagctgcaggagatcactcgctgcaagtcctctgaggagaagaagcctggtgagctcaagagactagtggaaagtcgccgacagcagatcttgagggagtttgaagagcttcataggcggctggatgaagagcagcaggtgttgctttcacgactggaagaagaggaacaggacattctgcagcgactccgagaaaatgctgctcaccttggggacaagcgccgggacctggcccacttggctgccgaggtggagggcaagtgcttacagtcaggcttcgagatgcttaaggatgtcaaaagtaccctggaaaagaatattcctagaaagttcggaggctcactctcaacgatctgtccacgggatcataaggctctccttggattagtaaaagaaatcaacagatgtgaaaaggtgaagaccatggaggtgacttcagtatccatagagctggaaaagaacttcagcaattttccccgacagtactttgccctaaggaaaatccttaaacagctaattgcggatgtgaccctggaccctgagacagctcatcctaacctagtcctgtcagaggatcgtaagagcgtcaagttcgtggagacaagactccgggatctccctgacacaccaaggcgtttcaccttctacccttgcgtcctggctactgagggtttcacctcaggtcgacactactgggaggtggaggtgggcgacaagacccactgggcagtgggtgtatgccgggactccgtgagccgaaagggcgagttgactccactccctgagactggctactggcgggtgcggctatggaatggggacaaatatgcagccaccaccacaccttttacccctttgcacatcaaggtgaaacccaagcgggtaggcatattcctagactatgaggccggcacactgtctttctacaatgtcacagaccgctctcatatctacaccttcactgatacttttactgagaaactttggcccctcttctacccaggcatccgggctggacggaagaatgctgcaccacttaccatcaggcccccaacagattgggagtgacaggttgggatgtgggaatgactggggtgaggcagggtcaagtgctacgggcctccttcccgtgtcctgctggaacgtcttcgtgtccacctgggtccagtcctgaatcatcttggagaaacaccttggtttctaggatggttttgtgtggagggggaggtaggactgggctggatgagagagcacagctgtgacttcctcctaactgtcagggtggggagctggttcccagaggattgtctaccctgaagtccatcaggttttctgttgcacaaggacgggtcaggaaggaaggagaggcttttccagaaacaaaaaatctgtgagggtctgacttgctcaaaccagaggaggaaacagaaacccctgcacatctttttagggggttctttgacccaggatagtcttgcttcttgaggtagatcacaggggtctgtgtacctctgaattcatgagagatgaatgacagatgctctcatgggtctagatattgaggagtttttctgagggcagagattggacatcaacaaggctagaagggtcagggaagtgggctaaaggaacagattcctagagattaatgaagaggagggaggtttctttggtcttctattccaagggtaaggttgcgattatgggtaagattggccagaggtaggaatgtggggagaaggagaggctgaaaagaaagcagaggagaacccaggtccctgcctcagccttcagcagagttggcttattgcctgcctctataccaataagtcagtcaccttgctcctctccagaggcaaagtggaagagatcctgcaagacacatctatcctttcacagtgttcccaagggaacttggaaaggagagtcaggtattagaggaaagagaagggtatttgtatacaaagccctggccttaaagaatgttacttagtagctactcccaaattgtcagccttcttacctggccaaggtgtccaagccagaaaggaaaaaaggttatggagtctttctcaccctaaggacagggtggaagagggtggtatatagggaagggccagataggcaacttcatttggcttgtgtgcatctggcctggaactggtgttaagccaggcttttgcttgtttgttgccatccctcaccctttgccatttcccttttcagagaatgtaaatgattttcatgttaggccaaaataaacaacttatagggtacatatgttgtcataaaaggtaaaagtgatgcatgccaaaccaaactaaaccaatttggattatctgctattcgggtaatcttcacagaaatgactgagagaagaatctgcagtttactgagggcatttcagttcctcctaccacctcaacaggactttgtccagactctcctcctcttacctttgtgccttgactgtggttctttgtggcaagatactttggttggttaaaataatatggaacaaaggatccactgaagtga

SEQ ID NO: 194943 - DNA, 3535 bp, Homo sapiens
  Payload ID: 18499
  Gene Name: tripartite motif containing 39
  Uniprot ID: Q9HCM9
  ENST ID: ENST00000383603
  CDS Start-End: 599-2065
cggcagcgtcatagcggcgggcatcccatctgcacgtcacacctctttctcacctggacacgcatcccttcctaccctgccagccacgacgtttcctctttcccctctccaatgccccagccccagatctggcggaagaagatggagaacgggggtgggacagagttgtggacaacctctcaggagagggtcgcaaggtgggaccctgaacagtggtagaaacaaaatgagattgtccctgaagtttgcccttcagctgagacacaaggagtagaggaagaggaaggactaacgcagaggcactcaaggtctcactatgactgtagttgagagtcctctcccttcttccctaaccctttccccatttctctcaccacttctttgccagtctagatccgtcctggtgccttactgtgcatacagttctactcgtctcagattcctttcttgtctgttagaaacgtatgtcaaacgaggatacagtgtctggaactattggttctaagatataagtggaatgagcctggatcaggagaagtatgctgagctagagttgaaggaagcttctctttctaacaagagaaagcagagttaaattatggcagagacaagtctgttagaggctggggcctctgcagcctctacagctgcggctttggagaacttacaggtggaggcgagctgctctgtgtgcctggagtatctgaaggaacctgtcatcattgagtgtgggcacaacttctgcaaagcttgcatcacccgctggtgggaggacctagagagggacttcccttgtcctgtctgtcgaaagacatcccgctaccgcagtctccgacctaatcggcaactaggcagtatggtggaaattgccaagcagctccaggccgtcaagcggaagatccgggatgagagcctctgcccccaacaccatgaggccctcagccttttctgttatgaggaccaggaggctgtatgcttgatatgtgcaatttcccacacccaccgggctcacaccgttgtgccactggacgatgctacacaggagtacaaggaaaaactgcagaagtgtctggagcccctggaacagaagctgcaggagatcactcgctgcaagtcctctgaggagaagaagcctggtgagctcaagagactagtggaaagtcgccgacagcagatcttgagggagtttgaagagcttcataggcggctggatgaagagcagcaggtgttgctttcacgactggaagaagaggaacaggacattctgcagcgactccgagaaaatgctgctcaccttggggacaagcgccgggacctggcccacttggctgccgaggtggagggcaagtgcttacagtcaggcttcgagatgcttaaggatgtcaaaagtaccctggaaaaatgtgaaaaggtgaagaccatggaggtgacttcagtatccatagagctggaaaagaacttcagcaattttccccgacagtactttgccctaaggaaaatccttaaacagctaattgcggatgtgaccctggaccctgagacagctcatcctaacctagtcctgtcagaggatcgtaagagcgtcaagttcgtggagacaagactccgggatctccctgacacaccaaggcgtttcaccttctacccttgcgtcctggctactgagggtttcacctcaggtcgacactactgggaggtggaggtgggcgacaagacccactgggcagtgggtgtatgccgggactccgtgagccgaaagggcgagttgactccactccctgagactggctactggcgggtgcggctatggaatggggacaaatatgcagccaccaccacaccttttacccctttgcacatcaaggtgaaacccaagcgggtaggcatattcctagactatgaggccggcacactgtctttctacaatgtcacagaccgctctcatatctacaccttcactgatacttttactgagaaactttggcccctcttctacccaggcatccgggctggacggaagaatgctgcaccacttaccatcaggcccccaacagattgggagtgacaggttgggatgtgggaatgactggggtgaggcagggtcaagtgctacgggcctccttcccgtgtcctgctggaacgtcttcgtgtccacctgggtccagtcctgaatcatcttggagaaacaccttggtttctaggatggttttgtgtggagggggaggtaggactgggctggatgagagagcacagctgtgacttcctcctaactgtcagggtggggagctggttcccagaggattgtctaccctgaagtccatcaggttttctgttgcacaaggacgggtcaggaaggaaggagaggcttttccagaaacaaaaaatctgtgagggtctgacttgctcaaaccagaggaggaaacagaaacccctgcacatctttttagggggttctttgacccaggatagtcttgcttcttgaggtagatcacaggggtctgtgtacctctgaattcatgagagatgaatgacagatgctctcatgggtctagatattgaggagtttttctgagggcagagattggacatcaacaaggctagaagggtcagggaagtgggctaaaggaacagattcctagagattaatgaagaggagggaggtttctttggtcttctattccaagggtaaggttgcgattatgggtaagattggccagaggtaggaatgtggggagaaggagaggctgaaaagaaagcagaggagaacccaggtccctgcctcagccttcagcagagttggcttattgcctgcctctataccaataagtcagtcaccttgctcctctccagaggcaaagtggaagagatcctgcaagacacatctatcctttcacagtgttcccaagggaacttggaaaggagagtcaggtattagaggaaagagaagggtatttgtatacaaagccctggccttaaagaatgttacttagtagctactcccaaattgtcagccttcttacctggccaaggtgtccaagccagaaaggaaaaaaggttatggagtctttctcaccctaaggacagggtggaagagggtggtatatagggaagggccagataggcaacttcatttggcttgtgtgcatctggcctggaactggtgttaagccaggcttttgcttgtttgttgccatccctcaccctttgccatttcccttttcagagaatgtaaatgattttcatgttaggccaaaataaacaacttatagggtacatatgttgtcataaaaggtaaaagtgatgcatgccaaaccaaactaaaccaatttggattatctgctattcgggtaatcttcacagaaatgactgagagaagaatctgcagtttactgagggcatttcagttcctcctaccacctcaacaggactttgtccagactctcctcctcttacctttgtgccttgactgtggttctttgtggcaagatactttggttggttaaaataatatggaacaaaggatccactgaagtga

SEQ ID NO: 194944 - DNA, 3187 bp, Homo sapiens
  Payload ID: 18499
  Gene Name: tripartite motif containing 39
  Uniprot ID: Q9HCM9
  ENST ID: ENST00000396547
  CDS Start-End: 161-1717
attcctttcttgtctgttagaaacgtatgtcaaacgaggatacagtgtctggaactattggttctaagatataagtggaatgagcctggatcaggagaagtatgctgagctagagttgaaggaagcttctctttctaacaagagaaagcagagttaaattatggcagagacaagtctgttagaggctggggcctctgcagcctctacagctgcggctttggagaacttacaggtggaggcgagctgctctgtgtgcctggagtatctgaaggaacctgtcatcattgagtgtgggcacaacttctgcaaagcttgcatcacccgctggtgggaggacctagagagggacttcccttgtcctgtctgtcgaaagacatcccgctaccgcagtctccgacctaatcggcaactaggcagtatggtggaaattgccaagcagctccaggccgtcaagcggaagatccgggatgagagcctctgcccccaacaccatgaggccctcagccttttctgttatgaggaccaggaggctgtatgcttgatatgtgcaatttcccacacccaccgggcccacaccgttgtgccactggacgatgctacacaggagtacaaggaaaaactgcagaagtgtctggagcccctggaacagaagctgcaggagatcactcgctgcaagtcctctgaggagaagaagcctggtgagctcaagagactagtggaaagtcgccgacagcagatcttgagggagtttgaagagcttcataggcggctggatgaagagcagcaggtgttgctttcacgactggaagaagaggaacaggacattctgcagcgactccgagaaaatgctgctcaccttggggacaagcgccgggacctggcccacttggctgccgaggtggagggcaagtgcttacagtcaggcttcgagatgcttaaggatgtcaaaagtaccctggaaaagaatattcctagaaagttcggaggctcactctcaacgatctgtccacgggatcataaggctctccttggattagtaaaagaaatcaacagatgtgaaaaggtgaagaccatggaggtgacttcagtatccatagagctggaaaagaacttcagcaattttccccgacagtactttgccctaaggaaaatccttaaacagctaattgcggatgtgaccctggaccctgagacagctcatcctaacctagtcctgtcagaggatcgtaagagcgtcaagttcgtggagacaagactccgggatctccctgacacaccaaggcgtttcaccttctacccttgcgtcctggctactgagggtttcacctcaggtcgacactactgggaggtggaggtgggcgacaagacccactgggcagtgggtgtatgccgggactccgtgagccgaaagggcgagttgactccactccctgagactggctactggcgggtgcggctatggaatggggacaaatatgcagccaccaccacaccttttacccctttgcacatcaaggtgaaacccaagcgggtaggcatattcctagactatgaggccggcacactgtctttctacaatgtcacagaccgctctcatatctacaccttcactgatacttttactgagaaactttggcccctcttctacccaggcatccgggctggacggaagaatgctgcaccacttaccatcaggcccccaacagattgggagtgacaggttgggatgtgggaatgactggggtgaggcagggtcaagtgctacgggcctccttcccgtgtcctgctggaacgtcttcgtgtccacctgggtccagtcctgaatcatcttggagaaacaccttggtttctaggatggttttgtgtggagggggaggtaggactgggctggatgagagagcacagctgtgacttcctcctaactgtcagggtggggagctggttcccagaggattgtctaccctgaagtccatcaggttttctgttgcacaaggacgggtcaggaaggaaggagaggcttttccagaaacaaaaaatctgtgagggtctgacttgctcaaaccagaggaggaaacagaaacccctgcacatctttttagggggttctttgacccaggatagtcttgcttcttgaggtagatcacaggggtctgtgtacctctgaattcatgagagatgaatgacagatgctctcatgggtctagatattgaggagtttttctgagggcagagattggacatcaacaaggctagaagggtcagggaagtgggctaaaggaacagattcctagagattaatgaagaggagggaggtttctttggtcttctattccaagggtaaggttgcgattatgggtaagattggccagaggtaggaatgtggggagaaggagaggctgaaaagaaagcagaggagaacccaggtccctgcctcagccttcagcagagttggcttattgcctgcctctataccaataagtcagtcaccttgctcctctccagaggcaaagtggaagagatcctgcaagacacatctatcctttcacagtgttcccaagggaacttggaaaggagagtcaggtattagaggaaagagaagggtatttgtatacaaagccctggccttaaagaatgttacttagtagctactcccaaattgtcagccttcttacctggccaaggtgtccaagccagaaaggaaaaaaggttatggagtctttctcaccctaaggacagggtggaagagggtggtatatagggaagggccagataggcaacttcatttggcttgtgtgcatctggcctggaactggtgttaagccaggcttttgcttgtttgttgccatccctcaccctttgccatttcccttttcagagaatgtaaatgattttcatgttaggccaaaataaacaacttatagggtacatatgttgtcataaaaggtaaaagtgatgcatgccaaaccaaactaaaccaatttggattatctgctattcgggtaatcttcacagaaatgactgagagaagaatctgcagtttactgagggcatttcagttcctcctaccacctcaacaggactttgtccagactctcctcctcttacctttgtgccttgactgtggttctttgtggcaagatactttggttggttaaaataatatggaacaaaggatccactgaagtga

SEQ ID NO: 194945 - DNA, 3198 bp, Homo sapiens
  Payload ID: 18499
  Gene Name: tripartite motif containing 39
  Uniprot ID: Q9HCM9
  ENST ID: ENST00000396548
  CDS Start-End: 262-1728
gcgaggggaggaggaaggagggaggcagcgctccggcggctccgcgccccgcactcccggacccgaagccgggaagatccgtcctggtgccttactgtgcatacagttctactcgtctcagaaacgtatgtcaaacgaggatacagtgtctggaactattggttctaagatataagtggaatgagcctggatcaggagaagtatgctgagctagagttgaaggaagcttctctttctaacaagagaaagcagagttaaattatggcagagacaagtctgttagaggctggggcctctgcagcctctacagctgcggctttggagaacttacaggtggaggcgagctgctctgtgtgcctggagtatctgaaggaacctgtcatcattgagtgtgggcacaacttctgcaaagcttgcatcacccgctggtgggaggacctagagagggacttcccttgtcctgtctgtcgaaagacatcccgctaccgcagtctccgacctaatcggcaactaggcagtatggtggaaattgccaagcagctccaggccgtcaagcggaagatccgggatgagagcctctgcccccaacaccatgaggccctcagccttttctgttatgaggaccaggaggctgtatgcttgatatgtgcaatttcccacacccaccgggcccacaccgttgtgccactggacgatgctacacaggagtacaaggaaaaactgcagaagtgtctggagcccctggaacagaagctgcaggagatcactcgctgcaagtcctctgaggagaagaagcctggtgagctcaagagactagtggaaagtcgccgacagcagatcttgagggagtttgaagagcttcataggcggctggatgaagagcagcaggtgttgctttcacgactggaagaagaggaacaggacattctgcagcgactccgagaaaatgctgctcaccttggggacaagcgccgggacctggcccacttggctgccgaggtggagggcaagtgcttacagtcaggcttcgagatgcttaaggatgtcaaaagtaccctggaaaaatgtgaaaaggtgaagaccatggaggtgacttcagtatccatagagctggaaaagaacttcagcaattttccccgacagtactttgccctaaggaaaatccttaaacagctaattgcggatgtgaccctggaccctgagacagctcatcctaacctagtcctgtcagaggatcgtaagagcgtcaagttcgtggagacaagactccgggatctccctgacacaccaaggcgtttcaccttctacccttgcgtcctggctactgagggtttcacctcaggtcgacactactgggaggtggaggtgggcgacaagacccactgggcagtgggtgtatgccgggactccgtgagccgaaagggcgagttgactccactccctgagactggctactggcgggtgcggctatggaatggggacaaatatgcagccaccaccacaccttttacccctttgcacatcaaggtgaaacccaagcgggtaggcatattcctagactatgaggccggcacactgtctttctacaatgtcacagaccgctctcatatctacaccttcactgatacttttactgagaaactttggcccctcttctacccaggcatccgggctggacggaagaatgctgcaccacttaccatcaggcccccaacagattgggagtgacaggttgggatgtgggaatgactggggtgaggcagggtcaagtgctacgggcctccttcccgtgtcctgctggaacgtcttcgtgtccacctgggtccagtcctgaatcatcttggagaaacaccttggtttctaggatggttttgtgtggagggggaggtaggactgggctggatgagagagcacagctgtgacttcctcctaactgtcagggtggggagctggttcccagaggattgtctaccctgaagtccatcaggttttctgttgcacaaggacgggtcaggaaggaaggagaggcttttccagaaacaaaaaatctgtgagggtctgacttgctcaaaccagaggaggaaacagaaacccctgcacatctttttagggggttctttgacccaggatagtcttgcttcttgaggtagatcacaggggtctgtgtacctctgaattcatgagagatgaatgacagatgctctcatgggtctagatattgaggagtttttctgagggcagagattggacatcaacaaggctagaagggtcagggaagtgggctaaaggaacagattcctagagattaatgaagaggagggaggtttctttggtcttctattccaagggtaaggttgcgattatgggtaagattggccagaggtaggaatgtggggagaaggagaggctgaaaagaaagcagaggagaacccaggtccctgcctcagccttcagcagagttggcttattgcctgcctctataccaataagtcagtcaccttgctcctctccagaggcaaagtggaagagatcctgcaagacacatctatcctttcacagtgttcccaagggaacttggaaaggagagtcaggtattagaggaaagagaagggtatttgtatacaaagccctggccttaaagaatgttacttagtagctactcccaaattgtcagccttcttacctggccaaggtgtccaagccagaaaggaaaaaaggttatggagtctttctcaccctaaggacagggtggaagagggtggtatatagggaagggccagataggcaacttcatttggcttgtgtgcatctggcctggaactggtgttaagccaggcttttgcttgtttgttgccatccctcaccctttgccatttcccttttcagagaatgtaaatgattttcatgttaggccaaaataaacaacttatagggtacatatgttgtcataaaaggtaaaagtgatgcatgccaaaccaaactaaaccaatttggattatctgctattcgggtaatcttcacagaaatgactgagagaagaatctgcagtttactgagggcatttcagttcctcctaccacctcaacaggactttgtccagactctcctcctcttacctttgtgccttgactgtggttctttgtggcaagatactttggttggttaaaataatatggaacaaaggatccactgaagtga

SEQ ID NO: 194946 - DNA, 3249 bp, Homo sapiens
  Payload ID: 18499
  Gene Name: tripartite motif containing 39
  Uniprot ID: Q9HCM9
  ENST ID: ENST00000396551
  CDS Start-End: 313-1779
cccagcttccactgacacgagcctcggcgcggcttccgcttccggcgagtattgtgtgtcgcgccgcggggcgggggcgaggggaggaggaaggagggaggcagcgctccggcggctccgcgccccgcactcccggacccgaagccgggaagattcctttcttgtctgttagaaacgtatgtcaaacgaggatacagtgtctggaactattggttctaagatataagtggaatgagcctggatcaggagaagtatgctgagctagagttgaaggaagcttctctttctaacaagagaaagcagagttaaattatggcagagacaagtctgttagaggctggggcctctgcagcctctacagctgcggctttggagaacttacaggtggaggcgagctgctctgtgtgcctggagtatctgaaggaacctgtcatcattgagtgtgggcacaacttctgcaaagcttgcatcacccgctggtgggaggacctagagagggacttcccttgtcctgtctgtcgaaagacatcccgctaccgcagtctccgacctaatcggcaactaggcagtatggtggaaattgccaagcagctccaggccgtcaagcggaagatccgggatgagagcctctgcccccaacaccatgaggccctcagccttttctgttatgaggaccaggaggctgtatgcttgatatgtgcaatttcccacacccaccgggcccacaccgttgtgccactggacgatgctacacaggagtacaaggaaaaactgcagaagtgtctggagcccctggaacagaagctgcaggagatcactcgctgcaagtcctctgaggagaagaagcctggtgagctcaagagactagtggaaagtcgccgacagcagatcttgagggagtttgaagagcttcataggcggctggatgaagagcagcaggtgttgctttcacgactggaagaagaggaacaggacattctgcagcgactccgagaaaatgctgctcaccttggggacaagcgccgggacctggcccacttggctgccgaggtggagggcaagtgcttacagtcaggcttcgagatgcttaaggatgtcaaaagtaccctggaaaaatgtgaaaaggtgaagaccatggaggtgacttcagtatccatagagctggaaaagaacttcagcaattttccccgacagtactttgccctaaggaaaatccttaaacagctaattgcggatgtgaccctggaccctgagacagctcatcctaacctagtcctgtcagaggatcgtaagagcgtcaagttcgtggagacaagactccgggatctccctgacacaccaaggcgtttcaccttctacccttgcgtcctggctactgagggtttcacctcaggtcgacactactgggaggtggaggtgggcgacaagacccactgggcagtgggtgtatgccgggactccgtgagccgaaagggcgagttgactccactccctgagactggctactggcgggtgcggctatggaatggggacaaatatgcagccaccaccacaccttttacccctttgcacatcaaggtgaaacccaagcgggtaggcatattcctagactatgaggccggcacactgtctttctacaatgtcacagaccgctctcatatctacaccttcactgatacttttactgagaaactttggcccctcttctacccaggcatccgggctggacggaagaatgctgcaccacttaccatcaggcccccaacagattgggagtgacaggttgggatgtgggaatgactggggtgaggcagggtcaagtgctacgggcctccttcccgtgtcctgctggaacgtcttcgtgtccacctgggtccagtcctgaatcatcttggagaaacaccttggtttctaggatggttttgtgtggagggggaggtaggactgggctggatgagagagcacagctgtgacttcctcctaactgtcagggtggggagctggttcccagaggattgtctaccctgaagtccatcaggttttctgttgcacaaggacgggtcaggaaggaaggagaggcttttccagaaacaaaaaatctgtgagggtctgacttgctcaaaccagaggaggaaacagaaacccctgcacatctttttagggggttctttgacccaggatagtcttgcttcttgaggtagatcacaggggtctgtgtacctctgaattcatgagagatgaatgacagatgctctcatgggtctagatattgaggagtttttctgagggcagagattggacatcaacaaggctagaagggtcagggaagtgggctaaaggaacagattcctagagattaatgaagaggagggaggtttctttggtcttctattccaagggtaaggttgcgattatgggtaagattggccagaggtaggaatgtggggagaaggagaggctgaaaagaaagcagaggagaacccaggtccctgcctcagccttcagcagagttggcttattgcctgcctctataccaataagtcagtcaccttgctcctctccagaggcaaagtggaagagatcctgcaagacacatctatcctttcacagtgttcccaagggaacttggaaaggagagtcaggtattagaggaaagagaagggtatttgtatacaaagccctggccttaaagaatgttacttagtagctactcccaaattgtcagccttcttacctggccaaggtgtccaagccagaaaggaaaaaaggttatggagtctttctcaccctaaggacagggtggaagagggtggtatatagggaagggccagataggcaacttcatttggcttgtgtgcatctggcctggaactggtgttaagccaggcttttgcttgtttgttgccatccctcaccctttgccatttcccttttcagagaatgtaaatgattttcatgttaggccaaaataaacaacttatagggtacatatgttgtcataaaaggtaaaagtgatgcatgccaaaccaaactaaaccaatttggattatctgctattcgggtaatcttcacagaaatgactgagagaagaatctgcagtttactgagggcatttcagttcctcctaccacctcaacaggactttgtccagactctcctcctcttacctttgtgccttgactgtggttctttgtggcaagatactttggttggttaaaataatatggaacaaaggatccactgaagtga

SEQ ID NO: 194947 - DNA, 3249 bp, Homo sapiens
  Payload ID: 18499
  Gene Name: tripartite motif containing 39
  Uniprot ID: Q9HCM9
  ENST ID: ENST00000400644
  CDS Start-End: 313-1779
cccagcttccactgacacgagcctcggcgcggcttccgcttccggcgagtattgtgtgtcgcgccgcggggcgggggcgaggggaggaggaaggagggaggcagcgctccggcggctccgcgccccgcactcccggacccgaagccgggaagattcctttcttgtctgttagaaacgtatgtcaaacgaggatacagtgtctggaactattggttctaagatataagtggaatgagcctggatcaggagaagtatgctgagctagagttgaaggaagcttctctttctaacaagagaaagcagagttaaattatggcagagacaagtctgttagaggctggggcctctgcagcctctacagctgcggctttggagaacttacaggtggaggcgagctgctctgtgtgcctggagtatctgaaggaacctgtcatcattgagtgtgggcacaacttctgcaaagcttgcatcacccgctggtgggaggacctagagagggacttcccttgtcctgtctgtcgaaagacatcccgctaccgcagtctccgacctaatcggcaactaggcagtatggtggaaattgccaagcagctccaggccgtcaagcggaagatccgggatgagagcctctgcccccaacaccatgaggccctcagccttttctgttatgaggaccaggaggctgtatgcttgatatgtgcaatttcccacacccaccgggctcacaccgttgtgccactggacgatgctacacaggagtacaaggaaaaactgcagaagtgtctggagcccctggaacagaagctgcaggagatcactcgctgcaagtcctctgaggagaagaagcctggtgagctcaagagactagtggaaagtcgccgacagcagatcttgagggagtttgaagagcttcataggcggctggatgaagagcagcaggtgttgctttcacgactggaagaagaggaacaggacattctgcagcgactccgagaaaatgctgctcaccttggggacaagcgccgggacctggcccacttggctgccgaggtggagggcaagtgcttacagtcaggcttcgagatgcttaaggatgtcaaaagtaccctggaaaaatgtgaaaaggtgaagaccatggaggtgacttcagtatccatagagctggaaaagaacttcagcaattttccccgacagtactttgccctaaggaaaatccttaaacagctaattgcggatgtgaccctggaccctgagacagctcatcctaacctagtcctgtcagaggatcgtaagagcgtcaagttcgtggagacaagactccgggatctccctgacacaccaaggcgtttcaccttctacccttgcgtcctggctactgagggtttcacctcaggtcgacactactgggaggtggaggtgggcgacaagacccactgggcagtgggtgtatgccgggactccgtgagccgaaagggcgagttgactccactccctgagactggctactggcgggtgcggctatggaatggggacaaatatgcagccaccaccacaccttttacccctttgcacatcaaggtgaaacccaagcgggtaggcatattcctagactatgaggccggcacactgtctttctacaatgtcacagaccgctctcatatctacaccttcactgatacttttactgagaaactttggcccctcttctacccaggcatccgggctggacggaagaatgctgcaccacttaccatcaggcccccaacagattgggagtgacaggttgggatgtgggaatgactggggtgaggcagggtcaagtgctacgggcctccttcccgtgtcctgctggaacgtcttcgtgtccacctgggtccagtcctgaatcatcttggagaaacaccttggtttctaggatggttttgtgtggagggggaggtaggactgggctggatgagagagcacagctgtgacttcctcctaactgtcagggtggggagctggttcccagaggattgtctaccctgaagtccatcaggttttctgttgcacaaggacgggtcaggaaggaaggagaggcttttccagaaacaaaaaatctgtgagggtctgacttgctcaaaccagaggaggaaacagaaacccctgcacatctttttagggggttctttgacccaggatagtcttgcttcttgaggtagatcacaggggtctgtgtacctctgaattcatgagagatgaatgacagatgctctcatgggtctagatattgaggagtttttctgagggcagagattggacatcaacaaggctagaagggtcagggaagtgggctaaaggaacagattcctagagattaatgaagaggagggaggtttctttggtcttctattccaagggtaaggttgcgattatgggtaagattggccagaggtaggaatgtggggagaaggagaggctgaaaagaaagcagaggagaacccaggtccctgcctcagccttcagcagagttggcttattgcctgcctctataccaataagtcagtcaccttgctcctctccagaggcaaagtggaagagatcctgcaagacacatctatcctttcacagtgttcccaagggaacttggaaaggagagtcaggtattagaggaaagagaagggtatttgtatacaaagccctggccttaaagaatgttacttagtagctactcccaaattgtcagccttcttacctggccaaggtgtccaagccagaaaggaaaaaaggttatggagtctttctcaccctaaggacagggtggaagagggtggtatatagggaagggccagataggcaacttcatttggcttgtgtgcatctggcctggaactggtgttaagccaggcttttgcttgtttgttgccatccctcaccctttgccatttcccttttcagagaatgtaaatgattttcatgttaggccaaaataaacaacttatagggtacatatgttgtcataaaaggtaaaagtgatgcatgccaaaccaaactaaaccaatttggattatctgctattcgggtaatcttcacagaaatgactgagagaagaatctgcagtttactgagggcatttcagttcctcctaccacctcaacaggactttgtccagactctcctcctcttacctttgtgccttgactgtggttctttgtggcaagatactttggttggttaaaataatatggaacaaaggatccactgaagtga

SEQ ID NO: 194948 - DNA, 3535 bp, Homo sapiens
  Payload ID: 18499
  Gene Name: tripartite motif containing 39
  Uniprot ID: Q9HCM9
  ENST ID: ENST00000450778
  CDS Start-End: 599-2065
cggcagcgtcatagcggcgggcatcccatctgcacgtcacacctctttctcacctggacacgcatcccttcctaccctgccagccacgacgtttcctctttcccctctccaatgccccagccccagatctggcggaagaagatggagaacgggggtgggacagagttgtggacaacctctcaggagagggtcgcaaggtgggaccctgaacagtggtagaaacaaaatgagattgtccctgaagtttgcccttcagctgagacacaaggagtagaggaagaggaaggactaacgcagaggcactcaaggtctcactatgactgtagttgagagtcctctcccttcttccctaaccctttccccatttctctcaccacttctttgccagtctagatccgtcctggtgccttactgtgcatacagttctactcgtctcagattcctttcttgtctgttagaaacgtatgtcaaacgaggatacagtgtctggaactattggttctaagatataagtggaatgagcctggatcaggagaagtatgctgagctagagttgaaggaagcttctctttctaacaagagaaagcagagttaaattatggcagagacaagtctgttagaggctggggcctctgcagcctctacagctgcggctttggagaacttacaggtggaggcgagctgctctgtgtgcctggagtatctgaaggaacctgtcatcattgagtgtgggcacaacttctgcaaagcttgcatcacccgctggtgggaggacctagagagggacttcccttgtcctgtctgtcgaaagacatcccgctaccgcagtctccgacctaatcggcaactaggcagtatggtggaaattgccaagcagctccaggccgtcaagcggaagatccgggatgagagcctctgcccccaacaccatgaggccctcagccttttctgttatgaggaccaggaggctgtatgcttgatatgtgcaatttcccacacccaccgggcccacaccgttgtgccactggacgacgctacacaggagtacaaggaaaaactgcagaagtgtctggagcccctggaacagaagctgcaggagatcactcgctgcaagtcctctgaggagaagaagcctggtgagctcaagagactagtggaaagtcgccgacagcagatcttgagggagtttgaagagcttcataggcggctggatgaagagcagcaggtgttgctttcacgactggaagaagaggaacaggacattctgcagcgactccgagaaaatgctgctcaccttggggacaagcgccgggacctggcccacttggctgccgaggtggagggcaagtgcttacagtcaggcttcgagatgcttaaggatgtcaaaagtaccctggaaaaatgtgaaaaggtgaagaccatggaggtgacttcagtatccatagagctggaaaagaacttcagcaattttccccgacagtactttgccctaaggaaaatccttaaacagctaattgcggatgtgaccctggaccccgagacagctcatcctaacctagtcctgtcagaggatcgtaagagcgtcaagttcgtggagacaagactccgggatctccctgacacaccaaggcgtttcaccttctacccttgcgtcctggctactgagggtttcacctcaggtcgacactactgggaggtggaggtgggcgacaagacccactgggcagtgggtgtatgccgggactccgtgagccgaaagggcgagttgactccactccctgagactggctactggcgggtgcggctatggaatggggacaaatatgcagccaccaccacaccttttacccctttgcacatcaaggtgaaacccaagcgggtaggcatattcctagactatgaggccggcacactgtctttctacaatgtcacagaccgctctcatatctacaccttcactgatacttttactgagaaactttggcccctcttctacccaggcatccgggctggacggaagaatgctgcaccacttaccatcaggcccccaacagattgggagtgacaggttgggatgtgggaatgactggggtgaggcagggtcaagtgctacgggcctccttcccgtgtcctgctggaacgtcttcgtgtccacctgggtccagtcctgaatcatcttggagaaacaccttggtttctaggatggttttgtgtggagggggaggtaggactgggctggatgagagagcacagctgtgacttcctcctaactgtcagggtggggagctggttcccagaggattgtctaccctgaagtccatcaggttttctgttgcacaaggacgggtcaggaaggaaggagaggcttttccagaaacaaaaaatctgtgagggtctgacttgctcaaaccagaggaggaaacagaaacccctgcacatctttttagggggttctttgacccaggatagtcttgcttcttgaggtagatcacaggggtctgtgtacctctgaattcatgagagatgaatgacagatgctctcatgggtctagatattgaggagtttttctgagggcagagattggacatcaacaaggctagaagggtcagggaagtgggctaaaggaacagattcctagagattaatgaagaggagggaggtttctttggtcttctattccaagggtaaggttgcgattatgggtaagattggccagaggtaggaatgtggggagaaggagaggctgaaaagaaagcagaggagaacccaggtccctgcctcagccttcagcagagttggcttattgcctgcctctataccaataagtcagtcaccttgctcctctccagaggcaaagtggaagagatcctgcaagacacatctatcctttcacagtgttcccaagggaacttggaaaggagagtcaggtattagaggaaagagaagggtatttgtatacaaagccctggccttaaagaatgttacttagtagctactcccaaattgtcagccttcttacctggccaaggtgtccaagccagaaaggaaaaaaggttatggagtctttctcaccctaaggacagggtggaagagggtggtatatagggaagggccagataggcaacttcatttggcttgtgtgcatctggcctggaactggtgttaagccaggcttttgcttgtttgttgccatccctcaccctttgccatttcccttttcagagaatgtaaatgattttcatgttaggccaaaataaacaacttatagggtacatatgttgtcataaaaggtaaaagtgatgcatgccaaaccaaactaaaccaatttggattatctgctattcgggtaatcttcacagaaatgactgagagaagaatctgcagtttactgagggcatttcagttcctcctaccacctcaacaggactttgtccagactctcctcctcttacctttgtgccttgactgtggttctttgtggcaagatactttggttggttaaaataatatggaacaaaggatccactgaagtga

SEQ ID NO: 194949 - DNA, 708 bp, Homo sapiens
  Payload ID: 18499
  Gene Name: tripartite motif containing 39
  ENST ID: ENST00000437257
  CDS Start-End: 1-683
agacatcccgctaccgcagtctccgacctaatcggcaactaggcagtatggtggaaattgccaagcagctccaggccgtcaagcggaagatccgggatgagagcctctgcccccaacaccatgaggccctcagccttttctgttatgaggaccaggaggctgtatgcttgatatgtgcaatttcccacacccaccgggcccacaccgttgtgccactggacgatgctacacaggagtacaaggaaaaactgcagaagtgtctggagcccctggaacagaagctgcaggagatcactcgctgcaagtcctctgaggagaagaagcctggtgagctcaagagactagtggaaagtcgccgacagcagatcttgagggagtttgaagagcttcataggcggctggatgaagagcagcaggtgttgctttcacgactggaagaagaggaacaggacattctgcagcgactccgagaaaatgctgctcaccttggggacaagcgccgggacctggcccacttggctgccgaggtggagggcaagtgcttacagtcaggcttcgagatgcttaaggatgtcaaaagtaccctggaaaaatgtgaaaaggtgaagaccatggaggtgacttcaactacaccttgtacttctctacatagtgagataaatgataatgtcagagggagatgaagagaggaccaggcgggaacctaga

SEQ ID NO: 194950 - DNA, 708 bp, Homo sapiens; identical to SEQ ID NO: 194949
  Payload ID: 18499
  Gene Name: tripartite motif containing 39
  ENST ID: ENST00000420746
  CDS Start-End: 1-683

SEQ ID NO: 194951 - DNA, 459 bp, Homo sapiens
  Payload ID: 18499
  Gene Name: tripartite motif containing 39
  ENST ID: ENST00000457343
  CDS Start-End: 315-459
caaggagtagaggaagaggaaggactaacgcagaggcactcaaggtctcactatgactgtagttgagagtcctctcccttcttccctaaccctttccccatttctctcaccacttctttgccagtctagatccgtcctggtgccttactgtgcatacagttctactcgtctcagaaacgtatgtcaaacgaggatacagtgtctggaactattggttctaagatataagtggaatgagcctggatcaggagaagtatgctgagctagagttgaaggaagcttctctttctaacaagagaaagcagagttaaattatggcagagacaagtctgttagaggctggggcctctgcagcctctacagctgcggctttggagaacttacaggtggaggcgagctgctctgtgtgcctggagtatctgaaggaacctgtcatcattgagtgtgggcacaacttct

SEQ ID NO: 194952 - DNA, 1013 bp, Homo sapiens
  Payload ID: 18499
  Gene Name: tripartite motif containing 39
  ENST ID: ENST00000431871
  CDS Start-End: 232-1013
cgccgcggggcgggggcgaggggaggaggaaggagggaggcagcgctccggcggctccgcgccccgcactcccggacccgaagccgggaagaaacgtatgtcaaacgaggatacagtgtctggaactattggttctaagatataagtggaatgagcctggatcaggagaagtatgctgagctagagttgaaggaagcttctctttctaacaagagaaagcagagttaaattatggcagagacaagtctgttagaggctggggcctctgcagcctctacagctgcggctttggagaacttacaggtggaggcgagctgctctgtgtgcctggagtatctgaaggaacctgtcatcattgagtgtgggcacaacttctgcaaagcttgcatcacccgctggtgggaggacctagagagggacttcccttgtcctgtctgtcgaaagacatcccgctaccgcagtctccgacctaatcggcaactaggcagtatggtggaaattgccaagcagctccaggccgtcaagcggaagatccgggatgagagcctctgcccccaacaccatgaggccctcagccttttctgttatgaggaccaggaggctgtatgcttgatatgtgcaatttcccacacccaccgggcccacaccgttgtgccactggacgatgctacacaggagtacaaggaaaaactgcagaagtgtctggagcccctggaacagaagctgcaggagatcactcgctgcaagtcctctgaggagaagaagcctggtgagctcaagagactagtggaaagtcgccgacagcagatcttgagggagtttgaagagcttcataggcggctggatgaagagcagcaggtgttgctttcacgactggaagaagaggaacaggacattctgcagcgactccgagaaaatgctgctcaccttggggacaagcgccgggacctggcccacttggctgccgaggtggagggcaagtgcttacagtcaggcttcgagatgcttaaggt

SEQ ID NO: 194953 - DNA, 3249 bp, Homo sapiens; identical to SEQ ID NO: 194946
  Payload ID: 18499
  Gene Name: tripartite motif containing 39
  Uniprot ID: Q9HCM9
  ENST ID: ENST00000438076
  CDS Start-End: 313-1779

SEQ ID NO: 194954 - DNA, 1013 bp, Homo sapiens
  Payload ID: 18499
  Gene Name: tripartite motif containing 39
  ENST ID: ENST00000442914
  CDS Start-End: 232-1013
cgccgcggggcgggggcgaggggaggaggaaggagggaggcagcgctccggcggctccgcgccccgcactcccggacccgaagccgggaagaaacgtatgtcaaacgaggatacagtgtctggaactattggttctaagatataagtggaatgagcctggatcaggagaagtatgctgagctagagttgaaggaagcttctctttctaacaagagaaagcagagttaaattatggcagagacaagtctgttagaggctggggcctctgcagcctctacagctgcggctttggagaacttacaggtggaggcgagctgctctgtgtgcctggagtatctgaaggaacctgtcatcattgagtgtgggcacaacttctgcaaagcttgcatcacccgctggtgggaggacctagagagggacttcccttgtcctgtctgtcgaaagacatcccgctaccgcagtctccgacctaatcggcaactaggcagtatggtggaaattgccaagcagctccaggccgtcaagcggaagatccgggatgagagcctctgcccccaacaccatgaggccctcagccttttctgttatgaggaccaggaggctgtatgcttgatatgtgcaatttcccacacccaccgggcccacaccgttgtgccactggacgacgctacacaggagtacaaggaaaaactgcagaagtgtctggagcccctggaacagaagctgcaggagatcactcgctgcaagtcctctgaggagaagaagcctggtgagctcaagagactagtggaaagtcgccgacagcagatcttgagggagtttgaagagcttcataggcggctggatgaagagcagcaggtgttgctttcacgactggaagaagaggaacaggacattctgcagcgactccgagaaaatgctgctcaccttggggacaagcgccgggacctggcccacttggctgccgaggtggagggcaagtgcttacagtcaggcttcgagatgcttaaggt

SEQ ID NO: 194955 - DNA, 588 bp, Homo sapiens
  Payload ID: 18499
  Gene Name: tripartite motif containing 39
  ENST ID: ENST00000412150
  CDS Start-End: 367-588
cgccgacaccccagcttccactgacacgagcctcggcgcggcttccgcttccggcgagtattgtgtgtcgcgccgcggggcgggggcgaggggaggaggaaggagggaggcagcgctccggcggctccgcgccccgcactcccggacccgaagccgggaagatccgtcctggtgccttactgtgcatacagttctactcgtctcagattcctttcttgtctgttagaaacgtatgtcaaacgaggatacagtgtctggaactattggttctaagatataagtggaatgagcctggatcaggagaagtatgctgagctagagttgaaggaagcttctctttctaacaagagaaagcagagttaaattatggcagagacaagtctgttagaggctggggcctctgcagcctctacagctgcggctttggagaacttacaggtggaggcgagctgctctgtgtgcctggagtatctgaaggaacctgtcatcattgagtgtgggcacaacttctgcaaagcttgcatcacccgctggtgggaggacctagagagggacttcccttgtcctgtctgtcgaaagacatcccgc

SEQ ID NO: 194956 - DNA, 3535 bp, Homo sapiens; identical to SEQ ID NO: 194940
  Payload ID: 18499
  Gene Name: tripartite motif containing 39
  Uniprot ID: Q9HCM9
  ENST ID: ENST00000433900
  CDS Start-End: 599-2065

SEQ ID NO: 194957 - DNA, 708 bp, Homo sapiens
  Payload ID: 18499
  Gene Name: tripartite motif containing 39
  ENST ID: ENST00000457154
  CDS Start-End: 1-683
agacatcccgctaccgcagtctccgacctaatcggcaactaggcagtatggtggaaattgccaagcagctccaggccgtcaagcggaagatccgggatgagagcctctgcccccaacaccatgaggccctcagccttttctgttatgaggaccaggaggctgtatgcttgatatgtgcaatttcccacacccaccgggctcacaccgttgtgccactggacgatgctacacaggagtacaaggaaaaactgcagaagtgtctggagcccctggaacagaagctgcaggagatcactcgctgcaagtcctctgaggagaagaagcctggtgagctcaagagactagtggaaagtcgccgacagcagatcttgagggagtttgaagagcttcataggcggctggatgaagagcagcaggtgttgctttcacgactggaagaagaggaacaggacattctgcagcgactccgagaaaatgctgctcaccttggggacaagcgccgggacctggcccacttggctgccgaggtggagggcaagtgcttacagtcaggcttcgagatgcttaaggatgtcaaaagtaccctggaaaaatgtgaaaaggtgaagaccatggaggtgacttcaactacaccttgtacttctctacatagtgagataaatgataatgtcagagggagatgaagagaggaccaggcgggaacctaga

SEQ ID NO: 194958 - DNA, 427 bp, Homo sapiens
  Payload ID: 18499
  Gene Name: tripartite motif containing 39
  ENST ID: ENST00000424074
  CDS Start-End: 250-427
ggctccgcgccccgcactcccggacccgaagccgggaagtctagatccgtcctggtgccttactgtgcatacagttctactcgtctcagattcctttcttgtctgttagaaacgtatgtcaaacgaggatacagtgtctggaactattggttctaagatataagtggaatgagcctggatcaggagaagtatgctgagctagagttgaaggaagcttctctttctaacaagagaaagcagagttaaattatggcagagacaagtctgttagaggctggggcctctgcagcctctacagctgcggctttggagaacttacaggtggaggcgagctgctctgtgtgcctggagtatctgaaggaacctgtcatcattgagtgtgggcacaacttctgcaaagcttgcatcacccgctggtgggaggacc

SEQ ID NO: 194959 - DNA, 3187 bp, Homo sapiens
  Payload ID: 18499
  Gene Name: tripartite motif containing 39
  Uniprot ID: Q9HCM9
  ENST ID: ENST00000445206
  CDS Start-End: 161-1717
attcctttcttgtctgttagaaacgtatgtcaaacgaggatacagtgtctggaactattggttctaagatataagtggaatgagcctggatcaggagaagtatgctgagctagagttgaaggaagcttctctttctaacaagagaaagcagagttaaattatggcagagacaagtctgttagaggctggggcctctgcagcctctacagctgcggctttggagaacttacaggtggaggcgagctgctctgtgtgcctggagtatctgaaggaacctgtcatcattgagtgtgggcacaacttctgcaaagcttgcatcacccgctggtgggaggacctagagagggacttcccttgtcctgtctgtcgaaagacatcccgctaccgcagtctccgacctaatcggcaactaggcagtatggtggaaattgccaagcagctccaggccgtcaagcggaagatccgggatgagagcctctgcccccaacaccatgaggccctcagccttttctgttatgaggaccaggaggctgtatgcttgatatgtgcaatttcccacacccaccgggcccacaccgttgtgccactggacgacgctacacaggagtacaaggaaaaactgcagaagtgtctggagcccctggaacagaagctgcaggagatcactcgctgcaagtcctctgaggagaagaagcctggtgagctcaagagactagtggaaagtcgccgacagcagatcttgagggagtttgaagagcttcataggcggctggatgaagagcagcaggtgttgctttcacgactggaagaagaggaacaggacattctgcagcgactccgagaaaatgctgctcaccttggggacaagcgccgggacctggcccacttggctgccgaggtggagggcaagtgcttacagtcaggcttcgagatgcttaaggatgtcaaaagtaccctggaaaagaatattcctagaaagttcggaggctcactctcaacgatctgtccacgggatcataaggctctccttggattagtaaaagaaatcaacagatgtgaaaaggtgaagaccatggaggtgacttcagtatccatagagctggaaaagaacttcagcaattttccccgacagtactttgccctaaggaaaatccttaaacagctaattgcggatgtgaccctggaccccgagacagctcatcctaacctagtcctgtcagaggatcgtaagagcgtcaagttcgtggagacaagactccgggatctccctgacacaccaaggcgtttcaccttctacccttgcgtcctggctactgagggtttcacctcaggtcgacactactgggaggtggaggtgggcgacaagacccactgggcagtgggtgtatgccgggactccgtgagccgaaagggcgagttgactccactccctgagactggctactggcgggtgcggctatggaatggggacaaatatgcagccaccaccacaccttttacccctttgcacatcaaggtgaaacccaagcgggtaggcatattcctagactatgaggccggcacactgtctttctacaatgtcacagaccgctctcatatctacaccttcactgatacttttactgagaaactttggcccctcttctacccaggcatccgggctggacggaagaatgctgcaccacttaccatcaggcccccaacagattgggagtgacaggttgggatgtgggaatgactggggtgaggcagggtcaagtgctacgggcctccttcccgtgtcctgctggaacgtcttcgtgtccacctgggtccagtcctgaatcatcttggagaaacaccttggtttctaggatggttttgtgtggagggggaggtaggactgggctggatgagagagcacagctgtgacttcctcctaactgtcagggtggggagctggttcccagaggattgtctaccctgaagtccatcaggttttctgttgcacaaggacgggtcaggaaggaaggagaggcttttccagaaacaaaaaatctgtgagggtctgacttgctcaaaccagaggaggaaacagaaacccctgcacatctttttagggggttctttgacccaggatagtcttgcttcttgaggtagatcacaggggtctgtgtacctctgaattcatgagagatgaatgacagatgctctcatgggtctagatattgaggagtttttctgagggcagagattggacatcaacaaggctagaagggtcagggaagtgggctaaaggaacagattcctagagattaatgaagaggagggaggtttctttggtcttctattccaagggtaaggttgcgattatgggtaagattggccagaggtaggaatgtggggagaaggagaggctgaaaagaaagcagaggagaacccaggtccctgcctcagccttcagcagagttggcttattgcctgcctctataccaataagtcagtcaccttgctcctctccagaggcaaagtggaagagatcctgcaagacacatctatcctttcacagtgttcccaagggaacttggaaaggagagtcaggtattagaggaaagagaagggtatttgtatacaaagccctggccttaaagaatgttacttagtagctactcccaaattgtcagccttcttacctggccaaggtgtccaagccagaaaggaaaaaaggttatggagtctttctcaccctaaggacagggtggaagagggtggtatatagggaagggccagataggcaacttcatttggcttgtgtgcatctggcctggaactggtgttaagccaggcttttgcttgtttgttgccatccctcaccctttgccatttcccttttcagagaatgtaaatgattttcatgttaggccaaaataaacaacttatagggtacatatgttgtcataaaaggtaaaagtgatgcatgccaaaccaaactaaaccaatttggattatctgctattcgggtaatcttcacagaaatgactgagagaagaatctgcagtttactgagggcatttcagttcctcctaccacctcaacaggactttgtccagactctcctcctcttacctttgtgccttgactgtggttctttgtggcaagatactttggttggttaaaataatatggaacaaaggatccactgaagtga

SEQ ID NO: 194960 - DNA, 3249 bp, Homo sapiens; identical to SEQ ID NO: 194946
  Payload ID: 18499
  Gene Name: tripartite motif containing 39
  Uniprot ID: Q9HCM9
  ENST ID: ENST00000440117
  CDS Start-End: 313-1779

SEQ ID NO: 194961 - DNA, 427 bp, Homo sapiens; identical to SEQ ID NO: 194958
  Payload ID: 18499
  Gene Name: tripartite motif containing 39
  ENST ID: ENST00000429069
  CDS Start-End: 250-427

SEQ ID NO: 194962 - DNA, 3198 bp, Homo sapiens
  Payload ID: 18499
  Gene Name: tripartite motif containing 39
  Uniprot ID: Q9HCM9
  ENST ID: ENST00000451132
  CDS Start-End: 262-1728
gcgaggggaggaggaaggagggaggcagcgctccggcggctccgcgccccgcactcccggacccgaagccgggaagatccgtcctggtgccttactgtgcatacagttctactcgtctcagaaacgtatgtcaaacgaggatacagtgtctggaactattggttctaagatataagtggaatgagcctggatcaggagaagtatgctgagctagagttgaaggaagcttctctttctaacaagagaaagcagagttaaattatggcagagacaagtctgttagaggctggggcctctgcagcctctacagctgcggctttggagaacttacaggtggaggcgagctgctctgtgtgcctggagtatctgaaggaacctgtcatcattgagtgtgggcacaacttctgcaaagcttgcatcacccgctggtgggaggacctagagagggacttcccttgtcctgtctgtcgaaagacatcccgctaccgcagtctccgacctaatcggcaactaggcagtatggtggaaattgccaagcagctccaggccgtcaagcggaagatccgggatgagagcctctgcccccaacaccatgaggccctcagccttttctgttatgaggaccaggaggctgtatgcttgatatgtgcaatttcccacacccaccgggcccacaccgttgtgccactggacgacgctacacaggagtacaaggaaaaactgcagaagtgtctggagcccctggaacagaagctgcaggagatcactcgctgcaagtcctctgaggagaagaagcctggtgagctcaagagactagtggaaagtcgccgacagcagatcttgagggagtttgaagagcttcataggcggctggatgaagagcagcaggtgttgctttcacgactggaagaagaggaacaggacattctgcagcgactccgagaaaatgctgctcaccttggggacaagcgccgggacctggcccacttggctgccgaggtggagggcaagtgcttacagtcaggcttcgagatgcttaaggatgtcaaaagtaccctggaaaaatgtgaaaaggtgaagaccatggaggtgacttcagtatccatagagctggaaaagaacttcagcaattttccccgacagtactttgccctaaggaaaatccttaaacagctaattgcggatgtgaccctggaccccgagacagctcatcctaacctagtcctgtcagaggatcgtaagagcgtcaagttcgtggagacaagactccgggatctccctgacacaccaaggcgtttcaccttctacccttgcgtcctggctactgagggtttcacctcaggtcgacactactgggaggtggaggtgggcgacaagacccactgggcagtgggtgtatgccgggactccgtgagccgaaagggcgagttgactccactccctgagactggctactggcgggtgcggctatggaatggggacaaatatgcagccaccaccacaccttttacccctttgcacatcaaggtgaaacccaagcgggtaggcatattcctagactatgaggccggcacactgtctttctacaatgtcacagaccgctctcatatctacaccttcactgatacttttactgagaaactttggcccctcttctacccaggcatccgggctggacggaagaatgctgcaccacttaccatcaggcccccaacagattgggagtgacaggttgggatgtgggaatgactggggtgaggcagggtcaagtgctacgggcctccttcccgtgtcctgctggaacgtcttcgtgtccacctgggtccagtcctgaatcatcttggagaaacaccttggtttctaggatggttttgtgtggagggggaggtaggactgggctggatgagagagcacagctgtgacttcctcctaactgtcagggtggggagctggttcccagaggattgtctaccctgaagtccatcaggttttctgttgcacaaggacgggtcaggaaggaaggagaggcttttccagaaacaaaaaatctgtgagggtctgacttgctcaaaccagaggaggaaacagaaacccctgcacatctttttagggggttctttgacccaggatagtcttgcttcttgaggtagatcacaggggtctgtgtacctctgaattcatgagagatgaatgacagatgctctcatgggtctagatattgaggagtttttctgagggcagagattggacatcaacaaggctagaagggtcagggaagtgggctaaaggaacagattcctagagattaatgaagaggagggaggtttctttggtcttctattccaagggtaaggttgcgattatgggtaagattggccagaggtaggaatgtggggagaaggagaggctgaaaagaaagcagaggagaacccaggtccctgcctcagccttcagcagagttggcttattgcctgcctctataccaataagtcagtcaccttgctcctctccagaggcaaagtggaagagatcctgcaagacacatctatcctttcacagtgttcccaagggaacttggaaaggagagtcaggtattagaggaaagagaagggtatttgtatacaaagccctggccttaaagaatgttacttagtagctactcccaaattgtcagccttcttacctggccaaggtgtccaagccagaaaggaaaaaaggttatggagtctttctcaccctaaggacagggtggaagagggtggtatatagggaagggccagataggcaacttcatttggcttgtgtgcatctggcctggaactggtgttaagccaggcttttgcttgtttgttgccatccctcaccctttgccatttcccttttcagagaatgtaaatgattttcatgttaggccaaaataaacaacttatagggtacatatgttgtcataaaaggtaaaagtgatgcatgccaaaccaaactaaaccaatttggattatctgctattcgggtaatcttcacagaaatgactgagagaagaatctgcagtttactgagggcatttcagttcctcctaccacctcaacaggactttgtccagactctcctcctcttacctttgtgccttgactgtggttctttgtggcaagatactttggttggttaaaataatatggaacaaaggatccactgaagtga

SEQ ID NO: 194963 - DNA, 1003 bp, Homo sapiens
  Payload ID: 18499
  Gene Name: tripartite motif containing 39
  ENST ID: ENST00000456425
  CDS Start-End: 570-1003
gaagagaggaaaagtgtggaagtccacaagccgcccccgccccgccctcttcgtcgactttcagctgcaccgggaggcggcggcgcctggccagagccggggcctggagcctggactagacagcctcgccggccggggcgccagtccagcgccctgcgggcaatgggcttcagcgctcgagcacgcgcatgcgcgggcctgtatctccagaggattcctcgggtcacctggacgccagcatctcagccacctgcccctctgggtcccttcttgcccttgattccccctgctgcttctcatcgccagccctcctcctccttcttccgcaggcaccgctagacccggccgcggccgcccgccgacaccccagcttccactgacacgagcctcggcgcggcttccgcttccgattcctttcttgtctgttagaaacgtatgtcaaacgaggatacagtgtctggaactattggttctaagatataagtggaatgagcctggatcaggagaagtatgctgagctagagttgaaggaagcttctctttctaacaagagaaagcagagttaaattatggcagagacaagtctgttagaggctggggcctctgcagcctctacagctgcggctttggagaacttacaggtggaggcgagctgctctgtgtgcctggagtatctgaaggaacctgtcatcattgagtgtgggcacaacttctgcaaagcttgcatcacccgctggtgggaggacctagagagggacttcccttgtcctgtctgtcgaaagacatcccgctaccgcagtctccgacctaatcggcaactaggcagtatggtggaaattgccaagcagctccaggccgtcaagcggaagatccgggatgagagcctctgcccccaacaccatgaggccctcagccttttctgttatgaggaccaggaggctgtatgcttgatatgtgcaatttcccacacccaccgggcccacaccgttgtgccactggacga

SEQ ID NO: 194964 - DNA, 588 bp, Homo sapiens; identical to SEQ ID NO: 194955
  Payload ID: 18499
  Gene Name: tripartite motif containing 39
  ENST ID: ENST00000440271
  CDS Start-End: 367-588

SEQ ID NO: 194965 - DNA, 588 bp, Homo sapiens; identical to SEQ ID NO: 194955
  Payload ID: 18499
  Gene Name: tripartite motif containing 39
  ENST ID: ENST00000426676
  CDS Start-End: 367-588

SEQ ID NO: 194966 - DNA, 3535 bp, Homo sapiens; identical to SEQ ID NO: 194940
  Payload ID: 18499
  Gene Name: tripartite motif containing 39
  Uniprot ID: Q9HCM9
  ENST ID: ENST00000431272
  CDS Start-End: 599-2065

SEQ ID NO: 194967 - DNA, 3187 bp, Homo sapiens; identical to SEQ ID NO: 194944
  Payload ID: 18499
  Gene Name: tripartite motif containing 39
  Uniprot ID: Q9HCM9
  ENST ID: ENST00000426469
  CDS Start-End: 161-1717

SEQ ID NO: 194968 - DNA, 427 bp, Homo sapiens; identical to SEQ ID NO: 194958
  Payload ID: 18499
  Gene Name: tripartite motif containing 39
  ENST ID: ENST00000424180
  CDS Start-End: 250-427

SEQ ID NO: 194969 - DNA, 459 bp, Homo sapiens; identical to SEQ ID NO: 194951
  Payload ID: 18499
  Gene Name: tripartite motif containing 39
  ENST ID: ENST00000428555
  CDS Start-End: 315-459

SEQ ID NO: 194970 - DNA, 3187 bp, Homo sapiens; identical to SEQ ID NO: 194944
  Payload ID: 18499
  Gene Name: tripartite motif containing 39
  Uniprot ID: Q9HCM9
  ENST ID: ENST00000451715
  CDS Start-End: 161-1717

SEQ ID NO: 194971 - DNA, 459 bp, Homo sapiens; identical to SEQ ID NO: 194951
  Payload ID: 18499
  Gene Name: tripartite motif containing 39
  ENST ID: ENST00000421662
  CDS Start-End: 315-459

SEQ ID NO: 194972 - DNA, 427 bp, Homo sapiens; identical to SEQ ID NO: 194958
  Payload ID: 18499
  Gene Name: tripartite motif containing 39
  ENST ID: ENST00000441470
  CDS Start-End: 250-427

SEQ ID NO: 194973 - DNA, 3198 bp, Homo sapiens; identical to SEQ ID NO: 194945
  Payload ID: 18499
  Gene Name: tripartite motif containing 39
  Uniprot ID: Q9HCM9
  ENST ID: ENST00000430502
  CDS Start-End: 262-1728

SEQ ID NO: 194974 - DNA, 588 bp, Homo sapiens; identical to SEQ ID NO: 194955
  Payload ID: 18499
  Gene Name: tripartite motif containing 39
  ENST ID: ENST00000418057
  CDS Start-End: 367-588

SEQ ID NO: 194975 - DNA, 708 bp, Homo sapiens; identical to SEQ ID NO: 194949
  Payload ID: 18499
  Gene Name: tripartite motif containing 39
  ENST ID: ENST00000438168
  CDS Start-End: 1-683

SEQ ID NO: 194976 - DNA, 708 bp, Homo sapiens
  Payload ID: 18499
  Gene Name: tripartite motif containing 39
  ENST ID: ENST00000425693
  CDS Start-End: 1-683
agacatcccgctaccgcagtctccgacctaatcggcaactaggcagtatggtggaaattgccaagcagctccaggccgtcaagcggaagatccgggatgagagcctctgcccccaacaccatgaggccctcagccttttctgttatgaggaccaggaggctgtatgcttgatatgtgcaatttcccacacccaccgggcccacaccgttgtgccactggacgacgctacacaggagtacaaggaaaaactgcagaagtgtctggagcccctggaacagaagctgcaggagatcactcgctgcaagtcctctgaggagaagaagcctggtgagctcaagagactagtggaaagtcgccgacagcagatcttgagggagtttgaagagcttcataggcggctggatgaagagcagcaggtgttgctttcacgactggaagaagaggaacaggacattctgcagcgactccgagaaaatgctgctcaccttggggacaagcgccgggacctggcccacttggctgccgaggtggagggcaagtgcttacagtcaggcttcgagatgcttaaggatgtcaaaagtaccctggaaaaatgtgaaaaggtgaagaccatggaggtgacttcaactacaccttgtacttctctacatagtgagataaatgataatgtcagagggagatgaagagaggaccaggcgggaacctaga

SEQ ID NO: 194977 - DNA, 1003 bp, Homo sapiens
  Payload ID: 18499
  Gene Name: tripartite motif containing 39
  ENST ID: ENST00000424571
  CDS Start-End: 570-1003
gaagagaggaaaagtgtggaagtccacaagccgcccccgccccgccctcttcgtcgactttcagctgcaccgggaggcggcggcgcctggccagagccggggcctggagcctggactagacagcctcgccggccggggcgccagtccagcgccctgcgggcaatgggcttcagcgctcgagcacgcgcatgcgcgggcctgtatctccagaggattcctcgggtcacctggacgccagcatctcagccacctgcccctctgggtcccttcttgcccttgattccccctgctgcttctcatcgccagccctcctcctccttcttccgcaggcaccactagacccggccgcggccgcccgccgacaccccagcttccactgacacgagcctcggcgcggcttccgcttccgattcctttcttgtctgttagaaacgtatgtcaaacgaggatacagtgtctggaactattggttctaagatataagtggaatgagcctggatcaggagaagtatgctgagctagagttgaaggaagcttctctttctaacaagagaaagcagagttaaattatggcagagacaagtctgttagaggctggggcctctgcagcctctacagctgcggctttggagaacttacaggtggaggcgagctgctctgtgtgcctggagtatctgaaggaacctgtcatcattgagtgtgggcacaacttctgcaaagcttgcatcacccgctggtgggaggacctagagagggacttcccttgtcctgtctgtcgaaagacatcccgctaccgcagtctccgacctaatcggcaactaggcagtatggtggaaattgccaagcagctccaggccgtcaagcggaagatccgggatgagagcctctgcccccaacaccatgaggccctcagccttttctgttatgaggaccaggaggctgtatgcttgatatgtgcaatttcccacacccaccgggctcacaccgttgtgccactggacga

SEQ ID NO: 194978 - DNA, 1013 bp, Homo sapiens
  Payload ID: 18499
  Gene Name: tripartite motif containing 39
  ENST ID: ENST00000447077
  CDS Start-End: 232-1013
cgccgcggggcgggggcgaggggaggaggaaggagggaggcagcgctccggcggctccgcgccccgcactcccggacccgaagccgggaagaaacgtatgtcaaacgaggatacagtgtctggaactattggttctaagatataagtggaatgagcctggatcaggagaagtatgctgagctagagttgaaggaagcttctctttctaacaagagaaagcagagttaaattatggcagagacaagtctgttagaggctggggcctctgcagcctctacagctgcggctttggagaacttacaggtggaggcgagctgctctgtgtgcctggagtatctgaaggaacctgtcatcattgagtgtgggcacaacttctgcaaagcttgcatcacccgctggtgggaggacctagagagggacttcccttgtcctgtctgtcgaaagacatcccgctaccgcagtctccgacctaatcggcaactaggcagtatggtggaaattgccaagcagctccaggccgtcaagcggaagatccgggatgagagcctctgcccccaacaccatgaggccctcagccttttctgttatgaggaccaggaggctgtatgcttgatatgtgcaatttcccacacccaccgggctcacaccgttgtgccactggacgatgctacacaggagtacaaggaaaaactgcagaagtgtctggagcccctggaacagaagctgcaggagatcactcgctgcaagtcctctgaggagaagaagcctggtgagctcaagagactagtggaaagtcgccgacagcagatcttgagggagtttgaagagcttcataggcggctggatgaagagcagcaggtgttgctttcacgactggaagaagaggaacaggacattctgcagcgactccgagaaaatgctgctcaccttggggacaagcgccgggacctggcccacttggctgccgaggtggagggcaagtgcttacagtcaggcttcgagatgcttaaggt

SEQ ID NO: 194979 - DNA, 3535 bp, Homo sapiens; identical to SEQ ID NO: 194940
  Payload ID: 18499
  Gene Name: tripartite motif containing 39
  Uniprot ID: Q9HCM9
  ENST ID: ENST00000414015
  CDS Start-End: 599-2065

SEQ ID NO: 194980 - DNA, 588 bp, Homo sapiens; identical to SEQ ID NO: 194955
  Payload ID: 18499
  Gene Name: tripartite motif containing 39
  ENST ID: ENST00000438089
  CDS Start-End: 367-588

SEQ ID NO: 194981 - DNA, 3535 bp, Homo sapiens; identical to SEQ ID NO: 194940
  Payload ID: 18499
  Gene Name: tripartite motif containing 39
  Uniprot ID: Q9HCM9
  ENST ID: ENST00000419790
  CDS Start-End: 599-2065

SEQ ID NO: 194982 - DNA, 588 bp, Homo sapiens; identical to SEQ ID NO: 194955
  Payload ID: 18499
  Gene Name: tripartite motif containing 39
  ENST ID: ENST00000450818
  CDS Start-End: 367-588

SEQ ID NO: 194983 - DNA, 459 bp, Homo sapiens; identical to SEQ ID NO: 194951
  Payload ID: 18499
  Gene Name: tripartite motif containing 39
  ENST ID: ENST00000422419
  CDS Start-End: 315-459

SEQ ID NO: 194984 - DNA, 427 bp, Homo sapiens; identical to SEQ ID NO: 194958
  Payload ID: 18499
  Gene Name: tripartite motif containing 39
  ENST ID: ENST00000434862
  CDS Start-End: 250-427

SEQ ID NO: 194985 - DNA, 3249 bp, Homo sapiens; identical to SEQ ID NO: 194946
  Payload ID: 18499
  Gene Name: tripartite motif containing 39
  Uniprot ID: Q9HCM9
  ENST ID: ENST00000458607
  CDS Start-End: 313-1779

SEQ ID NO: 194986 - DNA, 3198 bp, Homo sapiens; identical to SEQ ID NO: 194945
  Payload ID: 18499
  Gene Name: tripartite motif containing 39
  Uniprot ID: Q9HCM9
  ENST ID: ENST00000449318
  CDS Start-End: 262-1728

SEQ ID NO: 194987 - DNA, 459 bp, Homo sapiens; identical to SEQ ID NO: 194951
  Payload ID: 18499
  Gene Name: tripartite motif containing 39
  ENST ID: ENST00000418079
  CDS Start-End: 315-459

SEQ ID NO: 194988 - DNA, 427 bp, Homo sapiens; identical to SEQ ID NO: 194958
  Payload ID: 18499
  Gene Name: tripartite motif containing 39
  ENST ID: ENST00000428404
  CDS Start-End: 250-427

SEQ ID NO: 194989 - DNA, 1003 bp, Homo sapiens; identical to SEQ ID NO: 194963
  Payload ID: 18499
  Gene Name: tripartite motif containing 39
  ENST ID: ENST00000458516
  CDS Start-End: 570-1003

SEQ ID NO: 194990 - DNA, 1013 bp, Homo sapiens; identical to SEQ ID NO: 194952
  Payload ID: 18499
  Gene Name: tripartite motif containing 39
  ENST ID: ENST00000428728
  CDS Start-End: 232-1013

SEQ ID NO: 194991 - DNA, 1003 bp, Homo sapiens; identical to SEQ ID NO: 194963
  Payload ID: 18499
  Gene Name: tripartite motif containing 39
  ENST ID: ENST00000430414
  CDS Start-End: 570-1003

SEQ ID NO: 194992 - DNA, 708 bp, Homo sapiens; identical to SEQ ID NO: 194949
  Payload ID: 18499
  Gene Name: tripartite motif containing 39
  ENST ID: ENST00000426384
  CDS Start-End: 1-683

SEQ ID NO: 194993 - DNA, 588 bp, Homo sapiens; identical to SEQ ID NO: 194955
  Payload ID: 18499
  Gene Name: tripartite motif containing 39
  ENST ID: ENST00000447542
  CDS Start-End: 367-588

SEQ ID NO: 194994 - DNA, 1003 bp, Homo sapiens; identical to SEQ ID NO: 194963
  Payload ID: 18499
  Gene Name: tripartite motif containing 39
  ENST ID: ENST00000453856
  CDS Start-End: 570-1003

SEQ ID NO: 194995 - DNA, 459 bp, Homo sapiens; identical to SEQ ID NO: 194951
  Payload ID: 18499
  Gene Name: tripartite motif containing 39
  ENST ID: ENST00000450170
  CDS Start-End: 315-459

SEQ ID NO: 194996 - DNA, 1013 bp, Homo sapiens; identical to SEQ ID NO: 194952
  Payload ID: 18499
  Gene Name: tripartite motif containing 39
  ENST ID: ENST00000440130
  CDS Start-End: 232-1013

SEQ ID NO: 194997 - DNA, 708 bp, Homo sapiens; identical to SEQ ID NO: 194949
  Payload ID: 18499
  Gene Name: tripartite motif containing 39
  ENST ID: ENST00000412022
  CDS Start-End: 1-683

SEQ ID NO: 194998 - DNA, 3187 bp, Homo sapiens; identical to SEQ ID NO: 194944
  Payload ID: 18499
  Gene Name: tripartite motif containing 39
  Uniprot ID: Q9HCM9
  ENST ID: ENST00000424575
  CDS Start-End: 161-1717

SEQ ID NO: 194999 - DNA, 1003 bp, Homo sapiens; identical to SEQ ID NO: 194963
  Payload ID: 18499
  Gene Name: tripartite motif containing 39
  ENST ID: ENST00000411711
  CDS Start-End: 570-1003

SEQ ID NO: 195000 - DNA, 3249 bp, Homo sapiens
  Payload ID: 18499
  Gene Name: tripartite motif containing 39
  Uniprot ID: Q9HCM9
  ENST ID: ENST00000438859
  CDS Start-End: 313-1779
cccagcttccactgacacgagcctcggcgcggcttccgcttccggcgagtattgtgtgtcgcgccgcggggcgggggcgaggggaggaggaaggagggaggcagcgctccggcggctccgcgccccgcactcccggacccgaagccgggaagattcctttcttgtctgttagaaacgtatgtcaaacgaggatacagtgtctggaactattggttctaagatataagtggaatgagcctggatcaggagaagtatgctgagctagagttgaaggaagcttctctttctaacaagagaaagcagagttaaattatggcagagacaagtctgttagaggctggggcctctgcagcctctacagctgcggctttggagaacttacaggtggaggcgagctgctctgtgtgcctggagtatctgaaggaacctgtcatcattgagtgtgggcacaacttctgcaaagcttgcatcacccgctggtgggaggacctagagagggacttcccttgtcctgtctgtcgaaagacatcccgctaccgcagtctccgacctaatcggcaactaggcagtatggtggaaattgccaagcagctccaggccgtcaagcggaagatccgggatgagagcctctgcccccaacaccatgaggccctcagccttttctgttatgaggaccaggaggctgtatgcttgatatgtgcaatttcccacacccaccgggcccacaccgttgtgccactggacgacgctacacaggagtacaaggaaaaactgcagaagtgtctggagcccctggaacagaagctgcaggagatcactcgctgcaagtcctctgaggagaagaagcctggtgagctcaagagactagtggaaagtcgccgacagcagatcttgagggagtttgaagagcttcataggcggctggatgaagagcagcaggtgttgctttcacgactggaagaagaggaacaggacattctgcagcgactccgagaaaatgctgctcaccttggggacaagcgccgggacctggcccacttggctgccgaggtggagggcaagtgcttacagtcaggcttcgagatgcttaaggatgtcaaaagtaccctggaaaaatgtgaaaaggtgaagaccatggaggtgacttcagtatccatagagctggaaaagaacttcagcaattttccccgacagtactttgccctaaggaaaatccttaaacagctaattgcggatgtgaccctggaccccgagacagctcatcctaacctagtcctgtcagaggatcgtaagagcgtcaagttcgtggagacaagactccgggatctccctgacacaccaaggcgtttcaccttctacccttgcgtcctggctactgagggtttcacctcaggtcgacactactgggaggtggaggtgggcgacaagacccactgggcagtgggtgtatgccgggactccgtgagccgaaagggcgagttgactccactccctgagactggctactggcgggtgcggctatggaatggggacaaatatgcagccaccaccacaccttttacccctttgcacatcaaggtgaaacccaagcgggtaggcatattcctagactatgaggccggcacactgtctttctacaatgtcacagaccgctctcatatctacaccttcactgatacttttactgagaaactttggcccctcttctacccaggcatccgggctggacggaagaatgctgcaccacttaccatcaggcccccaacagattgggagtgacaggttgggatgtgggaatgactggggtgaggcagggtcaagtgctacgggcctccttcccgtgtcctgctggaacgtcttcgtgtccacctgggtccagtcctgaatcatcttggagaaacaccttggtttctaggatggttttgtgtggagggggaggtaggactgggctggatgagagagcacagctgtgacttcctcctaactgtcagggtggggagctggttcccagaggattgtctaccctgaagtccatcaggttttctgttgcacaaggacgggtcaggaaggaaggagaggcttttccagaaacaaaaaatctgtgagggtctgacttgctcaaaccagaggaggaaacagaaacccctgcacatctttttagggggttctttgacccaggatagtcttgcttcttgaggtagatcacaggggtctgtgtacctctgaattcatgagagatgaatgacagatgctctcatgggtctagatattgaggagtttttctgagggcagagattggacatcaacaaggctagaagggtcagggaagtgggctaaaggaacagattcctagagattaatgaagaggagggaggtttctttggtcttctattccaagggtaaggttgcgattatgggtaagattggccagaggtaggaatgtggggagaaggagaggctgaaaagaaagcagaggagaacccaggtccctgcctcagccttcagcagagttggcttattgcctgcctctataccaataagtcagtcaccttgctcctctccagaggcaaagtggaagagatcctgcaagacacatctatcctttcacagtgttcccaagggaacttggaaaggagagtcaggtattagaggaaagagaagggtatttgtatacaaagccctggccttaaagaatgttacttagtagctactcccaaattgtcagccttcttacctggccaaggtgtccaagccagaaaggaaaaaaggttatggagtctttctcaccctaaggacagggtggaagagggtggtatatagggaagggccagataggcaacttcatttggcttgtgtgcatctggcctggaactggtgttaagccaggcttttgcttgtttgttgccatccctcaccctttgccatttcccttttcagagaatgtaaatgattttcatgttaggccaaaataaacaacttatagggtacatatgttgtcataaaaggtaaaagtgatgcatgccaaaccaaactaaaccaatttggattatctgctattcgggtaatcttcacagaaatgactgagagaagaatctgcagtttactgagggcatttcagttcctcctaccacctcaacaggactttgtccagactctcctcctcttacctttgtgccttgactgtggttctttgtggcaagatactttggttggttaaaataatatggaacaaaggatccactgaagtga

SEQ ID NO: 195001 - DNA, 3187 bp, Homo sapiens; identical to SEQ ID NO: 194944
  Payload ID: 18499
  Gene Name: tripartite motif containing 39
  Uniprot ID: Q9HCM9
  ENST ID: ENST00000413715
  CDS Start-End: 161-1717

SEQ ID NO: 195002 - DNA, 3198 bp, Homo sapiens; identical to SEQ ID NO: 194945
  Payload ID: 18499
  Gene Name: tripartite motif containing 39
  Uniprot ID: Q9HCM9
  ENST ID: ENST00000446397
  CDS Start-End: 262-1728

SEQ ID NO: 195003 - DNA, 427 bp, Homo sapiens; identical to SEQ ID NO: 194958
  Payload ID: 18499
  Gene Name: tripartite motif containing 39
  ENST ID: ENST00000434118
  CDS Start-End: 250-427

SEQ ID NO: 195004 - DNA, 3198 bp, Homo sapiens; identical to SEQ ID NO: 194945
  Payload ID: 18499
  Gene Name: tripartite motif containing 39
  Uniprot ID: Q9HCM9
  ENST ID: ENST00000443109
  CDS Start-End: 262-1728

SEQ ID NO: 195005 - DNA, 3249 bp, Homo sapiens; identical to SEQ ID NO: 194946
  Payload ID: 18499
  Gene Name: tripartite motif containing 39
  Uniprot ID: Q9HCM9
  ENST ID: ENST00000452705
  CDS Start-End: 313-1779

SEQ ID NO: 195006 - DNA, 1013 bp, Homo sapiens; identical to SEQ ID NO: 194952
  Payload ID: 18499
  Gene Name: tripartite motif containing 39
  ENST ID: ENST00000449396
  CDS Start-End: 232-1013

SEQ ID NO: 195007 - DNA, 1003 bp, Homo sapiens; identical to SEQ ID NO: 194963
  Payload ID: 18499
  Gene Name: tripartite motif containing 39
  ENST ID: ENST00000416213
  CDS Start-End: 570-1003

SEQ ID NO: 195008 - DNA, 459 bp, Homo sapiens; identical to SEQ ID NO: 194951
  Payload ID: 18499
  Gene Name: tripartite motif containing 39
  ENST ID: ENST00000426443
  CDS Start-End: 315-459

SEQ ID NO: 195009 - DNA, 1013 bp, Homo sapiens; identical to SEQ ID NO: 194952
  Payload ID: 18499
  Gene Name: tripartite motif containing 39
  ENST ID: ENST00000450421
  CDS Start-End: 232-1013

SEQ ID NO: 195010 - DNA, 1567 bp, Homo sapiens
  Payload ID: 18499
  Gene Name: tripartite motif containing 39
  ENST ID: ENST00000552257
  CDS Start-End: 8-1519
ttaaattatggcagagacaagtctgttagaggctggggcctctgcagcctctacagctgcggctttggagaacttacaggtggaggcgagctgctctgtgtgcctggagtatctgaaggaacctgtcatcattgagtgtgggcacaacttctgcaaagcttgcatcacccgctggtgggaggacctagagagggacttcccttgtcctgtctgtcgaaagacatcccgctaccgcagtctccgacctaatcggcaactaggcagtatggtggaaattgccaagcagctccaggccgtcaagcggaagatccgggatgagagcctctgcccccaacaccatgaggccctcagccttttctgttatgaggaccaggaggctgtatgcttgatatgtgcaatttcccacacccaccgggcccacaccgttgtgccactggacgatgctacacaggagtacaaggaaaaactgcagaagtgtctggagcccctggaacagaagctgcaggagatcactcgctgcaagtcctctgaggagaagaagcctggtgagctcaagagactagtggaaagtcgccgacagcagatcttgagggagtttgaagagcttcataggcggctggatgaagagcagcaggtgttgctttcacgactggaagaagaggaacaggacattctgcagcgactccgagaaaatgctgctcaccttggggacaagcgccgggacctggcccacttggctgccgaggtggagggcaagtgcttacagtcaggcttcgagatgcttaaggatgtcaaaagtaccctggaaaaatgtgaaaaggtgaagaccatggaggtgacttcagtatccatagagctggaaaagaacttcagcaattttccccgacagtactttgccctaaggaaaatccttaaacagctaattgcggatgtgaccctggaccctgagacagctcatcctaacctagtcctgtcagaggatcgtaagagcgtcaagttcgtggagacaagactccgggatctccctgacacaccaaggcgtttcaccttctacccttgcgtcctggctactgagggtttcacctcaggtcgacactactgggaggtggaggccgcccattgtgtccttgcccaggaccccgagaaccaggcgctggcgaggttttactgctacactgagaggaccattgcgaagcggctcgtcttgcggcgagatccctcggtgaagaggactctctgtcgaggctgctcttccctcctcgtcccgggcctcacctgcacccagcgccagagacgctgcaggggacagcgctggaccgtacagacctgcctaacatgccagcgcagccaacgcttcctcaatgatcccgggcatttactctggggagacaggcctgaggcccagctcgggagccaagcagattccaaaccactacaacccttgccaaacacagcccactccatttcagaccgccttcctgaggagaaaatgcagactcagggttccagtaaccagtgatggattcaccccatctcccaaataaagtttacttgttttacattccat

SEQ ID NO: 195011 - DNA, 1567 bp, Homo sapiens
  Payload ID: 18499
  Gene Name: tripartite motif containing 39
  ENST ID: ENST00000552950
  CDS Start-End: 8-1519
ttaaattatggcagagacaagtctgttagaggctggggcctctgcagcctctacagctgcggctttggagaacttacaggtggaggcgagctgctctgtgtgcctggagtatctgaaggaacctgtcatcattgagtgtgggcacaacttctgcaaagcttgcatcacccgctggtgggaggacctagagagggacttcccttgtcctgtctgtcgaaagacatcccgctaccgcagtctccgacctaatcggcaactaggcagtatggtggaaattgccaagcagctccaggccgtcaagcggaagatccgggatgagagcctctgcccccaacaccatgaggccctcagccttttctgttatgaggaccaggaggctgtatgcttgatatgtgcaatttcccacacccaccgggcccacaccgttgtgccactggacgatgctacacaggagtacaaggaaaaactgcagaagtgtctggagcccctggaacagaagctgcaggagatcactcgctgcaagtcctctgaggagaagaagcctggtgagctcaagagactagtggaaagtcgccgacagcagatcttgagggagtttgaagagcttcataggcggctggatgaagagcagcaggtgttgctttcacgactggaagaagaggaacaggacattctgcagcgactccgagaaaatgctgctcaccttggggacaagcgccgggacctggcccacttggctgccgaggtggagggcaagtgcttacagtcaggcttcgagatgcttaaggatgtcaaaagtaccctggaaaaatgtgaaaaggtgaagaccatggaggtgacttcagtatccatagagctggaaaagaacttcagcaattttccccgacagtactttgccctaaggaaaatccttaaacagctaattgcggatgtgaccctggaccctgagacagctcatcctaacctagtcctgtcagaggatcgtaagagcgtcaagttcgtggagacaagactccgggatctccctgacacaccaaggcgtttcaccttctacccttgcgtcctggctactgagggtttcacctcaggtcgacactactgggaggtggaggccgcccattgtgtccttgcccaggaccccgagaaccaggcgctggcgaggttttactgctacactgagaggaccattgcgaagcggctcgtcttgcggcgggatccctcggtgaagaggactctctgtcgaggctgctcttccctcctcgtcccgggcctcacctgcacccagcgccagagacgctgcaggggacagcgctggaccgtacagacctgcctaacatgccagcgcagccaacgcttcctcaatgatcccgggcatttactctggggagacaggcctgaggcccagctcgggagccaagcagattccaaaccactacaacccttgccaaacacagcccactccatttcagaccgccttcctgaggagaaaatgcagactcagggttccagtaaccagtgatggattcaccccatctcccaaataaagtttacttgttttacattccat

SEQ ID NO: 195012 - DNA, 1567 bp, Homo sapiens
  Payload ID: 18499
  Gene Name: tripartite motif containing 39
  ENST ID: ENST00000550618
  CDS Start-End: 8-1519
ttaaattatggcagagacaagtctgttagaggctggggcctctgcagcctctacagctgcggctttggagaacttacaggtggaggcgagctgctctgtgtgcctggagtatctgaaggaacctgtcatcattgagtgtgggcacaacttctgcaaagcttgcatcacccgctggtgggaggacctagagagggacttcccttgtcctgtctgtcgaaagacatcccgctaccgcagtctccgacctaatcggcaactaggcagtatggtggaaattgccaagcagctccaggccgtcaagcggaagatccgggatgagagcctctgcccccaacaccatgaggccctcagccttttctgttatgaggaccaggaggctgtatgcttgatatgtgcaatttcccacacccaccgggctcacaccgttgtgccactggacgatgctacacaggagtacaaggaaaaactgcagaagtgtctggagcccctggaacagaagctgcaggagatcactcgctgcaagtcctctgaggagaagaagcctggtgagctcaagagactagtggaaagtcgccgacagcagatcttgagggagtttgaagagcttcataggcggctggatgaagagcagcaggtgttgctttcacgactggaagaagaggaacaggacattctgcagcgactccgagaaaatgctgctcaccttggggacaagcgccgggacctggcccacttggctgccgaggtggagggcaagtgcttacagtcaggcttcgagatgcttaaggatgtcaaaagtaccctggaaaaatgtgaaaaggtgaagaccatggaggtgacttcagtatccatagagctggaaaagaacttcagcaattttccccgacagtactttgccctaaggaaaatccttaaacagctaattgcggatgtgaccctggaccctgagacagctcatcctaacctagtcctgtcagaggatcgtaagagcgtcaagttcgtggagacaagactccgggatctccctgacacaccaaggcgtttcaccttctacccttgcgtcctggctactgagggtttcacctcaggtcgacactactgggaggtggaggccgcccattgtgtccttgcccaggaccccgagaaccaggcgctggcgaggttttactgctacactgagaggaccattgcgaagcggctcgtcttgcggcgggatccctcggtgaagaggactctctgtcgaggctgctcttccctcctcgtcccgggcctcacctgcacccaccgccagagacgctgcaggggacagcgctggaccgtacagacctgcctaacatgccagcgcagccaacgcttcctcaatgatcccgggcatttactctggggagacaggcctgaggcccagctcgggagccaagcagattccaaaccactacaacccttgccaaacacagcccactccatttcagaccgccttcctgaggagaaaatgcagactcagggttccagtaaccagtgatggattcaccccatctcccaaataaagtttacttgttttacattccat

SEQ ID NO: 195013 - DNA, 3338 bp, Homo sapiens; identical to SEQ ID NO: 194939
  Payload ID: 18499
  Gene Name: tripartite motif containing 39
  Uniprot ID: Q9HCM9
  ENST ID: ENST00000548002
  CDS Start-End: 313-1869

SEQ ID NO: 195014 - DNA, 1567 bp, Homo sapiens
  Payload ID: 18499
  Gene Name: tripartite motif containing 39
  ENST ID: ENST00000550581
  CDS Start-End: 8-1519
ttaaattatggcagagacaagtctgttagaggctggggcctctgcagcctctacagctgcggctttggagaacttacaggtggaggcgagctgctctgtgtgcctggagtatctgaaggaacctgtcatcattgagtgtgggcacaacttctgcaaagcttgcatcacccgctggtgggaggacctagagagggacttcccttgtcctgtctgtcgaaagacatcccgctaccgcagtctccgacctaatcggcaactaggcagtatggtggaaattgccaagcagctccaggccgtcaagcggaagatccgggatgagagcctctgcccccaacaccatgaggccctcagccttttctgttatgaggaccaggaggctgtatgcttgatatgtgcaatttcccacacccaccgggcccacaccgttgtgccactggacgatgctacacaggagtacaaggaaaaactgcagaagtgtctggagcccctggaacagaagctgcaggagatcactcgctgcaagtcctctgaggagaagaagcctggtgagctcaagagactagtggaaagtcgccgacagcagatcttgagggagtttgaagagcttcataggcggctggatgaagagcagcaggtgttgctttcacgactggaagaagaggaacaggacattctgcagcgactccgagaaaatgctgctcaccttggggacaagcgccgggacctggcccacttggctgccgaggtggagggcaagtgcttacagtcaggcttcgagatgcttaaggatgtcaaaagtaccctggaaaaatgtgaaaaggtgaagaccatggaggtgacttcagtatccatagagctggaaaagaacttcagcaattttccccgacagtactttgccctaaggaaaatccttaaacagctaattgcggatgtgaccctggaccctgagacagctcatcctaacctagtcctgtcagaggatcgtaagagcgtcaagttcgtggagacaagactccgggatctccctgacacaccaaggcgtttcaccttctacccttgcgtcctggctactgagggtttcacctcaggtcgacactactgggaggtggaggccgcccattgtgtccttgcccaggaccccgagaaccaggcgctggcgaggttttactgctacactgagaggaccattgcgaagcggctcgtcttgcggcgggatccctcggtgaagaggactctctgtcgaggctgctcttccctcctcgtcccgggcctcacctgcacccaccgccagagacgctgcaggggacagcgctggaccgtacagacctgcctaacatgccagcgcagccaacgcttcctcaatgatcccgggcatttactctggggagacaggcctgaggcccagctcgggagccaagcagattccaaaccactacaacccttgccaaacacagcccactccatttcagaccgccttcctgaggagaaaatgcagactcagggttccagtaaccagtgatggattcaccccatctcccaaataaagtttacttgttttacattccat

SEQ ID NO: 195015 - DNA, 3338 bp, Homo sapiens; identical to SEQ ID NO: 194939
  Payload ID: 18499
  Gene Name: tripartite motif containing 39
  Uniprot ID: Q9HCM9
  ENST ID: ENST00000552520
  CDS Start-End: 313-1869

SEQ ID NO: 195016 - DNA, 1567 bp, Homo sapiens
  Payload ID: 18499
  Gene Name: tripartite motif containing 39
  ENST ID: ENST00000552136
  CDS Start-End: 8-1519
ttaaattatggcagagacaagtctgttagaggctggggcctctgcagcctctacagctgcggctttggagaacttacaggtggaggcgagctgctctgtgtgcctggagtatctgaaggaacctgtcatcattgagtgtgggcacaacttctgcaaagcttgcatcacccgctggtgggaggacctagagagggacttcccttgtcctgtctgtcgaaagacatcccgctaccgcagtctccgacctaatcggcaactaggcagtatggtggaaattgccaagcagctccaggccgtcaagcggaagatccgggatgagagcctctgcccccaacaccatgaggccctcagccttttctgttatgaggaccaggaggctgtatgcttgatatgtgcaatttcccacacccaccgggcccacaccgttgtgccactggacgacgctacacaggagtacaaggaaaaactgcagaagtgtctggagcccctggaacagaagctgcaggagatcactcgctgcaagtcctctgaggagaagaagcctggtgagctcaagagactagtggaaagtcgccgacagcagatcttgagggagtttgaagagcttcataggcggctggatgaagagcagcaggtgttgctttcacgactggaagaagaggaacaggacattctgcagcgactccgagaaaatgctgctcaccttggggacaagcgccgggacctggcccacttggctgccgaggtggagggcaagtgcttacagtcaggcttcgagatgcttaaggatgtcaaaagtaccctggaaaaatgtgaaaaggtgaagaccatggaggtgacttcagtatccatagagctggaaaagaacttcagcaattttccccgacagtactttgccctaaggaaaatccttaaacagctaattgcggatgtgaccctggaccccgagacagctcatcctaacctagtcctgtcagaggatcgtaagagcgtcaagttcgtggagacaagactccgggatctccctgacacaccaaggcgtttcaccttctacccttgcgtcctggctactgagggtttcacctcaggtcgacactactgggaggtggaggccgcccattgtgtccttgcccaggaccccgagaaccaggcgctggcgaggttttactgctacactgagaggaccattgcgaagcggctcgtcttgcggcgggatccctcggtgaagaggactctctgtcgaggctgctcttccctcctcgtcccgggcctcacctgcacccagcgccagagacgctgcaggggacagcgctggaccgtacagacctgcctaacatgccagcgcagccaacgcttcctcaatgatcccgggcatttactctggggagacaggcctgaggcccagctcgggagccaagcagattccaaaccactacaacccttgccaaacacagcccactccatttcagaccgccttcctgaggagaaaatgcagacgaagggttccagtaaccagtgatggattcacctcatctcccaaataaagtttacttgttttacattccat

SEQ ID NO: 195017 - DNA, 3338 bp, Homo sapiens; identical to SEQ ID NO: 194939
  Payload ID: 18499
  Gene Name: tripartite motif containing 39
  Uniprot ID: Q9HCM9
  ENST ID: ENST00000549841
  CDS Start-End: 313-1869

SEQ ID NO: 195018 - DNA, 3338 bp, Homo sapiens
  Payload ID: 18499
  Gene Name: tripartite motif containing 39
  Uniprot ID: Q9HCM9
  ENST ID: ENST00000550282
  CDS Start-End: 313-1869
cccagcttccactgacacgagcctcggcgcggcttccgcttccggcgagtattgtgtgtcgcgccgcggggcgggggcgaggggaggaggaaggagggaggcagcgctccggcggctccgcgccccgcactcccggacccgaagccgggaagattcctttcttgtctgttagaaacgtatgtcaaacgaggatacagtgtctggaactattggttctaagatataagtggaatgagcctggatcaggagaagtatgctgagctagagttgaaggaagcttctctttctaacaagagaaagcagagttaaattatggcagagacaagtctgttagaggctggggcctctgcagcctctacagctgcggctttggagaacttacaggtggaggcgagctgctctgtgtgcctggagtatctgaaggaacctgtcatcattgagtgtgggcacaacttctgcaaagcttgcatcacccgctggtgggaggacctagagagggacttcccttgtcctgtctgtcgaaagacatcccgctaccgcagtctccgacctaatcggcaactaggcagtatggtggaaattgccaagcagctccaggccgtcaagcggaagatccgggatgagagcctctgcccccaacaccatgaggccctcagccttttctgttatgaggaccaggaggctgtatgcttgatatgtgcaatttcccacacccaccgggctcacaccgttgtgccactggacgatgctacacaggagtacaaggaaaaactgcagaagtgtctggagcccctggaacagaagctgcaggagatcactcgctgcaagtcctctgaggagaagaagcctggtgagctcaagagactagtggaaagtcgccgacagcagatcttgagggagtttgaagagcttcataggcggctggatgaagagcagcaggtgttgctttcacgactggaagaagaggaacaggacattctgcagcgactccgagaaaatgctgctcaccttggggacaagcgccgggacctggcccacttggctgccgaggtggagggcaagtgcttacagtcaggcttcgagatgcttaaggatgtcaaaagtaccctggaaaagaatattcctagaaagttcggaggctcactctcaacgatctgtccacgggatcataaggctctccttggattagtaaaagaaatcaacagatgtgaaaaggtgaagaccatggaggtgacttcagtatccatagagctggaaaagaacttcagcaattttccccgacagtactttgccctaaggaaaatccttaaacagctaattgcggatgtgaccctggaccctgagacagctcatcctaacctagtcctgtcagaggatcgtaagagcgtcaagttcgtggagacaagactccgggatctccctgacacaccaaggcgtttcaccttctacccttgcgtcctggctactgagggtttcacctcaggtcgacactactgggaggtggaggtgggcgacaagacccactgggcagtgggtgtatgccgggactccgtgagccgaaagggcgagttgactccactccctgagactggctactggcgggtgcggctatggaatggggacaaatatgcagccaccaccacaccttttacccctttgcacatcaaggtgaaacccaagcgggtaggcatattcctagactatgaggccggcacactgtctttctacaatgtcacagaccgctctcatatctacaccttcactgatacttttactgagaaactttggcccctcttctacccaggcatccgggctggacggaagaatgctgcaccacttaccatcaggcccccaacagattgggagtgacaggttgggatgtgggaatgactggggtgaggcagggtcaagtgctacgggcctccttcccgtgtcctgctggaacgtcttcgtgtccacctgggtccagtcctgaatcatcttggagaaacaccttggtttctaggatggttttgtgtggagggggaggtaggactgggctggatgagagagcacagctgtgacttcctcctaactgtcagggtggggagctggttcccagaggattgtctaccctgaagtccatcaggttttctgttgcacaaggacgggtcaggaaggaaggagaggcttttccagaaacaaaaaatctgtgagggtctgacttgctcaaaccagaggaggaaacagaaacccctgcacatctttttagggggttctttgacccaggatagtcttgcttcttgaggtagatcacaggggtctgtgtacctctgaattcatgagagatgaatgacagatgctctcatgggtctagatattgaggagtttttctgagggcagagattggacatcaacaaggctagaagggtcagggaagtgggctaaaggaacagattcctagagattaatgaagaggagggaggtttctttggtcttctattccaagggtaaggttgcgattatgggtaagattggccagaggtaggaatgtggggagaaggagaggctgaaaagaaagcagaggagaacccaggtccctgcctcagccttcagcagagttggcttattgcctgcctctataccaataagtcagtcaccttgctcctctccagaggcaaagtggaagagatcctgcaagacacatctatcctttcacagtgttcccaagggaacttggaaaggagagtcaggtattagaggaaagagaagggtatttgtatacaaagccctggccttaaagaatgttacttagtagctactcccaaattgtcagccttcttacctggccaaggtgtccaagccagaaaggaaaaaaggttatggagtctttctcaccctaaggacagggtggaagagggtggtatatagggaagggccagataggcaacttcatttggcttgtgtgcatctggcctggaactggtgttaagccaggcttttgcttgtttgttgccatccctcaccctttgccatttcccttttcagagaatgtaaatgattttcatgttaggccaaaataaacaacttatagggtacatatgttgtcataaaaggtaaaagtgatgcatgccaaaccaaactaaaccaatttggattatctgctattcgggtaatcttcacagaaatgactgagagaagaatctgcagtttactgagggcatttcagttcctcctaccacctcaacaggactttgtccagactctcctcctcttacctttgtgccttgactgtggttctttgtggcaagatactttggttggttaaaataatatggaacaaaggatccactgaagtg

SEQ ID NO: 195019 - DNA, 1567 bp, Homo sapiens; identical to SEQ ID NO: 195014
  Payload ID: 18499
  Gene Name: tripartite motif containing 39
  ENST ID: ENST00000551862
  CDS Start-End: 8-1519

SEQ ID NO: 195020 - DNA, 3338 bp, Homo sapiens; identical to SEQ ID NO: 194939
  Payload ID: 18499
  Gene Name: tripartite motif containing 39
  Uniprot ID: Q9HCM9
  ENST ID: ENST00000547030
  CDS Start-End: 313-1869

SEQ ID NO: 195021 - DNA, 3338 bp, Homo sapiens
  Payload ID: 18499
  Gene Name: tripartite motif containing 39
  Uniprot ID: Q9HCM9
  ENST ID: ENST00000552337
  CDS Start-End: 313-1869
cccagcttccactgacacgagcctcggcgcggcttccgcttccggcgagtattgtgtgtcgcgccgcggggcgggggcgaggggaggaggaaggagggaggcagcgctccggcggctccgcgccccgcactcccggacccgaagccgggaagattcctttcttgtctgttagaaacgtatgtcaaacgaggatacagtgtctggaactattggttctaagatataagtggaatgagcctggatcaggagaagtatgctgagctagagttgaaggaagcttctctttctaacaagagaaagcagagttaaattatggcagagacaagtctgttagaggctggggcctctgcagcctctacagctgcggctttggagaacttacaggtggaggcgagctgctctgtgtgcctggagtatctgaaggaacctgtcatcattgagtgtgggcacaacttctgcaaagcttgcatcacccgctggtgggaggacctagagagggacttcccttgtcctgtctgtcgaaagacatcccgctaccgcagtctccgacctaatcggcaactaggcagtatggtggaaattgccaagcagctccaggccgtcaagcggaagatccgggatgagagcctctgcccccaacaccatgaggccctcagccttttctgttatgaggaccaggaggctgtatgcttgatatgtgcaatttcccacacccaccgggcccacaccgttgtgccactggacgacgctacacaggagtacaaggaaaaactgcagaagtgtctggagcccctggaacagaagctgcaggagatcactcgctgcaagtcctctgaggagaagaagcctggtgagctcaagagactagtggaaagtcgccgacagcagatcttgagggagtttgaagagcttcataggcggctggatgaagagcagcaggtgttgctttcacgactggaagaagaggaacaggacattctgcagcgactccgagaaaatgctgctcaccttggggacaagcgccgggacctggcccacttggctgccgaggtggagggcaagtgcttacagtcaggcttcgagatgcttaaggatgtcaaaagtaccctggaaaagaatattcctagaaagttcggaggctcactctcaacgatctgtccacgggatcataaggctctccttggattagtaaaagaaatcaacagatgtgaaaaggtgaagaccatggaggtgacttcagtatccatagagctggaaaagaacttcagcaattttccccgacagtactttgccctaaggaaaatccttaaacagctaattgcggatgtgaccctggaccccgagacagctcatcctaacctagtcctgtcagaggatcgtaagagcgtcaagttcgtggagacaagactccgggatctccctgacacaccaaggcgtttcaccttctacccttgcgtcctggctactgagggtttcacctcaggtcgacactactgggaggtggaggtgggcgacaagacccactgggcagtgggtgtatgccgggactccgtgagccgaaagggcgagttgactccactccctgagactggctactggcgggtgcggctatggaatggggacaaatatgcagccaccaccacaccttttacccctttgcacatcaaggtgaaacccaagcgggtaggcatattcctagactatgaggccggcacactgtctttctacaatgtcacagaccgctctcatatctacaccttcactgatacttttactgagaaactttggcccctcttctacccaggcatccgggctggacggaagaatgctgcaccacttaccatcaggcccccaacagattgggagtgacaggttgggatgtgggaatgactggggtgaggcagggtcaagtgctacgggcctccttcccgtgtcctgctggaacgtcttcgtgtccacctgggtccagtcctgaatcatcttggagaaacaccttggtttctaggatggttttgtgtggagggggaggtaggactgggctggatgagagagcacagctgtgacttcctcctaactgtcagggtggggagctggttcccagaggattgtctaccctgaagtccatcaggttttctgttgcacaaggacgggtcaggaaggaaggagaggcttttccagaaacaaaaaatctgtgagggtctgacttgctcaaaccagaggaggaaacagaaacccctgcacatctttttagggggttctttgacccaggatagtcttgcttcttgaggtagatcacaggggtctgtgtacctctgaattcatgagagatgaatgacagatgctctcatgggtctagatattgaggagtttttctgagggcagagattggacatcaacaaggctagaagggtcagggaagtgggctaaaggaacagattcctagagattaatgaagaggagggaggtttctttggtcttctattccaagggtaaggttgcgattatgggtaagattggccagaggtaggaatgtggggagaaggagaggctgaaaagaaagcagaggagaacccaggtccctgcctcagccttcagcagagttggcttattgcctgcctctataccaataagtcagtcaccttgctcctctccagaggcaaagtggaagagatcctgcaagacacatctatcctttcacagtgttcccaagggaacttggaaaggagagtcaggtattagaggaaagagaagggtatttgtatacaaagccctggccttaaagaatgttacttagtagctactcccaaattgtcagccttcttacctggccaaggtgtccaagccagaaaggaaaaaaggttatggagtctttctcaccctaaggacagggtggaagagggtggtatatagggaagggccagataggcaacttcatttggcttgtgtgcatctggcctggaactggtgttaagccaggcttttgcttgtttgttgccatccctcaccctttgccatttcccttttcagagaatgtaaatgattttcatgttaggccaaaataaacaacttatagggtacatatgttgtcataaaaggtaaaagtgatgcatgccaaaccaaactaaaccaatttggattatctgctattcgggtaatcttcacagaaatgactgagagaagaatctgcagtttactgagggcatttcagttcctcctaccacctcaacaggactttgtccagactctcctcctcttacctttgtgccttgactgtggttctttgtggcaagatactttggttggttaaaataatatggaacaaaggatccactgaagtg

SEQ ID NO: 195022 - DNA, 3374 bp, Homo sapiens
  Payload ID: 18500
  Gene Name: tripartite motif containing 4
  Uniprot ID: Q9C037
  ENST ID: ENST00000349062
  CDS Start-End: 200-1624
cggtcttgcgcgctcaggccgggcaacgtccgtgcgttctttttgggtcctgaaccccggaagagaaactgcgttgtacccttttacgtgaggcggtgacggcggttcggaagtcgtctggcctccccgcggccgctcgcagcttgctggcctctcccgcgcctcacgtcggactccgtctccgcggcagggaagcagcatggaagctgaggacatccaggaggagttgacctgccccatctgcctggactatttccaggacccggtgtccatcgagtgcggccacaacttctgccgcggctgcctgcaccgcaactgggcgccgggcggcggcccgttcccctgccccgaatgtcggcacccatcggcgcccgccgcgctgcgacccaactgggccctggccaggctgactgagaagacgcagcgccggcgcctgggccccgtgcccccgggcctgtgcggccgccactgggagccgctgcggctcttctgcgaggacgaccagcggccagtgtgcctggtgtgcagggagtcccaggagcaccagactcacgccatggcacccatcgacgaggccttcgagagctaccgggagaaacttcttaagtctcagcgtaatctcgtggccaagatgaagaaagtcatgcatttacaggatgtagaagtgaagaacgccacacagtggaaggataagataaagagtcagcgaatgagaatcagcacggagttttcaaagctgcacaacttcctggttgaagaagaggacctgtttcttcagagattgaacaaagaagaagaagagacgaagaagaagctgaatgagaacacgttaaaactcaatcaaactatcgcttcattgaagaagctcatcttagaggtgggggagaagagccaggctcccaccctggagctgcttcagaatccaaaagaagtgttgaccaggagtgagatccaggatgtgaactattctcttgaagctgtaaaggtgaagacagtgtgccagataccattgatgaaggaaatgctaaagcgattccaagtggctgtaaacctagctgaagacacagctcatcccaaactcgtcttctcccaggaagggagatacgtgaaaaatacagcatcagccagttcttggccagtgttttcttcagcatggaactactttgctggatggaggaatcctcagaagactgcttttgtagagagatttcagcacttaccctgtgttctgggaaaaaacgttttcacctcagggaaacattactgggaagttgagagtagagatagtctggaggttgctgttggggtgtgtcgggaggacgtcatgggaattactgatcgttcaaaaatgtccccagatgtgggcatctgggcgatttattggagtgctgctggctattggcccttgataggcttccctggaactcccacccagcaagagccagctctccaccgagtgggggtttacctggatcgtgggactgggaatgtctccttctacagcgctgtggacggagtgcacctgcacaccttttcttgttcttctgtctcacgcctccggccatttttttggttgagtccattagcatctttagtcattccaccagtgactgataggaaatgaggcttttcttcccctgaccaaaactccttccctgtagtccagctgagggacacacatccctgggccctcttctgcccttcatgtctctatcctggatggtccatcttctgggtctccctaacggtaccgtttggtatctgccctttgtgtgcttcacaagaggcagtcccatgggaggtgggtctggccaatggagatgggacaggaaattttccaagacgcttttgggaaatctttttgtagcttttaaagagatgtgcggggaagacatatggatgttagcagccatattggaactgagaacacaggaatggtggaaaggtagaagaaacagagtttttgttgccgttgtgaaattgttgaaatttccttcatgccaagcttcttgttatatgagataattacgcccttattgtataagacaattttagttgtatttggttacttgcagcctgaagtaccgtaactgcactaaagggacgtagtgtgaacatcccgcagtataggcttaagtcacttttgtgaaatttgacaaaggcatagaatctttttctatccagtcaggcattgcctattctttccagtaactactgattcccccacttttctgtcttagaaaattgtgggaatcccccctcactctgcctatgttgcactctctctcttcccaaccataactctgccctcagctattaactgtgctgtgtatttatcaagttggtatgttgtatgtacagtgttattcatgtcatcatgagaatgttgaacgcttgttaaatatcttttgctagcctcttcatatgctgttgcatatgactctcatcacaactcagtgagatggaaagtcaaatcctatttgtacaaatgagaaaactgaactctttagagtaactagctcagtattggccagctggtaaatggcagtgttgggattaaaatccagttcttatctactctccctttattcagaagcatttattggatgttgatctttgtttcaggttttgattttgttacttttttatactgtgtatattttcctcagtctacccttctgctctagattgtctggactcaggagattgtggcagttactggatagttatttttaagataatgattgcttttctctgtttatataagtcatgtgtacttattgtagaaagtttgtaagatgcaaaaagtataaaaattaaagttatgcactactaacatttcaatatattttctcccagattttcagtaaagactttcaggcagtgatttaacgaggattttattttaacttatattttagtttaaggggaacacgtgcaggtttgttctatagatcaattacatgtcacaggggtttggtgtacatattatttcattacccaggtaataagcatagtacccaatagatacttttttgataccccaccctcctccaccctctaccctcaagtagtccctggtgtctgttgttcccttttttgtgtccatgggtactcaatgtttagctctcccttatacgtgagaacatgtgatgtttggttttctgttcatgtgttggtttgcttagggtaatggcctccagctccatccatgttgctgcaaagacatgatctcattctttttttatggctgcatagtattccatggtgtatatgtactatgttttctttatccagtctactgttgatgggcatttaggttgattccatgtctttgctattgtgaatagtgctgcaatgaatatatacatgca

SEQ ID NO: 195023 - DNA, 1942 bp, Homo sapiens
  Payload ID: 18500
  Gene Name: tripartite motif containing 4
  Uniprot ID: Q9C037
  ENST ID: ENST00000354241
  CDS Start-End: 93-977
cggaagtcgtctggcctccccgcggccgctcgcagcttgctggcctctcccgcgcctcacgtcggactccgtctccgcggcagggaagcagcatggaagctgaggacatccaggaggagttgacctgccccatctgcctggactatttccaggacccggtgtccatcgagtgcggccacaacttctgccgcggctgcctgcaccgcaactgggcgccgggcggcggcccgttcccctgccccgaatgtcggcacccatcggcgcccgccgcgctgcgacccaactgggccctggccaggctgactgagaagacgcagcgccggcgcctgggccccgtgcccccgggcctgtgcggccgccactgggagccgctgcggctcttctgcgaggacgaccagcggccagtgtgcctggtgtgcagggagtcccaggagcaccagactcacgccatggcacccatcgacgaggccttcgagagctaccgggagaaacttcttaagtctcagcgtaatctcgtggccaagatgaagaaagtcatgcatttacaggatgtagaagtgaagaacgccacacagtggaaggataagataaagagtcagcgaatgagaatcagcacggagttttcaaagctgcacaacttcctggttgaagaagaggacctgtttcttcagagattgaacaaagaagaagaagagacgaagaagaagctgaatgagaacacgttaaaactcaatcaaactatcgcttcattgaagaagctcatcttagaggtgggggagaagagccaggctcccaccctggagctgcttcagaatccaaaagaagtgttgaccaggagtgagatccaggatgtgaactattctcttgaagctgtaaaggtgaagacagtgtgccagataccattgatgaaggaaatgctaaagcgattccaagcaactaaaataaaaacacaaaaacaaaacaggcacaatatgtgaaacaaccgttttcaaagcaccagacgtcaggcagtgaaggacggtgattcctgagaaatgtgaaacaaatgaggtcagcctatgattgccctaccctctgcctgagggagtttccagaccatgtaaggctgaggtaactgaggtagagccagggagacttgctgagttgaggaatagacctgggagttcacggagaacaaagtagtgagagttcgcaaagtactgggcagtatcctggagcggagagagccggacacagagagaaccctcgccatctatggaggagcttcctagttgtttggcagagttctgatcagcacatgcctgtgaaaatctactcaaggctggagatagaagcttctaaaacgattagagggaacggttcctggtgctcacacagggccaggaacagtgccagttcctatcagccacaccagaaaactcgtagttcacgggcactgagtagcgtactcaggaaaatcttgcctcattagcagaaaatatttagcccttgactgggtgctgctccacacccaccttacaaatcatgaaagcaagacccaaaggggtcaaactctttccaactaacttaactgcatcccaggataaagccctagaaaattggtagaaataaacaaaaaaagagcacctaacaatataaattcacaatgtctggcatccagtcaaatatgcatgcaaaaagataggaaagcagtgacccataatggaggaaaataatcaactgaaactgacctagaattgacacagatgttagaataagcatggaaggactttaaaacatttattatgagtgtattctgtaaagaggtacatagagaccagatcaaagttttaaagatgaaaaatgtgattaaggcgaagaatgcactggatgggattaatagttgattaaatattacaaaagaaaaaattggtgaacttgaagacagagcaatggaaactac

SEQ ID NO: 195024 - DNA, 3383 bp, Homo sapiens
  Payload ID: 18500
  Gene Name: tripartite motif containing 4
  Uniprot ID: Q9C037
  ENST ID: ENST00000355947
  CDS Start-End: 131-1633
tgcgttgtacccttttacgtgaggcggtgacggcggttcggaagtcgtctggcctccccgcggccgctcgcagcttgctggcctctcccgcgcctcacgtcggactccgtctccgcggcagggaagcagcatggaagctgaggacatccaggaggagttgacctgccccatctgcctggactatttccaggacccggtgtccatcgagtgcggccacaacttctgccgcggctgcctgcaccgcaactgggcgccgggcggcggcccgttcccctgccccgaatgtcggcacccatcggcgcccgccgcgctgcgacccaactgggccctggccaggctgactgagaagacgcagcgccggcgcctgggccccgtgcccccgggcctgtgcggccgccactgggagccgctgcggctcttctgcgaggacgaccagcggccagtgtgcctggtgtgcagggagtcccaggagcaccagactcacgccatggcacccatcgacgaggccttcgagagctaccggacaggtaactttgacatccacgtggatgaatggaagagaagactaattaggctgctcttgtaccattttaagcaggaggagaaacttcttaagtctcagcgtaatctcgtggccaagatgaagaaagtcatgcatttacaggatgtagaagtgaagaacgccacacagtggaaggataagataaagagtcagcgaatgagaatcagcacggagttttcaaagctgcacaacttcctggttgaagaagaggacctgtttcttcagagattgaacaaagaagaagaagagacgaagaagaagctgaatgagaacacgttaaaactcaatcaaactatcgcttcattgaagaagctcatcttagaggtgggggagaagagccaggctcccaccctggagctgcttcagaatccaaaagaagtgttgaccaggagtgagatccaggatgtgaactattctcttgaagctgtaaaggtgaagacagtgtgccagataccattgatgaaggaaatgctaaagcgattccaagtggctgtaaacctagctgaagacacagctcatcccaaactcgtcttctcccaggaagggagatacgtgaaaaatacagcatcagccagttcttggccagtgttttcttcagcatggaactactttgctggatggaggaatcctcagaagactgcttttgtagagagatttcagcacttaccctgtgttctgggaaaaaacgttttcacctcagggaaacattactgggaagttgagagtagagatagtctggaggttgctgttggggtgtgtcgggaggacgtcatgggaattactgatcgttcaaaaatgtccccagatgtgggcatctgggcgatttattggagtgctgctggctattggcccttgataggcttccctggaactcccacccagcaagagccagctctccaccgagtgggggtttacctggatcgtgggactgggaatgtctccttctacagcgctgtggacggagtgcacctgcacaccttttcttgttcttctgtctcacgcctccggccatttttttggttgagtccattagcatctttagtcattccaccagtgactgataggaaatgaggcttttcttcccctgaccaaaactccttccctgtagtccagctgagggacacacatccctgggccctcttctgcccttcatgtctctatcctggatggtccatcttctgggtctccctaacggtaccgtttggtatctgccctttgtgtgcttcacaagaggcagtcccatgggaggtgggtctggccaatggagatgggacaggaaattttccaagacgcttttgggaaatctttttgtagcttttaaagagatgtgcggggaagacatatggatgttagcagccatattggaactgagaacacaggaatggtggaaaggtagaagaaacagagtttttgttgccgttgtgaaattgttgaaatttccttcatgccaagcttcttgttatatgagataattacgcccttattgtataagacaattttagttgtatttggttacttgcagcctgaagtaccgtaactgcactaaagggacgtagtgtgaacatcccgcagtataggcttaagtcacttttgtgaaatttgacaaaggcatagaatctttttctatccagtcaggcattgcctattctttccagtaactactgattcccccacttttctgtcttagaaaattgtgggaatcccccctcactctgcctatgttgcactctctctcttcccaaccataactctgccctcagctattaactgtgctgtgtatttatcaagttggtatgttgtatgtacagtgttattcatgtcatcatgagaatgttgaacgcttgttaaatatcttttgctagcctcttcatatgctgttgcatatgactctcatcacaactcagtgagatggaaagtcaaatcctatttgtacaaatgagaaaactgaactctttagagtaactagctcagtattggccagctggtaaatggcagtgttgggattaaaatccagttcttatctactctccctttattcagaagcatttattggatgttgatctttgtttcaggttttgattttgttacttttttatactgtgtatattttcctcagtctacccttctgctctagattgtctggactcaggagattgtggcagttactggatagttatttttaagataatgattgcttttctctgtttatataagtcatgtgtacttattgtagaaagtttgtaagatgcaaaaagtataaaaattaaagttatgcactactaacatttcaatatattttctcccagattttcagtaaagactttcaggcagtgatttaacgaggattttattttaacttatattttagtttaaggggaacacgtgcaggtttgttctatagatcaattacatgtcacaggggtttggtgtacatattatttcattacccaggtaataagcatagtacccaatagatacttttttgataccccaccctcctccaccctctaccctcaagtagtccctggtgtctgttgttcccttttttgtgtccatgggtactcaatgtttagctctcccttatacgtgagaacatgtgatgtttggttttctgttcatgtgttggtttgcttagggtaatggcctccagctccatccatgttgctgcaaagacatgatctcattctttttttatggctgcatagtattccatggtgtatatgtactatgttttctttatccagtctactgttgatgggcatttaggttgattccatgtctttgctattgtgaatagtgctgcaatgaatatatacatgca

SEQ ID NO: 195025 - DNA, 639 bp, Homo sapiens
  Payload ID: 18500
  Gene Name: tripartite motif containing 4
  ENST ID: ENST00000447480
  CDS Start-End: 1-607
ggacgaccagcggccagtgtgcctggtgtgcagggagtcccaggagcaccagactcacgccatggcacccatcgacgaggccttcgagagctaccgggagaaacttcttaagtctcagcgtaatctcgtggccaagatgaagaaagtcatgcatttacaggatgtagaagtgaagaacgccacacagtggaaggataagataaagagtcagcgaatgagaatcagcacggagttttcaaagctgcacaacttcctggttgaagaagaggacctgtttcttcagagattgaacaaagaagaagaagagacgaagaagaagctgaatgagaacacgttaaaactcaatcaaactatcgcttcattgaagaagctcatcttagaggtgggggagaagagccaggctcccaccctggagctgcttcagaatccaaaagaagtgttgaccaggagtgagatccaggatgtgaactattctcttgaagctgtaaaggtgaagacagtgtgccagataccattgatgaaggaaatgctaaagcgattccaagggattgagaaaggggacaatgtggcagaagaatcagacctctctggcagacttcatccttgaggggctcttcgatgactcccttacccaccttt

SEQ ID NO: 195026 - DNA, 1640 bp, Homo sapiens
  Payload ID: 18501
  Gene Name: tripartite motif containing 40
  Uniprot ID: Q6P9F5
  ENST ID: ENST00000307859
  CDS Start-End: 28-717
ggaggctgacagggtaggaacgaggccatgatccctttgcagaaggacaaccaggaggagggtgtctgccccatctgccaggagagcctgaaggaggccgtgagcaccaactgcggacatctcttctgtcgagtgtgcctgacacagcatgtggagaaggcctcagcctctggggtcttctgctgccccctctgccggaagccctgttctgaggaggtgctagggacaggctatatctgccccaaccaccagaagagggtgtgcaggttctgtgaggagagcagacttcttctatgtgtggaatgcctggtgtcccctgaacacatgtctcatcatgaactgaccattgaaaatgccctcagccactacaaggaacgactcaatcgccggagcaggaagctcagaaaggacattgcagaacttcagcggctcaaggctcagcaggagaagaaactgcaggctctgcagcagtggctgggccagctggagcacatgccagcagaagcggccagaatccttgacatctccagggcagtaacacagctcagaagcctggtcattgatctggaaaggacggccaaggaattagacaccaacacactgaagaatgctggtgacttactgaacaggagtgctccacagaaattagaggttatttatccccagttggagaaaggagtcagtgaattgcttcttcagccccctcagaagctctgacctgttcatccctgggacacctcacttcaggctcacctcagcctcctctctctccttcctccaacctgtccaggcccccactgggtctacccagtgcatcttcgggcctgccagctcctgaacatgtcaccatttcttcatgtccacagtcatcacctgatgcctgaccctctgactcttggacgatagccagcctccttccaggacaggctcatgcttggggctgccactgtggaggtcggggcccatggtctccaggagcatttgtgaaatctccattttgcctgtaaactgatggtagtgcccatctctcacaatctcattcaaataggatcctccaggcctctgaatggcccgagctcatcagcagtgacaccacctcacatgtggagcccagctgagttcctgcagtacttgttgtctgtaccactcacctggcacttatttattattgttgtggaagacagactcaaagacagcctcccttcatgatcctcacctcttggaattcatgcccttgtttggtcccctccccttgagtgtaagtgggatctgtgacttgcttctaatgaatggaataaggcaaaggtgatagggtgtcactctggcaactgtgttgcattgtatagaactcctccttgctggcccacccttttagagcccctcctaggagccaagagcagcttccagccaacaacaagcagaggccctcagtcttgtggctgcaagaacctgaattctgccaacaacccgagtgagcttggaagcagattcttccccaactgagccggataagaacctagtccagccaacaccttgattatagtcttgtgagtacctaagctgaggacccagtgaagctgtgccaaaatttcccacccacagaaacagtgtgacaataaatgtgtgtgtgtttttttgtt

SEQ ID NO: 195027 - DNA, 2006 bp, Homo sapiens
  Payload ID: 18501
  Gene Name: tripartite motif containing 40
  Uniprot ID: Q6P9F5
  ENST ID: ENST00000376724
  CDS Start-End: 307-1083
aggtgtatgaaaaataatttcaagtttaacaaacacaaggaaaccgcagggtccatgtcaaagctgatgagctatttctgaaactcgtgcagaattgtggtttgtgtggtctatgtcacggcacccttgagggagagtgggcaattgcctgaacttggaggctgtgtcctgtccccaggctgctccagggctgcctccttccgactgggccttcttatctgggactgttgagggcaacaggccttccgaagaccagtgaagaaggaggccctgcaaacaggaggctgacagggtaggaacgaggccatgatccctttgcagaaggacaaccaggaggagggtgtctgccccatctgccaggagagcctgaaggaggccgtgagcaccaactgcggacatctcttctgtcgagtgtgcctgacacagcatgtggagaaggcctcagcctctggggtcttctgctgccccctctgccggaagccctgttctgaggaggtgctagggacaggctatatctgccccaaccaccagaagagggtgtgcaggttctgtgaggagagcagacttcttctatgtgtggaatgcctggtgtcccctgaacacatgtctcatcatgaactgaccattgaaaatgccctcagccactacaaggaacgactcaatcgccggagcaggaagctcagaaaggacattgcagaacttcagcggctcaaggctcagcaggagaagaaactgcaggctctgcagtttcaggtagaccacgggaaccacaggctggaggctgggccggagagccagcaccaaaccagggaacagctgggtgccctccctcagcagtggctgggccagctggagcacatgccagcagaagcggccagaatccttgacatctccagggcagtaacacagctcagaagcctggtcattgatctggaaaggacggccaaggaattagacaccaacacactgaagaatgctggtgacttactgaacaggagtgctccacagaaattagaggttatttatccccagttggagaaaggagtcagtgaattgcttcttcagccccctcagaagctctgacctgttcatccctgggacacctcacttcaggctcacctcagcctcctctctctccttcctccaacctgtccaggcccccactgggtctacccagtgcatcttcgggcctgccagctcctgaacatgtcaccatttcttcatgtccacagtcatcacctgatgcctgaccctctgactcttggacgatagccagcctccttccaggacaggctcatgcttggggctgccactgtggaggtcggggcccatggtctccaggagcatttgtgaaatctccattttgcctgtaaactgatggtagtgcccatctctcacaatctcattcaaataggatcctccaggcctctgaatggcccgagctcatcagcagtgacaccacctcacatgtggagcccagctgagttcctgcagtacttgttgtctgtaccactcacctggcacttatttattattgttgtggaagacagactcaaagacagcctcccttcatgatcctcacctcttggaattcatgcccttgtttggtcccctccccttgagtgtaagtgggatctgtgacttgcttctaatgaatggaataaggcaaaggtgatagggtgtcactctggcaactgtgttgcattgtatagaactcctccttgctggcccacccttttagagcccctcctaggagccaagagcagcttccagccaacaacaagcagaggccctcagtcttgtggctgcaagaacctgaattctgccaacaacccgagtgagcttggaagcagattcttccccaactgagccggataagaacctagtccagccaacaccttgattatagtcttgtgagtacctaagctgaggacccagtgaagctgtgccaaaatttcccacccacagaaacagtgtgacaataaatgtgtgtgtgtttttttgtt

SEQ ID NO: 195028 - DNA, 2086 bp, Homo sapiens
  Payload ID: 18501
  Gene Name: tripartite motif containing 40
  Uniprot ID: Q6P9F5
  ENST ID: ENST00000383610
  CDS Start-End: 387-1163
ataagaaccactcatctgctggccatctctccaggtctggagccagagaagatgatctgaaattgtagcaggagaaattgaggtgtatgaaaaataatttcaagtttaacaaacacaaggaaaccgcagggtccatgtcaaagctgatgagctatttctgaaactcgtgcagaattgtggtttgtgtggtctatgtcacggcacccttgagggagagtgggcaattgcctgaacttggaggctgtgtcctgtccccaggctgctccagggctgcctccttccgactgggccttcttatctgggactgttgagggcaacaggccttccgaagaccagtgaagaaggaggccctgcaaacaggaggctgacagggtaggaacgaggccatgatccctttgcagaaggacaaccaggaggagggtgtctgccccatctgccaggagagcctgaaggaggccgtgagcaccaactgcggacatctcttctgtcgagtgtgcctgacacagcatgtggagaaggcctcagcctctggggtcttctgctgccccctctgccggaagccctgttctgaggaggtgctagggacaggctatatctgccccaaccaccagaagagggtgtgcaggttctgtgaggagagcagacttcttctatgtgtggaatgcctggtgtcccctgaacacatgtctcatcatgaactgaccattgaaaatgccctcagccactacaaggaacgactcaatcgccggagcaggaagctcagaaaggacattgcagaacttcagcggctcaaggctcagcaggagaagaaactgcaggctctgcagtttcaggtagaccacgggaaccacaggctggaggctgggccggagagccagcaccaaaccagggaacagctgggtgccctccctcagcagtggctgggccagctggagcacatgccagcagaagcggccagaatccttgacatctccagggcagtaacacagctcagaagcctggtcattgatctggaaaggacggccaaggaattagacaccaacacactgaagaatgctggtgacttactgaacaggagtgctccacagaaattagaggttatttatccccagttggagaaaggagtcagtgaattgcttcttcagccccctcagaagctctgacctgttcatccctgggacacctcacttcaggctcacctcagcctcctctctctccttcctccaacctgtccaggcccccactgggtctacccagtgcatcttcgggcctgccagctcctgaacatgtcaccatttcttcatgtccacagtcatcacctgatgcctgaccctctgactcttggacgatagccagcctccttccaggacaggctcatgcttggggctgccactgtggaggtcggggcccatggtctccaggagcatttgtgaaatctccattttgcctgtaaactgatggtagtgcccatctctcacaatctcattcaaataggatcctccaggcctctgaatggcccgagctcatcagcagtgacaccacctcacatgtggagcccagctgagttcctgcagtacttgttgtctgtaccactcacctggcacttatttattattgttgtggaagacagactcaaagacagcctcccttcgtgatcctcacctcttggaattcatgcccttgtttggtcccctccccttgagtgtaagtgggatctgtgacttgcttctaatgaatggaataaggcaaaggtgatagggtgtcactctggcaactgtgttgcattgtatagaactcctccttgctggcccacccttttagagcccctcctaggagccaagagcagcttccagccaacaacaagcagaggccctcagtcttgtggctgcaagaacctgaattctgccaacaacccgagtgagcttggaagcagattcttccccaactgagccggataagaacctagtccagccaacaccttgattatagtcttgtgagtacctaagctgaggacccagtgaagctgtgccaaaatttcccacccacagaaacagtgtgacaataaatgtgtgtgtgtttttttgtt

SEQ ID NO: 195029 - DNA, 2086 bp, Homo sapiens
  Payload ID: 18501
  Gene Name: tripartite motif containing 40
  Uniprot ID: Q6P9F5
  ENST ID: ENST00000396581
  CDS Start-End: 387-1163
ataagaaccactcatctgctggccatctctccaggtctggagccagagaagatgatctgaaattgtagcaggagaaattgaggtgtatgaaaaataatttcaagtttaacaaacacaaggaaaccgcagggtccatgtcaaagctgatgagctatttctgaaactcgtgcagaattgtggtttgtgtggtctatgtcacggcacccttgagggagagtgggcaattgcctgaacttggaggctgtgtcctgtccccaggctgctccagggctgcctccttccgactgggccttcttatctgggactgttgagggcaacaggccttccgaagaccagtgaagaaggaggccctgcaaacaggaggctgacagggtaggaacgaggccatgatccctttgcagaaggacaaccaggaggagggtgtctgccccatctgccaggagagcctgaaggaggccgtgagcaccaactgcggacatctcttctgtcgagtgtgcctgacacagcatgtggagaaggcctcagcctctggggtcttctgctgccccctctgccggaagccctgttctgaggaggtgctagggacaggctatatctgccccaaccaccagaagagggtgtgcaggttctgtgaggagagcagacttcttctatgtgtggaatgcctggtgtcccctgaacacatgtctcatcatgaactgaccattgaaaatgccctcagccactacaaggaacgactcaatcgccggagcaggaagctcagaaaggacattgcagaacttcagcggctcaaggctcagcaggagaagaaactgcaggctctgcagtttcaggtagaccacgggaaccacaggctggaggctgggccggagagccagcaccaaaccagggaacagctgggtgccctccctcagcagtggctgggccagctggagcacatgccagcagaagcggccagaatccttgacatctccagggcagtaacacagctcagaagcctggtcattgatctggaaaggacggccaaggaattagacaccaacacactgaagaatgctggtgacttactgaacaggagtgctccacagaaattagaggttatttatccccagttggagaaaggagtcagtgaattgcttcttcagccccctcagaagctctgacctgttcatccctgggacacctcacttcaggctcacctcagcctcctctctctccttcctccaacctgtccaggcccccactgggtctacccagtgcatcttcgggcctgccagctcctgaacatgtcaccatttcttcatgtccacagtcatcacctgatgcctgaccctctgactcttggacgatagccagcctccttccaggacaggctcatgcttggggctgccactgtggaggtcggggcccatggtctccaggagcatttgtgaaatctccattttgcctgtaaactgatggtagtgcccatctctcacaatctcattcaaataggatcctccaggcctctgaatggcccgagctcatcagcagtgacaccacctcacatgtggagcccagctgagttcctgcagtacttgttgtctgtaccactcacctggcacttatttattattgttgtggaagacagactcaaagacagcctcccttcatgatcctcacctcttggaattcatgcccttgtttggtcccctccccttgagtgtaagtgggatctgtgacttgcttctaatgaatggaataaggcaaaggtgatagggtgtcactctggcaactgtgttgcattgtatagaactcctccttgctggcccacccttttagagcccctcctaggagccaagagcagcttccagccaacaacaagcagaggccctcagtcttgtggctgcaagaacctgaattctgccaacaacccgagtgagcttggaagcagattcttccccaactgagccggataagaacctagtccagccaacaccttgattatagtcttgtgagtacctaagctgaggacccagtgaagctgtgccaaaatttcccacccacagaaacagtgtgacaataaatgtgtgtgtgtttttttgtt

SEQ ID NO: 195030 - DNA, 1640 bp, Homo sapiens
  Payload ID: 18501
  Gene Name: tripartite motif containing 40
  Uniprot ID: Q6P9F5
  ENST ID: ENST00000400651
  CDS Start-End: 28-717
ggaggctgacagggtaggaacgaggccatgatccctttgcagaaggacaaccaggaggagggtgtctgccccatctgccaggagagcctgaaggaggccgtgagcaccaactgcggacatctcttctgtcgagtgtgcctgacacagcatgtggagaaggcctcagcctctggggtcttctgctgccccctctgccggaagccctgttctgaggaggtgctagggacaggctatatctgccccaaccaccagaagagggtgtgcaggttctgtgaggagagcagacttcttctatgtgtggaatgcctggtgtcccctgaacacatgtctcatcatgaactgaccattgaaaatgccctcagccactacaaggaacgactcaatcgccggagcaggaagctcagaaaggacattgcagaacttcagcggctcaaggctcagcaggagaagaaactgcaggctctgcagcagtggctgggccagctggagcacatgccagcagaagcggccagaatccttgacatctccagggcagtaacacagctcagaagcctggtcattgatctggaaaggacggccaaggaattagacaccaacacactgaagaatgctggtgacttactgaacaggagtgctccacagaaattagaggttatttatccccagttggagaaaggagtcagtgaattgcttcttcagccccctcagaagctctgacctgttcatccctgggacacctcacttcaggctcacctcagcctcctctctctccttcctccaacctgtccaggcccccactgggtctacccagtgcatcttcgggcctgccagctcctgaacatgtcaccatttcttcatgtccacagtcatcacctgatgcctgaccctctgactcttggacgatagccagcctccttccaggacaggctcatgcttggggctgccactgtggaggtcggggcccatggtctccaggagcatttgtgaaatctccattttgcctgtaaactgatggtagtgcccatctctcacaatctcattcaaataggatcctccaggcctctgaatggcccgagctcatcagcagtgacaccacctcacatgtggagcccagctgagttcctgcagtacttgttgtctgtaccactcacctggcacttatttattattgttgtggaagacagactcaaagacagcctcccttcgtgatcctcacctcttggaattcatgcccttgtttggtcccctccccttgagtgtaagtgggatctgtgacttgcttctaatgaatggaataaggcaaaggtgatagggtgtcactctggcaactgtgttgcattgtatagaactcctccttgctggcccacccttttagagcccctcctaggagccaagagcagcttccagccaacaacaagcagaggccctcagtcttgtggctgcaagaacctgaattctgccaacaacccgagtgagcttggaagcagattcttccccaactgagccggataagaacctagtccagccaacaccttgattatagtcttgtgagtacctaagctgaggacccagtgaagctgtgccaaaatttcccacccacagaaacagtgtgacaataaatgtgtgtgtgtttttttgtt

SEQ ID NO: 195031 - DNA, 2086 bp, Homo sapiens
  Payload ID: 18501
  Gene Name: tripartite motif containing 40
  Uniprot ID: Q6P9F5
  ENST ID: ENST00000434151
  CDS Start-End: 387-1163
ataagaaccactcatctgctggccatctctccaggtctagagccagagaagatgatctgaaattgtagcaggagaaattgaggtgtatgaaaaataatttcaagtttaacaaacacaaggaaaccgcagggtccatgtcaaagctgatgagctatttctgaaactcgtgaagaattgtggtttgtgtggtctatgtcacggcacccttgagggagagtgggcaattgcctgaacttggaggctgtgtcctgtccccaggctgctccagggctgcctccttccgactgggccttcttatctgggactgttgagggcaacaggccttccgaagaccagtgaagaaggaggccctgcaaacaggaggctgacagggtaggaacgaggccatgatccctttgcagaaggacaaccaggaggagggtgtctgccccatctgccaggagagcctgaaggaggccgtgagcaccaactgcggacatctcttctgtcgagtgtgcctgacacagcatgtggagaaggcctcagcctctggggtcttctgctgccccctctgccggaagccctgttctgaggaggtgctagggacaggctatatctgccccaaccaccagaagagggtgtgcaggttctgtgaggagagcagacttcttctatgtgtggaatgcctggtgtcccctgaacacatgtctcatcatgaactgaccattgaaaatgccctcagccactacaaggaacgactcaatcgccggagcaggaagctcagaaaggacattgcagaacttcagcggctcaaggctcagcaggagaagaaactgcaggctctgcagtttcaggtagaccacgggaaccacaggctggaggctgggccggagagccagcaccaaaccagggaacagctgggtgccctccctcagcagtggctgggccagctggagcacatgccagcagaagcggccagaatccttgacatctccagggcagtaacacagctcagaagcctggtcattgatctggaaaggacggccaaggaattagacaccaacacactgaagaatgctggtgacttactgaacaggagtgctccacagaaattagaggttatttatccccagttggagaaaggagtcagtgaattgcttcttcagccccctcagaagctctgacctgttcatccctgggacacctcacttcaggctcacctcagcctcctctctctccttcctccaacctgtccaggcccccactgggtctacccagtgcatcttcgggcctgccagctcctgaacatgtcaccatttcttcatgtccacagtcatcacctgatgcctgaccctctgactcttggacgatagccagcctccttccaggacaggctcatgcttggggctgccactgtggaggtcggggcccatggtctccaggagcatttgtgaaatctccattttgcctgtaaactgatggtagtgcccatctctcacaatctcattcaaataggatcctccaggcctctgaatggcccgagctcatcagcagtgacaccacctcacatgtggagcccagctgagttcctgcagtacttgttgtctgtaccactcacctggcacttatttattattgttgtggaagacagactcaaagacagcctcccttcgtgatcctcacctcttggaattcatgcccttgtttggtcccctccccttgagtgtaagtgggatctgtgacttgcttctaatgaatggaataaggcaaaggtgatagggtgtcactctggcaactgtgttgcattgtatagaactcctccttgctggcccacccttttagagcccctcctaggagccaagagcagcttccagccaacaacaagcagaggccctcagtcttgtggctgcaagaacctgaattctgccaacaacccgagtgagcttggaagcagattcttccccaactgagccggataagaacctagtccagccaacaccttgattatagtcttgtgagtacctaagctgaggacccagtgaagctgtgccaaaatttcccacccacagaaacagtgtgacaataaatgtgtgtgtgtttttttgtt

SEQ ID NO: 195032 - DNA, 2066 bp, Homo sapiens
  Payload ID: 18501
  Gene Name: tripartite motif containing 40
  Uniprot ID: Q6P9F5
  ENST ID: ENST00000433713
  CDS Start-End: 367-1143
ggccatctctccaggtctagagccagagaagatgatctgaaattgtagcaggagaaattgaggtgtatgaaaaataatttcaagtttaacaaacacaaggaaaccgcagggtccatgtcaaagctgatgagctatttctgaaactcgtgaagaattgtggtttgtgtggtctatgtcacggcacccttgagggagagtgggcaattgcctgaacttggaggctgtgtcctgtccccaggctgctccagggctgcctccttccgactgggccttcttatctgggactgttgagggcaacaggccttccgaagaccagtgaagaaggaggccctgcaaacaggaggctgacagggtaggaacgaggccatgatccctttgcagaaggacaaccaggaggagggtgtctgccccatctgccaggagagcctgaaggaggccgtgagcaccaactgcggacatctcttctgtcgagtgtgcctgacacagcatgtggagaaggcctcagcctctggggtcttctgctgccccctctgccggaagccctgttctgaggaggtgctagggacaggctatatctgccccaaccaccagaagagggtgtgcaggttctgtgaggagagcagacttcttctatgtgtggaatgcctggtgtcccctgaacacatgtctcatcatgaactgaccattgaaaatgccctcagccactacaaggaacgactcaatcgccggagcaggaagctcagaaaggacattgcagaacttcagcggctcaaggctcagcaggagaagaaactgcaggctctgcagtttcaggtagaccacgggaaccacaggctggaggctgggccggagagccagcaccaaaccagggaacagctgggtgccctccctcagcagtggctgggccagctggagcacatgccagcagaagcggccagaatccttgacatctccagggcagtaacacagctcagaagcctggtcattgatctggaaaggacggccaaggaattagacaccaacacactgaagaatgctggtgacttactgaacaggagtgctccacagaaattagaggttatttatccccagttggagaaaggagtcagtgaattgcttcttcagccccctcagaagctctgacctgttcatccctgggacacctcacttcaggctcacctcagcctcctctctctccttcctccaacctgtccaggcccccactgggtctacccagtgcatcttcgggcctgccagctcctgaacatgtcaccatttcttcatgtccacagtcatcacctgatgcctgaccctctgactcttggacgatagccagcctccttccaggacaggctcatgcttggggctgccactgtggaggtcggggcccatggtctccaggagcatttgtgaaatctccattttgcctgtaaactgatggtagtgcccatctctcacaatctcattcaaataggatcctccaggcctctgaatggcccaagctcatcagcagtgacaccacctcacatgtggagcccagctgagttcctgcagtacttgttgtctgtaccactcacctggcacttatttattattgttgtggaagacagactcaaagacagcctcccttcgtgatcctcacctcttggaattcatgcccttgtttggtcccctccccttgagtgtaagtgggatctgtgacttgcttctaatgaatggaataaggcaaaggtgatagggtgtcactctggcaactgtgttgcattgtatagaactcctccttgctggcccacccttttagagcccctcctaggagccaagagcagcttccagccaacaacaagcagaggccctcagtcttgtggctgcaagaacctgaattctgccaacaacccgagtgagcttggaagcagattcttccccaactgagccggataagaacctagtccagccaacaccttgattatagtcttgtgagtacctaagctgaggacccagtgaagctgtgccaaaatttcccacccacagaaacagtgtgacaataaatgtgtgtgtgtttttttgtt

SEQ ID NO: 195033 - DNA, 1640 bp, Homo sapiens; identical to SEQ ID NO: 195030
  Payload ID: 18501
  Gene Name: tripartite motif containing 40
  Uniprot ID: Q6P9F5
  ENST ID: ENST00000429471
  CDS Start-End: 28-717

SEQ ID NO: 195034 - DNA, 1640 bp, Homo sapiens
  Payload ID: 18501
  Gene Name: tripartite motif containing 40
  ENST ID: ENST00000456884
  CDS Start-End: 28-717
ggaggctgacagggtaggaacaaggccatgatccctttgcagaaggacaaccaggaggagggtgtctgccccatctgccaggagagcctgaaggaggccgtgagcaccaactgcggacatctcttctgtcgagtgtgcctgacacagcatgtggagaaggcctcagcctctggggtcttctgctgccccctctgccggaagccctgttctgaggaggtgctagggacaggctatatctgccccaaccaccagaagagggtgtgcaggttctgtgaggagagcagacttcttctatgtgtggaatgcctggtgtcccctgaacacatgtctcatcatgaactgaccattgaaaatgccctcagccactacaaggaacgactcaatcgccggagcaggaagctcagaaaggacattgcagaacttcagcggctcaaggctcagcaggagaagaaactgcaggctctgcagcagtggctgggccagctggagcacatgccagcagaagcggccagaatccttgacatctccagggcagtaacacagctcagaagcctggtcattgatctggaaaggatggccaaggaattagacaccaacacactgaagaatgctggtgacttactgaacaggagtgctccacagaaattagaggttatttatccccagttgaagaaaggagtcagtgaattgcttcttcagccccctcagaagctctgacctgttcatccctgggacacctcacttcaggctcacctcagcctcctctctctccttcctccaacctgtccaggcccccactgggtctacccagtgcatcttcgggcctgccagctcctgaacatgtcaccatttcttcatgtccacagtcatcacctgatgcctgaccctctgactcttggacgatagccagcctccttccaggacaggctcatgcttggggctgccactgtggaggtcggggcccatggtctccaggagcatttgtgaaatctccattttgcctgtaaactgatggtagtgcccatctctcacaatctcattcaaataggatcctccaggcctctgaatggcccgagctcatcagcagtgacatcacctcacatgtggagcccagctgagttcctgcagtacttgttgtctgtaccactcacctggcacttatttattattgttgtggaagacagactcaaagacagcctcccttcgtgatcctcacctcttggaattcatgcccttgtttggtcccctccccttgagtgtaagtgggatctgtgacttgcttctaatcaatggaataaggcaaaggtgatagggtgtcactctggcaactgtgttgcattgtatagaactcctccttgctggcccacccttttagagcccctcctaggagccaagagcagcttccagccaacaacaagcagaggccctcagtcttgtggctgcaagaacctgaattctgccaacaacctgagtgagcttggaagcagattcttccccaactgagccggataagaacctagtccagccaacaccttgattatagtcttgtgagtacctaagctgaggacccagtgaagctgtgccaaaatttcccacccacagaaacagtgtgacaataaatgtgtgtgtgtttttttgtt

SEQ ID NO: 195035 - DNA, 1640 bp, Homo sapiens
  Payload ID: 18501
  Gene Name: tripartite motif containing 40
  ENST ID: ENST00000445004
  CDS Start-End: 28-717
ggaggctgacagggtaggaacgaggccatgatccctttgcagaaggacaaccaggaggagggtgtctgccccatctgccaggagagcctgaaggaggccgtgagcaccaactgcggacatctcttctgtcgagtgtgcctgacacagcatgtggagaaggcctcagcctctggggtcttctgctgccccctctgccggaagccctgttctgaggaggtgctagggacaggctatatctgccccaaccaccagaagagggtgtgcaggttctgtgaggagagcagacttcttctatgtgtggaatgcctggtgtcccctgaacacatgtctcatcatgaactgaccattgaaaatgccctcagccactgcaaggaacgactcaatcgccggagcaggaagctcagaaaggacattgcagaacttcagcggctcaaggctcagcaggagaagaaactgcaggctctgcagcagtggctgggccagctggagcacatgccagcagaagcggccagaatccttgacatctccagggcagtaacacagctcagaagcctggtcattgatctggaaaggacggccaaggaattagacaccaacacactgaagaatgctggtgacttactgaacaggagtgctccacagaaattagaggttatttatccccagttggagaaaggagtcagtgaattgcttcttcagccccctcagaagctctgacctgttcatccctgggacacctcacttcaggctcacctcagcctcctctctctccttcctccaacctgtccaggcccccactgggtctacccagtgcatcttcgggcctgccagctcctgaacatgtcaccatttcttcatgtccacagtcatcacctgatgcctgaccctctgactcttggacgatagccagcctccttccaggacaggctcatgcttggggctgccactgtggaggtcggggcccatggtctccaggagcatttgtgaaatctccattttgcctgtaaactgatggtagtgcccatctctcacaatctcattcaaataggatcctccaggcctctgaatggcccaagctcatcagcagtgacaccacctcacatgtggagcccagctgagttcctgcagtacttgttgtctgtaccactcacctggcacttatttattattgttgtggaagacagactcaaagacagcctcccttcgtgatcctcacctcttggaattcatgcccttgtttggtcccctccccttgagtgtaagtgggatctgtgacttgcttctaatgaatggaataaggcaaaggtgatagggtgtcactctggcaactgtgttgcattgtatagaactcctccttgctggcccacccttttagagcccctcctaggagccaagagcagcttccagccaacaacaagcagaggccctcagtcttgtggctgcaagaacctgaattctgccaacaacccgagtgagcttggaagcagattcttccccaactgagccggataagaacctagtccagccaacaccttgattatagtcttgtgagtacctaagctgaggacccagtgaagctgtgccaaaatttcccacccacagaaacagtgtgacaataaatgtgtgtgtgtttttttgtt

SEQ ID NO: 195036 - DNA, 2086 bp, Homo sapiens
  Payload ID: 18501
  Gene Name: tripartite motif containing 40
  ENST ID: ENST00000431397
  CDS Start-End: 387-1163
ataagaaccactcatctgctggccatctctccaggtctagagccagagaagatgatctgaaattgtagcaggagaaattgaggtgtatgaaaaataatttcaagtttaacaaacacaaggaaaccgcagggtccatgtcaaagctgatgagctatttctgaaactcgtgaagaattgtggtttgtgtggtctatgtcacggcacccttgagggagagtgggcaattgcctgaacttggaggctgtgtcctgtccccaggctgctccagggctgcctccttccgactgggccttcttatctgggactgttgagggcaacaggccttccgaagaccagtgaagaaggaggccctgcaaacaggaggctgacagggtaggaacgaggccatgatccctttgcagaaggacaaccaggaggagggtgtctgccccatctgccaggagagcctgaaggaggccgtgagcaccaactgcggacatctcttctgtcgagtgtgcctgacacagcatgtggagaaggcctcagcctctggggtcttctgctgccccctctgccggaagccctgttctgaggaggtgctagggacaggctatatctgccccaaccaccagaagagggtgtgcaggttctgtgaggagagcagacttcttctatgtgtggaatgcctggtgtcccctgaacacatgtctcatcatgaactgaccattgaaaatgccctcagccactgcaaggaacgactcaatcgccggagcaggaagctcagaaaggacattgcagaacttcagcggctcaaggctcagcaggagaagaaactgcaggctctgcagtttcaggtagaccacgggaaccacaggctggaggctgggccggagagccagcaccaaaccagggaacagctgggtgccctccctcagcagtggctgggccagctggagcacatgccagcagaagcggccagaatccttgacatctccagggcagtaacacagctcagaagcctggtcattgatctggaaaggacggccaaggaattagacaccaacacactgaagaatgctggtgacttactgaacaggagtgctccacagaaattagaggttatttatccccagttggagaaaggagtcagtgaattgcttcttcagccccctcagaagctctgacctgttcatccctgggacacctcacttcaggctcacctcagcctcctctctctccttcctccaacctgtccaggcccccactgggtctacccagtgcatcttcgggcctgccagctcctgaacatgtcaccatttcttcatgtccacagtcatcacctgatgcctgaccctctgactcttggacgatagccagcctccttccaggacaggctcatgcttggggctgccactgtggaggtcggggcccatggtctccaggagcatttgtgaaatctccattttgcctgtaaactgatggtagtgcccatctctcacaatctcattcaaataggatcctccaggcctctgaatggcccaagctcatcagcagtgacaccacctcacatgtggagcccagctgagttcctgcagtacttgttgtctgtaccactcacctggcacttatttattattgttgtggaagacagactcaaagacagcctcccttcgtgatcctcacctcttggaattcatgcccttgtttggtcccctccccttgagtgtaagtgggatctgtgacttgcttctaatgaatggaataaggcaaaggtgatagggtgtcactctggcaactgtgttgcattgtatagaactcctccttgctggcccacccttttagagcccctcctaggagccaagagcagcttccagccaacaacaagcagaggccctcagtcttgtggctgcaagaacctgaattctgccaacaacccgagtgagcttggaagcagattcttccccaactgagccggataagaacctagtccagccaacaccttgattatagtcttgtgagtacctaagctgaggacccagtgaagctgtgccaaaatttcccacccacagaaacagtgtgacaataaatgtgtgtgtgtttttttgtt

SEQ ID NO: 195037 - DNA, 1640 bp, Homo sapiens; identical to SEQ ID NO: 195030
  Payload ID: 18501
  Gene Name: tripartite motif containing 40
  Uniprot ID: Q6P9F5
  ENST ID: ENST00000421981
  CDS Start-End: 28-717

SEQ ID NO: 195038 - DNA, 2086 bp, Homo sapiens
  Payload ID: 18501
  Gene Name: tripartite motif containing 40
  ENST ID: ENST00000425845
  CDS Start-End: 387-1163
ataagaaccactcgtctgctggccatctctccaggtctggagccagagaagatgatctgaaattgtagcaggagaaattgaggtgtatgaaaaataatttcaagtttaacaaacacaaggaaaccgcagggtccatgtcaaagctgatgagctatttctgaaactcgtgcagaattgtggtttgtgtggtctatgtcacggcacccttgagggagagtgggcaattgcctgaacttggaggctgtgtcctgtccccaggctgctccagggctgcctccttccgactgggccttcttatctgggactgttgagggcaacaggccttccgaagaccagtgaagaaggaggccctgcagacaggaggctgacagggtaggaacaaggccatgatccctttgcagaaggacaaccaggaggagggtgtctgccccatctgccaggagagcctgaaggaggccgtgagcaccaactgcggacatctcttctgtcgagtgtgcctgacacagcatgtggagaaggcctcagcctctggggtcttctgctgccccctctgccggaagccctgttctgaggaggtgctagggacaggctatatctgccccaaccaccagaagagggtgtgcaggttctgtgaggagagcagacttcttctatgtgtggaatgcttggtgtcccctgaacacatgtctcatcatgaactgaccattgaaaatgccctcagccactacaaggaacgactcaatcgccggagcaggaagctcagaaaggacattgcagaacttcagcggctcaaggctcagcaggagaagaaactgcaggctctgcagtttcaggtagaccacgggaaccacaggctggaggctgggccggagagccagcaccaaaccagggaacagctgggtgccctcccccagcagtggctgggccagctggagcacatgccagcagaagcggccagaatccttgacatctccagggcagtaacacagctcagaagcctggtcattgatctggaaaggatggccaaggaattagacaccaacacactgaagaatgctggtgacttactgaacaggagtgctccacagaaattagaggttatttatccccagttgaagaaaggagtcagtgaattgcttcttcagccccctcagaagctctgacctgttcatccctgggacacctcacttcaggctcacctcagcctcctctctctccttcctccaacctgtccaggcccccactgggtctacccagtgcatcttcgggcctgccagctcctgaacatgtcaccatttcttcatgtccacagtcatcacctgatgcctgaccctctgactcttggacgatagccagcctccttccaggacaggctcatgcttggggctgccactgtggaggtcggggcccatggtctccaggagcatttgtgaaatctccattttgcctgtaaactgatggtagtgcccatctctcacaatctcattcaaataggatcctccaggcctctgaatggcccgagctcatcagcagtgacatcacctcacatgtggagcccagctgagttcctgcagtacttgttgtctgtaccactcacctggcacttatttattattgttgtggaagacagactcaaagacagcctcccttcgtgatcctcacctcttggaattcatgcccttgtttggtcccctccccttgagtgtaagtgggatctgtgacttgcttctaatcaatggaataaggcaaaggtgatagggtgtcactctggcaactgtgttgcattgtatagaactcctccttgctggcccacccttttagagcccctcctaggagccaagagcagcttccagccaacaacaagcagaggccctcagtcttgtggctgcaagaacctgaattctgccaacaacctgagtgagcttggaagcagattcttccccaactgagccggataagaacctagtccagccaacaccttgattatagtcttgtgagtacctaagctgaggacccagtgaagctgtgccaaaatttcccacccacagaaacagtgtgacaataaatgtgtgtgtgtttttttgtt

SEQ ID NO: 195039 - DNA, 2086 bp, Homo sapiens
  Payload ID: 18501
  Gene Name: tripartite motif containing 40
  ENST ID: ENST00000430485
  CDS Start-End: 387-1163
ataagaaccactcgtctgctggccatctctccaggtctggagccagagaagatgatctgaaattgtagcaggagaaattgaggtgtatgaaaaataatttcaagtttaacaaacacaaggaaaccgcagggtccatgtcaaagctgatgagctatttctgaaactcgtgcagaattgtggtttgtgtggtctatgtcacggcacccttgagggagagtgggcaattgcctgaacttggaggctgtgtcctgtccccaggctgctccagggctgcctccttccgactgggccttcttatctgggactgttgagggcaacaggccttccgaagaccagtgaagaaggaggccctgcagacaggaggctgacagggtaggaacaaggccatgatccctttgcagaaggacaaccaggaggagggtgtctgccccatctgccaggagagcctgaaggaggccgtgagcaccaactgcggacatctcttctgtcgagtgtgcctgacacagcatgtggagaaggcctcagcctctggggtcttctgctgccccctctgccggaagccctgttctgaggaggtgctagggacaggctatatctgccccaaccaccagaagagggtgtgcaggttctgtgaggagagcagacttcttctatgtgtggaatgcctggtgtcccctgaacacatgtctcatcatgaactgaccattgaaaatgccctcagccactacaaggaacgactcaatcgccggagcaggaagctcagaaaggacattgcagaacttcagcggctcaaggctcagcaggagaagaaactgcaggctctgcagtttcaggtagaccacgggaaccacaggctggaggctgggccggagagccagcaccaaaccagggaacagctgggtgccctcccccagcagtggctgggccagctggagcacatgccagcagaagcggccagaatccttgacatctccagggcagtaacacagctcagaagcctggtcattgatctggaaaggatggccaaggaattagacaccaacacactgaagaatgctggtgacttactgaacaggagtgctccacagaaattagaggttatttatccccagttgaagaaaggagtcagtgaattgcttcttcagccccctcagaagctctgacctgttcatccctgggacacctcacttcaggctcacctcagcctcctctctctccttcctccaacctgtccaggcccccactgggtctacccagtgcatcttcgggcctgccagctcctgaacatgtcaccatttcttcatgtccacagtcatcacctgatgcctgaccctctgactcttggacgatagccagcctccttccaggacaggctcatgcttggggctgccactgtggaggtcggggcccatggtctccaggagcatttgtgaaatctccattttgcctgtaaactgatggtagtgcccatctctcacaatctcattcaaataggatcctccaggcctctgaatggcccgagctcatcagcagtgacatcacctcacatgtggagcccagctgagttcctgcagtacttgttgtctgtaccactcacctggcacttatttattattgttgtggaagacagactcaaagacagcctcccttcgtgatcctcacctcttggaattcatgcccttgtttggtcccctccccttgagtgtaagtgggatctgtgacttgcttctaatcaatggaataaggcaaaggtgatagggtgtcactctggcaactgtgttgcattgtatagaactcctccttgctggcccacccttttagagcccctcctaggagccaagagcagcttccagccaacaacaagcagaggccctcagtcttgtggctgcaagaacctgaattctgccaacaacctgagtgagcttggaagcagattcttccccaactgagccggataagaacctagtccagccaacaccttgattatagtcttgtgagtacctaagctgaggacccagtgaagctgtgccaaaatttcccacccacagaaacagtgtgacaataaatgtgtgtgtgtttttttgtt

SEQ ID NO: 195040 - DNA, 1640 bp, Homo sapiens
  Payload ID: 18501
  Gene Name: tripartite motif containing 40
  ENST ID: ENST00000418267
  CDS Start-End: 28-717
ggaggctgacagggtaggaacaaggccatgatccctttgcagaaggacaaccaggaggagggtgtctgccccatctgccaggagagcctgaaggaggccgtgagcaccaactgcggacatctcttctgtcgagtgtgcctgacacagcatgtggagaaggcctcagcctctggggtcttctgctgccccctctgccggaagccctgttctgaggaggtgctagggacaggctatatctgccccaaccaccagaagagggtgtgcaggttctgtgaggagagcagacttcttctatgtgtggaatgcttggtgtcccctgaacacatgtctcatcatgaactgaccattgaaaatgccctcagccactacaaggaacgactcaatcgccggagcaggaagctcagaaaggacattgcagaacttcagcggctcaaggctcagcaggagaagaaactgcaggctctgcagcagtggctgggccagctggagcacatgccagcagaagcggccagaatccttgacatctccagggcagtaacacagctcagaagcctggtcattgatctggaaaggatggccaaggaattagacaccaacacactgaagaatgctggtgacttactgaacaggagtgctccacagaaattagaggttatttatccccagttgaagaaaggagtcagtgaattgcttcttcagccccctcagaagctctgacctgttcatccctgggacacctcacttcaggctcacctcagcctcctctctctccttcctccaacctgtccaggcccccactgggtctacccagtgcatcttcgggcctgccagctcctgaacatgtcaccatttcttcatgtccacagtcatcacctgatgcctgaccctctgactcttggacgatagccagcctccttccaggacaggctcatgcttggggctgccactgtggaggtcggggcccatggtctccaggagcatttgtgaaatctccattttgcctgtaaactgatggtagtgcccatctctcacaatctcattcaaataggatcctccaggcctctgaatggcccgagctcatcagcagtgacatcacctcacatgtggagcccagctgagttcctgcagtacttgttgtctgtaccactcacctggcacttatttattattgttgtggaagacagactcaaagacagcctcccttcgtgatcctcacctcttggaattcatgcccttgtttggtcccctccccttgagtgtaagtgggatctgtgacttgcttctaatcaatggaataaggcaaaggtgatagggtgtcactctggcaactgtgttgcattgtatagaactcctccttgctggcccacccttttagagcccctcctaggagccaagagcagcttccagccaacaacaagcagaggccctcagtcttgtggctgcaagaacctgaattctgccaacaacctgagtgagcttggaagcagattcttccccaactgagccggataagaacctagtccagccaacaccttgattatagtcttgtgagtacctaagctgaggacccagtgaagctgtgccaaaatttcccacccacagaaacagtgtgacaataaatgtgtgtgtgtttttttgtt

SEQ ID NO: 195041 - DNA, 1640 bp, Homo sapiens
  Payload ID: 18501
  Gene Name: tripartite motif containing 40
  Uniprot ID: Q6P9F5
  ENST ID: ENST00000436951
  CDS Start-End: 28-717
ggaggctgacagggtaggaacgaggccatgatccctttgcagaaggacaaccaggaggagggtgtctgccccatctgccaggagagcctgaaggaggccgtgagcaccaactgcggacatctcttctgtcgagtgtgcctgacacagcatgtggagaaggcctcagcctctggggtcttctgctgccccctctgccggaagccctgttctgaggaggtgctagggacaggctatatctgccccaaccaccagaagagggtgtgcaggttctgtgaggagagcagacttcttctatgtgtggaatgcctggtgtcccctgaacacatgtctcatcatgaactgaccattgaaaatgccctcagccactacaaggaacgactcaatcgccggagcaggaagctcagaaaggacattgcagaacttcagcggctcaaggctcagcaggagaagaaactgcaggctctgcagcagtggctgggccagctggagcacatgccagcagaagcggccagaatccttgacatctccagggcagtaacacagctcagaagcctggtcattgatctggaaaggacggccaaggaattagacaccaacacactgaagaatgctggtgacttactgaacaggagtgctccacagaaattagaggttatttatccccagttggagaaaggagtcagtgaattgcttcttcagccccctcagaagctctgacctgttcatccctgggacacctcacttcaggctcacctcagcctcctctctctccttcctccaacctgtccaggcccccactgggtctacccagtgcatcttcgggcctgccagctcctgaacatgtcaccatttcttcatgtccacagtcatcacctgatgcctgaccctctgactcttggacgatagccagcctccttccaggacaggctcatgcttggggctgccactgtggaggtcggggcccatggtctccaggagcatttgtgaaatctccattttgcctgtaaactgatggtagtgcccatctctcacaatctcattcaaataggatcctccaggcctctgaatggcccaagctcatcagcagtgacaccacctcacatgtggagcccagctgagttcctgcagtacttgttgtctgtaccactcacctggcacttatttattattgttgtggaagacagactcaaagacagcctcccttcgtgatcctcacctcttggaattcatgcccttgtttggtcccctccccttgagtgtaagtgggatctgtgacttgcttctaatgaatggaataaggcaaaggtgatagggtgtcactctggcaactgtgttgcattgtatagaactcctccttgctggcccacccttttagagcccctcctaggagccaagagcagcttccagccaacaacaagcagaggccctcagtcttgtggctgcaagaacctgaattctgccaacaacccgagtgagcttggaagcagattcttccccaactgagccggataagaacctagtccagccaacaccttgattatagtcttgtgagtacctaagctgaggacccagtgaagctgtgccaaaatttcccacccacagaaacagtgtgacaataaatgtgtgtgtgtttttttgtt

SEQ ID NO: 195042 - DNA, 2086 bp, Homo sapiens; identical to SEQ ID NO: 195028
  Payload ID: 18501
  Gene Name: tripartite motif containing 40
  Uniprot ID: Q6P9F5
  ENST ID: ENST00000437563
  CDS Start-End: 387-1163

SEQ ID NO: 195043 - DNA, 2006 bp, Homo sapiens
  Payload ID: 18501
  Gene Name: tripartite motif containing 40
  Uniprot ID: Q6P9F5
  ENST ID: ENST00000547289
  CDS Start-End: 307-1083
aggtgtatgaaaaataatttcaagtttaacaaacacaaggaaaccgcagggtccatgtcaaagctgatgagctatttctgaaactcgtgcagaattgtggtttgtgtggtctatgtcacggcacccttgagggagagtgggcaattgcctgaacttggaggctgtgtcctgtccccaggctgctccagggctgcctccttccgactgggccttcttatctgggactgttgagggcaacaggccttccgaagaccagtgaagaaggaggccctgcaaacaggaggctgacagggtaggaacgaggccatgatccctttgcagaaggacaaccaggaggagggtgtctgccccatctgccaggagagcctgaaggaggccgtgagcaccaactgcggacatctcttctgtcgagtgtgcctgacacagcatgtggagaaggcctcagcctctggggtcttctgctgccccctctgccggaagccctgttctgaggaggtgctagggacaggctatatctgccccaaccaccagaagagggtgtgcaggttctgtgaggagagcagacttcttctatgtgtggaatgcctggtgtcccctgaacacatgtctcatcatgaactgaccattgaaaatgccctcagccactacaaggaacgactcaatcgccggagcaggaagctcagaaaggacattgcagaacttcagcggctcaaggctcagcaggagaagaaactgcaggctctgcagtttcaggtagaccacgggaaccacaggctggaggctgggccggagagccagcaccaaaccagggaacagctgggtgccctccctcagcagtggctgggccagctggagcacatgccagcagaagcggccagaatccttgacatctccagggcagtaacacagctcagaagcctggtcattgatctggaaaggacggccaaggaattagacaccaacacactgaagaatgctggtgacttactgaacaggagtgctccacagaaattagaggttatttatccccagttggagaaaggagtcagtgaattgcttcttcagccccctcagaagctctgacctgttcatccctgggacacctcacttcaggctcacctcagcctcctctctctccttcctccaacctgtccaggcccccactgggtctacccagtgcatcttcgggcctgccagctcctgaacatgtcaccatttcttcatgtccacagtcatcacctgatgcctgaccctctgactcttggacgatagccagcctccttccaggacaggctcatgcttggggctgccactgtggaggtcggggcccatggtctccaggagcatttgtgaaatctccattttgcctgtaaactgatggtagtgcccatctctcacaatctcattcaaataggatcctccaggcctctgaatggcccgagctcatcagcagtgacaccacctcacatgtggagcccagctgagttcctgcagtacttgttgtctgtaccactcacctggcacttatttattattgttgtggaagacagactcaaagacagcctcccttcgtgatcctcacctcttggaattcatgcccttgtttggtcccctccccttgagtgtaagtgggatctgtgacttgcttctaatgaatggaataaggcaaaggtgatagggtgtcactctggcaactgtgttgcattgtatagaactcctccttgctggcccacccttttagagcccctcctaggagccaagagcagcttccagccaacaacaagcagaggccctcagtcttgtggctgcaagaacctgaattctgccaacaacccgagtgagcttggaagcagattcttccccaactgagccggataagaacctagtccagccaacaccttgattatagtcttgtgagtacctaagctgaggacccagtgaagctgtgccaaaatttcccacccacagaaacagtgtgacaataaatgtgtgtgtgtttttttgtt

SEQ ID NO: 195044 - DNA, 2006 bp, Homo sapiens
  Payload ID: 18501
  Gene Name: tripartite motif containing 40
  Uniprot ID: Q6P9F5
  ENST ID: ENST00000549728
  CDS Start-End: 307-1083
aggtgtatgaaaaataatttcaagtttaacaaacacaaggaaaccgcagggtccatgtcaaagctgatgagctatttctgaaactcgtgaagaattgtggtttgtgtggtctatgtcacggcacccttgagggagagtgggcaattgcctgaacttggaggctgtgtcctgtccccaggctgctccagggctgcctccttccgactgggccttcttatctgggactgttgagggcaacaggccttccgaagaccagtgaagaaggaggccctgcaaacaggaggctgacagggtaggaacgaggccatgatccctttgcagaaggacaaccaggaggagggtgtctgccccatctgccaggagagcctgaaggaggccgtgagcaccaactgcggacatctcttctgtcgagtgtgcctgacacagcatgtggagaaggcctcagcctctggggtcttctgctgccccctctgccggaagccctgttctgaggaggtgctagggacaggctatatctgccccaaccaccagaagagggtgtgcaggttctgtgaggagagcagacttcttctatgtgtggaatgcctggtgtcccctgaacacatgtctcatcatgaactgaccattgaaaatgccctcagccactacaaggaacgactcaatcgccggagcaggaagctcagaaaggacattgcagaacttcagcggctcaaggctcagcaggagaagaaactgcaggctctgcagtttcaggtagaccacgggaaccacaggctggaggctgggccggagagccagcaccaaaccagggaacagctgggtgccctccctcagcagtggctgggccagctggagcacatgccagcagaagcggccagaatccttgacatctccagggcagtaacacagctcagaagcctggtcattgatctggaaaggacggccaaggaattagacaccaacacactgaagaatgctggtgacttactgaacaggagtgctccacagaaattagaggttatttatccccagttggagaaaggagtcagtgaattgcttcttcagccccctcagaagctctgacctgttcatccctgggacacctcacttcaggctcacctcagcctcctctctctccttcctccaacctgtccaggcccccactgggtctacccagtgcatcttcgggcctgccagctcctgaacatgtcaccatttcttcatgtccacagtcatcacctgatgcctgaccctctgactcttggacgatagccagcctccttccaggacaggctcatgcttggggctgccactgtggaggtcggggcccatggtctccaggagcatttgtgaaatctccattttgcctgtaaactgatggtagtgcccatctctcacaatctcattcaaataggatcctccaggcctctgaatggcccgagctcatcagcagtgacaccacctcacatgtggagcccagctgagttcctgcagtacttgttgtctgtaccactcacctggcacttatttattattgttgtggaagacagactcaaagacagcctcccttcgtgatcctcacctcttggaattcatgcccttgtttggtcccctccccttgagtgtaagtgggatctgtgacttgcttctaatgaatggaataaggcaaaggtgatagggtgtcactctggcaactgtgttgcattgtatagaactcctccttgctggcccacccttttagagcccctcctaggagccaagagcagcttccagccaacaacaagcagaggccctcagtcttgtggctgcaagaacctgaattctgccaacaacccgagtgagcttggaagcagattcttccccaactgagccggataagaacctagtccagccaacaccttgattatagtcttgtgagtacctaagctgaggacccagtgaagctgtgccaaaatttcccacccacagaaacagtgtgacaataaatgtgtgtgtgtttttttgtt

SEQ ID NO: 195045 - DNA, 2006 bp, Homo sapiens
  Payload ID: 18501
  Gene Name: tripartite motif containing 40
  ENST ID: ENST00000548672
  CDS Start-End: 307-1083
aggtgtatgaaaaataatttcaagtttaacaaacacaaggaaaccgcagggtccatgtcaaagctgatgagctatttctgaaactcgtgaagaattgtggtttgtgtggtctatgtcacggcacccttgagggagagtgggcaattgcctgaacttggaggctgtgtcctgtccccaggctgctccagggctgcctccttccgactgggccttcttatctgggactgttgagggcaacaggccttccgaagaccagtgaagaaggaggccctgcaaacaggaggctgacagggtaggaacgaggccatgatccctttgcagaaggacaaccaggaggagggtgtctgccccatctgccaggagagcctgaaggaggccgtgagcaccaactgcggacatctcttctgtcgagtgtgcctgacacagcatgtggagaaggcctcagcctctggggtcttctgctgccccctctgccggaagccctgttctgaggaggtgctagggacaggctatatctgccccaaccaccagaagagggtgtgcaggttctgtgaggagagcagacttcttctatgtgtggaatgcctggtgtcccctgaacacatgtctcatcatgaactgaccattgaaaatgccctcagccactgcaaggaacgactcaatcgccggagcaggaagctcagaaaggacattgcagaacttcagcggctcaaggctcagcaggagaagaaactgcaggctctgcagtttcaggtagaccacgggaaccacaggctggaggctgggccggagagccagcaccaaaccagggaacagctgggtgccctccctcagcagtggctgggccagctggagcacatgccagcagaagcggccagaatccttgacatctccagggcagtaacacagctcagaagcctggtcattgatctggaaaggacggccaaggaattagacaccaacacactgaagaatgctggtgacttactgaacaggagtgctccacagaaattagaggttatttatccccagttggagaaaggagtcagtgaattgcttcttcagccccctcagaagctctgacctgttcatccctgggacacctcacttcaggctcacctcagcctcctctctctccttcctccaacctgtccaggcccccactgggtctacccagtgcatcttcgggcctgccagctcctgaacatgtcaccatttcttcatgtccacagtcatcacctgatgcctgaccctctgactcttggacgatagccagcctccttccaggacaggctcatgcttggggctgccactgtggaggtcggggcccatggtctccaggagcatttgtgaaatctccattttgcctgtaaactgatggtagtgcccatctctcacaatctcattcaaataggatcctccaggcctctgaatggcccaagctcatcagcagtgacaccacctcacatgtggagcccagctgagttcctgcagtacttgttgtctgtaccactcacctggcacttatttattattgttgtggaagacagactcaaagacagcctcccttcgtgatcctcacctcttggaattcatgcccttgtttggtcccctccccttgagtgtaagtgggatctgtgacttgcttctaatgaatggaataaggcaaaggtgatagggtgtcactctggcaactgtgttgcattgtatagaactcctccttgctggcccacccttttagagcccctcctaggagccaagagcagcttccagccaacaacaagcagaggccctcagtcttgtggctgcaagaacctgaattctgccaacaacccgagtgagcttggaagcagattcttccccaactgagccggataagaacctagtccagccaacaccttgattatagtcttgtgagtacctaagctgaggacccagtgaagctgtgccaaaatttcccacccacagaaacagtgtgacaataaatgtgtgtgtgtttttttgtt

SEQ ID NO: 195046 - DNA, 2006 bp, Homo sapiens; identical to SEQ ID NO: 195043
  Payload ID: 18501
  Gene Name: tripartite motif containing 40
  Uniprot ID: Q6P9F5
  ENST ID: ENST00000552119
  CDS Start-End: 307-1083

SEQ ID NO: 195047 - DNA, 2006 bp, Homo sapiens
  Payload ID: 18501
  Gene Name: tripartite motif containing 40
  ENST ID: ENST00000618891
  CDS Start-End: 307-1083
aggtgtatgaaaaataatttcaagtttaacaaacacaaggaaaccgcagggtccatgtcaaagctgatgagctatttctgaaactcgtgcagaattgtggtttgtgtggtctatgtcacggcacccttgagggagagtgggcaattgcctgaacttggaggctgtgtcctgtccccaggctgctccagggctgcctccttccgactgggccttcttatctgggactgttgagggcaacaggccttccgaagaccagtgaagaaggaggccctgcagacaggaggctgacagggtaggaacaaggccatgatccctttgcagaaggacaaccaggaggagggtgtctgccccatctgccaggagagcctgaaggaggccgtgagcaccaactgcggacatctcttctgtcgagtgtgcctgacacagcatgtggagaaggcctcagcctctggggtcttctgctgccccctctgccggaagccctgttctgaggaggtgctagggacaggctatatctgccccaaccaccagaagagggtgtgcaggttctgtgaggagagcagacttcttctatgtgtggaatgcctggtgtcccctgaacacatgtctcatcatgaactgaccattgaaaatgccctcagccactacaaggaacgactcaatcgccggagcaggaagctcagaaaggacattgcagaacttcagcggctcaaggctcagcaggagaagaaactgcaggctctgcagtttcaggtagaccacgggaaccacaggctggaggctgggccggagagccagcaccaaaccagggaacagctgggtgccctcccccagcagtggctgggccagctggagcacatgccagcagaagcggccagaatccttgacatctccagggcagtaacacagctcagaagcctggtcattgatctggaaaggatggccaaggaattagacaccaacacactgaagaatgctggtgacttactgaacaggagtgctccacagaaattagaggttatttatccccagttgaagaaaggagtcagtgaattgcttcttcagccccctcagaagctctgacctgttcatccctgggacacctcacttcaggctcacctcagcctcctctctctccttcctccaacctgtccaggcccccactgggtctacccagtgcatcttcgggcctgccagctcctgaacatgtcaccatttcttcatgtccacagtcatcacctgatgcctgaccctctgactcttggacgatagccagcctccttccaggacaggctcatgcttggggctgccactgtggaggtcggggcccatggtctccaggagcatttgtgaaatctccattttgcctgtaaactgatggtagtgcccatctctcacaatctcattcaaataggatcctccaggcctctgaatggcccgagctcatcagcagtgacatcacctcacatgtggagcccagctgagttcctgcagtacttgttgtctgtaccactcacctggcacttatttattattgttgtggaagacagactcaaagacagcctcccttcgtgatcctcacctcttggaattcatgcccttgtttggtcccctccccttgagtgtaagtgggatctgtgacttgcttctaatcaatggaataaggcaaaggtgatagggtgtcactctggcaactgtgttgcattgtatagaactcctccttgctggcccacccttttagagcccctcctaggagccaagagcagcttccagccaacaacaagcagaggccctcagtcttgtggctgcaagaacctgaattctgccaacaacctgagtgagcttggaagcagattcttccccaactgagccggataagaacctagtccagccaacaccttgattatagtcttgtgagtacctaagctgaggacccagtgaagctgtgccaaaatttcccacccacagaaacagtgtgacaataaatgtgtgtgtgtttttttgtt

SEQ ID NO: 195048 - DNA, 2006 bp, Homo sapiens
  Payload ID: 18501
  Gene Name: tripartite motif containing 40
  ENST ID: ENST00000614405
  CDS Start-End: 307-1083
aggtgtatgaaaaataatttcaagtttaacaaacacaaggaaaccgcagggtccatgtcaaagctgatgagctatttctgaaactcgtgcagaattgtggtttgtgtggtctatgtcacggcacccttgagggagagtgggcaattgcctgaacttggaggctgtgtcctgtccccaggctgctccagggctgcctccttccgactgggccttcttatctgggactgttgagggcaacaggccttccgaagaccagtgaagaaggaggccctgcagacaggaggctgacagggtaggaacaaggccatgatccctttgcagaaggacaaccaggaggagggtgtctgccccatctgccaggagagcctgaaggaggccgtgagcaccaactgcggacatctcttctgtcgagtgtgcctgacacagcatgtggagaaggcctcagcctctggggtcttctgctgccccctctgccggaagccctgttctgaggaggtgctagggacaggctatatctgccccaaccaccagaagagggtgtgcaggttctgtgaggagagcagacttcttctatgtgtggaatgcttggtgtcccctgaacacatgtctcatcatgaactgaccattgaaaatgccctcagccactacaaggaacgactcaatcgccggagcaggaagctcagaaaggacattgcagaacttcagcggctcaaggctcagcaggagaagaaactgcaggctctgcagtttcaggtagaccacgggaaccacaggctggaggctgggccggagagccagcaccaaaccagggaacagctgggtgccctcccccagcagtggctgggccagctggagcacatgccagcagaagcggccagaatccttgacatctccagggcagtaacacagctcagaagcctggtcattgatctggaaaggatggccaaggaattagacaccaacacactgaagaatgctggtgacttactgaacaggagtgctccacagaaattagaggttatttatccccagttgaagaaaggagtcagtgaattgcttcttcagccccctcagaagctctgacctgttcatccctgggacacctcacttcaggctcacctcagcctcctctctctccttcctccaacctgtccaggcccccactgggtctacccagtgcatcttcgggcctgccagctcctgaacatgtcaccatttcttcatgtccacagtcatcacctgatgcctgaccctctgactcttggacgatagccagcctccttccaggacaggctcatgcttggggctgccactgtggaggtcggggcccatggtctccaggagcatttgtgaaatctccattttgcctgtaaactgatggtagtgcccatctctcacaatctcattcaaataggatcctccaggcctctgaatggcccgagctcatcagcagtgacatcacctcacatgtggagcccagctgagttcctgcagtacttgttgtctgtaccactcacctggcacttatttattattgttgtggaagacagactcaaagacagcctcccttcgtgatcctcacctcttggaattcatgcccttgtttggtcccctccccttgagtgtaagtgggatctgtgacttgcttctaatcaatggaataaggcaaaggtgatagggtgtcactctggcaactgtgttgcattgtatagaactcctccttgctggcccacccttttagagcccctcctaggagccaagagcagcttccagccaacaacaagcagaggccctcagtcttgtggctgcaagaacctgaattctgccaacaacctgagtgagcttggaagcagattcttccccaactgagccggataagaacctagtccagccaacaccttgattatagtcttgtgagtacctaagctgaggacccagtgaagctgtgccaaaatttcccacccacagaaacagtgtgacaataaatgtgtgtgtgtttttttgtt

SEQ ID NO: 195049 - DNA, 2006 bp, Homo sapiens
  Payload ID: 18501
  Gene Name: tripartite motif containing 40
  Uniprot ID: Q6P9F5
  ENST ID: ENST00000616351
  CDS Start-End: 307-1083
aggtgtatgaaaaataatttcaagtttaacaaacacaaggaaaccgcagggtccatgtcaaagctgatgagctatttctgaaactcgtgaagaattgtggtttgtgtggtctatgtcacggcacccttgagggagagtgggcaattgcctgaacttggaggctgtgtcctgtccccaggctgctccagggctgcctccttccgactgggccttcttatctgggactgttgagggcaacaggccttccgaagaccagtgaagaaggaggccctgcaaacaggaggctgacagggtaggaacgaggccatgatccctttgcagaaggacaaccaggaggagggtgtctgccccatctgccaggagagcctgaaggaggccgtgagcaccaactgcggacatctcttctgtcgagtgtgcctgacacagcatgtggagaaggcctcagcctctggggtcttctgctgccccctctgccggaagccctgttctgaggaggtgctagggacaggctatatctgccccaaccaccagaagagggtgtgcaggttctgtgaggagagcagacttcttctatgtgtggaatgcctggtgtcccctgaacacatgtctcatcatgaactgaccattgaaaatgccctcagccactacaaggaacgactcaatcgccggagcaggaagctcagaaaggacattgcagaacttcagcggctcaaggctcagcaggagaagaaactgcaggctctgcagtttcaggtagaccacgggaaccacaggctggaggctgggccggagagccagcaccaaaccagggaacagctgggtgccctccctcagcagtggctgggccagctggagcacatgccagcagaagcggccagaatccttgacatctccagggcagtaacacagctcagaagcctggtcattgatctggaaaggacggccaaggaattagacaccaacacactgaagaatgctggtgacttactgaacaggagtgctccacagaaattagaggttatttatccccagttggagaaaggagtcagtgaattgcttcttcagccccctcagaagctctgacctgttcatccctgggacacctcacttcaggctcacctcagcctcctctctctccttcctccaacctgtccaggcccccactgggtctacccagtgcatcttcgggcctgccagctcctgaacatgtcaccatttcttcatgtccacagtcatcacctgatgcctgaccctctgactcttggacgatagccagcctccttccaggacaggctcatgcttggggctgccactgtggaggtcggggcccatggtctccaggagcatttgtgaaatctccattttgcctgtaaactgatggtagtgcccatctctcacaatctcattcaaataggatcctccaggcctctgaatggcccaagctcatcagcagtgacaccacctcacatgtggagcccagctgagttcctgcagtacttgttgtctgtaccactcacctggcacttatttattattgttgtggaagacagactcaaagacagcctcccttcgtgatcctcacctcttggaattcatgcccttgtttggtcccctccccttgagtgtaagtgggatctgtgacttgcttctaatgaatggaataaggcaaaggtgatagggtgtcactctggcaactgtgttgcattgtatagaactcctccttgctggcccacccttttagagcccctcctaggagccaagagcagcttccagccaacaacaagcagaggccctcagtcttgtggctgcaagaacctgaattctgccaacaacccgagtgagcttggaagcagattcttccccaactgagccggataagaacctagtccagccaacaccttgattatagtcttgtgagtacctaagctgaggacccagtgaagctgtgccaaaatttcccacccacagaaacagtgtgacaataaatgtgtgtgtgtttttttgtt

SEQ ID NO: 195050 - DNA, 3637 bp, Homo sapiens
  Payload ID: 18502
  Gene Name: tripartite motif containing 41
  Uniprot ID: Q8WV44
  ENST ID: ENST00000315073
  CDS Start-End: 711-2603
atcggctgtggggagtaccggctgcagtcggctgtgccgggagggtaggatggcgtctggccgatgcggtgatagcaccgaaagcagacggccgccaggcgctccccctaccccccgaagtttctccccagcggcgggggatgggggtaggcggttcctctgttctttctgcgttccccgcggcctcttaccacagagacgcgggcctccaccgtcctagccctcccgccctgttctctagtgcggactagagcgtctcctcgccatttcctgtcgccctggggccccgcggggaaaaagggggagtagcaggacagcggagggaagtcgcgagcttaggtggtgtgtagacgccggaagtgttgggaaggaggccggaagctaggggcggggccaggaagtgaggaggggcgggggtttatgaggagtccaagggagcattggggcagacttgtactcagagccacctgagggacttggcggtggcgcccagcactgtcccctcccctcgtagagacacggttgtcgtttgggagtagggaacactgtgttggggtgggttgtcggcaggacatctctctggctgctcttggggcgaggtgtggaggggcagggctgggggtggagccgggtcgccagggcgtcggtagggaagacccccgcccctcgcccccccaccgaacctctacactggctggctggacactaagatggctgccgttgccatgacacccaaccctgtgcagacccttcaggaggaggcggtgtgcgccatctgcctcgattacttcacggaccccgtgtccatcggctgcgggcacaacttctgccgagtttgtgtaacccagttgtggggtggggaggatgaggaggacagagatgagttagatcgggaggaggaggaggaggacggagaggaggaggaagtggaggctgtgggggctggcgcggggtgggacacccccatgcgggatgaagactacgagggtgacatggaggaggaggtcgaggaggaagaagagggtgtgttctggaccagtggcatgagcaggtccagctgggacaacatggactatgtgtgggaggaggaggacgaggaggaagacctggactactacttgggggacatggaggaggaggacctgaggggggaggatgaggaggacgaggaggaagtgctggaggaggttgaggaagaggatctagaccccgtcaccccactgcccccgcctccagcccctcggaggtgcttcacatgccctcagtgccgaaagagctttcctcggcggagcttccgccccaacctgcagctggccaatatggtccaggtgattcggcagatgcacccaacccctggtcgagggagccgcgtgaccgatcagggcatctgtcccaaacaccaagaagccctgaagctcttctgcgaggtagacgaagaggccatctgtgtggtgtgccgagaatccaggagccacaaacagcacagcgtggtgccattggaggaggtggtgcaggagtacaaggccaaactgcaggggcacgtggaaccactgaggaagcacctggaggcagtgcagaagatgaaagccaaggaggagaggcgagtgacagaactgaagagccagatgaagtcagagctggcagcggtggcctcggagtttgggcgactgacacggtttctggctgaagagcaggcagggctggaacggcgtctcagagagatgcatgaagcccagctggggcgtgcgggagccgcggctagtcgccttgcagaacaggccgcccagctcagccgcctgctggcagaggcccaggagcggagccagcaggggggtctccggctgctccaggacatcaaggagactttcaataggtgtgaagaggtacagctgcagcccccagaggtctggtcccctgacccgtgccaaccccatagccatgacttcctgacagatgccatcgtgaggaaaatgagccggatgttctgtcaggctgcgagagtggacctgacgctggaccctgacacggctcacccggccctgatgctgtcccctgaccgccggggggtccgcctggcagagcggcggcaggaggttgctgaccatcccaagcgcttctcggccgactgctgcgtactgggggcccagggcttccgctccggccggcactactgggaggtagaggtgggcgggcggcggggctgggcggtgggtgctgcccgtgaatcaacccatcataaggaaaaggtgggccctgggggttcctccgtgggcagcggggatgccagctcctcgcgccatcaccatcgccgccgccggctccacctgccccagcagcccctgctccagcgggaagtgtggtgcgtgggcaccaacggcaaacgctatcaggcccagagctccacagaacagacgctgctgagccccagtgagaaaccaaggcgctttggtgtgtacctggactatgaagctgggcgcctgggcttctacaacgcagagactctagcccacgtgcacaccttctcggctgccttcctgggcgagcgtgtctttcctttcttccgggtgctctccaagggcacccgcatcaagctctgcccttgattatcctgccacccgcaggggcccctctgtcagcacttggggggtgggtggtggagggtggcccgtaagtttgagggctcaaaggctcttcccactgcttgttactgtgttgcttcccactcccccttgaccccaggcccctgcttctccctctaggagcctaaagaaccctcctggcctccagctcagccttctctcacctactatgtctgtccaacaggtctgcatgggtccctgataatgagaacagctgcctggtcttctctcccagtctgcctagcccagccctgggactggaatttgagtaggggatgaggggaaattgtaatttcattccttaacttccttttccccacccctgctcttcaacctctttatcagttctgaggctggagggtttgggcaaggcaacatccccattccaattccattttctgatgcagattttagctgagggatttggaagccatttggggaggcaggctgggccaaagggtagagctgggtaataaatgtctattctcctggggaggagggattctaaactttccttccgtcctcaatttctacctccatagaccggccagaatttagcttcacttgagagagatctggaatggtcgccatgattgaaaccacgcaccattacatcatcattacattaattacatcaacataaattatttcttcccccttcccttttccagcactcaaccaaggagcaaagctcatcccaccccacacccctcccaggtctgctcactgccaggctcctctcccctttgttcagtggagctggcttttctcccagcccctttccatgcctttcactccatttggcaagctctgagggggagcctggggacgggtttgggtccccaggaggagagccttgggtataatctatttttctaggagcctcttgccttgtcacttgcagctttcgccctctgctttgatggctgaggtgaactcatgttctttgggaaaagggaaggcgtgctgtggaaataaaatgtttatttgcttctctt

SEQ ID NO: 195051 - DNA, 2696 bp, Homo sapiens
  Payload ID: 18502
  Gene Name: tripartite motif containing 41
  Uniprot ID: Q8WV44
  ENST ID: ENST00000351937
  CDS Start-End: 711-2267
atcggctgtggggagtaccggctgcagtcggctgtgccgggagggtaggatggcgtctggccgatgcggtgatagcaccgaaagcagacggccgccaggcgctccccctaccccccgaagtttctccccagcggcgggggatgggggtaggcggttcctctgttctttctgcgttccccgcggcctcttaccacagagacgcgggcctccaccgtcctagccctcccgccctgttctctagtgcggactagagcgtctcctcgccatttcctgtcgccctggggccccgcggggaaaaagggggagtagcaggacagcggagggaagtcgcgagcttaggtggtgtgtagacgccggaagtgttgggaaggaggccggaagctaggggcggggccaggaagtgaggaggggcgggggtttatgaggagtccaagggagcattggggcagacttgtactcagagccacctgagggacttggcggtggcgcccagcactgtcccctcccctcgtagagacacggttgtcgtttgggagtagggaacactgtgttggggtgggttgtcggcaggacatctctctggctgctcttggggcgaggtgtggaggggcagggctgggggtggagccgggtcgccagggcgtcggtagggaagacccccgcccctcgcccccccaccgaacctctacactggctggctggacactaagatggctgccgttgccatgacacccaaccctgtgcagacccttcaggaggaggcggtgtgcgccatctgcctcgattacttcacggaccccgtgtccatcggctgcgggcacaacttctgccgagtttgtgtaacccagttgtggggtggggaggatgaggaggacagagatgagttagatcgggaggaggaggaggaggacggagaggaggaggaagtggaggctgtgggggctggcgcggggtgggacacccccatgcgggatgaagactacgagggtgacatggaggaggaggtcgaggaggaagaagagggtgtgttctggaccagtggcatgagcaggtccagctgggacaacatggactatgtgtgggaggaggaggacgaggaggaagacctggactactacttgggggacatggaggaggaggacctgaggggggaggatgaggaggacgaggaggaagtgctggaggaggttgaggaagaggatctagaccccgtcaccccactgcccccgcctccagcccctcggaggtgcttcacatgccctcagtgccgaaagagctttcctcggcggagcttccgccccaacctgcagctggccaatatggtccaggtgattcggcagatgcacccaacccctggtcgagggagccgcgtgaccgatcagggcatctgtcccaaacaccaagaagccctgaagctcttctgcgaggtagacgaagaggccatctgtgtggtgtgccgagaatccaggagccacaaacagcacagcgtggtgccattggaggaggtggtgcaggagtacaaggccaaactgcaggggcacgtggaaccactgaggaagcacctggaggcagtgcagaagatgaaagccaaggaggagaggcgagtgacagaactgaagagccagatgaagtcagagctggcagcggtggcctcggagtttgggcgactgacacggtttctggctgaagagcaggcagggctggaacggcgtctcagagagatgcatgaagcccagctggggcgtgcgggagccgcggctagtcgccttgcagaacaggccgcccagctcagccgcctgctggcagaggcccaggagcggagccagcaggggggtctccggctgctccaggacatcaaggagactttcaataggtgtgaagaggtacagctgcagcccccagaggtctggtcccctgacccgtgccaaccccatagccatgacttcctgacagatgccatcgtgaggaaaatgagccggatgttctgtcaggctgcgagagtggacctgacgctggaccctgacacggctcacccggccctgatgctgtcccctgaccgccggggggtccgcctggcagagcggcggcaggaggttgctgaccatcccaagcgcttctcggccgactgctgcgtactgggggcccagggcttccgctccggccggcactactgggaggagcctaaagaaccctcctggcctccagctcagccttctctcacctactatgtctgtccaacagaccggccagaatttagcttcacttgagagagatctggaatggtcgccatgattgaaaccacgcaccattacatcatcattacattaattacatcaacataaattatttcttcccccttcccttttccagcactcaaccaaggagcaaagctcatcccaccccacacccctcccaggtctgctcactgccaggctcctctcccctttgttcagtggagctggcttttctcccagcccctttccatgcctttcactccatttggcaagctctgagggggagcctggggacgggtttgggtccccaggaggagagccttgggtataatctatttttctaggagcctcttgccttgtcacttgcagctttcgccctctgctttgatggctgaggtgaactcatgttctttgggaaaagggaaggcgtgctgtggaaataaaatgtttatttgcttctct

SEQ ID NO: 195052 - DNA, 1904 bp, Homo sapiens
  Payload ID: 18502
  Gene Name: tripartite motif containing 41
  ENST ID: ENST00000503114
  CDS Start-End: 1-1088
gcgccatctgcctcgattacttcacggaccccgtgtccatcggctgcgggcacaacttctgccgagtttgtgtaacccagttgtggggtggggaggatgaggaggacagagatgagttagatcgggaggaggaggaggaggacggagaggaggaggaagtggaggctgtgggggctggcgcggggtgggacacccccatgcgggatgaagactacgagggtgacatggaggaggaggtcgaggaggaagaagagggtgtgttctggaccagtggcatgagcaggtccagctgggacaacatggactatgtgtgggaggaggaggacgaggaggaagacctggactactacttgggggacatggaggaggaggacctgaggggggaggatgaggaggacgaggaggaagtgctggaggaggttgaggaagaggatctagaccccgtcaccccactgcccccgcctccagcccctcggaggtgcttcacatgccctcagtgccgaaagagctttcctcggcggagcttccgccccaacctgcagctggccaatatggtccaggtgattcggcagatgcacccaacccctggtcgagggagccgcgtgaccgatcagggcatctgtcccaaacaccaagaagccctgaagctcttctgcgaggtagacgaagaggccatctgtgtggtgtgccgagaatccaggagccacaaacagcacagcgtggtgccattggaggaggtggtgcaggagtacaaggccaaactgcaggggcacgtggaaccactgaggaagcacctggaggcagtgcagaagatgaaagccaaggaggagaggcgagtgacagaactgaagagccagatgaagtcagagctggcagcggtggcctcggagtttgggcgactgacacggtttctggctgaagagcaggcagggctggaacggcgtctcagagagatgcatgaagcccagctggggcgtgcgggagccgcggctagtcgccttgcagaacaggccgcccagctcagccgcctgctggcagaggcccaggagcggagccagcaggggggtctccggctgctccaggtgtgaagaggtacagctgcagcccccagaggtctggtcccctgacccgtgccaaccccatagccatgacttcctgacagatgccatcgtgaggaaaatgagccggatgttctgtcaggctgcgagagtggacctgacgctggaccctgacacggctcacccggccctgatgctgtcccctgaccgccggggggtccgcctggcagagcggcggcaggaggttgctgaccatcccaagcgcttctcggccgactgctgcgtactgggggcccagggcttccgctccggccggcactactgggaggagcctaaagaaccctcctggcctccagctcagccttctctcacctactatgtctgtccaacagaccggccagaatttagcttcacttgagagagatctggaatggtcgccatgattgaaaccacgcaccattacatcatcattacattaattacatcaacataaattatttcttcccccttcccttttccagcactcaaccaaggagcaaagctcatcccaccccacacccctcccaggtctgctcactgccaggctcctctcccctttgttcagtggagctggcttttctcccagcccctttccatgcctttcactccatttggcaagctctgagggggagcctggggacgggtttgggtccccaggaggagagccttgggtataatctatttttctaggagcctcttgccttgtcacttgcagctttcgccctctgctttgatggctgaggtgaactcatgttctttgggaaaagggaaggcgtgctgtggaaataaaatgtttatttgcttctc

SEQ ID NO: 195053 - DNA, 459 bp, Homo sapiens
  Payload ID: 18502
  Gene Name: tripartite motif containing 41
  ENST ID: ENST00000514219
  CDS Start-End: 1-349
ccaggacatcaaggagactttcaataggtgtgaagaggtacagctgcagcccccagaggtctggtcccctgacccgtgccaaccccatagccatgacttcctgacagatgccatcgtgaggaaaatgagccggatgttctgtcaggctgcgagagtggacctgacgctggaccctgacacggctcacccggccctgatgctgtcccctgaccgccggggggtccgcctggcagagcggcggcaggaggttgctgaccatcccaagcgcttctcggccgactgctgcgtactgggggcccagggcttccgctccggccggcactactgggaggtctgcatgggtccctgataatgagaacagctgcctggtcttctctcccagtctgcctagcccagccctgggactggaatttgaaccggccagaatttagcttcacttgagagagatctggaatggtc

SEQ ID NO: 195054 - DNA, 914 bp, Homo sapiens
  Payload ID: 18502
  Gene Name: tripartite motif containing 41
  ENST ID: ENST00000515499
  CDS Start-End: 341-914
tgaagacacacacggctgagacggccgggatagctctaggcaagcgcccttgtaggacaggcccggggacccctgccgcggccggctgagcggtgtccaggttctggagccggacttgtccaccgcagccgagtccgcaggtcctgtaatggcctagcatagttcacccacgagggttcgtggtttttggcgcgtttgatctgacatactcagaggcctgaccacccccctaggaagcgcgacgtccatctggagttttcccgcgagccgccttgagagcagggccaaactgcaggggcacgtggaaccactgaggaagcacctggaggcagtgcagaagatgaaagccaaggaggagaggcgagtgacagaactgaagagccagatgaagtcagagctggcagcggtggcctcggagtttgggcgactgacacggtttctggctgaagagcaggcagggctggaacggcgtctcagagagatgcatgaagcccagctggggcgtgcgggagccgcggctagtcgccttgcagaacaggccgcccagctcagccgcctgctggcagaggcccaggagcggagccagcaggggggtctccggctgctccaggacatcaaggagactttcaataggtgtgaagaggtacagctgcagcccccagaggtctggtcccctgacccgtgccaaccccatagccatgacttcctgacagatgccatcgtgaggaaaatgagccggatgttctgtcaggctgcgagagtggacctgacgctggaccctgacacggctcacccggccctgatgctgtcccctgaccgccggggggtccgcctggcagagcggcggcaggaggttgctgaccatcccaagcgcttctcggccgactgctgcgtactgggggcccagggcttcc

SEQ ID NO: 195055 - DNA, 450 bp, Homo sapiens
  Payload ID: 18502
  Gene Name: tripartite motif containing 41
  ENST ID: ENST00000617715
  CDS Start-End: 1-450
cttcaggaggaggcggtgtgcgccatctgcctcgattacttcacggaccccgtgtccatcggctgcgggcacaacttctgccgagtttgtgtaacccagttgtggggacggagaggaggaggaagtggaggctaccccgtcaccccactgcccccgcctccagcccctcggaggtgcttcacatgccctcagtgccgaaagagctttcctcggcggagcttccgccccaacctgcagctggccaatatggtccaggtgattcggcagatgcacccaacccctggtcgagggagccgcgtgaccgatcagggcatctgtcccaaacaccaagaagccctgaagctcttctgcgaggtagacgaagaggccatctgtgtggtgtgccgagaatccaggagccacaaacagcacagcgtggtgccattggaggaggtggtgcaggagtacaag

SEQ ID NO: 195056 - DNA, 2539 bp, Homo sapiens
  Payload ID: 18503
  Gene Name: tripartite motif containing 42
  Uniprot ID: Q8IWZ5
  ENST ID: ENST00000286349
  CDS Start-End: 192-2363
aatgccagcctatgagcttcctggtagggacaccagctgtgaagtcctcataacagccaacttcttgcaactttcaagctgacggcctcaggaatgggaggaaggactcctccactggagaactgatagcagtattctggtagaggaggcatcaagagtcctgggaggccggtggtaatcatgtaggcaccatggaaactgctatgtgcgtttgctgtccatgttgtacatggcagagatgttgtcctcagttatgctcctgtctgtgctgcaagttcatcttcacctcagagcggaactgcacctgcttcccctgcccttacaaagatgagcggaactgccagttctgccactgcacctgttctgagagccccaactgccattggtgttgctgctcttgggccaatgatcccaactgtaagtgctgctgcacagccagcagcaatctcaactgctactactatgagagccgctgctgccgcaataccatcatcactttccacaagggccgcctcaggagcatccatacctcctccaagactgccctgcgcactgggagcagcgatacccaggtggatgaagtaaagtcaataccagccaacagtcacctggtgaaccacctcaattgccccatgtgcagccggctgcgcctgcactcattcatgctgccctgcaaccacagcctgtgcgagaagtgcctgcggcagctgcagaagcacgccgaggtcaccgagaacttcttcatcctcatctgcccagtgtgcgaccgctcgcactgcatgccctacagcaacaagatgcagctgcccgagaactacctgcacgggcgtctcaccaagcgctacatgcaggagcacggctacctcaagtggcgctttgaccgctcctccgggcccatcctctgccaggtctgccgcaacaagcgcatcgcttacaagcgctgcatcacctgccgcctcaacctgtgcaacgactgcctcaaggccttccactcggatgtggccatgcaagaccacgtctttgtggacaccagcgccgaggaacaggacgagaagatctgcatccaccacccatccagccgcatcatcgagtactgccgcaatgacaacaaattgctctgcaccttctgcaagttctctttccacaatggccacgacaccattagcctcatcgacgcctgctccgagagggccgcctcactcttcagcgccatcgccaagttcaaagcagtccgatatgaaattgataatgacctaatggaattcaacatcttaaaaaacagctttaaagctgacaaggaggcaaagcgaaaagagatcagaaatggctttctcaagttgcgcagcattcttcaggagaaagagaagatcatcatggagcagatagagaatctagaagtgtccaggcagaaggaaattgaaaaatatgtgtatgttacaaccatgaaagtgaacgagatggatggtctgatcgcctactccaaggaagccctgaaggagactggccaggtggcattcctgcagtcagccaagatcctggtggaccagatcgaggacggcatccagaccacctacaggcctgacccacagctccggctgcactcaataaactacgtgcccttggactttgttgagctttccagtgccatccatgagctcttccccacagggcccaagaaggtacgctcctcaggggactccctgccctccccctaccccgtgcactcagaaacaatgattgccaggaaggtcactttcagcacccacagcctcggcaaccagcacatataccagcgaagctcctccatgttgtccttcagcaacactgacaagaaggccaaggtgggtctggaggcctgtgggagagcccagtcagccacccccgccaaacccacagacggcctctacacctactggagtgctggagcagacagccagtctgtacagaacagcagcagcttccacaactggtactcattcaacgatggctctgtgaagaccccaggcccaattgttatctaccagactctggtgtacccaagagctgccaaggtttactggacatgtccagcagaagacgtggactcttttgagatggaattctatgaagtcattacttctcctcctaacaacgtacaaatggagctctgtggacaaattcgggacataatgcagcaaaatctggagctgcacaacctgacccccaacacagaatacgtgtttaaagttagagccatcaatgataatggtcctgggcaatggagtgatatctgcaaggtggtaacaccagatggacatgggaagaaccgagctaagtggggcctgctgaagaatatccagtctgccctccagaagcacttctgagccccttcagagcaggaaacaacctcagactcatcacaaagtagacatatacacacacatatatgtatgtatatttttctcaccacattcttcaaggaggttgtagacaaatgtttccatgacctctcagctttccaacaggaatcttgtaagagctaataaaaggaaatacctga

SEQ ID NO: 195057 - DNA, 1682 bp, Homo sapiens
  Payload ID: 18504
  Gene Name: tripartite motif containing 43
  Uniprot ID: Q96BQ3
  ENST ID: ENST00000272395
  CDS Start-End: 137-1477
acagagtagctttgcaactggctttggggacttccgaaagctaccagcactgcactgtgagactctcatccctgagctgaattcatctgattcgacggcaagctttggtgagaacatagatatatttctgaggaaaatggactcagacttctcacatgccttccagaaggaactcacctgcgtcatctgtttgaactacctggtagaccctgtcaccatctgctgtgggcacagcttctgtaggccctgtctctgcctttcgtgggaggaagcccaaagtcctgcaaactgccctgcatgcagggaaccatcaccgaaaatggacttcaaaaccaatattcttctgaagaatttagtgaccattgccagaaaagccagtctctggcaattcctgagctctgagaaacaaatatgtgggacccataggcaaacaaagaagatgttctgtgacatggacaagagtctcctctgcttgctgtgctccaactctcaggagcacggggctcacaaacaccatcccatcgaagaggcagctgaggaacaccgggagaaactcttaaagcaaatgaggattttatggaaaaagattcaagaaaatcagagaaatctatatgaggagggaagaacagccttcctctggaggggcaatgtggttttacgggcacagatgatcaggaatgagtataggaagctgcatccggttctccataaggaagaaaaacaacatttagagagactgaacaaggaataccaagagatttttcagcaactccagagaagttgggtcaaaatggatcaaaagagtaaacacttgaaagaaatgtatcaggaactaatggaaatgtgtcataaaccagatgtggagctgctccaggatttgggagacatcgtggcaaggagtgagtccgtgctgctgcacatgccccagcctgtgaatccagagctcactgcaggacccatcactggactggtgtacaggctcaaccgcttccgagtggaaatttccttccattttgaagtaaccaatcacaatatcaggctctttgaggatgtgagaagttggatgtttagacgtggacctttgaattctgacagatctgactattttgctgcatggggagccagggtcttctcctttgggaaacactactgggagctggatgtggacaactcttgtgactgggctctgggagtctgtaacaactcctggataaggaagaatagcacaatggttaactctgaggacatatttcttcttttgtgtctgaaggtggataatcatttcaatctcttgaccacctccccagtgtttcctcactacatagagaaacctctgggccgggttggtgtgtttcttgattttgaaagtggaagtgtgagttttttgaatgtcaccaagagttccctcatatggagttacccagctggctccttaacttttcctgtcaggcctttcttttacactggccacagatgatcaggattaagaaaacttactgtttgggaactccatatacaagggagcccttcactgttgatacaaagaaatcatactgttcaggcttttttgtactttagtgtcacttcattttattgctattaaataaaaaatttgtaaaaggcaaaactttttgtacattttcttacaattaaaataatctcttatggaccattacctaaaa

SEQ ID NO: 195058 - DNA, 12964 bp, Homo sapiens
  Payload ID: 18505
  Gene Name: tripartite motif containing 44
  Uniprot ID: Q96DX7
  ENST ID: ENST00000299413
  CDS Start-End: 308-1342
ggaggctgagcgggcggcgcgacgcgggggccgacgggggcgccgggtggccgcgccggaagtgccttgcgcggcagaggaagcgcagggacagagcggagcaggccgagccggcggaaagggtctttgctgctgcgcccgggcaggggctgccgcggccccaggtcccgcttcgagacgcggcgcggtccaggcgggaggcgactccctaggaagggacccggggcgggaggaggaagtgaggccgcgcggaaggaaggcggcgagccccggggccccgaggccttggccgcgtcacagcacccacatggcctctggagtgggcgcggccttcgaggaactgcctcacgacggcacgtgtgacgagtgcgagcccgacgaggctccgggggccgaggaagtgtgccgagaatgcggcttctgctactgccgccgccatgccgaggcgcacaggcagaagttcctcagtcaccatctggccgaatacgtccacggctcccaggcctggaccccgccagctgacggagagggggcggggaaggaagaagcggaggtcaaggtggagcaggagagggagatagaaagcgaggcaggggaagagagtgagtcggaggaagagagcgagtcagaggaagagagcgagacagaggaagagagtgaggatgagagcgatgaggagagtgaagaagacagcgaggaagaaatggaggatgagcaagaaagcgaggccgaagaagacaaccaagaagaaggggaatccgaggcggagggagaaactgaggcagaaagtgaatttgacccagaaatagaaatggaagcagagagagtggccaagaggaagtgtccggaccatgggcttgatttgagtacctattgccaggaagataggcagctcatctgtgtcctgtgtccagtcattggggctcaccagggccaccaactctccaccctagacgaagcctttgaagaattaagaagcaaagactcaggtggactgaaggccgctatgatcgaattggtggaaaggttgaagttcaagagctcagaccctaaagtaactcgggaccaaatgaagatgtttatacagcaggaatttaagaaagttcagaaagtgattgctgatgaggagcagaaggcccttcatctagtggacatccaagaggcaatggccacagctcatgtgactgagatactggcagacatccaatcccacatggataggttgatgactcagatggcccaagccaaggaacaacttgatacctctaatgaatcagctgagccaaaggcagagggcgatgaggaaggacccagtggtgccagtgaagaagaggacacatgaaggcttgctacccccagtggaaaatcatcccctccccttgtgtgtatgtgacagcgtgtatgtaacggcttctgatttctgtgaaagctgctcagcaacaaacgtacttccaccagatgtgtccccagatccacagcaggcacatatctctccaagggatgaccagttttatgcttactgtgtgcttctcatcccctggttgtggtaggtcaaggaaaagagcccctttgatccaccaggagcaattaagaaaggtccttcaggtaatccctcaatggctgctttgaacttactcaggaaagccagcccccataatattgtattaccaaacagtatcgctttgttaggaaggatctggaataatcttgaagggaagtcagagttttctccctgcctattaacaaaaacccaattttgttcatattgaagcatgaaataaatgagagcaaggtagggccaaattaactcttgtggacagtccctaaaagtccagttctacatttgtgaaaattgtggtgccatgaattaagatggatgactggaaaaaggtgttggagaaagagttaaagatgaggaagagatatttttagtatatgaagttatccaggacttgatattcataattcagtgctgtggaaatgaaaaaaatgattgaagaggtggaacggaaatgaccttagggggaaaaaaaaggaccaaagaagtctgattaaaagttgaaatcagtatttctgaattcaaattgcttgaatttccaaaatagtcagtaaaggatctaatagaaccagaattatttgggtgaattctgcaggttttatgggcttgtcacaacgtgaagggctggaatgtatattaccaaatgggaatttccattgtaggtttttgctagtcccacccccattttagcctaatttggcttaaacgcagtatggggagaattgttcccattccatgtgttctgaattcagctcatctcccagcatatagatatatcctcctttaactccgaccagaacccttcttcctgtggcactccccacccatagaccttcagatcatctcccacaccctggatctcactctcctcttagtaacagagacactcctgaggttggacttccttgcttttctctacttccaaatcacaatttcttacaaccaagctttgtgctcccgagtaagcagggatgtactaggggaatgtaaaactgcaaacttaaaaacctgcatcttcttgaagcatcagttttacttaccaaatggtttagagtcataagatgacctatttttatataaaagttatattatagaataaaatgttcatacgcatagactgttaagataaaaaaataggaatcttgcaaggtaattcttatttgcaagtgggttatgtgttcactctcctctacctttatggtattttggtgttcacttacgaagcatacaactagaaccatatccaagcagactctgggttgctgttaacccagggcctagacttctagtgcctctgaggcagaaccaaaggagcctgcactgggggaaatcccttttcctgcctgcctgtctgcctgtgacctgtgtacgtattacaggctttaggaccagctgattgttatgcttgcaggatggttttgaaacagaaacaatacttgtttactgtaggaatcctatttatattatttttcagtcctgtgaatgctgtgaaaagatttattcctttgaggccaggaagctcccaggcatatatgcttctaggttaggattgtcctgactcactaaagatgccaggatattggggctgaggggagtttgaggtgttaaaaaaaaaaaaaaaaaagcatttttctctcaaactgatggccaagaaatggctaggacaattttggtgctttacctatctctgcaaagactggagaatttggcataccattaattacaaccaccaatcatatccaacaaaagtaccctaaaagaaggaccagtggccactctcgaaaaaatttaagtatcagaagattaaaaagattttaggatttggaagcttgtattgtctttccccaataatcattgtttgatctccaaatagtagccttatattagcaatagacagatcattggttctccatatctgatcatatgttactactttgaatcagtatttgggaaattcaagcatttatgcagtggatataaatggaaatataaaaatatttgccaacctgtctcagtaacttatcatatctctgtgatcctcaaggaaagcacttttgcttttacttagaaagcgtttcagatttgctttatagactcctgctgtcttcagtacctgataaaactttaaccagggaagcattaaacacagtgcagcagcttttgcccaggcttctaagttcctgccggcagcatttatcaatgtaagaactaggatgcttcctgcagtggcactaccttcccctagagctggagcatgctgcttggccttaagccccagcatgatgaggcttccctcctgccaggtcagtaaaagttagagagctcagaattgggtcttgcctgggtgcaggtggcagggtttgctgaaacccctaaagagaagtcaccaagggaggcaggtaatgaatgtttccagaatcagtcggatactcatagcaatttctggctatctttcaaatgttgaatttctggatgctgagagggactttgatttgatatcattaaatccaggacagtcccaagaagtgcttggagtctcggctctgacagcccaagaagggaaataacttgtattaaggaacaactatgagccaggccctgagctgtctcttagataataaaacagatggggagtggaagagtcatttgcttcaagttatacagctaggaaatactcaagccaaatcttgaacgcagctccccctaattctgtggacaggcactttgtaccacacaccatggtccacctaaaaacagaaggataaaaagacttcaggttttcccactgtgtgctgaccatcccaatttatgaatcttcttcaaaatgacatttcacagttatagttagggctcagaaatggcattgaggtagccttatttctcccctttagcagatgctttaagtacacattgctgacttgagcccacccccaggagttaggagaacatttcctttttcatgccatcttccataaataaggtgtttcttggccttcaaagatatagaactttgcagcagtagtaaaagtgaagggtgttctgctctctactcaactttatttgaaaatgtctgcagcttcactcctgtagaaaaggaaatcttcatattttagtaaacttagccgccagtgtactctgtgaggatgtggcaattcaaagtccagtgaatctggactctcttactgattcctggttttagtgtgtgtgtcgggggagtgtgtacctatatataaaggacaagtgtgatatgtgtgtatatgtatatacatacatacatgtccgcacacacacacacaatatttgagagctaaggaaaactcaaagcagccccttcattatcttgcgtactacttcaaagatttctgtcagccctaattacaagtgtcaccatatagttggggcttaggtacttgcttacaggaagagcaattccctagcaaaggtcattagctcctaaggcactgagtcaaagtgacagccctgaaggaaattgcactccagccctcctccaggatgtctaataagatgggaaacttggatgcccagccattttggtgacctgagagtctaactactccagttagacctaagggcacaaatgcagaattcatgaccttgtagttgtggcagggtctaggaagtcctctctccccaagtagaaaatattctcttgccattcctgaaattccacattcatataatggctgtgcaatacatgcttctcaataagaaaattaactgcacgtttactgtgtgctgatcacatcagatttttatgtttaaaaaaatctcattatggattgagtccagcccagctctaagagaaaaagaaggcccatatgggagacttcagtctcattattattgcctttatccagcagtgcttatgaagccccctaccctgtcccattccagaaaccataagactcaggcagttcttgattctggaggcctgcctggtaagataagatagtataatttggaactgagaacataccagaaacagcagaacgagggccagagcagaaaaatgaaaataagtggagacacttatggatacattggtgcaaaaaaagccacggagcccatactgggcttgatatgactttgaggggacagcagattaatacttaatgagggttaaacctgaccagtctttctacagtgacaggccacactgcatgaatggggagaaccaatgaatccattgtcctctgcctattttcctgtgcacagtcacattccctccttaggaatcttccccttccaccctttacattaaacaagggaacactgaatctttcaagggaattacacgtttgggttaatgtttcagtatatcattttcatactgtaaattattttgtaagagagatttactgctatcccaggatgttcggacttggtgcccctgtgcatttggaaatcaataaactattactggaaatgccatttgtctctcagagttgtgcacaaaggaccctgcaaggtgtaaatatttatgacgagctgcatacttgactgtggtaatgctggagatgatggtgttttggttactagatgtgggagtctaatttactcctgacttttccacagtgccttaggagagagctctgggaagtggcaaaagaacagacttaagatcattattatttagtgataagttttctcctcaaagtaaaatgatccaggcctagattacattttatgagcaacttagattataacctaaagaatacttggtgccaaattatgttttcaaataacattaaagttttagaatttggatgaactagaaggaaggtaaaattgtaatttttgccatattttctagaaaaaaaaatgtcttttagagcaaattacagttaggccaacaaaatctttgttttgtgaaactttagaaatacatatttgcatgtaattgatgaaaacatagaatgagttgtaaatgaagcaattccaagctggtttgaaggaccagaggttgcattgaaatcagaagtcatatactcagaggccttcaggagccaaatgtgaagactcaagatggtagatactgtgtgaattagaaaataccaagccctgcctaaatgcattaaaatttaatgtttaaaaatcctaaaacccaccagcaggtgtatctggagggacagtttgtggactctcctctaaattttcttttaacacatttatcttcatcagacccttttagttagctagggactgtgtgagaaccttgagaaaattgtccaagagagggagataagtcactcaaggtcacccaacaagccaggctggtaaagcccaggacagcagactctctgtctccgagagcaatcattaggccctacttcctcttccccagttgcggaggacactgctgcctggtggggtggcactgcctgccactgtagcacttaggagtcttcagtgttttaacaaaccacaatgtgtttggaggttttcttccctgcttcctggtgccagtatctcaacaccacatccattgccccagccctttcttgttttatctttccctctgaaagctacaactctatattttattttattactctttgtttggtccaacatggccccatttcctttatactcataaaaaggtagaatttcagcttgtctggaatatctcctggccttcacaaggcaccagagttagagacacccaacagaaagtcgtaataagagaagatgtcacagaaatagaaacaaaagcaaaagactgcttgaagtcagtaacagactgcactaagtgtctgtgcttgttaactattgtaatctccaggtttaaatcattcatttatgttaataagagctgtcacttagctctttctctgggccaggtactctcctgttgtttttcacattatcataatagtaacagcaccaatactatcattccccactttgttgctcaggaatcaaatttagagaattaagtactgtgaccacggttacaccctaataagcgggaagccagaatttaaacccaggtctagcagacttcacagcctctttccttaatctcttctctcctagctgcactgattccatcttgtattggtgaataacaacactgatccccctacaactacccccacacatgtacagtatggccttggggcaaaggagtttgccttttgcaaagaaggtcttgctttgtatagcctgtaaaatgcaatgtacagtgagggaaagaaagtctaagggtagcagtcaaatcttctggcctgaaactgtacttttggaagggagaactgttagacttgctttatcttctttattccaaggccataaataagaaaatcaacgagaggcaaaaccatgtcttcttttgctatagcgttagaatcctgaaagtcagccagctctgacactgagtctgtgatttaattaaacatgttgaaggctctccaacagcttgacgtcaggccagcttcatattcttggaaagggacaacagcaaaaggagcttatctgttttaaagttcacttactgagttcagctgtcacggccacagcataccatttgccttataaaaatggcccacaaccttcacaatattttaggattcatggcaactcatttacctagggcttagccacctgatagctttacctatccctatttcctgaacacaaaatctaaaccagtggtttgacaatgagtaactgagacagaactagaaaaatctagaacctctgctgaacccatcaaaagtgactgagaattaagaagtaagcaaacaaggcttccaaccaattgaaataaataccatgaagcaaacgcataagacaaaggccatacatctagtcatcaggcacctcctcagaacctatttgctcttccttcacacatatttctaactgtaaaggaaagaaacagacttttagaggaaacaagaaggaaaaaggaggacagcaatagagaaaatggaaattttgagtagactgcaaagctccaaagccctgatatatgggttatttagtgtcaaaaacagtctatacacatctcaatctttaagagcctcactgtatcatgggacaatattctatttaaaatgatgaccctgtgcaccatacataaaaaaactatgcttagaagacaaaaatatgtatatcaaacattttagaaatatttacatcccaatggttaaaaaaaaaaacttttaggaattaaaaggaataaacctttgaccatccagaatatttagctaaatcaaacagtgtatatccccctagctgacttttattgtttcatgagcctctggtgttcagagagtttttttcacagctttgtaagtgactttcatgctacagtgctttgcatataatggcatgaacagtggaggtgccaactttccaatgtgatgaataaaactaataactagaatacagatcaaattctgttacaacaaatactgctaccataaaagtcacttaagcatccctgttagttctaagcccctgtcgattgcccatttattttaggcaatagtcattcaacaaaattggagcataataaaaagaaactggacctcagcgcaagttgagtgttacacaatttaacctgtaataacaggttctcacttgtatttctccagctctttgctgtaagaagaataaacgttatgtagatataataccagcgtgacagcttgtggttggtggtttctagaagaaataattcagaagcaaaagacacatgaagttatgtggcagttcctcactagggaatttggtctccagggccacttttgaccttaatccatgttggagccatcaatcaaagaattgcttgcatctaataatggtgtaatgccaatactaagccctggaacgaagataggattcatttctcatggattattgagcactctggggtaacctggccctgatctgatgacgctaagatttaaaaacccagatgcatgtgactagaactatcttttctcccatgatgcactgctttcaacactgcatgactgtaaaaacatgtgccacgctgattatatatagagatggtctaaatcagctgcatcccatttggtacccaggcaaggatttttccatacctatctttttgctggtggtaatgatgagttttgtcacttgctataacattctctgtccgtcttttttcttttatgtaaatacttttgtgacttcattgtaaccagcattttgtaatactcttaacagcagaggggattaaatcatgattcacttctgaacagtacaatcagcagtaggaaaacgaggagggagggagagggaaattgtccaccacttcccaatgataatgcctggctcggaccccagattcacatcatacttgaagttcataaattctgggcactgctcagcttgaggaggcaggcattgctccttcatatttcagggtgagacaaatgctctgttgaagccatgccactacaggatacattcacctctgcttgctttcctccctaagccagagtgtagttaaacatttatatgtcccaggccaggagatcaaattaagaggaggttagctactttccctggctcttaaaaacatttgagtccaagtatggttctctggcttgagggtggccatttgttgcctcactgtttttattaggacatctggagattagaggtgttaattggaagtaacttttctatatttggtttctctccacacattatgagaccttttagacccagttggatggctgtatcctagtatgaaattcagcttctaagtaggaagaactatgatagaggaacaagattgctctttgacttggtgatagtagggcaatagggagtgtcagtagggtagtttcaggtggggaggatgacaaaccactgataacaataaaaatgggtatttctcaacactcaagccaatttcccatttgataacaagtaggttctgatctattttccccaaattaatattttccctggaagattctgacctgtctgatcaaataaaggcattcctctgagagtatacctagcccacttgtggccaaattatacttgactgttatgtactcaaaacaagctttcctgttaatctctttctcttacctctattatgaggacaagacgtggaagaattaggtcaccggggcatctgccattgcatatgtttaagtggtataaagaagccaggattcctagaatggtctgtcttttgccatttctgggacaatgagaaaatccatctggagtgtttatgcccctctgaatagccaagtcatgggcttgtttgctttcagtcactgccttcagaaaaagacaattttacaatgacttacttctaataatcactgaaacagcctcatgaggacatgcaaaactgctgtctatcttcagacctggcccattgtcaaatggcagacttgcagagcaaataagggacctggcctagttcacaaggcagtcagaagtgatccaaagttcaggctccccctcccttttatcactccaccctgcctctactcctccgcctcctattcttccggcctttccatctggaaaccatgagcctcatggattccaggcacaaattctcagatttcagatgtttgggaaatttctcagcttgggtcattcttcaagagtaagaaattgaatttgtgagaaaaaaaaacagctgagactgtttcacagaagagaaaataaataaggtgtggtgcgtatccatcctcttcccaactcagctccaaaaccacacacaatgtctaacttcaaaaagagtatttagatcccccctgggaaggaacagaatggaaaaacaatctccactcataaaaacacttttctgccttctacagtataaacacaactggcatcagataatacaatgtaattgattttatgtgtgtaattggggaacagaagggtctctagagggtagacctaagagtaatggaatggagtgaaaagtaaaatttagactaaattgttgggaggaaactgttaacattgtgaaccacttgaccctagtgttgcatcttcacaaaaaagagcaatgtgccgtcttctgtctttggaaaatgggacaagcttgctcctgatactaggttttagaagcatacagacttggttttagtactggctttgttctttactaactctgaacaattaaatgagcagatggtctacagggcttagtacagtgcctgacacatagtaagcacttagaaatggtagcttctgactgttgtgctggagtcctgttagagattcagtagatggagccaccttcatgttgcccctcactgagctgctctgctcacctctagatgctccccatggctgtttcatagccctctgtaccacatccccatgtactttttcatatcaacggtaagtacctcaaattaccgtatgtatttacttgttcataaggttgatgtctgtaactctttgaaggttgtattagtcgtttgctcctatattactaatgatgacaaagtcgcctgacagagtagatgttcaaatttatggacttaaactgactgacatcttgataatgcccatatccagaggtactccagatattatatcttcatgcagaaaactgaaagatacctttagctacatctaccccagaatgagtgtccaaagcaggtggcaccaccaaaaggcaccttcttttcccatgaaaagagggaagagagttgagaagcctcactcccatccctgctctgccactgacaagttgtgtggcatttggcacatcatgttctctctctacatgcgcctaaaatgacgggtagggtcagagacattggaggatctctcttttctcttccacctctaacacggtaagatcttagcaaagtaaaaaggacagtgataacagaaaaattgttcctctaagagtcccaagtcatcttttttctctccgtgtgtgttagcatttgtgtgtgtctgtgggtgtgtatgcatgtgtgtggaagctatacaaggaaagctgaatccatatgtagacttcatggagactagtactgctccaaatgtgcacaagccatgtgatatggtttgcctctgtgtccccacccaaatctcatgttgaaatgtaatccccaatgctggaggtgggacctggtgggaagattggatcatgggggagttttctcatgatttaacaacatccgccctttgttgtcatgatagtgagttcttgtgagatctggttgtttaaaaatatgtgacacctccccccaccttccttctgctctggccatgtaaagtgctcactccccctttgccttccaccatgattgtaagtttcctgaagcctccctagaagctgagcagatgccagcatcatgcttgctgtgcagcctgcagaactgtgagccaattaaacctctttatgaatta

SEQ ID NO: 195059 - DNA, 3515 bp, Homo sapiens
  Payload ID: 18506
  Gene Name: tripartite motif containing 45
  Uniprot ID: Q9H8W5
  ENST ID: ENST00000256649
  CDS Start-End: 528-2270
gggccgaggcgcgggagaggcggtggacaccgagaagcccgccggcggcttgcaattccctcacccggcgcgcgcctttcgcagagggaaggagcaagagggcccctacctcatcgtgcgcgggtggggtcggcgcttgtcgcgtgtggcgcgcagtggggcgggcggcgggaggggggtggcagtggagggagcgagaggtgcaggggtgactttgttggcagcaggactagctggagagctagacctggaagcgcatccggggaggacttgcggggcagaggagggcgtgggcgtgtctggtgtgggatgcagtggaaaggagggggccctcctgagtagatctgtgggtgattccttcgaggacgcctcgtcttcccgtctgcccttttatttgtcagcgagggagtccccatggtctctgttcaagttctggagactttctctttgggtgggcttaatcacctgctactaaatcgtagaactgcccagggccctttctaatattggtcacaaacgtgaggagtatgtcagaaaacagaaaaccgctgctgggctttgtaagcaaactcactagtgggactgcacttgggaactcaggcaagactcactgccccctgtgcttggggcttttcaaagcccccaggctcttgccttgtttgcatacagtttgcaccacgtgtctggagcagctggagcccttctcagtagtggacatccgagggggagactctgacacaagctctgaggggtcaatattccaggaactcaagccacgaagtctgcagtcgcagatcggcatcctttgtcctgtatgtgatgctcaggtggacctgcccatgggtggagtgaaggctttaaccatagaccacctggccgtgaatgatgtgatgctggagagcctacgtggggaaggccagggcctggtgtgtgacctgtgcaacgacagggaagtagagaagaggtgtcagacctgcaaagccaacctctgccacttctgctgccaggctcataggcggcagaagaaaacgacttaccacaccatggtggacctaaaagacttgaaaggctacagccggattgggaagcccatcctgtgtcctgttcaccctgcagaggaactgaggctgttctgtgagttctgtgaccggcccgtgtgccaggattgtgtggtgggggagcatcgggaacacccctgtgacttcaccagcaatgtcatccacaagcatggggactctgtgtgggagctcctcaaaggtactcagccccacgtggaggccctggaggaagccctggctcagatccacataataaacagtgccctccagaagcgagtggaggcagtggcagctgatgtccggacattctcggagggctacattaaggccattgaggagcatcgggacaagctgctgaagcagctggaagacatacgggcccagaaggaaaattccctgcagctgcagaaggcccagctggaacagttactggcagacatgcggactggagtggagttcaccgagcacttgctgaccagcggctcagacttggagatcctcatcaccaagagggtggtggtagaacggctcaggaagctgaacaaagttcaatatagcacccgtcctggagtaaatgataagatacgcttctgtcctcaggagaaagcaggccagtgccgtggctatgaaatttatggtacgattaataccaaagaggttgatccagccaaatgtgtcctacaaggagaagacctccacagagcccgggagaaacagacggcctctttcaccctgctttgtaaggatgccgcaggagaaatcatgggcaggggaggagacaacgttcaagttgccgttgtccctaaagataagaaagacagcccagtcagaacaatggtccaggataacaaggatgggacatactacatttcctacacccccaaggaacctggcgtctatactgtgtgggtctgcatcaaagaacagcatgtgcagggctcgccattcactgtgatggtgaggagaaagcaccgcccacactcaggcgtgtttcactgctgcaccttctgctccagcgggggccagaaaaccgctcgctgcgcctgtggaggcaccatgccaggtgggtacctaggctgtggccatggacacaaaggccacccaggtcatccccactggtcatgctgtggaaaatttaatgagaaatctgaatgcacatggacaggtgggcagagcgcaccgaggagtctacttaggactgtggctctctgatgggtttgtgctcagccttttaaagctgcaggcagcaccacttgagatttccagaggacccagaccttcgttcattctaaagagactgatagaattaaaaacaaagtgccttatcttgcactggagttcaagtgctcttttgttagttattcactgattgtacttgtggatggttgagcacaaaaaaccacctctacatttctcttaaaggtaggttggcaacgttctttttctaccacaggatactccttttcattttgtacagtatggaggtatctattccattggcactgaagggtctaggtagtttagttcctttctgatataaccctttttttttcttttttttttttttttaaagacagagtctcactctgtcacccaggctggagtgcagtggcatgatctcggctcactgcaacctctgcctcccggttcaaatgattctcgtgccttggtgtcccgagtagctgggattacaggttcccccccaccttcccccacacccagctaatttttgtgtttttagtagagacggggtttcaccatgttggccaggctggtctcaaactcctgacctcgtgatccacctgcctcggcctcccaaagtgctggggttacaagcatgagccaccacacctggcctattatgacctttttcatttttctctgagctacacattatttagatatttcccctagagattagaaacctcctttcatcctgtccactttttgttagcatactttcattggatttactggtacatgttttgtgatcatgataatgtgatcttgttttggtggtgtccccctactccgtctctatgccatgacagccttctgccccaaagcctggaagattactctttggtcaagggcatacaaatagaaagttaataaaggggaatggtgttgaaatagaacctcatacatttattacagttctacttatacagaaaatctagacaccttcatccttctcacagctctgttttttagtagagtagtctttagagtagtcttcactgttatctatatacctagaaagttaactgggagctttgactcttactgtgccttcactcatagtgtgccttcttagctgctggagaatttggggagaggatgtacacagcactggtgcctcagccctgccaaggtcttcactgtatatattttgtgtgttcttctgaaactcttgatttcttatatggcaataaactcagcatgtattaaatataa

SEQ ID NO: 195060 - DNA, 2415 bp, Homo sapiens
  Payload ID: 18506
  Gene Name: tripartite motif containing 45
  ENST ID: ENST00000369461
  CDS Start-End: 724-2295
gttacacaggactgtggaatcccgggtgacattcaactccttaggtcatctgcactccccccggaccggaaaacaaagccttcccgagcccgacaaggagggtggcgctccctggcccggccgaagtaagccctccattcgacacctcggctccacggtctcccgaaccggtccccgtaacgcgagcctgagatgccctcacccccgaaaaatacccaaagtcggggagccgcgggagtgcttgtacccagcacgctaggcctgagggacctgtgagctacagtaagcgcctgaggacagaggggagcctcgcagcctcaaacccgcgtggaggagaaacgtctggcgcccccgagcggccgagacctcgggagcccgaaaaacgtctcccactcccagcgcagagccaactgacagtgccatccaccaatgggagaacccagtctgcgttcgtgggacgagtccgagggcagaaagaaggccgtcccggcgccaaatcagcgtggctttttaagaggtcctgaggcctctctggtcaccacagagagagggacagtccctgtgaaacggtgacgctgactacactatgccgctcgctccgagccttggccttttcctcccgccgcactctaagcccttcggccgccccgcccacggccttgtcaggtcccgccccccgcgtgagtggactggcgaagatgtggaatttccaaaacttattggatgcttagtggcgtcactctggagggcggcggggcccggagcggcgagggccgccgctctcggacggaactcaagccacgaagtctgcagtcgcagatcggcatcctttgtcctgtatgtgatgctcaggtggacctgcccatgggtggagtgaaggctttaaccatagaccacctggccgtgaatgatgtgatgctggagagcctacgtggggaaggccagggcctggtgtgtgacctgtgcaacgacagggaagtagagaagaggtgtcagacctgcaaagccaacctctgccacttctgctgccaggctcataggcggcagaagaaaacgacttaccacaccatggtggacctaaaagacttgaaaggctacagccggattgggaagcccatcctgtgtcctgttcaccctgcagaggaactgaggctgttctgtgagttctgtgaccggcccgtgtgccaggattgtgtggtgggggagcatcgggaacacccctgtgacttcaccagcaatgtcatccacaagcatggggactctgtgtgggagctcctcaaaggtactcagccccacgtggaggccctggaggaagccctggctcagatccacataataaacagtgccctccagaagcgagtggaggcagtggcagctgatgtccggacattctcggagggctacattaaggccattgaggagcatcgggacaagctgctgaagcagctggaagacatacgggcccagaaggaaaattccctgcagctgcagaaggcccagctggaacagttactggcagacatgcggactggagtggagttcaccgagcacttgctgaccagcggctcagacttggagatcctcatcaccaagagggtggtggtagaacggctcaggaagctgaacaaagttcaatatagcacccgtcctggagtaaatgataagatacgcttctgtcctcaggagaaagcaggccagtgccgtggctatgaaatttatggtacgattaataccaaagaggttgatccagccaaatgtgtcctacaaggagaagacctccacagagcccgggagaaacagacggcctctttcaccctgctttgtaaggatgccgcaggagaaatcatgggcaggggaggagacaacgttcaagttgccgttgtccctaaagataagaaagacagcccagtcagaacaatggtccaggataacaaggatgggacatactacatttcctacacccccaaggaacctggcgtctatactgtgtgggtctgcatcaaagaacagcatgtgcagggctcgccattcactgtgatggtgaggagaaagcaccgcccacactcaggcgtgtttcactgctgcaccttctgctccagcgggggccagaaaaccgctcgctgcgcctgtggaggcaccatgccaggtgggtacctaggctgtggccatggacacaaaggccacccaggtcatccccactggtcatgctgtggaaaatttaatgagaaatctgaatgcacatggacaggtgggcagagcgcaccgaggagtctacttaggactgtggctctctgatgggtttgtgctcagccttttaaagctgcaggcagcaccacttgagatttccagaggacccagaccttcgttcattctaaagagactgatagaattaaaaacaaagtgccttatcttgca

SEQ ID NO: 195061 - DNA, 3495 bp, Homo sapiens
  Payload ID: 18506
  Gene Name: tripartite motif containing 45
  Uniprot ID: Q9H8W5
  ENST ID: ENST00000369464
  CDS Start-End: 562-2250
ggtgtgaggaggggccagagcccgcgggcgtcccgggccgaggcgcgggagaggcggtggacaccgagaagcccgccggcggcttgcaattccctcacccggcgcgcgcctttcgcagagggaaggagcaagagggcccctacctcatcgtgcgcgggtggggtcggcgcttgtcgcgtgtggcgcgcagtggggcgggcggcgggaggggggtggcagtggagggagcgagaggtgcaggggtgactttgttggcagcaggactagctggagagctagacctggaagcgcatccggggaggacttgcggggcagaggagggcgtgggcgtgtctggtgtgggatgcagtggaaaggagggggccctcctgagtagatctgtgggtgattccttcgaggacgcctcgtcttcccgtctgcccttttatttgtcagcgagggagtccccatggtctctgttcaagttctggagactttctctttgggtgggcttaatcacctgctactaaatcgtagaactgcccagggccctttctaatattggtcacaaacgtgaggagtatgtcagaaaacagaaaaccgctgctgggctttgtaagcaaactcactagtgggactgcacttgggaactcaggcaagactcactgccccctgtgcttggggcttttcaaagcccccaggctcttgccttgtttgcatacagtttgcaccacgtgtctggagcagctggagcccttctcagtagtggacatccgagggggagactctgacacaagctctgaggggtcaatattccaggaactcaagccacgaagtctgcagtcgcagatcggcatcctttgtcctgtatgtgatgctcaggtggacctgcccatgggtggagtgaaggctttaaccatagaccacctggccgtgaatgatgtgatgctggagagcctacgtggggaaggccagggcctggtgtgtgacctgtgcaacgacagggaagtagagaagaggtgtcagacctgcaaagccaacctctgccacttctgctgccaggctcataggcggcagaagaaaacgacttaccacaccatggtggacctaaaagacttgaaaggctacagccggattgggaagcccatcctgtgtcctgttcaccctgcagaggaactgaggctgttctgtgagttctgtgaccggcccgtgtgccaggattgtgtggtgggggagcatcgggaacacccctgtgacttcaccagcaatgtcatccacaagcatggggactctgtgtgggagctcctcaaaggtactcagccccacgtggaggccctggaggaagccctggctcagatccacataataaacagtgccctccagaagcgagtggaggcagtggcagctgatgtccggacattctcggagggctacattaaggccattgaggagcatcgggacaagctgctgaagcagctggaagacatacgggcccagaaggaaaattccctgcagctgcagaaggcccagctggaacagttactggcagacatgcggactggagtggagttcaccgagcacttgctgaccagcggctcagacttggagatcctcatcaccaagagggtggtggtagaacggctcaggaagctgaacaaagttcaatatagcacccgtcctggagtaaatgataagatacgcttctgtcctcaggagaaagcaggccagtgccgtggctatgaaatttatgacctccacagagcccgggagaaacagacggcctctttcaccctgctttgtaaggatgccgcaggagaaatcatgggcaggggaggagacaacgttcaagttgccgttgtccctaaagataagaaagacagcccagtcagaacaatggtccaggataacaaggatgggacatactacatttcctacacccccaaggaacctggcgtctatactgtgtgggtctgcatcaaagaacagcatgtgcagggctcgccattcactgtgatggtgaggagaaagcaccgcccacactcaggcgtgtttcactgctgcaccttctgctccagcgggggccagaaaaccgctcgctgcgcctgtggaggcaccatgccaggtgggtacctaggctgtggccatggacacaaaggccacccaggtcatccccactggtcatgctgtggaaaatttaatgagaaatctgaatgcacatggacaggtgggcagagcgcaccgaggagtctacttaggactgtggctctctgatgggtttgtgctcagccttttaaagctgcaggcagcaccacttgagatttccagaggacccagaccttcgttcattctaaagagactgatagaattaaaaacaaagtgccttatcttgcactggagttcaagtgctcttttgttagttattcactgattgtacttgtggatggttgagcacaaaaaaccacctctacatttctcttaaaggtaggttggcaacgttctttttctaccacaggatactccttttcattttgtacagtatggaggtatctattccattggcactgaagggtctaggtagtttagttcctttctgatataaccctttttttttcttttttttttttttttaaagacagagtctcactctgtcacccaggctggagtgcagtggcatgatctcggctcactgcaacctctgcctcccggttcaaatgattctcgtgccttggtgtcccgagtagctgggattacaggttcccccccaccttcccccacacccagctaatttttgtgtttttagtagagacggggtttcaccatgttggccaggctggtctcaaactcctgacctcgtgatccacctgcctcggcctcccaaagtgctggggttacaagcatgagccaccacacctggcctattatgacctttttcatttttctctgagctacacattatttagatatttcccctagagattagaaacctcctttcatcctgtccactttttgttagcatactttcattggatttactggtacatgttttgtgatcatgataatgtgatcttgttttggtggtgtccccctactccgtctctatgccatgacagccttctgccccaaagcctggaagattactctttggtcaagggcatacaaatagaaagttaataaaggggaatggtgttgaaatagaacctcatacatttattacagttctacttatacagaaaatctagacaccttcatccttctcacagctctgttttttagtagagtagtctttagagtagtcttcactgttatctatatacctagaaagttaactgggagctttgactcttactgtgccttcactcatagtgtgccttcttagctgctggagaatttggggagaggatgtacacagcactggtgcctcagccctgccaaggtcttcactgtatatattttgtgtgttcttctgaaactcttgatttcttatatggcaataaactcagcatgtattaaatataa

SEQ ID NO: 195062 - DNA, 677 bp, Homo sapiens
  Payload ID: 18506
  Gene Name: tripartite motif containing 45
  ENST ID: ENST00000497970
  CDS Start-End: 1-314
atactgtgtgggtctgcatcaaagaacagcatgtgcagggctcgccattcactgtgatggtgaggagaaagcaccgcccacactcaggcgtgtttcactgctgcaccttctgctccagcgggggccagaaaaccgctcgctgcgcctgtggaggcaccatgccaggtgggtacctaggctgtggccatggacacaaaggccacccaggtcatccccactggtcatgctgtggaaaatttaatgagaaatctgaatgcacatggacaggtgggcagagcgcaccgaggagtctacttaggactgtggctctctgatgggtttgtgctcagccttttaaagctgcaggcagcaccacttgagatttccagaggacccagaccttcgttcattctaaagagactgatagaattaaaaacaaagtgccttatcttgcactggagttcaagtgctcttttgttagttattcactgattgtacttgtggatggttgagcacaaaaaaccacctctacatttctcttaaagtgtgccttcttagctgctggagaatttggggagaggatgtacacagcactggtgcctcagccctgccaaggtcttcactgtatatattttgtgtgttcttctgaaactcttgatttcttatatggcaataaactcagcatgtattaaatataa

SEQ ID NO: 195063 - DNA, 1109 bp, Homo sapiens
  Payload ID: 18506
  Gene Name: tripartite motif containing 45
  ENST ID: ENST00000485032
  CDS Start-End: 200-1109
ggactcgccggagtagaccgggctgggattggtgtgaggaggggccagagcccgcgggcgtcccgggccgaggcgcgggagaggcggtggacaccgagaagcccgccggcggcttgcaattccctcacccggcgcgcgcctttcgcagagggaaggagcaagagggcccctacctcatcgtgcgcgggtggacctgcccatgggtggagtgaaggctttaaccatagaccacctggccgtgaatgatgtgatgctggagagcctacgtggggaaggccagggcctggtgtgtgacctgtgcaacgacagggaagtagagaagaggtgtcagacctgcaaagccaacctctgccacttctgctgccaggctcataggcggcagaagaaaacgacttaccacaccatggtggacctaaaagacttgaaaggctacagccggattgggaagcccatcctgtgtcctgttcaccctgcagaggaactgaggctgttctgtgagttctgtgaccggcccgtgtgccaggattgtgtggtgggggagcatcgggaacacccctgtgacttcaccagcaatgtcatccacaagcatggggactctgtgtgggagctcctcaaaggtactcagccccacgtggaggccctggaggaagccctggctcagatccacataataaacagtgccctccagaagcgagtggaggcagtggcagctgatgtccggacattctcggagggctacattaaggccattgaggagcatcgggacaagctgctgaagcagctggaagacatacgggcccagaaggaaaattccctgcagctgcagaaggcccagctggaacagttactggcagacatgcggactggagtggagttcaccgagcacttgctgaccagcggctcagacttggagatcctcatcaccaagagggtggtggtagaacggctcaggaagctgaacaaagttcaatatagcacccgtcctggagtaaatgataagatacgcttctgtcctcaggagaaagcaggccagtgccgtggctatgaaatttatggtacgattaataccaaagaggttgatccagccaaatgtgtcctacaaggagaag

SEQ ID NO: 195064 - DNA, 3061 bp, Homo sapiens
  Payload ID: 18507
  Gene Name: tripartite motif containing 46
  Uniprot ID: Q7Z4K8
  ENST ID: ENST00000334634
  CDS Start-End: 1-2280
atggcagagggtgaggatatgcagaccttcacttccatcatggacgcactggtccgcatcagtaccagcatgaagaacatggagaaggaactgctgtgcccagtgtgtcaagagatgtacaagcagccactggtgctgccctgtacccacaacgtgtgccaggcctgtgcccgagaggtcttgggccagcagggctacataggacatggtggggaccccagctccgagcccacctctcctgcctccaccccttccacccgcagcccccgcctctcccgcagaactctccccaagccagaccgcctggaccggctgcttaagtcaggctttgggacataccctgggaggaagcgaggtgctttgcacccccaagtgatcatgttcccgtgcccagcctgccaaggtgatgtggagcttggggagcggggtctggcagggcttttccggaacctgaccctggagcgtgtggtggagcggtaccgccagagtgtgagtgtgggaggtgccatcctgtgccagttgtgcaagcccccaccactagaggccaccaagggctgcacagagtgccgcgccaccttctgcaatgagtgcttcaagctcttccacccctggggcacccagaaggcccagcatgagcccaccctgcctaccctctccttccgacccaagggccttatgtgcccagaccacaaggaagaggtgacccactactgcaagacatgccaacgcctggtatgtcaactctgccgggtgcggcgcacccacagcgggcacaagatcacaccagtgctcagtgcctaccaggccctcaaggacaagctgacaaagagcctgacatacatcctgggaaaccaggacacggtacagacccagatctgtgagctggaggaggccgtgaggcacaccgaggtgagtggtcagcaggccaaggaggaggtgtcgcagctggtgcgggggctgggggctgtgctggaggagaagcgggcatcactgcttcaggccattgaagaatgccagcaggagcggctggcccgtctcagcgcccagatccaggagcaccggagcctgctggatggctcaggtctggtgggctatgcccaggaagtacttaaggaaacagaccagccttgctttgtgcaagccgccaagcagctgcacaacaggattgcccgagccactgaagccctccagacattccggccagctgccagctcctccttccgccattgccagctcgacgtgggacgtgagatgaagctgctgacagagcttaacttcctgcgagtgcctgaggcccccgtcattgacacccagcgcacctttgcctatgatcagatcttcctgtgctggcggctgcccccccattcaccacctgcctggcactataccgttgagttccggcgcacggatgtgcctgctcagccaggccccacccgctggcagcggcgggaggaggtgaggggcaccagtgccctgcttgagaaccccgacacgggctctgtgtatgtgctgcgtgtccgcggctgcaacaaggccggctacggcgaatacagtgaagatgtgcacctgcacacgcccccggcacctgtcctgcacttcttcctcgatagccgctggggcgcaagccgagagcggctggctatcagcaaggaccagcgagcagtacggagtgttccagggctgcccctgctgctggctgctgaccggctgctgaccggctgccacctgagtgtggatgtggtcctgggcgacgtggctgtgacccagggccgcagctactgggcctgcgccgtagacccagcctcctacttggtcaaggtgggcgtcgggctggagagcaagcttcaagaaagtttccagggtgcccccgatgtgatcagccccaggtacgacccggacagcgggcacgacagcggtgccgaggatgccacagtggaggcgtcgccacccttcgctttcctaaccattggcatgggcaagatcctgctggggtcgggggcaagctcaaacgcagggctgacagggagggatggccccacagccggctgcacagtgcccctgccaccccgcctgggcatctgcctggactatgagcggggccgggtttccttcctggatgctgtttccttccgtgggctcttggagtgccccctggactgctcagggcctgtgtgccctgccttttgcttcatcgggggtggcgcagtacagctccaggagccagtgggcactaagcctgagaggaaagtcaccattgggggcttcgccaagctggactgagccttccaggcccctcatgcagacctggggtcctcctgggccctggcccccaaacctcttggcacccggttgttaccccctggcagcttctcccccaaactctcctaccatgtggccctgctccttctcccgtgtctgtcttcccacagttttctcttgacccaggggctctcttctgcccacctctctggatggcccccgttctctccattgcttgttagccaggcccccacccccactgagtctgccctatgacctgcctttggcatgttacccaagccatggagagagccccttctccatccctgtcctgtgccccccaggctgattgggagggagggcacctggaacactgggcatgatctccagctctgcccttgccctgccaagctccctgccctgttgatgctgaactacagccttgggacaggcaggctttggggctggacgctgtccaggcattcctggtgaggggaaggggaccctgtcatcctgctttatttatttgggtcccaacaccccgcagccgcatgccccttatgtccctcttctccctcttgcatgctttacctgtcccacacccatgccaatgtgccaagtctcccttggggacccagctgagtctgggtgttcccattgggttgggccaggcaaggcctctggtgcccgctgccgtccccctgcagtgggctctgctaggcctgtgctgagcaacagctgttattgtcatggtttataaacaataaactgtgatgccaggcacatctctgccttccctgag

SEQ ID NO: 195065 - DNA, 3127 bp, Homo sapiens
  Payload ID: 18507
  Gene Name: tripartite motif containing 46
  Uniprot ID: Q7Z4K8
  ENST ID: ENST00000368382
  CDS Start-End: 138-2348
ggggttcgcagccgcagccgggatcgggcacccaggggcgggcgggcacggtagggccatggcagagggtgaggatatgcagaccttcacttccatcatggacgcactggtccgcatcagtgtgagttaagaccagcatgaagaacatggagaaggaactgctgtgcccagtgtgtcaagagatgtacaagcagccactggtgctgccctgtacccacaacgtgtgccaggcctgtgcccgagaggtcttgggccagcagggctacataggacatggtggggaccccagctccgagcccacctctcctgcctccaccccttccacccgcagcccccgcctctcccgcagaactctccccaagccagaccgcctggaccggctgcttaagtcaggctttgggacataccctgggaggaagcgaggtgctttgcacccccaagtgatcatgttcccgtgcccagcctgccaaggtgatgtggagcttggggagcggggtctggcagggcttttccggaacctgaccctggagcgtgtggtggagcggtaccgccagagtgtgagtgtgggaggtgccatcctgtgccagttgtgcaagcccccaccactagaggccaccaagggctgcacagagtgccgcgccaccttctgcaatgagtgcttcaagctcttccacccctggggcacccagaaggcccagcatgagcccaccctgcctaccctctccttccgacccaagggccttatgtgcccagaccacaaggaagaggtgacccactactgcaagacatgccaacgcctggtatgtcaactctgccgggtgcggcgcacccacagcgggcacaagatcacaccagtgctcagtgcctaccaggccctcaaggacaagctgacaaagagcctgacatacatcctgggaaaccaggacacggtacagacccagatctgtgagctggaggaggccgtgaggcacaccgaggtgagtggtcagcaggccaaggaggaggtgtcgcagctggtgcgggggctgggggctgtgctggaggagaagcgggcatcactgcttcaggccattgaagaatgccagcaggagcggctggcccgtctcagcgcccagatccaggagcaccggagcctgctggatggctcaggtctggtgggctatgcccaggaagtacttaaggaaacagaccagccttgctttgtgcaagccgccaagcagctgcacaacaggattgcccgagccactgaagccctccagacattccggccagctgccagctcctccttccgccattgccagctcgacgtgggacgtgagatgaagctgctgacagagcttaacttcctgcgagtgcctgaggcccccgtcattgacacccagcgcacctttgcctatgatcagatcttcctgtgctggcggctgcccccccattcaccacctgcctggcactataccgttgagttccggcgcacggatgtgcctgctcagccaggccccacccgctggcagcggcgggaggaggtgaggggcaccagtgccctgcttgagaaccccgacacgggctctgtgtatgtgctgcgtgtccgcggctgcaacaaggccggctacggcgaatacagtgaagatgtgcacctgcacacgcccccggcacctgtcctgcacttcttcctcgatagccgctggggcgcaagccgagagcggctggctatcagcaaggaccagcgagcagtacggagtgttccagggctgcccctgctgctggctgctgaccggctgctgaccggctgccacctgagtgtggatgtggtcctgggcgacgtggctgtgacccagggccgcagctactgggcctgcgccgtagacccagcctcctacttggtcaaggtgggcgtcgggctggagagcaagcttcaagaaagtttccagggtgcccccgatgtgatcagccccaggtacgacccggacagcgggcacgacagcggtgccgaggatgccacagtggaggcgtcgccacccttcgctttcctaaccattggcatgggcaagatcctgctggggtcgggggcaagctcaaacgcagggctgacagggagggatggccccacagccggctgcacagtgcccctgccaccccgcctgggcatctgcctggactatgagcggggccgggtttccttcctggatgctgtttccttccgtgggctcttggagtgccccctggactgctcagggcctgtgtgccctgccttttgcttcatcgggggtggcgcagtacagctccaggagccagtgggcactaagcctgagaggaaagtcaccattgggggcttcgccaagctggactgagccttccaggcccctcatgcagacctggggtcctcctgggccctggcccccaaacctcttggcacccggttgttaccccctggcagcttctcccccaaactctcctaccatgtggccctgctccttctcccgtgtctgtcttcccacagttttctcttgacccaggggctctcttctgcccacctctctggatggcccccgttctctccattgcttgttagccaggcccccacccccactgagtctgccctatgacctgcctttggcatgttacccaagccatggagagagccccttctccatccctgtcctgtgccccccaggctgattgggagggagggcacctggaacactgggcatgatctccagctctgcccttgccctgccaagctccctgccctgttgatgctgaactacagccttgggacaggcaggctttggggctggacgctgtccaggcattcctggtgaggggaaggggaccctgtcatcctgctttatttatttgggtcccaacaccccgcagccgcatgccccttatgtccctcttctccctcttgcatgctttacctgtcccacacccatgccaatgtgccaagtctcccttggggacccagctgagtctgggtgttcccattgggttgggccaggcaaggcctctggtgcccgctgccgtccccctgcagtgggctctgctaggcctgtgctgagcaacagctgttattgtcatggtttataaacaataaactgtgatgccaggcacatctctgccttccctg

SEQ ID NO: 195066 - DNA, 2666 bp, Homo sapiens
  Payload ID: 18507
  Gene Name: tripartite motif containing 46
  ENST ID: ENST00000368383
  CDS Start-End: 68-2002
attaagcccggggttcgcagccgcagccgggatcgggcacccaggggcgggcgggcacggtagggccatggcagagggtgaggatatgcagaccttcacttccatcatggacgcactggtccgcatcagtaccagcatgaagaacatggagaaggaactgctgtgcccagtgtgtcaagagatgtacaagcagccactggtgctgccctgtacccacaacgtgtgccaggcctgtgcccgagaggtcttgggccagcagggctacataggacatggtggggaccccagctccgagcccacctctcctgcctccaccccttccacccgcagcccccgcctctcccgcagaactctccccaagccagaccgcctggaccggctgcttaagtcaggctttgggacataccctgggaggaagcgaggtgctttgcacccccaagtgatcatgttcccgtgcccagcctgccaaggtgatgtggagcttggggagcggggtctggcagggcttttccggaacctgaccctggagcgtgtggtggagcggtaccgccagagtgtgagtgtgggaggtgccatcctgtgccagttgtgcaagcccccaccactagaggccaccaagggctgcacagagtgccgcgccaccttctgcaatgagtgcttcaagctcttccacccctggggcacccagaaggcccagcatgagcccaccctgcctaccctctccttccgacccaagggccttatgtgcccagaccacaaggaagaggtgacccactactgcaagacatgccaacgcctggtatgtcaactctgccgggtgcggcgcacccacagcgggcacaagatcacaccagtgctcagtgcctaccaggccctcaaggacaagctgacaaagagcctgacatacatcctgggaaaccaggacacggtacagacccagatctgtgagctggaggaggccgtgaggcacaccgaggtgagtggtcagcaggccaaggaggaggtgtcgcagctggtgcgggggctgggggctgtgctggaggagaagcgggcatcactgcttcaggccattgaagaatgccagcaggagcggctggcccgtctcagcgcccagatccaggagcaccggagcctgctggatggctcaggtctggtgggctatgcccaggaagtacttaaggaaacagaccagccttgctttgtgcaagccgccaagcagctgcacaacaggattgcccgagccactgaagccctccagacattccggccagctgccagctcctccttccgccattgccagctcgacgtgggacgtgagatgaagctgctgacagagcttaacttcctgcgagtgcctgaggcccccgtcattgacacccagcgcacctttgcctatgatcagatcttcctgtgctggcggctgcccccccattcaccacctgcctggcactataccgttgagttccggcgcacggatgtgcctgctcagccaggccccacccgctggcagcggcgggaggaggtgaggggcaccagtgccctgcttgagaaccccgacacgggctctgtgtatgtgctgcgtgtccgcggctgcaacaaggccggctacggcgaatacagtgaagatgtgcacctgcacacgcccccggcacctgtcctgcacttcttcctcgatagccgctggggcgcaagccgagagcggctggctatcagcaaggaccagcgagcagtacggagtgttccagggctgcccctgctgctggctgctgaccggctgctgaccggctgccacctgagtgtggatgtggtcctgggcgacgtggctgtgacccagggccgcagctactgggcctgcgccgtagacccagcctcctacttggtcaaggtgggcgtcgggctggagagcaagcttcaagaaagtttccagggtgcccccgatgtgatcagccccaggtcagacccctctggaagggatggggtgtgggggtcctggtgggagtgaggggcacagaaggggtggcaagtggagcacagacttgctagggtggggctgggaggggattaggaggaagtagtaggagcctggaagccaggctgggaggcctgtgtccaggagacgcatgggctcagcaaaagggcttttgaggactgattttcagagcatgtcgtgtggtcagggaaagggatgatagaagagggagccatctctgcttccttccaaccatctgtcactctggatcaacacaccatctctccaagcatctgtgtcctttcttcctaacactccatttccaacataccttctccataaaacctttgctctccaagacctccttcacccgtatcttaaaattcttcccttagccggatgcggtggctcacgcctgtaatcccagcactttgggaggctgaggcaggcaaatcactggaggtcgagagttcgagaccagcttgaccaacatggagtgaccccatctctactaaaaatacaaaaaaaatagctgggcgtggtagcgcatgcctgtaaccccggctactcgtgaggctgaggcaggagaatcacttgaacccgggaggtggaggttgcggtgagccaagattgtgtcattgcactgcagcctgggcgacaaaagcaaaactccttctcaaaaaaaaaaaaaaaaaaa

SEQ ID NO: 195067 - DNA, 1864 bp, Homo sapiens
  Payload ID: 18507
  Gene Name: tripartite motif containing 46
  Uniprot ID: Q7Z4K8
  ENST ID: ENST00000368385
  CDS Start-End: 90-1745
cacacccccactgggctcctgcattaagcccggggttcgcagccgcagccgggatcgggcacccaggggcgggcgggcacggtagggccatggcagagggtgaggatatgcagaccttcacttccatcatggacgcactggtccgcatcagtaccagcatgaagaacatggagaaggaactgctgtgcccagtgtgtcaagagatgtacaagcagccactggtgctgccctgtacccacaacgtgtgccaggcctgtgcccgagaggtcttgggccagcagggctacataggacatggtggggaccccagctccgagcccacctctcctgcctccaccccttccacccgcagcccccgcctctcccgcagaactctccccaagccagaccgcctggaccggctgcttaagtcaggctttgggacataccctgggaggaagcgaggtgctttgcacccccaagtgatcatgttcccgtgcccagcctgccaaggtgatgtggagcttggggagcggggtctggcagggcttttccggaacctgaccctggagcgtgtggtggagcggtaccgccagagtgtgagtgtgggaggtgccatcctgtgccagttgtgcaagcccccaccactagaggccaccaagggctgcacagagtgccgcgccaccttctgcaatgagtgcttcaagctcttccacccctggggcacccagaaggcccagcatgagcccaccctgcctaccctctccttccgacccaagggccttatgtgcccagaccacaaggaagaggtgacccactactgcaagacatgccaacgcctggtatgtcaactctgccgggtgcggcgcacccacagcgggcacaagatcacaccagtgctcagtgcctaccaggccctcaaggacaagctgacaaagagcctgacatacatcctgggaaaccaggacacggtacagacccagatctgtgagctggaggaggccgtgaggcacaccgaggtgagtggtcagcaggccaaggaggaggtgtcgcagctggtgcgggggctgggggctgtgctggaggagaagcgggcatcactgcttcaggccattgaagaatgccagcaggagcggctggcccgtctcagcgcccagatccaggagcaccggagcctgctggatggctcaggtctggtgggctatgcccaggaagtacttaaggaaacagaccagccttgctttgtgcaagccgccaagcagctgcacaacaggattgcccgagccactgaagccctccagacattccggccagctgccagctcctccttccgccattgccagctcgacgtgggacgtgagatgaagctgctgacagagcttaacttcctgcgagtgcctgaggcccccgtcattgacacccagcgcacctttgcctatgatcagatcttcctgtgctggcggctgcccccccattcaccacctgcctggcactataccgttgagttccggcgcacggatgtgcctgctcagccaggccccacccgctggcagcggcgggaggaggtgaggggcaccagtgccctgcttgagaaccccgacacgggctctgtgtatgtgctgcgtgtccgcggctgcaacaaggccggctacggcgaatacagtgaagatgtgcacctgcacacgcccccggcacctggaatacaaaacttagccaggcgtggtggtgcgtgcctacaattccagctactcgggaggctgaggtaggagaatcgcttgaacctgggaggcggaggttgcagtgagctgagatcgcgccactggactccagcctggacaacagagcaagactccgacgtctcggaaaaataaataaataaataaat

SEQ ID NO: 195068 - DNA, 3195 bp, Homo sapiens
  Payload ID: 18507
  Gene Name: tripartite motif containing 46
  ENST ID: ENST00000392451
  CDS Start-End: 261-2414
gagaactatttcccaccccctaccccgacgggcgctgttcgaggctggtcccgggagcatgcgcagtgacacctcaacccccagccctcctcacacccccactgggctcctgcattaagcccggggttcgcagccgcagccgggatcgggcacccaggggcgggcgggcacggtagggccatggcagagggtgaggatatgcagaccttcacttccatcatggacgcactggtccgcatcagtctgcgcccctgaccgggatggctgcgaagagagggaccaagaccagcatgaagaacatggagaaggaactgctgtgcccagtgtgtcaagagatgtacaagcagccactggtgctgccctgtacccacaacgtgtgccaggcctgtgcccgagaggtcttgggccagcagggctacataggacatggtggggaccccagctccgagcccacctctcctgcctccaccccttccacccgcagcccccgcctctcccgcagaactctccccaagccagaccgcctggaccggctgcttaagtcaggctttgggacataccctgggaggaagcgaggtgctttgcacccccaagtgatcatgttcccgtgcccagcctgccaaggtgatgtggagcttggggagcggggtctggcagggcttttccggaacctgaccctggagcgtgtggtggagcggtaccgccagagtgtgagtgtgggaggtgccatcctgtgccagttgtgcaagcccccaccactagaggccaccaagggctgcacagagtgccgcgccaccttctgcaatgagtgcttcaagctcttccacccctggggcacccagaaggcccagcatgagcccaccctgcctaccctctccttccgacccaagggccttatgtgcccagaccacaaggaagaggtgacccactactgcaagacatgccaacgcctggtatgtcaactctgccgggtgcggcgcacccacagcgggcacaagatcacaccagtgctcagtgcctaccaggccctcaaggacaagctgacaaagagcctgacatacatcctgggaaaccaggacacggtacagacccagatctgtgagctggaggagaagcgggcatcactgcttcaggccattgaagaatgccagcaggagcggctggcccgtctcagcgcccagatccaggagcaccggagcctgctggatggctcaggtctggtgggctatgcccaggaagtacttaaggaaacagaccagccttgctttgtgcaagccgccaagcagctgcacaacaggattgcccgagccactgaagccctccagacattccggccagctgccagctcctccttccgccattgccagctcgacgtgggacgtgagatgaagctgctgacagagcttaacttcctgcgagtgcctgaggcccccgtcattgacacccagcgcacctttgcctatgatcagatcttcctgtgctggcggctgcccccccattcaccacctgcctggcactataccgttgagttccggcgcacggatgtgcctgctcagccaggccccacccgctggcagcggcgggaggaggtgaggggcaccagtgccctgcttgagaaccccgacacgggctctgtgtatgtgctgcgtgtccgcggctgcaacaaggccggctacggcgaatacagtgaagatgtgcacctgcacacgcccccggcacctgtcctgcacttcttcctcgatagccgctggggcgcaagccgagagcggctggctatcagcaaggaccagcgagcagtacggagtgttccagggctgcccctgctgctggctgctgaccggctgctgaccggctgccacctgagtgtggatgtggtcctgggcgacgtggctgtgacccagggccgcagctactgggcctgcgccgtagacccagcctcctacttggtcaaggtgggcgtcgggctggagagcaagcttcaagaaagtttccagggtgcccccgatgtgatcagccccaggtacgacccggacagcgggcacgacagcggtgccgaggatgccacagtggaggcgtcgccacccttcgctttcctaaccattggcatgggcaagatcctgctggggtcgggggcaagctcaaacgcagggctgacagggagggatggccccacagccggctgcacagtgcccctgccaccccgcctgggcatctgcctggactatgagcggggccgggtttccttcctggatgctgtttccttccgtgggctcttggagtgccccctggactgctcagggcctgtgtgccctgccttttgcttcatcgggggtggcgcagtacagctccaggagccagtgggcactaagcctgagaggaaagtcaccattgggggcttcgccaagctggactgagccttccaggcccctcatgcagacctggggtcctcctgggccctggcccccaaacctcttggcacccggttgttaccccctggcagcttctcccccaaactctcctaccatgtggccctgctccttctcccgtgtctgtcttcccacagttttctcttgacccaggggctctcttctgcccacctctctggatggcccccgttctctccattgcttgttagccaggcccccacccccactgagtctgccctatgacctgcctttggcatgttacccaagccatggagagagccccttctccatccctgtcctgtgccccccaggctgattgggagggagggcacctggaacactgggcatgatctccagctctgcccttgccctgccaagctccctgccctgttgatgctgaactacagccttgggacaggcaggctttggggctggacgctgtccaggcattcctggtgaggggaaggggaccctgtcatcctgctttatttatttgggtcccaacaccccgcagccgcatgccccttatgtccctcttctccctcttgcatgctttacctgtcccacacccatgccaatgtgccaagtctcccttggggacccagctgagtctgggtgttcccattgggttgggccaggcaaggcctctggtgcccgctgccgtccccctgcagtgggctctgctaggcctgtgctgagcaacagctgttattgtcatggtttataaacaataaactgtgatgccaggcacatctctgccttccctgag

SEQ ID NO: 195069 - DNA, 2979 bp, Homo sapiens
  Payload ID: 18507
  Gene Name: tripartite motif containing 46
  ENST ID: ENST00000545012
  CDS Start-End: 297-2198
gagaactatttcccaccccctaccccgacgggcgctgttcgaggctggtcccgggagcatgcgcagtgacacctcaacccccagccctcctcacacccccactgggctcctgcattaagcccggggttcgcagccgcagccgggatcgggcacccaggggcgggcgggcacggtagggccatggcagagggtgaggatatgcagaccttcacttccatcatggacgcactggtccgcatcagtgctttgggacataccctgggaggaagcgaggtgctttgcacccccaagtgatcatgttcccgtgcccagcctgccaaggtgatgtggagcttggggagcggggtctggcagggcttttccggaacctgaccctggagcgtgtggtggagcggtaccgccagagtgtgagtgtgggaggtgccatcctgtgccagttgtgcaagcccccaccactagaggccaccaagggctgcacagagtgccgcgccaccttctgcaatgagtgcttcaagctcttccacccctggggcacccagaaggcccagcatgagcccaccctgcctaccctctccttccgacccaagggccttatgtgcccagaccacaaggaagaggtgacccactactgcaagacatgccaacgcctggtatgtcaactctgccgggtgcggcgcacccacagcgggcacaagatcacaccagtgctcagtgcctaccaggccctcaaggacaagctgacaaagagcctgacatacatcctgggaaaccaggacacggtacagacccagatctgtgagctggaggaggccgtgaggcacaccgaggtgagtggtcagcaggccaaggaggaggtgtcgcagctggtgcgggggctgggggctgtgctggaggagaagcgggcatcactgcttcaggccattgaagaatgccagcaggagcggctggcccgtctcagcgcccagatccaggagcaccggagcctgctggatggctcaggtctggtgggctatgcccaggaagtacttaaggaaacagaccagccttgctttgtgcaagccgccaagcagctgcacaacaggattgcccgagccactgaagccctccagacattccggccagctgccagctcctccttccgccattgccagctcgacgtgggacgtgagatgaagctgctgacagagcttaacttcctgcgagtgcctgaggcccccgtcattgacacccagcgcacctttgcctatgatcagatcttcctgtgctggcggctgcccccccattcaccacctgcctggcactataccgttgagttccggcgcacggatgtgcctgctcagccaggccccacccgctggcagcggcgggaggaggtgaggggcaccagtgccctgcttgagaaccccgacacgggctctgtgtatgtgctgcgtgtccgcggctgcaacaaggccggctacggcgaatacagtgaagatgtgcacctgcacacgcccccggcacctgtcctgcacttcttcctcgatagccgctggggcgcaagccgagagcggctggctatcagcaaggaccagcgagcagtacggagtgttccagggctgcccctgctgctggctgctgaccggctgctgaccggctgccacctgagtgtggatgtggtcctgggcgacgtggctgtgacccagggccgcagctactgggcctgcgccgtagacccagcctcctacttggtcaaggtgggcgtcgggctggagagcaagcttcaagaaagtttccagggtgcccccgatgtgatcagccccaggtacgacccggacagcgggcacgacagcggtgccgaggatgccacagtggaggcgtcgccacccttcgctttcctaaccattggcatgggcaagatcctgctggggtcgggggcaagctcaaacgcagggctgacagggagggatggccccacagccggctgcacagtgcccctgccaccccgcctgggcatctgcctggactatgagcggggccgggtttccttcctggatgctgtttccttccgtgggctcttggagtgccccctggactgctcagggcctgtgtgccctgccttttgcttcatcgggggtggcgcagtacagctccaggagccagtgggcactaagcctgagaggaaagtcaccattgggggcttcgccaagctggactgagccttccaggcccctcatgcagacctggggtcctcctgggccctggcccccaaacctcttggcacccggttgttaccccctggcagcttctcccccaaactctcctaccatgtggccctgctccttctcccgtgtctgtcttcccacagttttctcttgacccaggggctctcttctgcccacctctctggatggcccccgttctctccattgcttgttagccaggcccccacccccactgagtctgccctatgacctgcctttggcatgttacccaagccatggagagagccccttctccatccctgtcctgtgccccccaggctgattgggagggagggcacctggaacactgggcatgatctccagctctgcccttgccctgccaagctccctgccctgttgatgctgaactacagccttgggacaggcaggctttggggctggacgctgtccaggcattcctggtgaggggaaggggaccctgtcatcctgctttatttatttgggtcccaacaccccgcagccgcatgccccttatgtccctcttctccctcttgcatgctttacctgtcccacacccatgccaatgtgccaagtctcccttggggacccagctgagtctgggtgttcccattgggttgggccaggcaaggcctctggtgcccgctgccgtccccctgcagtgggctctgctaggcctgtgctgagcaacagctgttattgtcatggtttataaacaataaactgtgatgccaggcacatctctgccttccctgag

SEQ ID NO: 195070 - DNA, 1703 bp, Homo sapiens
  Payload ID: 18507
  Gene Name: tripartite motif containing 46
  Uniprot ID: Q7Z4K8
  ENST ID: ENST00000543729
  CDS Start-End: 77-1573
ggctcctgcattaagcccggggttcgcagccgcagccgggatcgggcacccaggggcgggcgggcacggtagggccatggcagagggtgaggatatgcagaccttcacttccatcatggacgcactggtccgcatcagtaccagcatgaagaacatggagaaggaactgctgtgcccagtgtgtcaagagatgtacaagcagccactggtgctgccctgtacccacaacgtgtgccaggcctgtgcccgagaggtcttgggccagcagggctacataggacatggtggggaccccagctccgagcccacctctcctgcctccaccccttccacccgcagcccccgcctctcccgcagaactctccccaagccagaccgcctggaccggctgcttaagtcaggctttgggacataccctgggaggaagcgaggtgctttgcacccccaagtgatcatgttcccgtgcccagcctgccaaggtgatgtggagcttggggagcggggtctggcagggcttttccggaacctgaccctggagcgtgtggtggagcggtaccgccagagtgtgagtgtgggaggtgccatcctgtgccagttgtgcaagcccccaccactagaggccaccaagggctgcacagagtgccgcgccaccttctgcaatgagtgcttcaagctcttccacccctggggcacccagaaggcccagcatgagcccaccctgcctaccctctccttccgacccaagggccttatgtgcccagaccacaaggaagaggtgacccactactgcaagacatgccaacgcctggtatgtcaactctgccgggtgcggcgcacccacagcgggcacaagatcacaccagtgctcagtgcctaccaggccctcaaggacaagctgacaaagagcctgacatacatcctgggaaaccaggacacggtacagacccagatctgtgagctggaggaggccgtgaggcacaccgaggtgagtggtcagcaggccaaggaggaggtgtcgcagctggtgcgggggctgggggctgtgctggaggagaagcgggcatcactgcttcaggccattgaagaatgccagcaggagcggctggcccgtctcagcgcccagatccaggagcaccggagcctgctggatggctcaggtctggtgggctatgcccaggaagtacttaaggaaacagaccagccttgctttgtgcaagccgccaagcagctgcacaacaggattgcccgagccactgaagccctccagacattccggccagctgccagctcctccttccgccattgccagctcgacgtgggacgtgagatgaagctgctgacagagcttaacttcctgcgaggctgtggccaccgcggactctgctccggagcaccccagtgcctgaggcccccgtcattgacacccagcgcacctttgcctatgatcagatcttcctgtgctggcggctgcccccccattcaccacctgcctggcactataccgttgagttccggcgcacggatgtgcctgctcagccaggccccacccgctggcagcggcgggaggaggtgaggggcaccagtgccctgcttgagaaccccgacacgggctctgtgtatgtgctgcgtgtccgcggctgcaacaaggccggctacggcgaatacagtgaagatgtgcacctgcacacgcccccggcacctgg

SEQ ID NO: 195071 - DNA, 3082 bp, Homo sapiens
  Payload ID: 18507
  Gene Name: tripartite motif containing 46
  ENST ID: ENST00000611379
  CDS Start-End: 61-2301
agttcggagaagggggtgccgctgaccgggttgcgctgcgggagagggcgggagggcctgatgggggcgaaggggaatgggttgaccagcatgaagaacatggagaaggaactgctgtgcccagtgtgtcaagagatgtacaagcagccactggtgctgccctgtacccacaacgtgtgccaggcctgtgcccgagaggtcttgggccagcagggctacataggacatggtggggaccccagctccgagcccacctctcctgcctccaccccttccacccgcagcccccgcctctcccgcagaactctccccaagccagaccgcctggaccggctgcttaagtcaggctttgggacataccctgggaggaagcgaggtgctttgcacccccaagtgatcatgttcccgtgcccagcctgccaaggtgatgtggagcttggggagcggggtctggcagggcttttccggaacctgaccctggagcgtgtggtggagcggtaccgccagagtgtgagtgtgggaggtgccatcctgtgccagttgtgcaagcccccaccactagaggccaccaagggctgcacagagtgccgcgccaccttctgcaatgagtgcttcaagctcttccacccctggggcacccagaaggcccagcatgagcccaccctgcctaccctctccttccgacccaagggccttatgtgcccagaccacaaggaagaggtgacccactactgcaagacatgccaacgcctggtatgtcaactctgccgggtgcggcgcacccacagcgggcacaagatcacaccagtgctcagtgcctaccaggccctcaaggacaagctgacaaagagcctgacatacatcctgggaaaccaggacacggtacagacccagatctgtgagctggaggaggccgtgaggcacaccgaggtgagtggtcagcaggccaaggaggaggtgtcgcagctggtgcgggggctgggggctgtgctggaggagaagcgggcatcactgcttcaggccattgaagaatgccagcaggagcggctggcccgtctcagcgcccagatccaggagcaccggagcctgctggatggctcaggtctggtgggctatgcccaggaagtacttaaggaaacagaccagccttgctttgtgcaagccgccaagcagctgcacaacaggattgcccgagccactgaagccctccagacattccggccagctgccagctcctccttccgccattgccagctcgacgtgggacgtgagatgaagctgctgacagagcttaacttcctgcgagtgcctgaggcccccgtcattgacacccagcgcacctttgcctatgatcagatcttcctgtgctggcggctgcccccccattcaccacctgcctggcactataccgttgagttccggcgcacggatgtgcctgctcagccaggccccacccgctggcagcggcgggaggaggtgaggggcaccagtgccctgcttgagaaccccgacacgggctctgtgtatgtgctgcgtgtccgcggctgcaacaaggccggctacggcgaatacagtgaagatgtgcacctgcacacgcccccggcacctgtcctgcacttcttcctcgatagccgctggggcgcaagccgagagcggctggctatcagcaaggaccagcgagcagtacggagtgttccagggctgcccctgctgctggctgctgaccggctgctgaccggctgccacctgagtgtggatgtggtcctgggcgacgtggctgtgacccagggccgcagctactgggcctgcgccgtagacccagcctcctacttggtcaaggtgggcgtcgggctggagagcaagcttcaagaaagtttccagggtgcccccgatgtgatcagccccaggtacgacccggacagcgggcacgacagcggtgccgaggatgccacagtggaggcgtcgccacccttcgctttcctaaccattggcatgggcaagatcctgctggggtcgggggcaagctcaaacgcagggctgacagggagggatggccccacagccggctgcacagtgcccctgccaccccgcctgggcatctgcctggactatgagcggggccgggtttccttcctggatgctgtttccttccgtgggctcttggagtgccccctggactgctcagggcctgtgtgccctgccttttgcttcatcgggggtggcgcagtacagctccaggagccagtgggcactaagcctgagaggaaagtcaccattgggggcttcgccaagctggactgagccttccaggcccctcatgcagacctggggtcctcctgggccctggcccccaaacctcttggcacccggttgttaccccctggcagcttctcccccaaactctcctaccatgtggccctgctccttctcccgtgtctgtcttcccacagttttctcttgacccaggggctctcttctgcccacctctctggatggcccccgttctctccattgcttgttagccaggcccccacccccactgagtctgccctatgacctgcctttggcatgttacccaagccatggagagagccccttctccatccctgtcctgtgccccccaggctgattgggagggagggcacctggaacactgggcatgatctccagctctgcccttgccctgccaagctccctgccctgttgatgctgaactacagccttgggacaggcaggctttggggctggacgctgtccaggcattcctggtgaggggaaggggaccctgtcatcctgctttatttatttgggtcccaacaccccgcagccgcatgccccttatgtccctcttctccctcttgcatgctttacctgtcccacacccatgccaatgtgccaagtctcccttggggacccagctgagtctgggtgttcccattgggttgggccaggcaaggcctctggtgcccgctgccgtccccctgcagtgggctctgctaggcctgtgctgagcaacagctgttattgtcatggtttataaacaataaactgtgatgccaggcacatctctgccttccctgag

SEQ ID NO: 195072 - DNA, 2266 bp, Homo sapiens
  Payload ID: 18508
  Gene Name: tripartite motif containing 47
  Uniprot ID: Q96LD4
  ENST ID: ENST00000254816
  CDS Start-End: 28-1944
ggcggcgccctgggcggccgcggagtcatggacggcagtggacccttcagctgccccatctgcctagagccactccgggagccggtgacgctgccctgcggccacaacttctgtctcgcctgcctgggcgcgctctggccgcatcgtggcgcgagtggagccggcggacccggaggcgcggcccgctgcccgctgtgccaggagcccttccccgacggccttcagctccgcaagaaccacacgctgtccgagctgctgcagctccgccagggctcgggccccgggtccggccccggcccggcccctgccctggccccggagccctcggcacccagcgcgctgcccagtgtcccggagccgtcggccccctgcgctcccgagccgtggcccgcgggcgaagagccagtgcgctgcgacgcgtgccccgagggcgcggccctgcccgccgcgctgtcctgcctctcctgcctcgcctccttttgccccgcgcacctgggcccgcacgagcgcagccccgccctccgcggacaccgcctggtgccgccgctgcgccggctagaggagagcctgtgcccgcgccacctacggccgctcgagcgctactgccgcgcggagcgcgtgtgtctgtgcgaggcctgcgccgcacaggagcaccgcggccacgagctggtgccgctggagcaggagcgcgcgcttcaggaggctgagcagtccaaagtcctgagcgccgtggaggaccgcatggacgagctgggtgctggcattgcacagtccaggcgcacagtggccctcatcaagagtgcagccgtagcagagcgggagagggtgagccggctgtttgcagatgctgcggccgccctgcagggcttccagacccaggtgctgggcttcatcgaggagggggaagctgccatgctaggccgctcccagggtgacctgcggcgacaggaggaacagcgcagccgcctgagccgagcccgccagaatctcagccaggtccctgaagctgactcagtcagcttcctgcaggagctgctggcactaaggctggccctggaggatgggtgtggccctgggcctggacccccgagggagctcagcttcaccaaatcatcccaagctgtccgtgcagtgagagacatgctggccgtggcctgcgtcaaccagtgggagcagctgagggggccgggtggcaacgaggatgggccacagaagctggactcggaagctgatgctgagccccaagacctcgagagtacgaacctcttggagagtgaagctcccagggactatttcctcaagtttgcctatattgtggatttggacagcgacacagcagacaagttcctgcagctgtttggaaccaaaggtgtcaagagggtgctgtgtcctatcaactaccccttgtcgcccacccgcttcacccattgtgagcaggtgctgggcgagggtgccctggaccgaggcacctactactgggaggtggagattatcgagggctgggtcagcatgggggtcatggccgaagacttctccccacaagagccctacgaccgcggccggctgggccgcaacgcccactcctgctgcctgcagtggaatggacgcagcttctccgtctggtttcatgggctggaggctcccctgccccaccccttctcgcccacggttggggtctgcctggaatacgctgaccgtgccttggccttctatgctgtacgggacggcaagatgagcctcctgcggaggctgaaggcctcccggccccgccggggtggcatcccggcctcccccattgaccccttccagagccgcctggacagtcactttgcggggctcttcacccacagactcaagcctgccttcttcctggagagtgtggacgcccacttgcagatcgggcccctcaagaagtcctgcatatccgtgctgaagaggaggtgatgccgggcacgggcgctcctgctgccgtctctgctccaggaagctgcctcctctgggccctctccttcgtctgggaaggcaccagcatgagtcccacacacccagccttctcatttctagaggcttccacctttttatacactcagccttccctctcccaggcaggaggacccccagaccctgttcccctgcagacctcacttctgggagacagagctacagctgggacagctccaagctaccctaacccctcctttcccaggtttctagaatagtgtctggcatgtagtagatgctcaataaacacttgttgaatgaatga

SEQ ID NO: 195073 - DNA, 1907 bp, Homo sapiens
  Payload ID: 18508
  Gene Name: tripartite motif containing 47
  ENST ID: ENST00000587339
  CDS Start-End: 1-368
agccgtggcccgcgggcgaagagccagtgcgctgcgacgcgtgccccgagggcgcggccctgcccgccgcgctgtcctgcctctcctgcctcgcctccttttgccccgcgcacctgggcccgcacgagcgcagccccgccctccgcggacaccgcctggtgccgccgctgcgccggctagaggagagcctgtgcccgcgccacctacggccgctcgagcgctactgccgcgcggagcgcgtgtgtctgtgcgaggcctgcgccgcacaggagcaccgcggccacgagctggtgccgctggagcaggagcgcgcgcttcaggaggtgggctccgggggcacactcgggctgagcagtccaaagtcctgagcgccgtggaggaccgcatggacgagctgggtgctggcattgcacagtccaggcgcacagtggccctcatcaagagtgcagccgtagcagagcgggagagggtgagccggctgtttgcagatgctgcggccgccctgcagggcttccagacccaggtgctgggcttcatcgaggagggggaagctgccatgctaggccgctcccagggtgacctgcggcgacaggaggaacagcgcagccgcctgagccgagcccgccagaatctcagccaggtccctgaagctgactcagtcagcttcctgcaggagctgctggcactaaggctggccctggaggatgggtgtggccctgggcctggacccccgagggagctcagcttcaccaaatcatcccaagctgtccgtgcagtgagagacatgctggccgtggcctgcgtcaaccagtgggagcagctgagggggccgggtggcaacgaggatgggccacagaagctggactcggaagctgatgctgagccccaagacctcgagagtacgaacctcttggagagtgaagctcccagggactatttcctcaagtttgcctatattgtggatttggacagcgacacagcagacaagttcctgcagctgtttggaaccaaaggtgtcaagagggtgctgtgtcctatcaactaccccttgtcgcccacccgcttcacccattgtgagcaggtgctgggcgagggtgccctggaccgaggcacctactactgggaggtggagattatcgagggctgggtcagcatgggggtcatggccgaagacttctccccacaagagccctacgaccgcggccggctgggccgcaacgcccactcctgctgcctgcagtggaatggacgcagcttctccgtctggtttcatgggctggaggctcccctgccccaccccttctcgcccacggttggggtctgcctggaatacgctgaccgtgccttggccttctatgctgtacgggacggcaagatgagcctcctgcggaggctgaaggcctcccggccccgccggggtggcatcccggcctcccccattgaccccttccagagccgcctggacagtcactttgcggggctcttcacccacagactcaagcctgccttcttcctggagagtgtggacgcccacttgcagatcgggcccctcaagaagtcctgcatatccgtgctgaagaggaggtgatgccgggcacgggcgctcctgctgccgtctctgctccaggaagctgcctcctctgggccctctccttcgtctgggaaggcaccagcatgagtcccacacacccagccttctcatttctagaggcttccacctttttatacactcagccttccctctcccaggcaggaggacccccagaccctgttcccctgcagacctcacttctgggagacagagctacagctgggacagctccaagctaccctaacccctcctttcccaggtttctagaatagtgtctggcatgtagtagatgctcaataaacacttgttgaatgaa

SEQ ID NO: 195074 - DNA, 605 bp, Homo sapiens
  Payload ID: 18508
  Gene Name: tripartite motif containing 47
  ENST ID: ENST00000586495
  CDS Start-End: 491-605
atccccttttttccaggcctggactgtggatgcaggctctttgggaacagtgatcctcaggacagcttaatgcctccttgtgcagtcacccctccgccgcccacctcccaacctaactggcttactctctgcctcttccccgccggaggaagttctcaaattcatctgagcaacactgagaccagcggacggccctgtactaggcctcctgtcagagacccgaggcagacacccagtcagcctgcacgccccccaggcgttcaggaaaggcaccagcctgggctgcaggcacctctggcatattatgggacatcgtggccactccagtcccacctgatgcacagataccactccccagtcacccccttctctcccctggcaaggcctgggacccgagtgtagggctgtggcctctgccagacctcacactcatggagggtgttgtccacaggctgagcagtccaaagtcctgagcgccgtggaggaccgcatggacgagctgggtgctggcattgcacagtccaggcgcacagtggccctcatcaagagtgcagccgtagcagagcgggagagggtgagccggctgtttgcagatgctgcggccg

SEQ ID NO: 195075 - DNA, 595 bp, Homo sapiens
  Payload ID: 18508
  Gene Name: tripartite motif containing 47
  ENST ID: ENST00000585333
  CDS Start-End: 1-551
ccccacaagagccctacgaccgcggccggctgggccgcaacgcccactcctgctgcctgcagtggaatggacgcagcttctccgtctggtttcatgggctggaggctcccctgccccaccccttctcgcccacggttggggtctgcctggaatacgctgaccgtgccttggccttctatgctactcaagcctgccttcttcctggagagtgtggacgcccacttgcagatcgggcccctcaagaagtcctgcatatccgtgctgaagaggaggtgatgccgggcacgggcgctcctgctgccgtctctgctccaggaagctgcctcctctgggccctctccttcgtctgggaaggcaccagcatgagtcccacacacccagccttctcatttctagaggcttccacctttttatacactcagccttccctctcccaggcaggaggacccccagaccctgttcccctgcagacctcacttctgggagacagagctacagctgggacagctccaagctaccctaacccctcctttcccaggtttctagaatagtgtctggcatgtagtagatgctcaataaacacttgttgaatgaa

SEQ ID NO: 195076 - DNA, 1445 bp, Homo sapiens
  Payload ID: 18509
  Gene Name: tripartite motif containing 48
  Uniprot ID: Q8IWZ4
  ENST ID: ENST00000417545
  CDS Start-End: 87-761
cttagagggagctgtgttttggtgacctctgaaactcagtactgcagcgaatgagctcctgaccttgaggagtacttaacagaattatgtctcgaagaatcattgtgggaacccttcaaagaacccagcgaaacatgaattctggaatctcgcaagtcttccagagggaactcacctgccccatctgcatgaactacttcatagacccggtcaccatagactgtgggcacagcttttgcaggccctgtttctacctcaactggcaagacatcccaattcttactcagtgctttgaatgcataaagacaatacagcagagaaacctcaaaactaacattcgattgaagaagatggcttcccttgccagaaaagccagtctctggctattcctgagctctgaggagcaaatgtgtggcattcacagggagacaaagaagatgttctgtgaagtggacaggagcctgctctgtttgctgtgctccagctctcaggagcaccggtatcacagacactgtcccgctgagtgggctgctgaggaacactgggagaagcttttaaagaaaatgcagtctttatgggaaaaagcttgtgaaaatcagagaaacctgaatgtggaaaccaccagaatcagccactggaaggcttttggagacatattatacaggagtgagtccgtgctgctgcacatgccccagcctctgaatctagcgctcagggcagggcccatcactggactgagggacaggctcaaccaattctgagtggatattactctgcatcacaatgaagccaacagtcatatcttccgatgtggagatttgagaagcatttgtattggatgtgaccgtcaaaatccgccccatatcactgcaacacctacaagttttcttgcatggggtgctcagactttcacctctggcaaatattactgggaggtccatgtgggggactcttggaattgggcttttggtgtctgtaataagtattggaaagggaagaatcagaatggcaatatatatggagaggagggactctttagtcttgggtgtgttaagaacgacattcagtgcagtctctttaccacctccccaattacactgcagtatgtcccaagacctaccaaccatgtagaattattcctggattgtgaagctagaactgtgagcttcgttgatgttagtcaaagctcccctatatacaccatccctaattgctccttctcacttcctctcagacctatctttttctgtattctcctctgaccagagacaaatcagaaatgtgttcatctgctgtgggaacccctttatcccagaaagccctcttccttgtgccttatcaaacaggacaaataggttcggttttatgtcttgaattgcattctaatgttattaaaactcatttattgtgttactattaaatgtagtaaaaacactaaaagtata

SEQ ID NO: 195077 - DNA, 2163 bp, Homo sapiens
  Payload ID: 18510
  Gene Name: tripartite motif containing 49
  Uniprot ID: P0CI25
  ENST ID: ENST00000329758
  CDS Start-End: 330-1688
ctaatcttccagttgccccctattgactttaaaccaaagctttgattcatgaccactgggatccagccagcgggggatttcttttcctgatggactgtacccaggatctcacatttgcttaagcagctcccacaattgggttcttataaaaggacacggaagagacaagctcagttttctctgaaggagaaggactgcacttagaactgcattttggcgacctctgaaattcagtactgcagtgaatgagcttctgatcttgaggtgaacttaacaaaattatttttggaaaaatcgttgtgggaaccattaaaagaactccaggaaacatgaattctggaatcttacaggtctttcagggggaactcatctgccccctgtgcatgaactacttcatagacccggtcaccatagactgtgggcacagcttttgcaggccttgtttctacctcaactggcaagacatcccatttcttgtccagtgctctgaatgcacaaagtcaaccgagcagataaacctcaaaaccaacattcatttgaagaagatggcttctcttgccagaaaagtcagtctctggctattcctgagctctgaggagcaaatgtgtggcactcacagggagacaaagaagatattctgtgaagtggacaggagcctgctctgtttgctgtgctccagctctcaggagcaccggtatcacagacaccgtcccattgagtgggctgctgaggaacaccgggagaagcttttacagaaaatgcagtctttgtgggaaaaagcttgtgaaaatcacagaaacctgaatgtggaaaccaccagaaccagatgctggaaggattatgtgaatttaaggctagaagcaattagagctgagtatcagaagatgcctgcatttcatcatgaagaagaaaaacataatttggagatgctgaaaaagaaggggaaagaaatttttcatcgacttcatttaagtaaagccaaaatggctcataggatggagattttaagaggaatgtatgaggagctgaacgaaatgtgccataaaccagatgtggagctacttcaggcttttggagacatattacacaggagtgagtccgtgctgctgcacatgccccagcctctgaatccagagctcagtgcagggcccatcactggactgagggacaggctcaaccaattccgagtgcatattactctgcatcatgaagaagccaacaatgatatctttctgtatgaaattttgagaagcatgtgtattggatgtgaccatcaagatgtaccctatttcactgcaacacctagaagttttcttgcatggggtgttcagactttcacctcgggcaaatattactgggaggtccatgtaggggactcctggaattgggcttttggtgtctgtaatatgtatcggaaagagaagaatcagaatgagaagatagatggaaaggcgggactctttcttcttgggtgtgttaagaatgacattcaatgcagtctctttaccacctccccacttatgctgcaatatatcccaaaacctaccagccgagtaggattattcctggattgtgaggctaagactgtgagctttgttgatgttaatcaaagctccctaatatacaccatccctaattgctctttctcacctcctctcaggcctatcttttgctgtattcacttctgaccagagacaaatcagaaatgtgttcacatgctgtgggaacccctttatcccaggaagtcctcttccttgtgccttaacatacaggacaaataggctctattttatgtcttgaattgccttctaatgttatcaaaactcatttattgtgttactattaaatatgctgaaaacgctaaaagtatacgtattggttctttattaaataatttttgaaaaatcattattcatgatcatggcatacagtatattctcttttttttctttatttatgactgtcactgagtgaaataatagatgacagacatgtctgaatgaagtaaaaatcaatggaagacagtcgggatcttttgcttcatgcaaaaaacttggagtgaagtctcaatgataactgggaaatgtttttcttcctctttatctaactatattacacttatccatcaggtttcattgtattaatctatcctttgaggtaata

SEQ ID NO: 195078 - DNA, 1437 bp, Homo sapiens
  Payload ID: 18510
  Gene Name: tripartite motif containing 49
  ENST ID: ENST00000532501
  CDS Start-End: 127-1254
gaactgcattttggcgacctctgaaattcagtactgcagtgaatgagcttctgatcttgaggtgaacttaacaaaattatttttggaaaaatcgttgtgggaaccattaaaagaactccaggaaacatgaattctggaatcttacaggtctttcagggggaactcatctgccccctgtgcatgaactacttcatagacccggtcaccatagactgtgggcacagcttttgcaggccttgtttctacctcaactggcaagacatcccatttcttgtccagtgctctgaatgcacaaagtcaaccgagcagataaacctcaaaaccaacattcatttgaagaagatggcttctcttgccagaaaagtcagtctctggctattcctgagctctgaggagcaaatgtgtggcactcacagggagacaaagaagatattctgtgaagtggacaggagcctgctctgtttgctgtgctccagctctcaggagcaccggtatcacagacaccgtcccattgagtgggctgctgaggaacaccgggagaagcttttacagaaaatgcagtctttgtgggaaaaagcttgtgaaaatcacagaaacctgaatgtggaaaccaccagaaccagatgctggaaggcttttggagacatattacacaggagtgagtccgtgctgctgcacatgccccagcctctgaatccagagctcagtgcagggcccatcactggactgagggacaggctcaaccaattccgagtgcatattactctgcatcatgaagaagccaacaatgatatctttctgtatgaaattttgagaagcatgtgtattggatgtgaccatcaagatgtaccctatttcactgcaacacctagaagttttcttgcatggggtgttcagactttcacctcgggcaaatattactgggaggtccatgtaggggactcctggaattgggcttttggtgtctgtaatatgtatcggaaagagaagaatcagaatgagaagatagatggaaaggcgggactctttcttcttgggtgtgttaagaatgacattcaatgcagtctctttaccacctccccacttatgctgcaatatatcccaaaacctaccagccgagtaggattattcctggattgtgaggctaagactgtgagctttgttgatgttaatcaaagctccctaatatacaccatccctaattgctctttctcacctcctctcaggcctatcttttgctgtattcacttctgaccagagacaaatcagaaatgtgttcacatgctgtgggaacccctttatcccaggaagtcctcttccttgtgccttaacatacaggacaaataggctctattttatgtcttgaattgccttctaatgttatcaaaactcatttattgtgttactattaaatatgctgaaaacgctaaaagtata

SEQ ID NO: 195079 - DNA, 1534 bp, Homo sapiens
  Payload ID: 18511
  Gene Name: tripartite motif containing 49B
  Uniprot ID: A6NDI0
  ENST ID: ENST00000332682
  CDS Start-End: 124-1482
ctgcattttggtgacctctgaaattcagtacggcagtgaatgagcttctgacgttgaggtgaacttaacaaaattatttttggaaaaatcgttgtgggaaccattaaaagaactcagggaaacatgaattctggaatcttacaggtctttcagagggaactcatctgccccatctgcatgaactacttcatagacccggtcaccatagactgtgggcacagcttttgcaggccttgtttctacctcaactggaaagacagcccatttcttgtccagtgctctgaatgcacaaagtcaacagggcagataaacctcaaaaccaacattcatttcaagaagatggcttctcttgctagaaaagtcagtctctggctattcctgagctctgaggagcaaatgtgtggcactcacagggagacaaagaagatgttctgtgaagtggacaggagcctgctctgtttgctgtgctccagctctcaggagcaccgggatcacagacactgtcccattgagtcggctgctgaggaacaccaggagaagcttttacagaaaatgcagtctttgtgggaaaaagcttgtgaaaatcacagaaacctgaatgtggaaaccaccagaaccagatgctggaaggattatgtgaatttaaggctagaagcaattagagctgagtatcagaagatgcctgcatttcaccatgaagaagaaaaacataatttggagatgctgaaaaagaaggggaaagatatttttcatcgacttcatttaagtaaagccaaaatggctcataggagggagattttaagaggaatgtatgaggagctgaacgaaatgtgccataaaccagatgtggagctacttcaggcttttggagacatattacacaggagtgagtccgtgctgctgcacatgccccagcctctgaatccagagctcagtgcagggcccatcactggactgagggacaggctcaaccaattccgagtgcatattactctgcatcatgaagaagccaacagtgatatctttctatgtgaaattttgagaagcatgtgtattggatgtgaccatcaagatgtaccctatttcactgcaacacctagaagttttcttgcatggggtgctcagactttcacctcgggcaaatattactgggaggtccatgtaggggactcctggaattgggcttttggtgtctgtaatatgtattggaaagagaagaatcagaatgagaagatagatggagaggatggactctttcttcttgggtgtgttaagaatgacattcaacgcagtctctttaccacctccccacttctgctgcaatatatcccaagacctaccagccgagtaggattattcctggattgtgaggctaagactgtgagctttgttgatgttaatcaaagctccctaatatacaccatccctaattgctctttctcacctcctctcaggcctatcttttgctgtattcacttctgaccagagacaaatcagaaatgtgttcacatgctgtgggaacccctttatccca

SEQ ID NO: 195080 - DNA, 2162 bp, Homo sapiens
  Payload ID: 18511
  Gene Name: tripartite motif containing 49B
  Uniprot ID: A6NDI0
  ENST ID: ENST00000622138
  CDS Start-End: 330-1688
ctaatcttccagttgccccctattgactttaaaccaaagctttgattcatgaccactgggatccagccagcgggggatttcttttcctgatggactgtacccaggatctcacatttgcttaagcagcccccacaattggattcttataaaaggacacagaagagacaagctcagttttctctgaaggagaaggactgcacttagaactgcattttggtgacctctgaaattcagtacggcagtgaatgagcttctgacgttgaggtgaacttaacaaaattatttttggaaaaatcgttgtgggaaccattaaaagaactcagggaaacatgaattctggaatcttacaggtctttcagagggaactcatctgccccatctgcatgaactacttcatagacccggtcaccatagactgtgggcacagcttttgcaggccttgtttctacctcaactggaaagacagcccatttcttgtccagtgctctgaatgcacaaagtcaacagggcagataaacctcaaaaccaacattcatttcaagaagatggcttctcttgctagaaaagtcagtctctggctattcctgagctctgaggagcaaatgtgtggcactcacagggagacaaagaagatgttctgtgaagtggacaggagcctgctctgtttgctgtgctccagctctcaggagcaccgggatcacagacactgtcccattgagtcggctgctgaggaacaccaggagaagcttttacagaaaatgcagtctttgtgggaaaaagcttgtgaaaatcacagaaacctgaatgtggaaaccaccagaaccagatgctggaaggattatgtgaatttaaggctagaagcaattagagctgagtatcagaagatgcctgcatttcaccatgaagaagaaaaacataatttggagatgctgaaaaagaaggggaaagatatttttcatcgacttcatttaagtaaagccaaaatggctcataggagggagattttaagaggaatgtatgaggagctgaacgaaatgtgccataaaccagatgtggagctacttcaggcttttggagacatattacacaggagtgagtccgtgctgctgcacatgccccagcctctgaatccagagctcagtgcagggcccatcactggactgagggacaggctcaaccaattccgagtgcatattactctgcatcatgaagaagccaacagtgatatctttctatgtgaaattttgagaagcatgtgtattggatgtgaccatcaagatgtaccctatttcactgcaacacctagaagttttcttgcatggggtgctcagactttcacctcgggcaaatattactgggaggtccatgtaggggactcctggaattgggcttttggtgtctgtaatatgtattggaaagagaagaatcagaatgagaagatagatggagaggatggactctttcttcttgggtgtgttaagaatgacattcaacgcagtctctttaccacctccccacttctgctgcaatatatcccaagacctaccagccgagtaggattattcctggattgtgaggctaagactgtgagctttgttgatgttaatcaaagctccctaatatacaccatccctaattgctctttctcacctcctctcaggcctatcttttgctgtattcacttctgaccagagacaaatcagaaatgtgttcacatgctgtgggaacccctttatcccaggaagtcctcttccttgtgccttaacatacaggacaaataggctctattttatatcttgaattgccttctaatgttatcaaaactcatttattgtgttactattaaatatgctgaaaacactaaaagtatatgtattggttctttattaaataatttttgaaaaatcattattcatgatcatggcatacagtatattctctttttttctttatttctgactgtcactgagtgaaataatagatggcagacatgtctgaatgaagtaaaaatcaatggaagacagtcaggatcttttgcttcatgcaaaaaacttggagtgaagtctcaatgataactgggaaatgtttttcttcctctttatctaactatattacacttatccatcaggcttcattgtattaatctatcctttgaggtaata

SEQ ID NO: 195081 - DNA, 2163 bp, Homo sapiens
  Payload ID: 18512
  Gene Name: tripartite motif containing 49C
  Uniprot ID: P0CI26
  ENST ID: ENST00000448984
  CDS Start-End: 330-1688
ctaatcttccagttgccccctattgactttaaaccaaagctttgattcatgaccactgggatccagccagcgggggatttcttttcctggtggactgtacccaggatctcacatttgcttaagcagcccccacaattgggttcttataaaaggacacggaagagacaagctcagttttctctgaaggagaaggactgcacttagaactgcattttggcgacctctgaaattcagtactgcagtgaatgagcttctgaccttgaggtgaacttaacaaaattatttttggaaaaatcgttgtgggaaccattaaaagaactccaggaaacatgaattctggaatcttacaggtctttcagggggaactcatctgccccctgtgcatgaactacttcatagacccggtcaccatagactgtgggcacagcttttgcaggccttgtttctacctcaactggcaagacatcccatttcttgtccagtgctctgaatgcacaaagtcaacagagcagataaacctcaaaaccaacattcatttgaagaagatggcttctcttgccagaaaagtcagtctctggctattcctgagctctgaggagcaaatgtgtggcactcacagggagacaaagaagatattctgtgaagtggacaggagcctgctctgtttgctgtgctccagctctcaggagcaccggtatcacagacaccgtcccattgagtgggctgctgaggaacaccgggagaagcttttacagaaaatgcagtctttgtgggaaaaagcttgtgaaaatcacagaaacctgaatgtggaaaccaccagaaccagatgctggaaggattatgtgaatttaaggctagaagcaattagagctgagtatcagaagatgcctgcatttcatcatgaagaagaaaaacataatttggagatgctgaaaaagaaggggaaagaaatttttcatcgacttcatttaagtaaagccaaaatggctcataggatggagattttaagaggaatgtatgaggagctgaacgaaatgtgccataaaccagatgtggagctacttcaggcttttggagacatattacacaggagtgagtccgtgctgctgcacatgccccagcctctgaatccagagctcagtgcagggcccatcactggactgagggacaggctcaaccaattccgagtgcatattactctgcatcatgaagaagccaacagtgatatctttctgtatgaaattttgagaagcatgtgtattggatgtgaccatcaagatgtaccctatttcactgcaacacctagaagttttcttgcatggggtgttcagactttcacctcgggcaaatattactgggaggtccatgtaggggactcctggaattgggcttttggtgtctgtaatatgtatcggaaggagaagaatcagaatgagaagatagatggaaaggagggactctttcttcttgggtgtattaagaatgacattcaatgcagtctctttaccacctccccacttatgctgcaatatatcccaaaacctaccagccgagtaggattattcctggattgtgaggctaagactgtgagctttgttgatgttaatcaaagctccctaatatacaccatccctaattgctctttctcacctcctctcaggcctatcttttgctgtattcacttctgaccagagacaaatcagaaatgtgttcacatgctgtgggaacccctttatcccaggaagtcctcttccttgtgccttaacatacaggacaaataggctctattttatgtcttgaattgccttctaatgttatcaaaactcatttattgtgttactattaaatatgctgaaaacgctaaaagtatacgtattggttctttattaaataatttttgaaaaatcattattcatgatcatggcatacagtatattctcttttttttctttatttatgactgtcactgagtgaaataatagatgacagacatgtctgaatgaagtaaaaatcaatggaagacagtcgggatcttttgcttcatgcaaaaaacttggagtgaagtctcaatgataactgggaaatgtttttcttcctctttatctaactatattacacttatccatcaggtttcattgtattaatctatcctttgaggtaata

SEQ ID NO: 195082 - DNA, 1651 bp, Homo sapiens
  Payload ID: 18513
  Gene Name: tripartite motif containing 49D1
  Uniprot ID: C9J1S8
  ENST ID: ENST00000420869
  CDS Start-End: 115-1473
ggtgacctctgaaactcagtactgcggcgaatgagctcctgaccttgaggagtacttaacagaattatttctcgaagaatcattgtgggaacccttcaaagaacccagcgaaacatgaattctggaatctcgcaagtcttccagagggaactcacctgccccatctgcctgaactacttcatagacccggtcaccatagactgtgggcacagcttttgcaggccctgtttctacctcaactggcaagacatcccaattcttactcagtgctttgaatgcctaaagacaacacagcagagaaacctcaaaactaacattcgattgaagaagatggcttcccgtgccagaaaagccagtctctggctattcctgagctctgaggagcaaatgtgtggcactcacagggagacaaagaagatattctgtgaagtggacaggagcctgctctgtttgctgtgctccagctctctggagcaccggtatcacagacactgtcccgctgagtgggctgctgaggaacaccgggagaagcttttaaagaaaatgcagtctttatgggaaaaagtttgtgaaaatcagagaaacctgaacgtggaaaccaccagaatcagccactggaaggattatgtgaatgtaaggctagaagctattagagctgagtatcagaagatgcctgcatttcatcatgaagaagaaaaacataatttggagatgctgaaaaagaaggggaaagatatttttcatcgacttcatttaagtaaagccaaaatggctcacaggagggagattttaagaggaacgtatgcggagctgatgaaaatgtgccataaaccagatgtggagctacttcaggcttttggagacatattacacaggagtgagtccgtgctgctgcacatgccccagcctctgaatctagagctcagggcagggcccatcactggactgagggacaggctcaaccaattccgagtggatattactctgcctcataatgaagccaacagtcatatcttccgacgtggagatttgagaagcatttgtattggatgtgaccgtcaaaatgcgccccatatcactgcaacacctacaagttttcttgcatggggtgctcagactttcacctctggcaaatattactgggaggtccatgtgggggactcttggaattgggcctttggtgtctgtaataagtattggaaagggacgaatcagaatggcaatatacatggagaggagggactctttagtcttgggtgtgttaagaatgacattcagtgcagcctctttaccacctccccacttacactgcagtatgtcccaagacctaccaaccatgtaggattattcctggattgtgaagctagaactgtgagcttcgttgatgttaatcaaagctcccctatacacaccatccctaattgctccttctcacctcctctcaggcctatcttttgctgtgttcacctctgaccagagacaaatcagatatgtgttcatctgctgtgggaacccctttatcccagaaagccctcttccttgtgccttatcaaacaggacaaatacgttctgttttatgtcttgaattgcattctaatgttattaaaactcatttattgtgttactattaaatgtggtaaaaacactaaaa

SEQ ID NO: 195083 - DNA, 2164 bp, Homo sapiens
  Payload ID: 18513
  Gene Name: tripartite motif containing 49D1
  Uniprot ID: C9J1S8
  ENST ID: ENST00000530311
  CDS Start-End: 330-1688
taatcttccagttgccccctaatgactttggaccaaagctttgaatcctgaccattgggatccagccagctgaggatttttcttcctaactgactttaacagggatctcatacttgctcaggcagcccatcaactattcttataaaaggacatagaagagacaagctcagttttctccaaaggagaaggagcgcacttagaggaagctgtgttttggtgacctctgaaactcagtactgcggcgaatgagctcctgaccttgaggagtacttaacagaattatttctcgaagaatcattgtgggaacccttcaaagaacccagcgaaacatgaattctggaatctcgcaagtcttccagagggaactcacctgccccatctgcctgaactacttcatagacccggtcaccatagactgtgggcacagcttttgcaggccctgtttctacctcaactggcaagacatcccaattcttactcagtgctttgaatgcctaaagacaacacagcagagaaacctcaaaactaacattcgattgaagaagatggcttcccgtgccagaaaagccagtctctggctattcctgagctctgaggagcaaatgtgtggcactcacagggagacaaagaagatattctgtgaagtggacaggagcctgctctgtttgctgtgctccagctctctggagcaccggtatcacagacactgtcccgctgagtgggctgctgaggaacaccgggagaagcttttaaagaaaatgcagtctttatgggaaaaagtttgtgaaaatcagagaaacctgaacgtggaaaccaccagaatcagccactggaaggattatgtgaatgtaaggctagaagctattagagctgagtatcagaagatgcctgcatttcatcatgaagaagaaaaacataatttggagatgctgaaaaagaaggggaaagatatttttcatcgacttcatttaagtaaagccaaaatggctcacaggagggagattttaagaggaacgtatgcggagctgatgaaaatgtgccataaaccagatgtggagctacttcaggcttttggagacatattacacaggagtgagtccgtgctgctgcacatgccccagcctctgaatctagagctcagggcagggcccatcactggactgagggacaggctcaaccaattccgagtggatattactctgcctcataatgaagccaacagtcatatcttccgacgtggagatttgagaagcatttgtattggatgtgaccgtcaaaatgcgccccatatcactgcaacacctacaagttttcttgcatggggtgctcagactttcacctctggcaaatattactgggaggtccatgtgggggactcttggaattgggcctttggtgtctgtaataagtattggaaagggacgaatcagaatggcaatatacatggagaggagggactctttagtcttgggtgtgttaagaatgacattcagtgcagcctctttaccacctccccacttacactgcagtatgtcccaagacctaccaaccatgtaggattattcctggattgtgaagctagaactgtgagcttcgttgatgttaatcaaagctcccctatacacaccatccctaattgctccttctcacctcctctcaggcctatcttttgctgtgttcacctctgaccagagacaaatcagatatgtgttcatctgctgtgggaacccctttatcccagaaagccctcttccttgtgccttatcaaacaggacaaatacgttctgttttatgtcttgaattgcattctaatgttattaaaactcatttattgtgttactattaaatgtggtaaaaacactaaaagtatgtgtactggttattaattaatttttgaaaaatcattattcatgatcatggcatgaaatatattctctgtttttttttctttatttctgactgccactgagtgaaataatagttgacagacatgtctgaatggagttaaaatcagtggaagagagtcgggatcttttgcttcatgcaaaaacttggagtgaagcgttaatgataactgggaaatgctgtttttctttctctttatctaactgtgttgcacttatccatcatgtttcattgtactaatctatcctttgagttaata

SEQ ID NO: 195084 - DNA, 1442 bp, Homo sapiens
  Payload ID: 18513
  Gene Name: tripartite motif containing 49D1
  ENST ID: ENST00000605881
  CDS Start-End: 135-1262
cttagaggaagctgtgttttggtgacctctgaaactcagtactgcggcgaatgagctcctgaccttgaggagtacttaacagaattatttctcgaagaatcattgtgggaacccttcaaagaacccagcgaaacatgaattctggaatctcgcaagtcttccagagggaactcacctgccccatctgcctgaactacttcatagacccggtcaccatagactgtgggcacagcttttgcaggccctgtttctacctcaactggcaagacatcccaattcttactcagtgctttgaatgcctaaagacaacacagcagagaaacctcaaaactaacattcgattgaagaagatggcttcccgtgccagaaaagccagtctctggctattcctgagctctgaggagcaaatgtgtggcactcacagggagacaaagaagatattctgtgaagtggacaggagcctgctctgtttgctgtgctccagctctctggagcaccggtatcacagacactgtcccgctgagtgggctgctgaggaacaccgggagaagcttttaaagaaaatgcagtctttatgggaaaaagtttgtgaaaatcagagaaacctgaacgtggaaaccaccagaatcagccactggaaggcttttggagacatattacacaggagtgagtccgtgctgctgcacatgccccagcctctgaatctagagctcagggcagggcccatcactggactgagggacaggctcaaccaattccgagtggatattactctgcctcataatgaagccaacagtcatatcttccgacgtggagatttgagaagcatttgtattggatgtgaccgtcaaaatgcgccccatatcactgcaacacctacaagttttcttgcatggggtgctcagactttcacctctggcaaatattactgggaggtccatgtgggggactcttggaattgggcctttggtgtctgtaataagtattggaaagggacgaatcagaatggcaatatacatggagaggagggactctttagtcttgggtgtgttaagaatgacattcagtgcagcctctttaccacctccccacttacactgcagtatgtcccaagacctaccaaccatgtaggattattcctggattgtgaagctagaactgtgagcttcgttgatgttaatcaaagctcccctatacacaccatccctaattgctccttctcacctcctctcaggcctatcttttgctgtgttcacctctgaccagagacaaatcagatatgtgttcatctgctgtgggaacccctttatcccagaaagccctcttccttgtgccttatcaaacaggacaaatacgttctgttttatgtcttgaattgcattctaatgttattaaaactcatttattgtgttactattaaatgtggtaaaaacactaaaagt

SEQ ID NO: 195085 - DNA, 1651 bp, Homo sapiens; identical to SEQ ID NO: 195082
  Payload ID: 18514
  Gene Name: tripartite motif containing 49D2
  Uniprot ID: C9J1S8
  ENST ID: ENST00000623787
  CDS Start-End: 115-1473

SEQ ID NO: 195086 - DNA, 1411 bp, Homo sapiens
  Payload ID: 18514
  Gene Name: tripartite motif containing 49D2
  Uniprot ID: C9J1S8
  ENST ID: ENST00000526396
  CDS Start-End: 1-1359
atgaattctggaatctcgcaagtcttccagagggaactcacctgccccatctgcctgaactacttcatagacccggtcaccatagactgtgggcacagcttttgcaggccctgtttctacctcaactggcaagacatcccaattcttactcagtgctttgaatgcctaaagacaacacagcagagaaacctcaaaactaacattcgattgaagaagatggcttcccgtgccagaaaagccagtctctggctattcctgagctctgaggagcaaatgtgtggcactcacagggagacaaagaagatattctgtgaagtggacaggagcctgctctgtttgctgtgctccagctctctggagcaccggtatcacagacactgtcccgctgagtgggctgctgaggaacaccgggagaagcttttaaagaaaatgcagtctttatgggaaaaagtttgtgaaaatcagagaaacctgaacgtggaaaccaccagaatcagccactggaaggattatgtgaatgtaaggctagaagctattagagctgagtatcagaagatgcctgcatttcatcatgaagaagaaaaacataatttggagatgctgaaaaagaaggggaaagatatttttcatcgacttcatttaagtaaagccaaaatggctcacaggagggagattttaagaggaacgtatgcggagctgatgaaaatgtgccataaaccagatgtggagctacttcaggcttttggagacatattacacaggagtgagtccgtgctgctgcacatgccccagcctctgaatctagagctcagggcagggcccatcactggactgagggacaggctcaaccaattccgagtggatattactctgcctcataatgaagccaacagtcatatcttccgacgtggagatttgagaagcatttgtattggatgtgaccgtcaaaatgcgccccatatcactgcaacacctacaagttttcttgcatggggtgctcagactttcacctctggcaaatattactgggaggtccatgtgggggactcttggaattgggcctttggtgtctgtaataagtattggaaagggacgaatcagaatggcaatatacatggagaggagggactctttagtcttgggtgtgttaagaatgacattcagtgcagcctctttaccacctccccacttacactgcagtatgtcccaagacctaccaaccatgtaggattattcctggattgtgaagctagaactgtgagcttcgttgatgttaatcaaagctcccctatacacaccatccctaattgctccttctcacctcctctcaggcctatcttttgctgtgttcacctctgaccagagacaaatcagatatgtgttcatctgctgtgggaacccctttatccca

SEQ ID NO: 195087 - DNA, 2290 bp, Homo sapiens
  Payload ID: 18515
  Gene Name: tripartite motif containing 5
  Uniprot ID: Q9C035
  ENST ID: ENST00000380027
  CDS Start-End: 785-1765
atttccttctagaagccaggagcaaaggacagacctctctctggtataaggaggaagagattgagaagaggaattctccagagtctattaactatactacatcaacgcctccaagatactatggtacccatcccaggggaagtggggctacaagaacagtataaatatctcctattggcataataaatggtgtaccccaagaatatgccaagggatgttttgtagagattttgagactaaggagatttggaaattgtgtggctattagcagtttcattcataatgaaatttataatcccttaaaaaacttggaggaagataattgcaggaagaacaccttgaataagcagaactcagctgtgagatcaggagcaagaggagcacattggaagaatttcgaaaaagggcaccttttctaatttttaatacttggctgggttaatctgaaactatgtcagaagaagtggcatgataacaagatcctgagactcaagagaaaagggagattgagtgggaatgcctctagttcccacggctcctcctgtgaacagcacagctacacggcccggctgattcattcagagggcgggactcaccaggccctacgtggagaaatgccattggcccatagtttatctttcactttcctgccctgagtgtgagcaagaatttcctgcggttcctctaggaaaattcctttgtgcagatcaggcccgtggattgggatctgtgaacaagaggaacctcagcagccaggacaggcaggagcagtggaatagctactatggcttctggaatcctggttaatgtaaaggaggaggtgacctgccccatctgcctggaactcctgacacaacccctgagcctggactgcggccacagcttctgccaagcatgcctcactgcaaaccacaagaagtccatgctagacaaaggagagagtagctgccctgtgtgccggatcagttaccagcctgagaacatacggcctaatcggcatgtagccaacatagtggagaagctcagggaggtcaagttgagcccagaggggcagaaagttgatcattgtgcacgccatggagagaaacttctactcttctgtcaggaggacgggaaggtcatttgctggctttgtgagcggtctcaggagcaccgtggtcaccacacgttcctcacagaggaggttgcccgggagtaccaagtgaagctccaggcagctctggagatgctgaggcagaagcagcaggaagctgaagagttagaagctgacatcagagaagagaaagcttcctggaagactcaaatacagtatgacaaaaccaacgtcttggcagattttgagcaactgagagacatcctggactgggaggagagcaatgagctgcaaaacctggagaaggaggaggaagacattctgaaaagccttacgaactctgaaactgagatggtgcagcagacccagtccctgagagagctcatctcagatctggagcatcggctgcaggggtcagtgatggagctgcttcagggtgtggatggcgtcataaaaaggacggagaacgtgaccttgaagaagccagaaacttttccaaaaaatcaaaggagagtgtttcgagctcctgatctgaaaggaatgctagaagtgtttagagagctgacagatgtccgacgctactggggctggagtgcaatggcacgatctcggttcactgcaacctccacctctcagattcaagcaattctcctgcctcagcctcccaagtagctgggattacaggtgcccaccaccacccctggctaaatttgtattttcagtagagacggggtttccccatgttggttaggctcgtctagaacctctgacctcaggtgatccacccgcctcggcctcccaaagtgctgggattacaggcgtgagccacggcgcccagcctgtgcttattttcttaaaataatttttgtattaaaaacttcacattaaataagtgctaatgttttattgcatagtagggtgactagagttaacaataacctattgcatatattttgaaatagctagaagagaggattttgaaagttctcaacacaaagaaatgacacatatttgaggtgatggatatgctaattaccctggttcggttattacgcaatgtatacatgtatcaaaacatcacactgtaccacataaatatgtatatttattatttgtcaattaaaagcaaaataaaacaaaaaaccttcatctaatactttggatcattgtgaaaaaataaattcctgaagtataaag

SEQ ID NO: 195088 - DNA, 2991 bp, Homo sapiens
  Payload ID: 18515
  Gene Name: tripartite motif containing 5
  Uniprot ID: Q9C035
  ENST ID: ENST00000380034
  CDS Start-End: 258-1739
gcggttcctctaggaaaattcctttgtgcagatcaggcccgtggattggtgagtgaatcctaaccacgtcttccctggcctgtcttcactcttctccccagaatcaccacttctgcactggtgtctgaaggtgtattgagtgattttgtggagggcagaagtaggaagtctttgggacaaaactgtatttaccttgggatctgtgaacaagaggaacctcagcagccaggacaggcaggagcagtggaatagctactatggcttctggaatcctggttaatgtaaaggaggaggtgacctgccccatctgcctggaactcctgacacaacccctgagcctggactgcggccacagcttctgccaagcatgcctcactgcaaaccacaagaagtccatgctagacaaaggagagagtagctgccctgtgtgccggatcagttaccagcctgagaacatacggcctaatcggcatgtagccaacatagtggagaagctcagggaggtcaagttgagcccagaggggcagaaagttgatcattgtgcacgccatggagagaaacttctactcttctgtcaggaggacgggaaggtcatttgctggctttgtgagcggtctcaggagcaccgtggtcaccacacgttcctcacagaggaggttgcccgggagtaccaagtgaagctccaggcagctctggagatgctgaggcagaagcagcaggaagctgaagagttagaagctgacatcagagaagagaaagcttcctggaagactcaaatacagtatgacaaaaccaacgtcttggcagattttgagcaactgagagacatcctggactgggaggagagcaatgagctgcaaaacctggagaaggaggaggaagacattctgaaaagccttacgaactctgaaactgagatggtgcagcagacccagtccctgagagagctcatctcagatctggagcatcggctgcaggggtcagtgatggagctgcttcagggtgtggatggcgtcataaaaaggacggagaacgtgaccttgaagaagccagaaacttttccaaaaaatcaaaggagagtgtttcgagctcctgatctgaaaggaatgctagaagtgtttagagagctgacagatgtccgacgctactgggttgatgtgacagtggctccaaacaacatttcatgtgctgtcatttctgaagataagagacaagtgagctctccgaaaccacagataatatatggggcacgagggacaagataccagacatttgtgaatttcaattattgtactggcatcctgggctctcaaagtatcacatcagggaaacattactgggaggtagacgtgtccaagaaaactgcttggatcctgggggtatgtgctggcttccaacctgatgcaatgtgtaatattgaaaaaaatgaaaattatcaacctaaatacggctactgggttatagggttagaggaaggagttaaatgtagtgctttccaggatagttccttccatactccttctgttcctttcattgtgcccctctctgtgattatttgtcctgatcgtgttggagttttcctagactatgaggcttgcactgtctcattcttcaatatcacaaaccatggatttctcatctataagttttctcactgttctttttctcagcctgtatttccatatttaaatcctagaaaatgtggagtccccatgactctgtgctcaccaagctcttgaaccttcttacacactcagccccttctgtacagcacctcttgtccaggtgcatctcatacacctgaactcatttgcatcattttaaccatcttttccttgctgtctcccttctttctatttgaacgtccttcactcatcagtaaaatgtaataattgccttgtgccatattgtccccaatattttattgacatttgatagcaatttttttcatcattttccgtactcctaaggaaaactgacctatacctcataaaatgagaccgctatttaggtattacttctgccagatatttatcacccaattgcctctgacactgactaagaagatgaagaaaagcttttcaacagcctttctatatcatcgtgtgataattgttcaccaatgaatgagtccttagccctgtgtcagtttaccctcgatgcccttatttgtgagttaaagagaaaatatcataaatggtatactcttaagtatagaggttttgtatctagaggatctcagttcaactcctgtctctccatataccagcagtgtaactgtgaataacatacttaaatggctgtgcttatttccttttcttttcttttttctttttttttttttttgagatgaagttttgctcttgttccccaggctggagtgcaatggcacgatctcggttcactgcaacctccacctctcagattcaagcaattctcctgcctcagcctcccaagtagctgggattacaggtgcccaccaccacccctggctaaatttgtattttcagtagagacggggtttccccatgttggttaggctcgtctagaacctctgacctcaggtgatccacccgcctcggcctcccaaagtgctgggattacaggcgtgagccacggcgcccagcctgtgcttattttcttaaaataatttttgtattaaaaacttcacattaaataagtgctaatgttttattgcatagtagggtgactagagttaacaataacctattgcatatattttgaaatagctagaagagaggattttgaaagttctcaacacaaagaaatgacacatatttgaggtgatggatatgctaattaccctggttcggttattacgcaatgtatacatgtatcaaaacatcacactgtaccacataaatatgtatatttattatttgtcaattaaaagcaaaataaaacaaaaaaccttcatctaatactttggatcattgtgaaaaaataaattcctgaagtataaagcatcta

SEQ ID NO: 195089 - DNA, 3170 bp, Homo sapiens
  Payload ID: 18515
  Gene Name: tripartite motif containing 5
  Uniprot ID: Q9C035
  ENST ID: ENST00000396847
  CDS Start-End: 237-1280
ctttgtgcagatcaggcccgtggattggtgagtgaatcctaaccacgtcttccctggcctgtcttcactcttctccccagaatcaccacttctgcactggtgtctgaaggtgtattgagtgattttgtggagggcagaagtaggaagtctttgggacaaaactgtatttaccttgggatctgtgaacaagaggaacctcagcagccaggacaggcaggagcagtggaatagctactatggcttctggaatcctggttaatgtaaaggaggaggtgacctgccccatctgcctggaactcctgacacaacccctgagcctggactgcggccacagcttctgccaagcatgcctcactgcaaaccacaagaagtccatgctagacaaaggagagagtagctgccctgtgtgccggatcagttaccagcctgagaacatacggcctaatcggcatgtagccaacatagtggagaagctcagggaggtcaagttgagcccagaggggcagaaagttgatcattgtgcacgccatggagagaaacttctactcttctgtcaggaggacgggaaggtcatttgctggctttgtgagcggtctcaggagcaccgtggtcaccacacgttcctcacagaggaggttgcccgggagtaccaagtgaagctccaggcagctctggagatgctgaggcagaagcagcaggaagctgaagagttagaagctgacatcagagaagagaaagcttcctggaagactcaaatacagtatgacaaaaccaacgtcttggcagattttgagcaactgagagacatcctggactgggaggagagcaatgagctgcaaaacctggagaaggaggaggaagacattctgaaaagccttacgaactctgaaactgagatggtgcagcagacccagtccctgagagagctcatctcagatctggagcatcggctgcaggggtcagtgatggagctgcttcagggtgtggatggcgtcataaaaaggacggagaacgtgaccttgaagaagccagaaacttttccaaaaaatcaaaggagagtgtttcgagctcctgatctgaaaggaatgctagaagtgtttagagagctgacagatgtccgacgctactggggtaaggagaagtcacattatcataagccaccctgcggcttatcattattattatctttatcttttagaattttatgttctctattaggctcatgttttaagatttatgattctccttccaagacacacataacttacccctccttataacttctaaacaaggttcctcccagttttctctcaagtctttatcaagatttctctcatatcacaaataaagttacattatatcccttagctgacctgttaatttttctacagttgatgtgacagtggctccaaacaacatttcatgtgctgtcatttctgaagataagagacaagtgagctctccgaaaccacagataatatatggggcacgagggacaagataccagacatttgtgaatttcaattattgtactggcatcctgggctctcaaagtatcacatcagggaaacattactgggaggtagacgtgtccaagaaaactgcttggatcctgggggtatgtgctggcttccaacctgatgcaatgtgtaatattgaaaaaaatgaaaattatcaacctaaatacggctactgggttatagggttagaggaaggagttaaatgtagtgctttccaggatagttccttccatactccttctgttcctttcattgtgcccctctctgtgattatttgtcctgatcgtgttggagttttcctagactatgaggcttgcactgtctcattcttcaatatcacaaaccatggatttctcatctataagttttctcactgttctttttctcagcctgtatttccatatttaaatcctagaaaatgtggagtccccatgactctgtgctcaccaagctcttgaaccttcttacacactcagccccttctgtacagcacctcttgtccaggtgcatctcatacacctgaactcatttgcatcattttaaccatcttttccttgctgtctcccttctttctatttgaacgtccttcactcatcagtaaaatgtaataattgccttgtgccatattgtccccaatattttattgacatttgatagcaatttttttcatcattttccgtactcctaaggaaaactgacctatacctcataaaatgagaccgctatttaggtattacttctgccagatatttatcacccaattgcctctgacactgactaagaagatgaagaaaagcttttcaacagcctttctatatcatcgtgtgataattgttcaccaatgaatgagtccttagccctgtgtcagtttaccctcgatgcccttatttgtgagttaaagagaaaatatcataaatggtatactcttaagtatagaggttttgtatctagaggatctcagttcaactcctgtctctccatataccagcagtgtaactgtgaataacatacttaaatggctgtgcttatttccttttcttttcttttttctttttttttttttttgagatgaagttttgctcttgttccccaggctggagtgcaatggcacgatctcggttcactgcaacctccacctctcagattcaagcaattctcctgcctcagcctcccaagtagctgggattacaggtgcccaccaccacccctggctaaatttgtattttcagtagagacggggtttccccatgttggttaggctcgtctagaacctctgacctcaggtgatccacccgcctcggcctcccaaagtgctgggattacaggcgtgagccacggcgcccagcctgtgcttattttcttaaaataatttttgtattaaaaacttcacattaaataagtgctaatgttttattgcatagtagggtgactagagttaacaataacctattgcatatattttgaaatagctagaagagaggattttgaaagttctcaacacaaagaaatgacacatatttgaggtgatggatatgctaattaccctggttcggttattacgcaatgtatacatgtatcaaaacatcacactgtaccacataaatatgtatatttattatttgtcaattaaaagcaaaataaaacaaaaaa

SEQ ID NO: 195090 - DNA, 1054 bp, Homo sapiens
  Payload ID: 18515
  Gene Name: tripartite motif containing 5
  ENST ID: ENST00000412903
  CDS Start-End: 427-1054
tccgttctgctggaacacaaacgcgcttctcagtttctctggaggaacttggttggcgaagagcttggcgcttcttgtaaaccttgtcccgctggacaaagacttgtgaaggaacacggagtgccaccaggactccgtggccctccccgcctctctctcctttttcccttcatggcggtgaagctgtggacgcttctcttcaggaggtgagctccagatgagacgccacatcccagcggagtcccggaagggtcaccccgcaggtctaaggcccgcctgttctgtgccgtgacctgtgctaccgaagtcatctgttgctgtagggaggccagggactcagccgatgcctcaatggccaactgcagggatctgtgaacaagaggaacctcagcagccaggacaggcaggagcagtggaatagctactatggcttctggaatcctggttaatgtaaaggaggaggtgacctgccccatctgcctggaactcctgacacaacccctgagcctggactgcggccacagcttctgccaagcatgcctcactgcaaaccacaagaagtccatgctagacaaaggagagagtagctgccctgtgtgccggatcagttaccagcctgagaacatacggcctaatcggcatgtagccaacatagtggagaagctcagggaggtcaagttgagcccagaggggcagaaagttgatcattgtgcacgccatggagagaaacttctactcttctgtcaggaggacgggaaggtcatttgctggctttgtgagcggtctcaggagcaccgtggtcaccacacgttcctcacagaggaggttgcccgggagtaccaagtgaagctccaggcagctctggagatgctgaggcagaagcagcaggaagctgaagagttagaagctgacatcagagaagagaaagcttcctggaagactcaaatacagtatgacaaaaccaacgtcttggcagattttgagcaactgagagacatcctggactgggaggagagcaatgagctgcaaaacctggagaaggaggaggaagaca

SEQ ID NO: 195091 - DNA, 607 bp, Homo sapiens
  Payload ID: 18515
  Gene Name: tripartite motif containing 5
  ENST ID: ENST00000419850
  CDS Start-End: 392-607
cctttgtgcagatcaggcccgtggattggtgagtgaatcctaaccacgtcttccctggcctgtcttcactcttctccccagaatcaccacttctgcactggtgtctgaaggtgtattgagtgattttgtggagggcagaagtaggaagtctttgggacaaaactgtatttaccttgaatgaagccgcggacgcttgcagtgagtgttacagttcttaaaggcggcatgtccggagtttcttccttctgatgttcggatgtgttcagagtttcttctttctggtgggttcgtggtctcgctggctcaggagggaagctgcagaccttcgcgggatctgtgaacaagaggaacctcagcagccaggacaggcaggagcagtggaatagctactatggcttctggaatcctggttaatgtaaaggaggaggtgacctgccccatctgcctggaactcctgacacaacccctgagcctggactgcggccacagcttctgccaagcatgcctcactgcaaaccacaagaagtccatgctagacaaaggagagagtagctgccctgtgtgccggatcagttaccagcctgagaacatacggcctaatcggcat

SEQ ID NO: 195092 - DNA, 2759 bp, Homo sapiens
  Payload ID: 18515
  Gene Name: tripartite motif containing 5
  Uniprot ID: Q9C035
  ENST ID: ENST00000433961
  CDS Start-End: 56-871
gtgaacaagaggaacctcagcagccaggacaggcaggagcagtggaatagctactatggcttctggaatcctggttaatgtaaaggaggaggtgacctgccccatctgcctggaactcctgacacaacccctgagcctggactgcggccacagcttctgccaagcatgcctcactgcaaaccacaagaagtccatgctagacaaaggagagagtagctgccctgtgtgccggatcagttaccagcctgagaacatacggcctaatcggcatgtagccaacatagtggagaagctcagggaggtcaagttgagcccagaggggcagaaagttgatcattgtgcacgccatggagagaaacttctactcttctgtcaggaggacgggaaggtcatttgctggctttgtgagcggtctcaggagcaccgtggtcaccacacgttcctcacagaggaggttgcccgggagtaccaagtgaagctccaggcagctctggagatgctgaggcagaagcagcaggaagctgaagagttagaagctgacatcagagaagagaaagcttcctggaagactcaaatacagtatgacaaaaccaacgtcttggcagattttgagcaactgagagacatcctggactgggaggagagcaatgagctgcaaaacctggagaaggaggaggaagacattctgaaaagccttacgaactctgaaactgagatggtgcagcagacccagtccctgagagagctcatctcagatctggagcatcggctgcaggggtcagtgatggagctgcttcaggacggagaacgtgaccttgaagaagccagaaacttttccaaaaaatcaaaggagagtgtttcgagctcctgatctgaaaggaatgctagaagtgtttagagagctgacagatgtccgacgctactgggttgatgtgacagtggctccaaacaacatttcatgtgctgtcatttctgaagataagagacaagtgagctctccgaaaccacagataatatatggggcacgagggacaagataccagacatttgtgaatttcaattattgtactggcatcctgggctctcaaagtatcacatcagggaaacattactgggaggtagacgtgtccaagaaaactgcttggatcctgggggtatgtgctggcttccaacctgatgcaatgtgtaatattgaaaaaaatgaaaattatcaacctaaatacggctactgggttatagggttagaggaaggagttaaatgtagtgctttccaggatagttccttccatactccttctgttcctttcattgtgcccctctctgtgattatttgtcctgatcgtgttggagttttcctagactatgaggcttgcactgtctcattcttcaatatcacaaaccatggatttctcatctataagttttctcactgttctttttctcagcctgtatttccatatttaaatcctagaaaatgtggagtccccatgactctgtgctcaccaagctcttgaaccttcttacacactcagccccttctgtacagcacctcttgtccaggtgcatctcatacacctgaactcatttgcatcattttaaccatcttttccttgctgtctcccttctttctatttgaacgtccttcactcatcagtaaaatgtaataattgccttgtgccatattgtccccaatattttattgacatttgatagcaatttttttcatcattttccgtactcctaaggaaaactgacctatacctcataaaatgagaccgctatttaggtattacttctgccagatatttatcacccaattgcctctgacactgactaagaagatgaagaaaagcttttcaacagcctttctatatcatcgtgtgataattgttcaccaatgaatgagtccttagccctgtgtcagtttaccctcgatgcccttatttgtgagttaaagagaaaatatcataaatggtatactcttaagtatagaggttttgtatctagaggatctcagttcaactcctgtctctccatataccagcagtgtaactgtgaataacatacttaaatggctgtgcttatttccttttcttttcttttttctttttttttttttttgagatgaagttttgctcttgttccccaggctggagtgcaatggcacgatctcggttcactgcaacctccacctctcagattcaagcaattctcctgcctcagcctcccaagtagctgggattacaggtgcccaccaccacccctggctaaatttgtattttcagtagagacggggtttccccatgttggttaggctcgtctagaacctctgacctcaggtgatccacccgcctcggcctcccaaagtgctgggattacaggcgtgagccacggcgcccagcctgtgcttattttcttaaaataatttttgtattaaaaacttcacattaaataagtgctaatgttttattgcatagtagggtgactagagttaacaataacctattgcatatattttgaaatagctagaagagaggattttgaaagttctcaacacaaagaaatgacacatatttgaggtgatggatatgctaattaccctggttcggttattacgcaatgtatacatgtatcaaaacatcacactgtaccacataaatatgtatatttattatttgtcaattaaaagcaaaataaaacaaaaaaccttcatctaatactttggatcattgtgaaaaaataaattcctgaagtataaa

SEQ ID NO: 195093 - DNA, 767 bp, Homo sapiens
  Payload ID: 18515
  Gene Name: tripartite motif containing 5
  ENST ID: ENST00000438025
  CDS Start-End: 1-563
gtggtcaccacacgttcctcacagaggaggttgcccgggagtaccaagtgaagctccaggcagctctggagatgctgaggcagaagcagcaggaagctgaagagttagaagctgacatcagagaagagaaagcttcctggaagactcaaatacagtatgacaaaaccaacgtcttggcagattttgagcaactgagagacatcctggactgggaggagagcaatgagctgcaaaacctggagaaggaggaggaagacattctgaaaagccttacgaactctgaaactgagatggtgcagcagacccagtccctgagagagctcatctcagatctggagcatcggctgcaggggtcagtgatggagctgcttcagggtgtggatggcgtcataaaaagagctgacagatgtccgacgctactggggctggagtgcaatggcacgatctcggttcactgcaacctccacctctcagattcaagcaattctcctgcctcagcctcccaagtagctgggattacaggtgcccaccaccacccctggctaaatttgtattttcagtagagacggggtttccccatgttggttaggctcgtctagaacctctgacctcaggtgatccacccgcctcggcctcccaaagtgctgggattacaggcgtgagccacggcgcccagcctgtgcttattttcttaaaataatttttgtattaaaaacttcacattaaataagtgctaatgttttattgcatagtagggtgactagagt

SEQ ID NO: 195094 - DNA, 2047 bp, Homo sapiens
  Payload ID: 18516
  Gene Name: tripartite motif containing 50
  Uniprot ID: Q86XT4
  ENST ID: ENST00000333149
  CDS Start-End: 202-1665
agagcatgatggggcacgcgcggtagcgcgaggcggggcatgtaaccatagcgtgcgggtcatgatgaggcacggacgtggggggttaggtggggcacgtaattggagctcgcggggcaggatggggcatctaactggagcgacagagagcacgatggggcacttacaggggccggaggctggcccgggcagtgagtgtggatggcttggcaggtgagcctgccagagctggaggaccggcttcagtgtcccatctgcctggaggtcttcaaggagcccctgatgctgcagtgtggccactcttactgcaagggctgcctggtttccctgtcctgccacctggatgccgagctgcgctgccccgtgtgccggcaggcggtggacggcagcagctccctgcccaacgtctccctggccagggtgatcgaagccctgaggctccctggggacccggagcccaaggtctgcgtgcaccaccggaacccgctcagccttttctgcgagaaggaccaggagctcatctgtggcctctgcggtctgctgggctcccaccaacaccacccggtcacgcccgtctccaccgtctacagccgcatgaaggaggagctcgcagccctcatctctgagctgaagcaggagcagaaaaaggtggatgagctcatcgccaaactggtgaacaaccggacccgaatcgtcaatgagtcggatgtcttcagctgggtgatccgccgcgagttccaggagctgcaccacctggtggatgaggagaaggcccgctgcctggaggggatagggggtcacacccgtggcctggtggcctccctggacatgcagctggagcaggcccagggaacccgggagcggctggcccaagccgagtgtgtgctggaacagttcggcaatgaggaccaccacaagttcatccggaagttccactccatggcctccagagcagagatgccgcaggcccggcccttagaaggcgcattcagccccatctccttcaagccaggcctccaccaggctgacatcaagctgaccgtgtggaaaaggctcttccggaaagttttgccagccccggagcctctcaagttggaccctgccactgcccacccactcctggagctctccaagggcaacacggtggtgcagtgcgggcttctggcccagcggcgagccagccagcctgagcgcttcgactacagcacctgcgtcctggccagccgcggcttctcctgcggccgccactactgggaggtggtggtgggcagcaagagcgactggcgcctgggggtcatcaagggcacagccagccgtaagggcaagctgaacaggtcccccgagcacggcgtgtggctgatcggcctgaaggagggccgggtgtacgaagcctttgcctgcccccgggtacccctgcccgtggccggccacccccaccgcatcgggctctacctgcactatgagcagggcgaactcaccttcttcgatgccgaccgccccgatgacctgcggccgctctacaccttccaggccgacttccagggcaagctctaccccatcctggacacctgctggcacgagaggggcagcaactcgctgcccatggtgctgcccccgcccagcgggcctggccccctcagccccgagcagcccaccaagctgtagggccgcccggagtcctgccggcccacaggcccatcccggcggggcaccggggactcgcgggcttctgctgggtcccgcctgaggtgatatcgtcactgtttaggaaggtcttcaggcctgtgtgtccctggaacatgtaatgatagggaacaggaccccagtccctttcccctcagccaagggtgtatttgtaaacttcggcccccaggccttggcagccagggacacactgaaatccccatggttcctgccacttgctaaccatgctatctgcgcagacgcttccgagggcagaaatagtcccatgtataccttttccatattactgtgaactttcaactactatcaaggataataaatttgacattatttctttctcttt

SEQ ID NO: 195095 - DNA, 1599 bp, Homo sapiens
  Payload ID: 18516
  Gene Name: tripartite motif containing 50
  Uniprot ID: Q86XT4
  ENST ID: ENST00000453152
  CDS Start-End: 126-1589
tttcccacttctgactctgtgcctgctgttccctgctgggaagaaggaaagccagtgatgctggcttgaggctgtagtgggaggcccagcggattgtgagaagccagcccgggcagtgagtgtggatggcttggcaggtgagcctgccagagctggaggaccggcttcagtgtcccatctgcctggaggtcttcaaggagcccctgatgctgcagtgtggccactcttactgcaagggctgcctggtttccctgtcctgccacctggatgccgagctgcgctgccccgtgtgccggcaggcggtggacggcagcagctccctgcccaacgtctccctggccagggtgatcgaagccctgaggctccctggggacccggagcccaaggtctgcgtgcaccaccggaacccgctcagccttttctgcgagaaggaccaggagctcatctgtggcctctgcggtctgctgggctcccaccaacaccacccggtcacgcccgtctccaccgtctacagccgcatgaaggaggagctcgcagccctcatctctgagctgaagcaggagcagaaaaaggtggatgagctcatcgccaaactggtgaacaaccggacccgaatcgtcaatgagtcggatgtcttcagctgggtgatccgccgcgagttccaggagctgcaccacctggtggatgaggagaaggcccgctgcctggaggggatagggggtcacacccgtggcctggtggcctccctggacatgcagctggagcaggcccagggaacccgggagcggctggcccaagccgagtgtgtgctggaacagttcggcaatgaggaccaccacaagttcatccggaagttccactccatggcctccagagcagagatgccgcaggcccggcccttagaaggcgcattcagccccatctccttcaagccaggcctccaccaggctgacatcaagctgaccgtgtggaaaaggctcttccggaaagttttgccagccccggagcctctcaagttggaccctgccactgcccacccactcctggagctctccaagggcaacacggtggtgcagtgcgggcttctggcccagcggcgagccagccagcctgagcgcttcgactacagcacctgcgtcctggccagccgcggcttctcctgcggccgccactactgggaggtggtggtgggcagcaagagcgactggcgcctgggggtcatcaagggcacagccagccgtaagggcaagctgaacaggtcccccgagcacggcgtgtggctgatcggcctgaaggagggccgggtgtacgaagcctttgcctgcccccgggtacccctgcccgtggccggccacccccaccgcatcgggctctacctgcactatgagcagggcgaactcaccttcttcgatgccgaccgccccgatgacctgcggccgctctacaccttccaggccgacttccagggcaagctctaccccatcctggacacctgctggcacgagaggggcagcaactcgctgcccatggtgctgcccccgcccagcgggcctggccccctcagccccgagcagcccaccaagctgtagggccgcccgg

SEQ ID NO: 195096 - DNA, 3466 bp, Homo sapiens
  Payload ID: 18517
  Gene Name: tripartite motif containing 52
  Uniprot ID: Q96A61
  ENST ID: ENST00000611618
  CDS Start-End: 306-1199
gctgcatctgaggcggacgccgcagtgtagggcacaccctgagggtagcgagagacgtgacaggaccgagcagctgggggctgcagcctgctctgtccccaccgatcccagagagaggctgtgagtctggatctgggcgttcgcaccctgagagagggggtcaaagctcccctgcggccccgaggaagaagagcaaggttgaggacagcctcgggtcaccagagtagtttggaggcaggcctgcaggcgcgtccccgctcctcagctccaagctgacgtatctacacctgccggcgggcattaagatggctggttatgccactactcccagccccatgcagacccttcaggaggaagcggtgtgtgccatctgcttggattacttcaaggaccccgtgtccatcagctgtgggcacaacttctgccgagggtgtgtgacccagctgtggagtaaggaggacgaggaggaccagaacgaggaggaagatgaatgggaggaggaggaggacgaggaagcggtgggggccatggatggatgggacggctccattcgagaggtgttgtatcgggggaatgctgacgaagagttgttccaagaccaagatgacgatgaactctggctcggtgacagtggtataactaattgggacaacgtagactatatgtgggacgaggaggaagaagaagaagaggaagatcaggactattacctaggaggcttgagacctgacctgagaattgatgtctaccgagaagaagaaatactggaagcatacgatgaggacgaagatgaagagctgtatcctgacatccacccgcctccttccttgccccttccagggcagttcacctgcccccagtgccgaaagagctttacacgtcgcagctttcgtcccaacttgcagctggccaacatggtccagataattcgccagatgtgccccactccttatcggggaaaccggagtaatgatcagggcatgtgctttaaacaccaggaagccctgaaactcttctgtgaggtggacaaagaggccatctgtgtggtgtgccgagaatccaggagccacaaacagcacagcgtgctgcctttggaggaggtggtgcaggagtaccaggaaataaagttggaaacaactctggtgggaatacttcagatagagcaagaaagcattcacagcaaggcctataatcagtaagatgtgtgaaaagttgggtagccacaggaggtgttcattaaggatatgattccatttatatagctatttctattgcataaccaggacagttttattgttttgaggtcaatgttcttttaaaatttgattttctgtaagaagaggctttttggcccagaaagccttacttattttacatcttccagtttgtccatcccatgagttagagttcgtcttgactctgcaagctagaatcaaagaattatgaaagtaagatcatttagatttgaccaagggcaccattaaatggtgtcaggttttaggaagcagacgggtgtataaaaagaaaatgaacaaagatttcacttattggggatcaggcataactggatgcctggattgtcctgccacccagctgccaccaataaaatcattcatcactctgcaagagggaccagatgcttccatcatcagtactccttgtttttctgttatctcctttgaggtagctaaaaatggcagccaaaaaaaaatgttgaggcttttctcaagtatatactcatgttattttgcagaagatagggtcaacttcttcagttgagttatctgaaagtgttgggcagtgacaccatgccaaacactgttaaattcatgccattaaaaacagtggagtgttctgcaaagcccgattctctgcagctttaagactggacagtattgaaatattcacaggaatcttccaagccgtgaaagcttaatattaaacagcccttttaattgcaaaggagaaaaaaatggagacacttgtgaaaccttgcattctgagtgctgccacaaataaattaaggaattccagaatttcttcatctacttctgcagtcttaactctgaattaatgactgtatatatcaaacttcagatcttaaaaaacatcagctcgcaagaggctgaggcaggagaatgacatgaacctgggaggcggagcttgcagtaagccgagactgagccactgcactccagcctgggcaatagagcaagactccatctcaaaaaaaaaaaaaaatcggctcatcttttattgctgttggttgagatgaatctactgatgaagaaaactgtactttgcttacattcagaataaggctttcaaaactgtgggtgtgctgttttcgtgagccttctacttgaccaccaaagacagtatttttgcagctgtatcaaatgaaccgagttggaggaaattgtataggagtatatcttaatggcactacagcaaactgtgttaaatttgggtttttggcaaagattgaagaaaactggtattcaagatgtactgcagctgtcaccaccaagcatgaactttcactgattacccataacctactggaaatcttcagccttgctgtcagcatagaccactgtgagaaacagtacattccattccagtttgccctgctttttgaagatctaaatgccattccatgttttctgttacatattgaagtttcttggttgccaaagaaaaacggattctgctgaacttgtggacagaacaaccccaaggttggaagaacaatgaaaaataatctatacttgaacatttcaaaagttaaaattttcaacagagttttaacacactgaagcttaaaatacattgacactgaaatgtcaatgggcaaacaccaatttcgccgttcattatgaaatacatcaaacaaaacttgccaaaaatacaaccataaaaatatagcaaatgtatgtatgagcaaactaatgctaaaaatgtctaattttcttggctagtctttcaaggaccagattcatgagtgttatttgaagggaaaaagtgaaatacttggaattattttgagtgatgtgctcctgagcttgttcttaaaatctaccagtggtagcttttggaaagaatgtgtttcataccgatgtgcaggcctcactggaagagcttcaagaggagtttgtgaaactcaaagtctaatggttttgattagaaacttccaggcaaatactccagagaaacttgggtgtaaaatgactaaacagatgaaaaggctttatccactattccatttgctccttacaccttaaaaagcttttttattttttaatgttttgatatatctagctttggggagaaagcagtgcaagagtgttattaaaagcagcttgtgttttcttgcacctttcacaccacccaggaaagaaaagttcaggcttaacagtgacatggctatcacatcatctgaataaattttttccttctaaaatta

SEQ ID NO: 195097 - DNA, 2027 bp, Homo sapiens
  Payload ID: 18518
  Gene Name: tripartite motif containing 54
  Uniprot ID: Q9BYV2
  ENST ID: ENST00000296098
  CDS Start-End: 271-1473
gtcatttgggaaacaaaaggagaattttacagagagagagggatagctaaaactacgtgagcctggcgagggtgcagagcagaaagtagagactgtccgaagactgctatctgggacgagacaagttgttaaagggacaggagagaaagcagagctatttcaagagtgagccacagaagggaatccagaggccatctaagcgaggaagggtctacaggcagtgagtgaaggccaggagcagggcccaggccaggcacgaccaccgaggggatgaacttcacagtgggtttcaagccgctgctaggggatgcacacagcatggacaacctggagaagcagctcatctgccccatctgcctggagatgttctccaaaccagtggtgatcctgccctgccaacacaacctgtgccgcaaatgtgccaacgacgtcttccaggcctcgaatcctctatggcagtcccggggctccaccactgtgtcttcaggaggccgtttccgctgcccatcgtgcaggcatgaggttgtcctggacagacacggtgtctacggcctgcagcgaaacctgctagtggagaacattatcgacatttacaagcaggagtcatccaggccgctgcactccaaggctgagcagcacctcatgtgcgaggagcatgaagaagagaagatcaatatttactgcctgagctgtgaggtgcccacctgctctctctgcaaggtcttcggtgcccacaaggactgtgaggtggccccactgcccaccatttacaaacgccagaagaaacaggatctcactctgttgcccaggctggagtgcagtggcacaaacacaacttactgcagccttgatctcccgagctcaagtgatcctcccatcttagcctcgcagaacactaagattatagatagtgagctcagcgatggcatcgcgatgctggtggcaggcaatgaccgcgtgcaagcagtgatcacacagatggaggaggtgtgccagactatcgaggacaatagccggaggcagaagcagttgttaaaccagaggtttgagagcctgtgcgcagtgctggaggagcgcaagggtgagctgctgcaggcgctggcccgggagcaagaggagaagctgcagcgcgtccgcggcctcatccgtcagtatggcgaccacctggaggcctcctctaagctggtggagtctgccatccagtccatggaagagccacaaatggcgctgtatctccagcaggccaaggagctgatcaataaggtcggggccatgtcgaaggtggagctggcagggcggccggagccaggctatgagagcatggagcaattcaccgtaagggtggagcacgtggccgaaatgctgcggaccatcgacttccagccaggcgcttccggggaggaagaggaggtggccccagacggagaggagggcagcgcggggccggaggaagagcggccggatgggccttaaggcctgcgccgacccgaccctgctcgagagcccgcgctagagtcggggaggatctgcgcagagaccgcagcatcacccaaatcggcgccggccccgggaggatctcaataaagaactcgagcgtcccagacccgtatctcctttcgctgcccaaccccgcagcctgggcttcgaaggcgacccgcccaccatcctgcccttcccagaacctgagaccgtctggggggcggaagccaaatgaacccctattgggcacctctgtgatgccaggagcgaactggtgagcccagcgccctgggaagagggccgagggcggggcggtggtgccgggacctctgaggtcctggggatttggggacccttggggtccacatgcacctggctgacctggctgaaagccgctgtctcggagccccccacagcattttgttcccctcccgctggcccgggggccccaccttcccacgggttcccacgctgctgtgactgccctgcctctacgacaaaagccaacgggtcttcagtacttttattaaaaaatagtcacgcagaca

SEQ ID NO: 195098 - DNA, 1967 bp, Homo sapiens
  Payload ID: 18518
  Gene Name: tripartite motif containing 54
  Uniprot ID: Q9BYV2
  ENST ID: ENST00000380075
  CDS Start-End: 341-1417
acagtaaaattaatctgctctctggggagtaagggacaaacagtgctacccacagagtgaacaagagagagtcatttgggaaacaaaaggagaattttacagagagagagggatagctaaaactacgtgagcctggcgagggtgcagagcagaaagtagagactgtccgaagactgctatctgggacgagacaagttgttaaagggacaggagagaaagcagagctatttcaagagtgagccacagaagggaatccagaggccatctaagcgaggaagggtctacaggcagtgagtgaaggccaggagcagggcccaggccaggcacgaccaccgaggggatgaacttcacagtgggtttcaagccgctgctaggggatgcacacagcatggacaacctggagaagcagctcatctgccccatctgcctggagatgttctccaaaccagtggtgatcctgccctgccaacacaacctgtgccgcaaatgtgccaacgacgtcttccaggcctcgaatcctctatggcagtcccggggctccaccactgtgtcttcaggaggccgtttccgctgcccatcgtgcaggcatgaggttgtcctggacagacacggtgtctacggcctgcagcgaaacctgctagtggagaacattatcgacatttacaagcaggagtcatccaggccgctgcactccaaggctgagcagcacctcatgtgcgaggagcatgaagaagagaagatcaatatttactgcctgagctgtgaggtgcccacctgctctctctgcaaggtcttcggtgcccacaaggactgtgaggtggccccactgcccaccatttacaaacgccagaagagtgagctcagcgatggcatcgcgatgctggtggcaggcaatgaccgcgtgcaagcagtgatcacacagatggaggaggtgtgccagactatcgaggacaatagccggaggcagaagcagttgttaaaccagaggtttgagagcctgtgcgcagtgctggaggagcgcaagggtgagctgctgcaggcgctggcccgggagcaagaggagaagctgcagcgcgtccgcggcctcatccgtcagtatggcgaccacctggaggcctcctctaagctggtggagtctgccatccagtccatggaagagccacaaatggcgctgtatctccagcaggccaaggagctgatcaataaggtcggggccatgtcgaaggtggagctggcagggcggccggagccaggctatgagagcatggagcaattcaccgtaagggtggagcacgtggccgaaatgctgcggaccatcgacttccagccaggcgcttccggggaggaagaggaggtggccccagacggagaggagggcagcgcggggccggaggaagagcggccggatgggccttaaggcctgcgccgacccgaccctgctcgagagcccgcgctagagtcggggaggatctgcgcagagaccgcagcatcacccaaatcggcgccggccccgggaggatctcaataaagaactcgagcgtcccagacccgtatctcctttcgctgcccaaccccgcagcctgggcttcgaaggcgacccgcccaccatcctgcccttcccagaacctgagaccgtctggggggcggaagccaaatgaacccctattgggcacctctgtgatgccaggagcgaactggtgagcccagcgccctgggaagagggccgagggcggggcggtggtgccgggacctctgaggtcctggggatttggggacccttggggtccacatgcacctggctgacctggctgaaagccgctgtctcggagccccccacagcattttgttcccctcccgctggcccgggggccccaccttcccacgggttcccacgctgctgtgactgccctgcctctacgacaaaagccaacgggtcttcagtacttttattaaaaaatagtcacgca

SEQ ID NO: 195099 - DNA, 1960 bp, Homo sapiens
  Payload ID: 18519
  Gene Name: tripartite motif containing 55
  Uniprot ID: Q9BYV6
  ENST ID: ENST00000276573
  CDS Start-End: 227-1849
tcctgtcactggcttatatggacacgtcagcccaccgtcacgtgaccgcaggctgctaaaaacagctccagcacccactccaaaccagggcctgaaacaatgtcctccaccgagagaaacgtaaaggacacttgatcacacaatccctggaataatatccaggaaacacttgctggagccactcgcagcacccttccctggcagcacacttggggacagcgaggagatgagcgcatctctgaattacaaatctttttccaaagagcagcagaccatggataacttagagaagcaactcatctgtcccatctgcttagagatgttcacgaaacctgtggtgattctcccttgtcagcacaacctgtgtaggaaatgtgccagtgatattttccaggcctctaacccgtatttgcccacaagaggaggtaccaccatggcatcagggggccgattccgctgcccatcctgtagacatgaagtggttttggatagacatggggtatatggacttcagaggaacctgctggtggaaaatatcattgacatctacaagcaggagtccaccaggccagaaaagaaatccgaccagcccatgtgcgaggaacatgaagaggagcgcatcaacatctactgtctgaactgcgaagtacccacctgctctctgtgcaaggtgtttggtgcacacaaagactgccaggtggctcccctcactcatgtgttccagagacagaagtctgagctcagtgatggcatcgccatcctcgtgggcagcaacgatcgagtccagggagtgatcagccagctggaagacacctgcaaaactatcgaggaatgttgcagaaaacagaaacaagagctttgtgagaagtttgattacctgtatggcattttggaggagaggaagaatgaaatgacccaagtcattacccgaacccaagaggagaaactggaacatgtccgtgctctgatcaaaaagtattctgatcatttggagaacgtctcaaagttggttgagtcaggaattcagtttatggatgagccagaaatggcagtgtttctgcagaatgccaaaaccctgctaaaaaaaatctcggaagcatcaaaggcatttcagatggagaaaatagaacatggctatgagaacatgaaccacttcacagtcaacctcaatagagaagaaaagataatacgtgaaattgacttttacagagaagatgaagatgaagaagaagaagaaggcggagaaggagaaaaagaaggagaaggagaagtgggaggagaagcagtagaagtggaagaggtagaaaatgttcaaacagagtttccaggagaagatgaaaacccagaaaaagcttcagagctctctcaggtggagctgcaggctgcccctggggcacttccagtttcctctccagagccacctccagccctgccacctgctgcggatgcccctgtgacacagggggaggttgtacccactggctctgagcagaccacagagtctgaaactccagtccctgcagcagcagaaactgcggatcccttgttttaccctagttggtataaaggccaaacccggaaagccaccaccaacccaccttgcaccccagggagcgaaggtctggggcaaatagggcctccaggttctgaggattcgaatgtacggaaggcagaagtggcagcagccgcagcgagtgagagggcagctgtgagtggtaaggaaactagtgcacctgcagctacttctcaggagttagtaatctgcctagcgcttttggcttttcttattcttcactacatctggagtcagattcagtgcttgatttttactttaatggattggatttgaggctcctcccctccagggacaggctgcagctccagcgagtggcagtggagctgattctgagccagctcgccatatcttctccttttcctggttgaactccctaaatgaatg

SEQ ID NO: 195100 - DNA, 2624 bp, Homo sapiens
  Payload ID: 18519
  Gene Name: tripartite motif containing 55
  Uniprot ID: Q9BYV6
  ENST ID: ENST00000353317
  CDS Start-End: 374-1732
tttgttgttgacaactgtcagcttcgacctccttctcctcacaaccccgtctaaatggggtttgtaatcctccttcccacccactctcttcactccctggggcaagaatgttgactcctgctctccgtcacctgtcaggatccatcctcctgtcactggcttatatggacacgtcagcccaccgtcacgtgaccgcaggctgctaaaaacagctccagcacccactccaaaccagggcctgaaacaatgtcctccaccgagagaaacgtaaaggacacttgatcacacaatccctggaataatatccaggaaacacttgctggagccactcgcagcacccttccctggcagcacacttggggacagcgaggagatgagcgcatctctgaattacaaatctttttccaaagagcagcagaccatggataacttagagaagcaactcatctgtcccatctgcttagagatgttcacgaaacctgtggtgattctcccttgtcagcacaacctgtgtaggaaatgtgccagtgatattttccaggcctctaacccgtatttgcccacaagaggaggtaccaccatggcatcagggggccgattccgctgcccatcctgtagacatgaagtggttttggatagacatggggtatatggacttcagaggaacctgctggtggaaaatatcattgacatctacaagcaggagtccaccaggccagaaaagaaatccgaccagcccatgtgcgaggaacatgaagaggagcgcatcaacatctactgtctgaactgcgaagtacccacctgctctctgtgcaaggtgtttggtgcacacaaagactgccaggtggctcccctcactcatgtgttccagagacagaagtctgagctcagtgatggcatcgccatcctcgtgggcagcaacgatcgagtccagggagtgatcagccagctggaagacacctgcaaaactatcgaggaatgttgcagaaaacagaaacaagagctttgtgagaagtttgattacctgtatggcattttggaggagaggaagaatgaaatgacccaagtcattacccgaacccaagaggagaaactggaacatgtccgtgctctgatcaaaaagtattctgatcatttggagaacgtctcaaagttggttgagtcaggaattcagtttatggatgagccagaaatggcagtgtttctgcagaatgccaaaaccctgctaaaaaaaatctcggaagcatcaaaggcatttcagatggagaaaatagaacatggctatgagaacatgaaccacttcacagtcaacctcaatagagaagaaaagataatacgtgaaattgacttttacagagaagatgaagatgaagaagaagaagaaggcggagaaggagaaaaagaaggagaaggagaagtgggaggagaagcagtagaagtggaagaggtagaaaatgttcaaacagagtttccaggagaagatgaaaacccagaaaaagcttcagagctctctcaggtggagctgcaggctgcccctggggcacttccagtttcctctccagagccacctccagccctgccacctgctgcggatgcccctgtgacacagattggatttgaggctcctcccctccagggacaggctgcagctccagcgagtggcagtggagctgattctgagccagctcgccatatcttctccttttcctggttgaactccctaaatgaatgatattcattccaactgctgcccctctgtctgcctggctgagatgcatgtgggcagcaggaagcccaagtgaaattaatattatgcagatgatgaaagggacctctgaacaggatttctgcaaaaatagccccaaactgcaattccatatgacttatctaacatcttggggggaaagaatattttgagaaaatagttgcagaaagcactggaaataataaacttgatcttatacaaatcttctattgtgtggaaaatgttgtgaagggtgtgtaggtgtggtacatgtgtatgtcactaacaagtggcaaatggtgaaaaaagtggtcactatgcttttgtctctcataggcactgactttttgttattatattatggtagctttcatttcctttactctttaacagtgcaggtggtcagtgaaaatcagtgtcaactcagaagtgactgatttatcaatacatggacaaaaagtaaatcattgaccaaagctatgaaatgtttcacaaagttttcctcttttgcataacagatgtcactggatgtacattcagaaatgttctttgaatttggtgacactttcatggtccagaaagctgaaggcctgggcatctcttgtgacatttttctaatattagttttagattttcacgtattaggcactttagttgaatcttccagcaaaagctgtctactttctcttttattcactgtggcaccaatctggtaaattgtagaacaattgcatgtgtttaaatatatatacaaacatatcacacattaaatatatatatatttaaatcatgctttgttaatatttgtcccaccataatgcctccttcagaacataagtgtaactttatatgaactcttaaataaatgatgtttttaaaa

SEQ ID NO: 195101 - DNA, 2914 bp, Homo sapiens
  Payload ID: 18519
  Gene Name: tripartite motif containing 55
  Uniprot ID: Q9BYV6
  ENST ID: ENST00000315962
  CDS Start-End: 374-2020
tttgttgttgacaactgtcagcttcgacctccttctcctcacaaccccgtctaaatggggtttgtaatcctccttcccacccactctcttcactccctggggcaagaatgttgactcctgctctccgtcacctgtcaggatccatcctcctgtcactggcttatatggacacgtcagcccaccgtcacgtgaccgcaggctgctaaaaacagctccagcacccactccaaaccagggcctgaaacaatgtcctccaccgagagaaacgtaaaggacacttgatcacacaatccctggaataatatccaggaaacacttgctggagccactcgcagcacccttccctggcagcacacttggggacagcgaggagatgagcgcatctctgaattacaaatctttttccaaagagcagcagaccatggataacttagagaagcaactcatctgtcccatctgcttagagatgttcacgaaacctgtggtgattctcccttgtcagcacaacctgtgtaggaaatgtgccagtgatattttccaggcctctaacccgtatttgcccacaagaggaggtaccaccatggcatcagggggccgattccgctgcccatcctgtagacatgaagtggttttggatagacatggggtatatggacttcagaggaacctgctggtggaaaatatcattgacatctacaagcaggagtccaccaggccagaaaagaaatccgaccagcccatgtgcgaggaacatgaagaggagcgcatcaacatctactgtctgaactgcgaagtacccacctgctctctgtgcaaggtgtttggtgcacacaaagactgccaggtggctcccctcactcatgtgttccagagacagaagtctgagctcagtgatggcatcgccatcctcgtgggcagcaacgatcgagtccagggagtgatcagccagctggaagacacctgcaaaactatcgaggaatgttgcagaaaacagaaacaagagctttgtgagaagtttgattacctgtatggcattttggaggagaggaagaatgaaatgacccaagtcattacccgaacccaagaggagaaactggaacatgtccgtgctctgatcaaaaagtattctgatcatttggagaacgtctcaaagttggttgagtcaggaattcagtttatggatgagccagaaatggcagtgtttctgcagaatgccaaaaccctgctaaaaaaaatctcggaagcatcaaaggcatttcagatggagaaaatagaacatggctatgagaacatgaaccacttcacagtcaacctcaatagagaagaaaagataatacgtgaaattgacttttacagagaagatgaagatgaagaagaagaagaaggcggagaaggagaaaaagaaggagaaggagaagtgggaggagaagcagtagaagtggaagaggtagaaaatgttcaaacagagtttccaggagaagatgaaaacccagaaaaagcttcagagctctctcaggtggagctgcaggctgcccctggggcacttccagtttcctctccagagccacctccagccctgccacctgctgcggatgcccctgtgacacagggggaggttgtacccactggctctgagcagaccacagagtctgaaactccagtccctgcagcagcagaaactgcggatcccttgttttaccctagttggtataaaggccaaacccggaaagccaccaccaacccaccttgcaccccagggagcgaaggtctggggcaaatagggcctccaggttctgaggattcgaatgtacggaaggcagaagtggcagcagccgcagcgagtgagagggcagctgtgagtggtaaggaaactagtgcacctgcagctacttctcagattggatttgaggctcctcccctccagggacaggctgcagctccagcgagtggcagtggagctgattctgagccagctcgccatatcttctccttttcctggttgaactccctaaatgaatgatattcattccaactgctgcccctctgtctgcctggctgagatgcatgtgggcagcaggaagcccaagtgaaattaatattatgcagatgatgaaagggacctctgaacaggatttctgcaaaaatagccccaaactgcaattccatatgacttatctaacatcttggggggaaagaatattttgagaaaatagttgcagaaagcactggaaataataaacttgatcttatacaaatcttctattgtgtggaaaatgttgtgaagggtgtgtaggtgtggtacatgtgtatgtcactaacaagtggcaaatggtgaaaaaagtggtcactatgcttttgtctctcataggcactgactttttgttattatattatggtagctttcatttcctttactctttaacagtgcaggtggtcagtgaaaatcagtgtcaactcagaagtgactgatttatcaatacatggacaaaaagtaaatcattgaccaaagctatgaaatgtttcacaaagttttcctcttttgcataacagatgtcactggatgtacattcagaaatgttctttgaatttggtgacactttcatggtccagaaagctgaaggcctgggcatctcttgtgacatttttctaatattagttttagattttcacgtattaggcactttagttgaatcttccagcaaaagctgtctactttctcttttattcactgtggcaccaatctggtaaattgtagaacaattgcatgtgtttaaatatatatacaaacatatcacacattaaatatatatatatttaaatcatgctttgttaatatttgtcccaccataatgcctccttcagaacataagtgtaactttatatgaactcttaaataaatgatgtttttaaaagc

SEQ ID NO: 195102 - DNA, 1177 bp, Homo sapiens
  Payload ID: 18519
  Gene Name: tripartite motif containing 55
  Uniprot ID: Q9BYV6
  ENST ID: ENST00000350034
  CDS Start-End: 227-952
tcctgtcactggcttatatggacacgtcagcccaccgtcacgtgaccgcaggctgctaaaaacagctccagcacccactccaaaccagggcctgaaacaatgtcctccaccgagagaaacgtaaaggacacttgatcacacaatccctggaataatatccaggaaacacttgctggagccactcgcagcacccttccctggcagcacacttggggacagcgaggagatgagcgcatctctgaattacaaatctttttccaaagagcagcagaccatggataacttagagaagcaactcatctgtcccatctgcttagagatgttcacgaaacctgtggtgattctcccttgtcagcacaacctgtgtaggaaatgtgccagtgatattttccaggcctctaacccgtatttgcccacaagaggaggtaccaccatggcatcagggggccgattccgctgcccatcctgtagacatgaagtggttttggatagacatggggtatatggacttcagaggaacctgctggtggaaaatatcattgacatctacaagcaggagtccaccaggccagaaaagaaatccgaccagcccatgtgcgaggaacatgaagaggagcgcatcaacatctactgtctgaactgcgaagtacccacctgctctctgtgcaaggtgtttggtgcacacaaagactgccaggtggctcccctcactcatgtgttccagagacagaagtctgagctcagtgatggcatcgccatcctcgtgggcagcaacgatcgagtccagggagtgatcagccagctggaagacacctgcaaaactatcgagattggatttgaggctcctcccctccagggacaggctgcagctccagcgagtggcagtggagctgattctgagccagctcgccatatcttctccttttcctggttgaactccctaaatgaatgatattcattccaactgctgcccctctgtctgcctggctgagatgcatgtgggcagcaggaagcccaagtgaaattaatattatgcagatgatgaaagggacctctgaacaggatttctgcaaaaatagccccaaactgcaattccatatgacttatctaacatcttggggggaaagaatattttgagaaaatagttgcagaaagcactggaaataataaacttgat

SEQ ID NO: 195103 - DNA, 10952 bp, Homo sapiens
  Payload ID: 18520
  Gene Name: tripartite motif containing 56
  Uniprot ID: Q9BRZ2
  ENST ID: ENST00000306085
  CDS Start-End: 298-2565
cctggctgggacggaagttgcaccacaagtacaattagtttcagttttgtttcttttccaggcacccagcaacggcggcctccaggcctcaggccccctcaccatcctagaggtcaagatcagctctggctagttctcacaggtctgacccaacaagtagcactgacatttttacgtttgctggatgtacacacggaagtggaggaggaggaggagaaggaggagggcagctccttagctcaagagcaagtggcccaaggcctcagaagactagaaggaagttcctggccattcagcatggtttcccacgggtcctcgccctccctcctggaggccctgagcagcgacttcctggcctgtaaaatctgcctggagcagctgcgggcacccaagacactgccctgcctgcatacctactgccaagactgcctggcacagctggcggatggcggccgcgtccgctgccccgagtgccgcgagacagtgcctgtgccgcccgagggtgtggcctccttcaagaccaacttcttcgtcaatgggctgctggacctggtgaaggcccgggcctgtggagacctgcgtgccgggaagccagcctgtgccctgtgtcccctggtgggtggcaccagcaccggggggccggccacggcccggtgcctggactgtgccgatgacttgtgccaggcctgtgccgacgggcaccgctgcacccgccagacccacacccaccgcgtggtggacctggtgggctacagggccgggtggtatgatgaggaggcccgggagcgccaagcggcccagtgtccccagcaccccggggaggcactgcgcttcctgtgccagccctgctcacagttgctgtgcagagagtgccgcctagacccccacctggaccacccctgcctgcctctggctgaagctgtgcgtgcccggaggccgggcctggagggactgctggccggtgtggacaataacctggtggagctggaggcagcgcggagggtggagaaggaggcgctagcccggctgcgggagcaggcggcccgggtggggactcaggtggaggaggcggctgagggcgtcctccgggccctgctggcccagaagcaggaggtgctggggcagctacgagcccacgtggaggctgccgaagaagctgctcgggagaggctggcggagcttgagggccgggagcaggtggccagggccgcagccgccttcgcccgccgggtactcagcctggggcgagaggccgagatcctctccctggaaggggcgatcgcacagcggctcaggcagctgcagggctgcccctgggcaccaggcccggccccctgcctgctcccacagctggagctccatcctgggctcctggacaagaactgccaccttcttcggctgtcctttgaggagcagcagccccagaaggatggtgggaaagacggagctggtacccagggaggtgaggagagccagagccggagggaggatgagccgaagactgagagacagggtggagtccagccccaggctggagatggagcccagaccccaaaagaggaaaaagcccagacaacccgagaagagggagcccagaccttggaggaggacagggcccagacaccccacgaggatggaggaccccagccccacaggggtggcagacccaacaagaagaaaaagttcaaaggcaggctcaagtcaatttcccgggagcccagcccagccctggggccgaatctggacggctctggcctcctccccagacccatcttttactgcagtttccccacgcggatgcctggagacaagcggtccccccggatcaccgggctctgtcccttcggtccccgggagatcctggtggcggatgagcagaaccgggcactgaaacgcttctccctcaacggcgactacaagggcaccgtgccggtccctgagggctgctccccttgcagcgtggccgccctgcagagcgcggtggccttctccgctagcgcacggctctatctcatcaaccccaacggcgaagtgcagtggcgcagggccctgagcctctcccaggccagccacgcggtggcggcactgcctagcggggaccgcgtggctgtcagcgtggcgggccacgtggaggtgtacaatatggaaggcagcctggccacccggttcattcctggaggcaaggccagccggggcctgcgggcgctggtgtttctgaccaccagcccccaggggcatttcgtggggtcggactggcagcagaatagtgtggtaatctgtgatgggctgggccaggtggttggggagtacaaggggccaggcctgcatggctgccagccgggctccgtgtctgtggataagaagggctacatctttctgacccttcgagaagtcaacaaggtggtgatcctggacccgaaggggtccctccttggagacttcctgacagcctaccacggcctggaaaagccccgggttaccaccatggtggatggcaggtacctggtcgtgtccctcagtaacgggaccatccacatctttcgggtccgttctccggacagttaaaggggctaggactagggtgagagggagtggggagggagagggcaggaaggaggcagagctgtccgtgggaggtggaggccgaggacattttcctgaagggcaggggttggcaacttttcaacatggagtgccaaactgctaacccgtcttctagtgtgtgagaatagggaccaaggtggtggcgtgaccttaactctcagaagcagaggaggcaggtgggtggagggggatgctgggagttcacctgcctcttgctttttgtgggtggctgctgccaccaccgccgctgctatatagtttaggtttctgaggtttgtgagcctgtcctgctttgcattcttcaaaaccattcctgatagagtagccgagggagagtcttggggccaagaagggcccagggtgggtcaggcgtgtgcactgtggaacagagctgagaccccggccccccttggactggcacagggtcctacagagtcagaggaggcctgagatttcgaatgggcagtgaatggcctcttctgccagccacaggcaggatgctccttgatcacggcatcccccggcggtagtacagggtgagcttgcaggagggtctgcaagtgcagacagcagctggggccaaagaggtgttaggttcaaaggctgcgaagagaataggctactggaaaaccaaacccaacagaattcacgtccaaaaatccacattctccatcgcttctcagccttttggctaagattaagtattaaaaaaaaaccaggctctgccaggcgcagtggctcatgcctataatcccggcactttgggagtctgtggcaggaggattgcttgaggccaggagtttgagaccagcctgggcaacatagcgagaccccatctctacaaaagattaaaaattagctgcgtgtagtagcatatgcctttcaacgtagctactcaggaggctgaggtgggaggatcccttgagccgaggagtttgagtctgcagtgagctatgatcgcaccactgcattccagaccccatctcgaaaaaaaaaaaaaaaaaaaaaaacagaaacaacagaaaaagcaggttatccatcacttctcagctaagatcaagtgttaaaataaataaataaataaataaataaataaataaataaataccaagttatgagtgtcagagcaggggagccctccacgcagccacggagccagtctgagggaagaggtacataggatagaaaaatctctaggctccaacgcttctgcttcggtgtctttccatttcccagggtctatgtgttgccttctcttcattttccagcaaaattccttttgagatatgttggccttcactcggctgaactagggggtgaaggaaggttgtcctctgtgggccactattgctggggaaacagctaaaccctgcaggccaagtggaacttggaggtgccaagaaaacctagaaggtgcaatggggctgcgacggatagaggtgtcaaaccagaagggaggaacccgtcggaggtgggctgtgaccaccggaccttttcataagtggtggcagtggtagaattgagggggcaagtaggcttggagaatgtttttagccaggggctgttgagagatggcagaagggggtcttaatgtggggactgtggacagtggggcattcgtgggaaccagagggattttggacaagtccagatggaatgtgcagggcataggtagagggaaaagaaaatccctttctgggaaaaccatttcttgtttattgaaacaatgcaggacatcatcaaagtccgggtggacacattccattatctacaaattacaaaggtaggcacagcaaagaataatgaagattataagaaaaccaagcgccaggcacggtgactcaagcctgtaatcccagcactctgggaggctggggtgggtggatcactcaaggtcaggagttcgagaccagcctggccaacatggagaaaccccatctctactaaaaatacaaaaattagctaggcgtgggagcgggcgtctgtaatcccagctacttgggaggctgaggcaggagaatcatttgaacccaggaggtggaagttgcagtgagctcagatcgcaccattgcactccagcctgggtaacaagaatgaaactccatctcaaaaaaaaagaaaaagaaaagaaagaaaaccaaggtccctctccctctccctctccccacggtctccctctgcctctctttccatggtcacggtctccctctgatgccgagccgaagctggactgtactgctgccatctcggctcactgcaacctccctgcctgattctcctgcctcagcctgccgagtgcctgcgattgcaggcgcgcgccgccacgcctgactggttttcgtatttttttggtggagacggggtttcactgtgttggccgggctggtctccagctcctaaccgcgagtgatccgccagcctcggcctccggaggtgccgggattgcagacggagtctcgttcactcggtgctcaatgttgcccaggctggagtgcagtgtcgtgatctcggctagctacaacctccacctcccagccgcccgccttggcctcccaaagtgccgagattacagcctctgcccggccgccaccccctctgggaagtgcggagtgtctctgcctggccgcccattgtctgggatgtgaggagcccctctgcccggctgcccagtctgggaagtgaggagcgcctcttcctggccgccatcccatctaggaagtgaggagtgtctctgcccggctgcccatcatctgagatgtggggagcacctcagccccgccgccccgtctgggatgtgaggagcgcctctgcccggccgcgacccagtctgggaggtgaggagcgtctctgcccagccgccccgtctgagaagtgaggagcccctccgcctggcagccgccccgtctgagaagtgaggagcccctccgcccggcagccgccccgtccgggagggaggtggggggtcagccccctcccggccagccgcgccgtccgggagggaggtggggggtcagcccccgcccggccagccgcgccttccgggagggaggtgggggatcagtccccgcccggccagccgccccgcccgggagcgaggtggggggcgcctccgcccggccgctgtcccgtccgggaggtggggggtcgcctctgcccggccgccccgtctgggaggtgaggagcccctctgcccggccaccaccccgtctgggaggtgtacccaacagctcattgagaacgggccatgatgacgatggcggttttgtggaatagaaaagggggaaaggtggggaaaagatagagaaatcagattgttgccgtgtctgtgtagaaagaagtagacatgggagacttcattttgttctgtactaagaaaaattcttctgccttgggatgctgttaatctaagaccttacccccaaccccgtgctctctgaaatatgtgctgtgtccactcagggttaaatggattaagggcggtgcaagatgtgctttgttaaacagatgcttgaaggcagcatgctccttaagagtcatcaccactccctaatctcaagtacccagggacacaaacactgcggaaggccgcagggtcgtctgcctaggaaaaccagagacctttgttcacttgtttatctgctgaccttccctccactattgtcctatgaccctgccaaatccccctctgcgagaaacacccaagaatgatcaataaaaaattaaaaaaaaaaaaaaaaaaagaaaaccaagaagatgggaaaaccatgcagaattgatttgacgaggaaagccttggtctctaatacatgcaatgactagaacagtatttggtcaaagaaccacataagctctgtaccctggaggaaatgtatgcaggcaaggactagtaaaataaaaaataataataattaaaaaaaaaaaaaagaaaggctggacgcggtggctcacacctgtaatcccagcactttgggaggctgaggtgggtggatcacctgaggtcaggagtttgagaccagcctggccactacggtgaaaccccatctctactaaaaatacaaaaattacccgggtgtggtggcgcatgcctgtaatcccagctactggggagtctgaggcaggagactcgcttgaacctgggaggcagagggtgcagcgagccgagttcaccccattgcactccagcctgggtgtcacagtgagactctgtctcaaaaaaataataaataaataattaaatccacttgcagtggtcaaaaataaatgttaaataaatgggtgagaaatcttgcggagaaatagactcctggcactataaaaatgatcctggagaataatttggctagactttgcaagaatgacaaaaatgattataagaatcagttgtctcactttggggaatacattctgggaaaataatgtaagagaaaaaatatttgcatacagacatttgaggctgctctgtatattacaggcaagaactggaaactgttcggctgcagggtgacagctaactagattgtggtttattaggggaatgagcctttctttgtgtatgacaactatgaaaactattgagaagaaatagttacgtgatacagtcataatcctcaaaaacggagaatcaggaattatgatcaaatagtgatagtaacaaggaaaacatctgtctaaataattactgagtagaaataggttcggaatttgtaaatagtcattaatttgggagattggggttttttttgttttgttttttgtttgtttttcattattttgtgctattattcatacgtgtacatttctacttcagtttttattatccattacataacatacatgcttgattatttgcttcaaggaaatacacctttataagtaatactcaataactactgggtttgagaatgaaggtgtcagaacgaatgagattgtcctatgaaagaagaggcaggagccagggaggaggatcccacccggccggggctcagccaggaggcagggccattggggcagggtggcagtccaaggaaccgctctgggaaggtttgcaaaggtcggggtcccccctgccaggtgatcgaattatcgtggagtgtctggaaggcgggggaagttttgttgagttcaccaaataactcagaccaactggaaaccaagtggagtttctacaggaccaactagaatagggatcagctacatgggggcggggggaggggggcagggaacggtgtctgtcttcattgcagctctgtctgcagagccagcactgtgatacctcatagtaggtgctcagtgaatgtctgtgaagtgaattactatctagacaaggatgagactggtatgactctccaaagctttcccacctccaaaacctcggcttgtggggaatctccagtagggggcactgtggacacggttcgcatctgcctcccaaggctgggctccgcgtcaaaaaaaaaaaaaaaaaatgagactgagccaggtgcagtggtcactcctgttatctcagcactttgcgtggccaaggcgggaggatgtcttgaggccaggagttcaagactaggctgggcaacatagcaagaccccatctctacaaaaaaatttttaaattagccagaggtggtggcatgcacccgtagtcccagctgctcgggaggctgaggcagaagattgctcgagcccaggagttcaaggctgcagtgagctctgattgtgccactgcactccagcctgagtgacagagcaaaacctggtttcctaagggggggataaaagagggagagatgagatcggggtgtcccgcttctgtgcatgtggagggggtaactgggaaccgtgtactgtaggggatcgcacaccttggggtggaaacagcagctctccggagttgcatgggagccatgggcagtggtcctggctggtgaaatgattctagccacgtggcccacccagggggcaaaacaatagaaaccttcagaaatgaaacgtcacctggctgcaagaagatagtcccacaggcgccctagagatggggatgccaagtggcttctcgggaagctgtaagaatccacagggcattgtaagatggagggaaatattaagttttcttcgtaaagaggtgaggggggcgagagcagcaaaggacactggaaaatgagaagcatggatgggaagtgttgcattgagcataatttggaggtaaaatctccaacaccgtaactgagtggcctggggacctgatagaaagccctgctcaggactaaggcagagttcccagttatatcgcagatacaaagagaccaggaacacgcttgtaatcacagcacttagggaggctgaggcgggtggatgacctgaggtcaggagttcgagaccagcctagccaacatggtgaaacccccatctctactaaaaatacaaaaattagccaggcgtggtggcacatgcctgtaatcccagctactcaggaggctgaggtgggagaatcgcttgagcccgggaggcaggggttgcagcgagctgagatcgtaccactgcactccagcctgggcaacagagtgagaccctgtctcaaaaagaaaaaaaaaaaagagagaaatcaggaacatcatgaaagatacagcaaaatgttttaccccagcccactgcaccacacctgggattgtgacaattaacttgataaattgttccttttcctgttcggaactgactaggttgtgcgtggatggaccagtgaaaagaaaatcctgtttgggtagggaagagggaagtagaaaacctctttcgtattcttggtgtcaagaaatgggaagagaatgagggagcagagacctgggttgagtgttggctctgcactaaacagctgtgtgatcttggtctagtgccttaacctctctgagcctcagtttgtacatcagtaacattgggataatgacatccacatgcccacttcacagagctgctgtgaggactggatgagaaatgtagagaagtatttcggacaccataaagctcaaatacaaggtgttggttaggaaaagtttcaactgacttgtacccacctgatacccctccatcagcataagcgtgtatgaggatgttaggtacatgtgttgtgagtgaaagctctggaacacccgagtagagctttctgcaaatcagcttctccttcagaggagaccattttgttttgctttccagcagttacttgaagaagccttatctgaagtcacaacagtgacttcaggaatagaagggaccaatggccagcttgctgaaatgtaatgccattcttaaaagccagctaagaatcagaccgtattagttaaggacccataagagtagacatttagaaaaagtgaaaaatggcaagagtggcccaatcttttgagagtttagagaaaatatcatttggaaagggagtagctctccttctattttagccttattattacggtatctataaagcaatgccatattctaaatctgcagaaataaaattctaaggggcgaaagtccaaggcagaagtcaaaagttttgcaaggaaaccgatgaggttgctgacctgagctgggcagggttgaacaggcgagtgccaagatcaaggtctctgattgtctctccttgaaaggtaagcagagaactagggctatcccataaattaagtgggagattggaaaggggtgcggacttctgtattggggagaaggtcttggatgaactggggcagagaactgccagagagagtacctaggaatacgttgttagcaggagaaagaccaagttcagatgcagacttgggaaagtaggtaacttgaccaaaggtagcaaaattagactacccaactggattgtgaatgcagtttatgaaatggatcaggacaggagcaaaaatagattttctagaaactgcagactcctgtgattggagcagtatacaaagtacagcaacatcagactagatctcacctgaggtgctgggtgagaaatcttagggaccagatggaagagggcctgtgtataaagacattaggaaggaggtttgggagggcagcctgacttgtctccagagaaagttagaactggttgacttagcaaccaagggacactgggtcaaagacgaggaatcaggacgtcggtgcctagtgactgagcgccagcccagcccatttctctacattgccatgggctaaacccagtgtgctgtaaactcttcagttcctttggttatggattttgtatcttttctgtgtttcttaataaagttcttttgaaaaatgggaacctttctcagatgggaattttgtatctttcctctgtttcttaataaagttcttttgaaaaattggaa

SEQ ID NO: 195104 - DNA, 1129 bp, Homo sapiens
  Payload ID: 18520
  Gene Name: tripartite motif containing 56
  ENST ID: ENST00000412507
  CDS Start-End: 215-1129
aggcctcaggccccctcaccatcctagaggtcaagatcagctctggctagttctcacaggtctgacccaacaagtagcactgacatttttacgtttgctggatgtacacacggaagtggaggaggaggaggagaaggaggagggcagctccttagctcaagagcaagtggcccaaggcctcagaagactagaaggaagttcctggccattcagcatggtttcccacgggtcctcgccctccctcctggaggccctgagcagcgacttcctggcctgtaaaatctgcctggagcagctgcgggcacccaagacactgccctgcctgcatacctactgccaagactgcctggcacagctggcggatggcggccgcgtccgctgccccgagtgccgcgagacagtgcctgtgccgcccgagggtgtggcctccttcaagaccaacttcttcgtcaatgggctgctggacctggtgaaggcccgggcctgtggagacctgcgtgccgggaagccagcctgtgccctgtgtcccctggtgggtggcaccagcaccggggggccggccacggcccggtgcctggactgtgccgatgacttgtgccaggcctgtgccgacgggcaccgctgcacccgccagacccacacccaccgcgtggtggacctggtgggctacagggccgggtggtatgatgaggaggcccgggagcgccaagcggcccagtgtccccagcaccccggggaggcactgcgcttcctgtgccagccctgctcacagttgctgtgcagagagtgccgcctagacccccacctggaccacccctgcctgcctctggctgaagctgtgcgtgcccggaggccgggcctggagggactgctggccggtgtggacaataacctggtggagctggaggcagcgcggagggtggagaaggaggcgctagcccggctgcgggagcaggcggcccgggtggggactcaggtggaggaggcggctgagggcgtcctccgggccctgctggcccagaagcaggagaatcatttgaacccaggaggtggaagttgcagtgagctcagatcgcaccattgcactccagcctgggtaacaagaatgaaactccatctcaaaaaaaaa

SEQ ID NO: 195105 - DNA, 581 bp, Homo sapiens
  Payload ID: 18520
  Gene Name: tripartite motif containing 56
  ENST ID: ENST00000467847
  CDS Start-End: 386-581
gcaagatcctaccccaactggcaggacctaggcatctctgcccactgggatccccgtctgtgtccttactgcctgctcctcgcaccctggcaccctatacagcaggaccccagtacctgtgcacacaggagggcttccaccatgtttgccacaaggcctgtggactggggacactgaggattcgattattagctaaggccagggactcctggtcttgtcagttctcacaggtctgacccaacaagtagcactgacatttttacgtttgctggatgtacacacggaagtggaggaggaggaggagaaggaggagggcagctccttagctcaagagcaagtggcccaaggcctcagaagactagaaggaagttcctggccattcagcatggtttcccacgggtcctcgccctccctcctggaggccctgagcagcgacttcctggcctgtaaaatctgcctggagcagctgcgggcacccaagacactgccctgcctgcatacctactgccaagactgcctggcacagctggcggatggcggccgcgtccgctgccccgagtgccgcgagacagtgcctgtgc

SEQ ID NO: 195106 - DNA, 3225 bp, Homo sapiens
  Payload ID: 18521
  Gene Name: tripartite motif containing 58
  Uniprot ID: Q8NG06
  ENST ID: ENST00000366481
  CDS Start-End: 49-1509
gggagacggtgcgggcggccgggagcgcagccctccgggaggcgggtcatggcctgggcgccgcccggggagcggctgcgcgaggatgcgcggtgcccggtgtgcctggatttcctgcaggagccggtcagcgtggactgcggccacagcttctgcctcaggtgcatctccgagttctgcgagaagtcggacggcgcgcagggcggcgtctacgcctgtccgcagtgccggggccccttccggccctcgggctttcgccccaaccggcagctggcgggcctggtggagagcgtgcggcggctggggttgggcgcggggcccggggcgcggcgatgcgcgcggcacggcgaggacctgagccgcttctgcgaggaggacgaggcggcgctgtgctgggtgtgcgacgccggccccgagcacaggacgcaccgcacggcgccgctgcaggaggccgccggcagctaccaggtaaagctccagatggctctggaacttatgaggaaagagttggaggacgccttgactcaggaggccaacgtggggaaaaagactgtcatttggaaggagaaagtggaaatgcagaggcagcgcttcagattggagtttgagaagcatcgtggctttctggcccaggaggagcaacggcagctgaggcggctggaggcggaggagcgagcgacgctgcagagactgcgggagagcaagagccggctggtccagcagagcaaggccctgaaggagctggcggatgagctgcaggagaggtgccagcgcccggccctgggtctgctggagggtgtgagaggagtcctgagcagaagtaaggctgtcacaaggctggaagcagagaacatccccatggaactgaagacagcatgctgcatccctgggaggagggagctcttaaggaagttccaagtggatgtaaagctggatcccgccacggcgcacccgagtctgctcttgaccgccgacctgcgcagtgtgcaggatggagaaccatggagggatgtccccaacaaccctgagcgatttgacacatggccctgcatcctgggtttgcagagcttctcatcagggaggcattactgggaggttctggtgggagaaggagcagagtggggtttaggggtctgtcaagacacactgccaagaaagggggaaaccacgccatctcctgagaatggggtctgggccctgtggctgctgaaagggaatgagtacatggtccttgcctccccatcagtgcctcttctccaactggaaagtcctcgctgcattgggattttcttggactatgaagccggtgaaatttcattctacaatgtcacagatggatcttatatctacacattcaaccaactcttctctggtcttcttcggccttactttttcatctgtgatgcaactcctcttatcttgccacccacaacaatagcagggtcaggaaattgggcatccagggatcatttagatcctgcttctgatgtaagagatgatcatctctaaaattctgttcccaagatgcagtcctagcgtagcgaacgttcctggagtggggtgaaggatatcaatatactaagttttaacagataccccatttaggtcagcacttgattcgttgttgctgtgaaatatgtccatgggacaaaagagggaatatgaaatatttgcatatgggaagattatagagcataataattttgtaaatggagcaatctcaacctctatttctagatcacattttcttgatgtcttccttcaaattaatgaccttggattacataaggatttctatgcattcattataatttgttattcctttcaatatccttgtatttcaaatcttccatataagaattagacatggcaattcttaaattgattcagaatggtctgatactattccagtatcacctccttaattctgtttctcctcgttttcctgattttccttctcattctctccttccccgctctgtctctctctccctgtcactctctctctcttgttccttattttttgtttcttacctcttactgtttaacctgttgcttccttctggattaatacatttagagccattcctttatatggtcacatttcctatgactttactcaattacttttaaaatcctttctattctgagactaatttttaagaattacaaagctcattcttctgaatctaatatcactaactcctagactttttccgttttctttggatacactttaagtaggaatttatcagaattttcattcaactcgttctttaatgcagatatttactagttataagaccttaaggctgggtgcagtggctcacgcctgtaatcccagcactttgggaggctgaggcgggtggatcacaagctcaggagttcaagaccagcctggccaacatggtgaaaccctgtctctactaaaaaaaaaaaaaaaatagaaaaattagctgggcatggtggcaggagcctgtaatcccagctattctggaggtggagacaggagaattgcttgaaccctggaggcggaggttgcagtgagccaatatctcaccactgtactccagcccagtgcgagactccatctcaaaaaagaaaaaagacctcaaacaacacttctctctctcttttagctgcttgttatggttcctatacatggaacaattatactggcctcactgtgttatggtaaatatttaaggtcatatttgatattgctggtttgaattcagcttttccatttaaatacattataatgatgatgatgaaatcatgataatatttaacttatttttaaagtatattctgtacctttccaacaaaaaggttaaaagtcattgaaggctaaccttactgccttctttgtatcactgtcttctaaataattattatgtctgggtacagtggctcacgcctgtaatcccagcactttgggaggccgaggtgggcagatcacgaggtcaggagattgagaccatcctggctaacacagtgaaaccccgtctctactaaaaatacaaaaagaaattagctgggcgtggtggtgggtgcctgttgtcccagctacttgggaggctgaggcaggagaatggcatgaacccaggaggcagagcttgtagtgagccgagatcgcgccactgcactccagccggggcaacagagcaagactccatctcaaaaataaataaataaataaataaataaataaataaataaata

SEQ ID NO: 195107 - DNA, 3867 bp, Homo sapiens
  Payload ID: 18522
  Gene Name: tripartite motif containing 59
  Uniprot ID: Q8IWR1
  ENST ID: ENST00000309784
  CDS Start-End: 187-1398
agcccttcggggcagaggagggcggggactcggggcggctctcagcatccgcctggagctcgtggcgctgtgtttccgtgctgtggagttgcctggtccgcttcctccccgcgaataagaataaaagattctggaggagttggagaagagtgtattcagcccccaaaccacgagatcaacaaagaaatgcacaattttgaggaagagttaacttgtcccatatgttatagtatttttgaagatcctcgtgtactgccatgctctcatacattttgtagaaattgtttggaaaacattcttcaggcatctggtaacttttatatatggagacctttacgaattccactcaagtgccctaattgcagaagtattactgaaattgctccaactggcattgaatctttacctgttaattttgcactaagggctattattgaaaagtaccagcaagaagaccatccagatattgtcacctgccctgaacattacaggcaaccattaaatgtttactgtctattagataaaaaattagtttgtggtcattgccttaccataggtcaacatcatggtcatcctatagatgaccttcaaagtgcctatttgaaagaaaaggacactcctcaaaaactgcttgaacagttgactgacacacactggacagatcttacccatcttattgaaaagctgaaagaacaaaaatctcattctgagaaaatgatccaaggcgataaggaagctgttctccagtattttaaggagcttaatgatacattagaacagaaaaaaaaaagtttcctaacggctctctgtgatgttggcaatctaattaatcaagaatatactccacaaattgaaagaatgaaggaaatacgagagcagcagcttgaattaatggcactgacaatatctttacaagaagagtctccacttaaatttcttgaaaaagttgatgatgtacgccagcatgtacagatcttgaaacaaagaccacttcctgaggttcaacccgttgaaatttatcctcgagtaagcaaaatattgaaagaagaatggagcagaacagaaattggacaaattaagaacgttctcattcccaaaatgaaaatttctccaaaaaggatgtcatgttcctggcctggtaaggatgaaaaggaagttgaatttttaaaaattttaaacattgttgtagttacattaatttcagtaatactgatgtcgatactctttttcaaccaacacatcataacctttttaagtgaaatcactttaatatggttttctgaagcctctctatctgtttaccaaagtttatctaacagtctgcataaggtaaagaatatactgtgtcacattttctatttgttgaaggaatttgtgtggaaaatagtttcccattgaaaatgtcaacctgaattgtttaaatgggcttattctgtacattgctaaacaaaaaatggggtagcatggataaagagcaaactaagctttattagtgctgcaactaatataaacaaatgtttatatttgttgcttcttttggttagcaatgatatgtcaaagttatatctgaaatagtcaaatctttgggaaacagaatctagtaacaatttgaaaagtaatacactatcccatttttattggctttatgatggttgacataatgttgctgtgacatttaaacattcttgtaccaatattgtcttttaccattattatatactgcagttaattggctttacagttctttatatatatagcaaaatcctgaaagaacatatacctttattttgatgtggcttgaagcttttgaatgggtgaataaggatgatagaaaggtttcaaaatcaagcaacaaagtcttaaagtgataaggcatggcttaaagatcttttgatcaaacatacctgtgtttgagatagatttaagagccctaaatgcttatcaccattcactccaaataaaactattgcttttggataactgttagagtaaagtggctttttaaaagaaatttttgagactgggtctcaccttgttgcccaggctggagtgtagttgtctggtcatgactcactgcagtttcgaccacccaggctcaatcgatcctcccgcctctgcctctggagcagctgggacaaggcacacacccccatgcctggctaattaaaaaaattgttttttgtagaaacgaggttttgccatattgcccaggttggtctcaaacttctgggctcaagagatctgcccaccttggcctcccaaagtgctgggattacagacgttagccacactgtgcctgggggccagcattttctaatacttgtcatattctatagtttgtgcaaatttaagattgtttttttttctgctcgtcagtcaaatcagttcttggattaaaaactcattcttattagaacagaatcatgttggtaacttggtctgcaacaggttttgatggcatcatgtggactttattcatcttaactcatttaaattttctaccacattcccttaagctaatgcaaaagtaccaacaacttaatcttttttttttttttttttttttttttttgagacggagtcttgctctgtcgcccaggctggagtgcagtggcgtgatctcggctcattgcaagccccgcctcccgggttcacaccattctcctgcctcagcctcccgagtagctgggactacaggcatctgctaccacgcccagctaattttctgtatttttagtagagatggggtttcactgtgttagccaggatggtctctatctcctgacctcatgatccactcgcctcagcctcccaaaatgctgggattataggcgtgagccgccacgcccggcccaacaacttaatcttttattagctttgcttaagagggccaattaaatcaaagccctttagttccctttaacagggactggagttatgatgcatgtgttacgacttttggcccactgtccatgcaactctaagtgcaggttgatttgctttccagaaatcccaaaggggctgctcttggatcaccgaagagccttacctatatcaaatcaaaaagacattctgggtcagattagactatgctcctggccctacagattgcacataaactatcataaatacagctttttcagggaactagttctaaaactcttacctgctgagaataagtcttaacactaagatgactgtattatatcaatttattattagaatcagacttatacctagcacaattaactattgtgtgggcaaagaacatttaaagggcatagtagaggtaaggagagacacatactcagctagagataaaaatactaagttgcactgattacttaaaatactagtcacaccataaaagtgccctgtagtttcaaaaacacgtaagcaatgaaatgttagccattatgtgttaaactacttaatctcatttctgtgatgtgaatatttttaaccccctttttgtagatgagggaactgacaagtgacttgtccaaggccatatagctgtgagaaaacccatgcattctcttttcagagttcatgctatcactcaactttaaagtaggccaagattaatgttggtaagggtttgtaatctgtaagaatgctaaaaacgtaagtatatatatcattttagatttgacattttgtatcttgccagtttttaggagaacttttcattttgttaagtatgcatgaatatagttgagtatatgagtaactggttcttatgctgctgttttgtatttttaccagcaggaagattgcaaaagttgatgtatgtaaatcttgaaatatttctaagttttatgtataacaaaatatgtattttaataaacttcttttgatatttta

SEQ ID NO: 195108 - DNA, 860 bp, Homo sapiens
  Payload ID: 18522
  Gene Name: tripartite motif containing 59
  ENST ID: ENST00000479460
  CDS Start-End: 328-860
ctccccgcggtgagtctaaggacctttacggatgcggagaaggtggttctgagtcctttttcttttcctgtagcacagtctggtgtgcctagtgtgttgggcggggagtcctgggggcgcgacgatggagggagtggcttgggacctgcactcattccctcttgtcccatactggagtttggggagccactttcccgtccctccactgtggagctgcgttcctgtgagggaggaggccctctgtggtggcgaggaataagaataaaagattctggaggagttggagaagagtgtattcagcccccaaaccacgagatcaacaaagaaatgcacaattttgaggaagagttaacttgtcccatatgttatagtatttttgaagatcctcgtgtactgccatgctctcatacattttgtagaaattgtttggaaaacattcttcaggcatctggtaacttttatatatggagacctttacgaattccactcaagtgccctaattgcagaagtattactgaaattgctccaactggcattgaatctttacctgttaattttgcactaagggctattattgaaaagtaccagcaagaagaccatccagatattgtcacctgccctgaacattacaggcaaccattaaatgtttactgtctattagataaaaaattagtttgtggtcattgccttaccataggtcaacatcatggtcatcctatagatgaccttcaaagtgcctatttgaaagaaaaggacactcctcaaaaactgcttgaacagttgactgacacacactggacagatcttacccatcttattgaaaagctgaaagaacaaaaatctcattctgagaaaatgat

SEQ ID NO: 195109 - DNA, 577 bp, Homo sapiens
  Payload ID: 18522
  Gene Name: tripartite motif containing 59
  ENST ID: ENST00000494486
  CDS Start-End: 243-577
gggggcgcgacgatggagggagtggcttgggacctgcactcattccctcttgtcccatactggagtttggggagccactttcccgtccctccactgtggagctgcgttcctgtgagggaggaggccctctgtggtggcgagggtgagctgagcggacgccgccgagtcgaataagaataaaagattctggaggagttggagaagagtgtattcagcccccaaaccacgagatcaacaaagaaatgcacaattttgaggaagagttaacttgtcccatatgttatagtatttttgaagatcctcgtgtactgccatgctctcatacattttgtagaaattgtttggaaaacattcttcaggcatctggtaacttttatatatggagacctttacgaattccactcaagtgccctaattgcagaagtattactgaaattgctccaactggcattgaatctttacctgttaattttgcactaagggctattattgaaaagtaccagcaagaagaccatccagatattgtcacctgccctgaacattacaggcaaccattaaatgtttactgtctattaga

SEQ ID NO: 195110 - DNA, 576 bp, Homo sapiens
  Payload ID: 18522
  Gene Name: tripartite motif containing 59
  ENST ID: ENST00000471155
  CDS Start-End: 234-576
gcgctgtgtttccgtgctgtggagttgcctggtccgcttcctccccgcgaataagaataaaagattctggaggagttggagaagagtgtattcagcccccaaaccacgagatcaacaaattaggtccacaaagatgtgagccccagtttgggtggtggcaccacttgaattttcccatacttaaagctgactcactagaagtcttgggacaagtcatcgaattctataatgaaatgcacaattttgaggaagagttaacttgtcccatatgttatagtatttttgaagatcctcgtgtactgccatgctctcatacattttgtagaaattgtttggaaaacattcttcaggcatctggtaacttttatatatggagacctttacgaattccactcaagtgccctaattgcagaagtattactgaaattgctccaactggcattgaatctttacctgttaattttgcactaagggctattattgaaaagtaccagcaagaagaccatccagatattgtcacctgccctgaacattacaggcaaccattaaatgtttactgtctattagataaaaaat

SEQ ID NO: 195111 - DNA, 603 bp, Homo sapiens
  Payload ID: 18522
  Gene Name: tripartite motif containing 59
  ENST ID: ENST00000496222
  CDS Start-End: 67-603
gtgtttccgtgctgtggagttgcctggtccgcttcctccccgcggtgagtctaaggacctttacggatgcggagaagaataagaataaaagattctggaggagttggagaagagtgtattcagcccccaaaccacgagatcaacaaagaaatgcacaattttgaggaagagttaacttgtcccatatgttatagtatttttgaagatcctcgtgtactgccatgctctcatacattttgtagaaattgtttggaaaacattcttcaggcatctggtaacttttatatatggagacctttacgaattccactcaagtgccctaattgcagaagtattactgaaattgctccaactggcattgaatctttacctgttaattttgcactaagggctattattgaaaagtaccagcaagaagaccatccagatattgtcacctgccctgaacattacaggcaaccattaaatgtttactgtctattagataaaaaattagtttgtggtcattgccttaccataggtcaacatcatggtcatcctatagatgaccttcaaagtgcctatttgaaagaaaaggacactcctcaaaaactgcttgaacag

SEQ ID NO: 195112 - DNA, 601 bp, Homo sapiens
  Payload ID: 18522
  Gene Name: tripartite motif containing 59
  ENST ID: ENST00000468542
  CDS Start-End: 398-601
aagcgattctcctgcctcagcctcgtgagtagctggggttacaggcgcccgctaccacacccggctaatttttgtatttttagtagagacgaggtttcaccatgttggtcaggctggtctgaaactcctgaagagatccgcccacctcggcctctcaaagtgctgggattacaggcgtgagctaccgcgcccggcccgagacccctttcttgtctctgcatagcgcccacccctggcctagagcctcttcagctttccatcactaagctaagctctcacctctactttagcctcttccttacttagacttgtgttatgggcttcctccactctgattaacccatccacatgctccgatcttctcatcttcctgaagtcatttgatacctctcatctaatggttcagccttcactggaaatgcacaattttgaggaagagttaacttgtcccatatgttatagtatttttgaagatcctcgtgtactgccatgctctcatacattttgtagaaattgtttggaaaacattcttcaggcatctggtaacttttatatatggagacctttacgaattccactcaagtgccctaattgcagaagt

SEQ ID NO: 195113 - DNA, 548 bp, Homo sapiens
  Payload ID: 18522
  Gene Name: tripartite motif containing 59
  ENST ID: ENST00000471396
  CDS Start-End: 84-548
gctgtgtttccgtgctgtggagttgcctggtccgcttcctccccgcggtgagtctaaggacctttacggatgcggagaaggaaatgcacaattttgaggaagagttaacttgtcccatatgttatagtatttttgaagatcctcgtgtactgccatgctctcatacattttgtagaaattgtttggaaaacattcttcaggcatctggtaacttttatatatggagacctttacgaattccactcaagtgccctaattgcagaagtattactgaaattgctccaactggcattgaatctttacctgttaattttgcactaagggctattattgaaaagtaccagcaagaagaccatccagatattgtcacctgccctgaacattacaggcaaccattaaatgtttactgtctattagataaaaaattagtttgtggtcattgccttaccataggtcaacatcatggtcatcctatagatgaccttcaaagtgcctatttgaaagaaaaggacactcctcaaaaactgcttgaacagttgactgacaca

SEQ ID NO: 195114 - DNA, 4615 bp, Homo sapiens
  Payload ID: 18522
  Gene Name: tripartite motif containing 59
  ENST ID: ENST00000543469
  CDS Start-End: 216-1187
aactgtgttggtgtttgtggcttttctgaaaacacgatgaagcatcgtgaagataaatatcaaagacagtgaactaacaaccatttttatgacatgagacaataaattgaaaacattaaagataacattattttaattttagaataagaataaaagattctggaggagttggagaagagtgtattcagcccccaaaccacgagatcaacaaagaaatgcacaattttgaggaagagttaacttgtcccatatgttatagtatttttgaagatcctcgtgtactgccatgctctcatacattttgtagaaattgtttggaaaacattcttcaggcatctggtaacttttatatatggagacctttacgaattccactcaagtgccctaattgcagaagtattactgaaattgctccaactggcattgaatctttacctgttaattttgcactaagggctattattgaaaagtaccagcaagaagaccatccagatattgtcacctgccctgaacattacaggcaaccattaaatgtttactgtctattagataaaaaattagtttgtggtcattgccttaccataggtcaacatcatggtcatcctatagatgaccttcaaagtgcctatttgaaagaaaaggacactcctcaaaaactgcttgaacagttgactgacacacactggacagatcttacccatcttattgaaaagctgaaagaacaaaaatctcattctgagaaaatgatccaaggcgataaggaagctgttctccagtattttaaggagcttaatgatacattagaacagaaaaaaaaaagtttcctaacggctctctgtgatgttggcaatctaattaatcaagaatatactccacaaattgaaagaatgaaggaaatacgagagcagcagcttgaattaatggcactgacaatatctttacaagaagagtctccacttaaatttcttgaaaaagttgatgatgtacgccagcatgtacagatcttgaaacaaagaccacttcctgaggttcaacccgttgaaatttatcctcgagtaagcaaaatattgaaagaagaatggagcagaacagaaattggacaaattaagaacgttctcattcccaaaatgaaaatttctccaaaaaggatgtcatgttcctggcctgatgagggaactgacaagtgacttgtccaaggccatatagctgtgagaaaacccatgcattctcttttcagagttcatgctatcactcaactttaaagtaggccaagattaatgttggtaagggtttgtaatctgtaagaatgctaaaaacgtaagtatatatatcattttagatttgacattttgtatcttgccagtttttaggagaacttttcattttgttaagtatgcatgaatatagttgagtatatgagtaactggttcttatgctgctgttttgtatttttaccagcaggaagattgcaaaagttgatgtatgtaaatcttgaaatatttctaagttttatgtataacaaaatatgtattttaataaacttcttttgatattttatttgcactgtcttaatgagacttccatactcaggagtggtagctatgggattttcacatgggttctgggtacttctaattctttgaaacttagtactgcaggctgggtgcagtggctcatgcctatagtccagcactttgggaggctgaggcaggcagatcacttgaggccaggagtttgagaccagcttggccaacatggcaaaaccctgtctaccaaaaacacaaaaattagctgggcactgtggtgtgcacctgtagtcccagctactcatgtggctgaggcacttgaatcgcttgaacccgtgaggcagggttgcagtgagccaagatcttgccacagcactccaccctgggtgatgcagtgagactttcaaaaaaaaaaaaaaaatctgagctctactgcattggttattaaaatataataaaagtattaaattctattttcgcaccaaatgaaaacacttgattatcattatagcactttaaacttacttttcccttatatattcttgatttagaacaaattaccgtacttgaatttccgatcttgctttctttaaatctttatttaaaagtccatgctaataatgtgtttacatttttacagttacattatgatagaaactgttggattttttaaatatctaaaacaatggcccactgaagaaaggaacaattaactctttaattaattccttaggataaatacccagaaatttaacagctagggcagacttctaatacaataccgaaagtccttccaaaaaccaagtggttgccaacttatgtcccttagcattataacattcttgagccaatagtgtaaaaatacgctgacaattttataggcaaacattactcaaggtatcttactttccacttattactaaagtaattaacccctaaatagatgctcctcaacagtgggactacatcctggtaaacctatcataagttgaaactatcaagttgaaatgcatttagtacccggataaacctatcataaagttgaaaatttgtaaattgaaccagtgtaaatcagaggccatcttacttcatactcatgaagcaactatagtgggatatttttcaacttacgagatagcctaggcttgttgaaacactgtcctaatttactggctctctggtaattaagtcataaatggtcaaacatcaaattctagaaaagcatatatttaaattctcatcactataattcagaatgactggtttacaaaaatatgttcatagtatttgggtaataactgtggtgattgtctcaactggcaagctaagtggaatgccttaaagaatctatccaagattagttggcaggcatttccagtgttggtaaatcaaaggcccacgaaggtatgctgagccttgatagcacaaccttgcttaggactttgcctcaactaacatactttttagtttggcaagttacctgaccctccaggtaactcatttttctccatagtctgctacttacaagattgtcatatttttgtaatctagaagcaattatagagaatattttattagactttacaaatgacaactgcataaaacagaaaccagtttcatgatctagtttagggagtatgtattttatacaactcataatcctttacaaatagaaaaaaatcagtaatacactgaatcaacttgaagaatcttcagcataaagttcaacaaagtcccttagatgcaatttcttttggatttacagcaacactttttgttatgttgtatgtcttgtaaattccaataagtctatccgaaatctcaaacatattatttcgaagagaaattattatgaactgtgcattttttgtttgttcctaaagagaaacaaagaaaagtcaaacattaagtaataacaggtaaatcacacaaacatgtaacctcaaatattttttggacaataaacattacattgataacatgtaaaggaatgatggcaggaataattcataaaacagtatttgagtgtgaaaggaatttggttattttgacttctagtggaaaagatctaggaagatgacctaggattctagctgtgattctgctactaatttgcatttttaatttatattttactcctccaaaatggaaatatttggttcaaataaaaaataatttggtctccactgataccagaggagatggagatggagttattagacaataaagaaaaagctcaattgtaagaaataaagaattccatgtgtaatgtttaggatacccctaaaagtttctggaatgaaaatcccaaaatgattacttacatatatataaaatgcaacaatggacacatttttaaaatcaagggctgcatcaatctcatccatgaagtaaaggggagtgggcttgtagtggtgaagagcaaatactaaagccaatgaactaagtgttttctctcctcccgaaaggttgaagatctttttccaacttttcttaggtggtcgaacactgaaatgattaagaaaatcatagtcaaattacctgtaaagctaaagttaagactttgtgatttgctttccataattgagttctactatcttttttaggaatctgtaacttgcttttcacaaatatgaattctcttttctgttattttataaaaacgttattggaggatgcatacataggagcacataccaaagttttaagatttaaagagcaagctaagtattatacttcttgctattctttctccttatcaaatacaatttctcaatcctcatgttaaaaatgccttgaaaatttaagaaaagatgaactagacaaatattttgtaaatactggctgtctgcccctgtaaactgcaagcataaatagcatgcaagcaaattagtatttactagtaaatgaaacaagttgtacatcttgccttcacatcctacctccaagaaatactgagtttggagaatatgtagaaaaaggtaacagtgggattataaactcagcataattacacacctgaacatgattccttcagagaaaggatccaagctgtctacaagctcgagttcggcgtcccctcccaaagt

SEQ ID NO: 195115 - DNA, 3217 bp, Homo sapiens
  Payload ID: 18523
  Gene Name: tripartite motif containing 6
  Uniprot ID: Q9C030
  ENST ID: ENST00000278302
  CDS Start-End: 141-1607
ctgagtctttcggcctgggtggaggacgcggctgcttcaagtccttggctctgatccaggccacagattccaggattctacaggcaggaaacatcttagaaatcagggttgggcaggcaggagccaggagagtagctacaatgacttcaccagtactggtggacatacgagaagaggtgacctgccctatctgcctggagctcctaacagaacccctgagcatagactgtggccacagcttctgccaagcctgcatcacaccaaatggcagggaatcagtgattggtcaagaaggggaaagaagctgccctgtgtgccagaccagctaccagccagggaacctgcggcctaatcggcatctggccaacatagtgaggcggctcagagaggtagtgttgggccctgggaagcagctgaaagcagttctttgtgcagaccatggagaaaaactgcagctcttctgtcaggaggatgggaaggtcatttgctggctttgtgagcggtctcaggagcaccgtggtcaccacacgttcctcgtggaggaggttgcccaggagtaccaggagaagtttcaggagtctctaaagaagctgaagaacgaggagcaggaagctgagaagctaacagcttttatcagagagaagaaaacatcctggaagaatcagatggagcctgagagatgcaggatccagacagagtttaatcagctgcgaaatatcctagacagagtggagcaacgggagctgaaaaagctggaacaggaagagaagaaggggctacgaattatagaagaggctgagaatgatctggtccaccagacccagtcgctgcgagagctcatctcggatctggagcgtcgatgtcaggggtcaacaatggagctgctgcaggatgtgagtgatgtcacagaaaggagtgagttctggaccctgaggaagccagaagctctccctacaaagctgagaagtatgttccgagccccagatctgaaaaggatgctgcgagtgtgtagagagctgacagatgtccaaagctactgggttgacgtgaccctgaatccacacacagctaatttaaatcttgtcctggctaaaaaccggagacaagtgaggtttgtgggagctaaagtatctggaccttcctgtctggaaaagcattatgactgtagtgtcctgggctcccagcacttctcctctggtaagcattactgggaggtagatgtggccaagaagactgcctggatcctgggggtatgcagcaattcactgggacctacattctctttcaaccattttgctcaaaatcacagtgcttactccaggtatcagcctcagagtggatactgggtgattgggttacagcataaccatgaatatagggcctatgaggattcttccccttccctgcttctctccatgacagtgccccctcgccgtgttggggttttcttagattatgaggctggtactgtctccttttataatgtcacaaaccatggcttccccatctacactttctctaaatattactttcccactactctttgtccatattttaatccttgcaactgtgtaattcctatgaccctgcgtcgtccaagctcttgaatattcttctgttcccacccacttctgataagtaccctgaggcttatcagcatgtgattctcccttctgatcttctgtttttctgtgttctcaattcttttgttgttttttggtttttgaatcttttttgagatggaatctcgctctgtcgcccaggctggagtgcactggcgcaatctcggctcactgcaacctctgcctcctgggttcaagcgaacctcctgcctcagcatcccaagtagctgggattacaggcacccaccaccatgcccaactaatttttgtatttttatagagatagggtttcaccgtgttggccaggctgatctcgaactcctgaccgcaagtgatccacccgcctcggtctcccaaagtgctgggattacagatgtgagccgccgcgcccagacagttctttcgttttaaacagttactcagtactaggatgcacccagtggtgagagtaagcatctttgactgatgacaggtcttgaggtggatagggggcgctttcagtattttgccattaagcatagtatttgatgcaggttttttttgattgatgcaggggatcaaatttaggaagttctgatctgttaatttactacaagtttttgtataaaatgaaaactcgtattctacctatgtcttttctgtaaattattgagacaattgtgtatcatttttgttctgttaatgtggcttagtacattgatttacttcaatttgttaccacaacttgctgaaatacaccattattatttgttgtatgcaatactggatttattttgataacgtattgtttagattttgttctcatctatgttaatgaaagaaattggcctgtatttttacattcttgtaatatctttgccaggttctataaaatgcaataataagcaaataaattactttgtttttgtataagtatgtataggattgagctctaaaaccaaaccattataatgataatttgggtagcttcaaactcaaattgaagagagtcttcactacaatcttcactacaacctttggccttcctctctacatttaagagtagcaatagaacaataaaaaaaaatacgtctttcaaattaattgcagtaaaaacaaaagagtagtggggagagaaaaacaatccaatacatatttttctctcagaatagaaagaaaacacaaagagaaaatatgaacaatataaagcacttaaaggaagaggatgatttcttccagcttttccacactctctttatgcgcaggaacaaacagctgttgagtgagctgctatgactttggtagagaggtgcaatatgttttttgaaccagctataaaagaaattaagaggtacatgtgagggtagaaacaaatatcaaggatgagaatggcactggctgtcccatatggtatccaggagccaccaatgtctgttgagtacttcatacatgcctagtctgaattgagatgtgctcaatgtataaaatatataccagatttcaaatacctacttcaaaaaataatgtaaaatatctcactaataacttttcctttgtgtattgcaatgataatatgttggctctattggattaaataaagtatgttattcatttta

SEQ ID NO: 195116 - DNA, 3403 bp, Homo sapiens
  Payload ID: 18523
  Gene Name: tripartite motif containing 6
  Uniprot ID: Q9C030
  ENST ID: ENST00000380097
  CDS Start-End: 243-1793
gccttccgcaaactcctgacctgtgggtccgtccgttcaacggccaaaggctggcggaggagggatcccctgcctttctcggaacggaacggagcagagtcgtgcgtggttgagtttagataaaagccgagtgagcgcgctctgttccttaagattagtttaaggtgccttggattgctctgaagagctttgaccacctgatattgcttacatctggaacttcttggcttctcattccccagatgtgcgggtcagagaggattctacaggcaggaaacatcttagaaatcagggttgggcaggcaggagccaggagagtagctacaatgacttcaccagtactggtggacatacgagaagaggtgacctgccctatctgcctggagctcctaacagaacccctgagcatagactgtggccacagcttctgccaagcctgcatcacaccaaatggcagggaatcagtgattggtcaagaaggggaaagaagctgccctgtgtgccagaccagctaccagccagggaacctgcggcctaatcggcatctggccaacatagtgaggcggctcagagaggtagtgttgggccctgggaagcagctgaaagcagttctttgtgcagaccatggagaaaaactgcagctcttctgtcaggaggatgggaaggtcatttgctggctttgtgagcggtctcaggagcaccgtggtcaccacacgttcctcgtggaggaggttgcccaggagtaccaggagaagtttcaggagtctctaaagaagctgaagaacgaggagcaggaagctgagaagctaacagcttttatcagagagaagaaaacatcctggaagaatcagatggagcctgagagatgcaggatccagacagagtttaatcagctgcgaaatatcctagacagagtggagcaacgggagctgaaaaagctggaacaggaagagaagaaggggctacgaattatagaagaggctgagaatgatctggtccaccagacccagtcgctgcgagagctcatctcggatctggagcgtcgatgtcaggggtcaacaatggagctgctgcaggatgtgagtgatgtcacagaaaggagtgagttctggaccctgaggaagccagaagctctccctacaaagctgagaagtatgttccgagccccagatctgaaaaggatgctgcgagtgtgtagagagctgacagatgtccaaagctactgggttgacgtgaccctgaatccacacacagctaatttaaatcttgtcctggctaaaaaccggagacaagtgaggtttgtgggagctaaagtatctggaccttcctgtctggaaaagcattatgactgtagtgtcctgggctcccagcacttctcctctggtaagcattactgggaggtagatgtggccaagaagactgcctggatcctgggggtatgcagcaattcactgggacctacattctctttcaaccattttgctcaaaatcacagtgcttactccaggtatcagcctcagagtggatactgggtgattgggttacagcataaccatgaatatagggcctatgaggattcttccccttccctgcttctctccatgacagtgccccctcgccgtgttggggttttcttagattatgaggctggtactgtctccttttataatgtcacaaaccatggcttccccatctacactttctctaaatattactttcccactactctttgtccatattttaatccttgcaactgtgtaattcctatgaccctgcgtcgtccaagctcttgaatattcttctgttcccacccacttctgataagtaccctgaggcttatcagcatgtgattctcccttctgatcttctgtttttctgtgttctcaattcttttgttgttttttggtttttgaatcttttttgagatggaatctcgctctgtcgcccaggctggagtgcactggcgcaatctcggctcactgcaacctctgcctcctgggttcaagcgaacctcctgcctcagcatcccaagtagctgggattacaggcacccaccaccatgcccaactaatttttgtatttttatagagatagggtttcaccgtgttggccaggctgatctcgaactcctgaccgcaagtgatccacccgcctcggtctcccaaagtgctgggattacagatgtgagccgccgcgcccagacagttctttcgttttaaacagttactcagtactaggatgcacccagtggtgagagtaagcatctttgactgatgacaggtcttgaggtggatagggggcgctttcagtattttgccattaagcatagtatttgatgcaggttttttttgattgatgcaggggatcaaatttaggaagttctgatctgttaatttactacaagtttttgtataaaatgaaaactcgtattctacctatgtcttttctgtaaattattgagacaattgtgtatcatttttgttctgttaatgtggcttagtacattgatttacttcaatttgttaccacaacttgctgaaatacaccattattatttgttgtatgcaatactggatttattttgataacgtattgtttagattttgttctcatctatgttaatgaaagaaattggcctgtatttttacattcttgtaatatctttgccaggttctataaaatgcaataataagcaaataaattactttgtttttgtataagtatgtataggattgagctctaaaaccaaaccattataatgataatttgggtagcttcaaactcaaattgaagagagtcttcactacaatcttcactacaacctttggccttcctctctacatttaagagtagcaatagaacaataaaaaaaaatacgtctttcaaattaattgcagtaaaaacaaaagagtagtggggagagaaaaacaatccaatacatatttttctctcagaatagaaagaaaacacaaagagaaaatatgaacaatataaagcacttaaaggaagaggatgatttcttccagcttttccacactctctttatgcgcaggaacaaacagctgttgagtgagctgctatgactttggtagagaggtgcaatatgttttttgaaccagctataaaagaaattaagaggtacatgtgagggtagaaacaaatatcaaggatgagaatggcactggctgtcccatatggtatccaggagccaccaatgtctgttgagtacttcatacatgcctagtctgaattgagatgtgctcaatgtataaaatatataccagatttcaaatacctacttcaaaaaataatgtaaaatatctcactaataacttttcctttgtgtattgcaatgataatatgttggctctattggattaaataaagtatgttattcatttta

SEQ ID NO: 195117 - DNA, 2590 bp, Homo sapiens
  Payload ID: 18523
  Gene Name: tripartite motif containing 6
  ENST ID: ENST00000380107
  CDS Start-End: 121-1509
ggaggacgcggctgcttcaagtccttggctctgatccaggccacagattccaggattctacaggcaggaaacatcttagaaatcagggttgggcaggcaggagccaggagagtagctacaatgacttcaccagtactggtggacatacgagaagaggtgacctgccctatctgcctggagctcctaacagaacccctgagcatagactgtggccacagcttctgccaagcctgcatcacaccaaatggcagggaatcagtgattggtcaagaaggggaaagaagctgccctgtgtgccagaccagctaccagccagggaacctgcggcctaatcggcatctggccaacatagtgaggcggctcagagaggaggatgggaaggtcatttgctggctttgtgagcggtctcaggagcaccgtggtcaccacacgttcctcgtggaggaggttgcccaggagtaccaggagaagtttcaggagtctctaaagaagctgaagaacgaggagcaggaagctgagaagctaacagcttttatcagagagaagaaaacatcctggaagaatcagatggagcctgagagatgcaggatccagacagagtttaatcagctgcgaaatatcctagacagagtggagcaacgggagctgaaaaagctggaacaggaagagaagaaggggctacgaattatagaagaggctgagaatgatctggtccaccagacccagtcgctgcgagagctcatctcggatctggagcgtcgatgtcaggggtcaacaatggagctgctgcaggatgtgagtgatgtcacagaaaggagtgagttctggaccctgaggaagccagaagctctccctacaaagctgagaagtatgttccgagccccagatctgaaaaggatgctgcgagtgtgtagagagctgacagatgtccaaagctactgggttgacgtgaccctgaatccacacacagctaatttaaatcttgtcctggctaaaaaccggagacaagtgaggtttgtgggagctaaagtatctggaccttcctgtctggaaaagcattatgactgtagtgtcctgggctcccagcacttctcctctggtaagcattactgggaggtagatgtggccaagaagactgcctggatcctgggggtatgcagcaattcactgggacctacattctctttcaaccattttgctcaaaatcacagtgcttactccaggtatcagcctcagagtggatactgggtgattgggttacagcataaccatgaatatagggcctatgaggattcttccccttccctgcttctctccatgacagtgccccctcgccgtgttggggttttcttagattatgaggctggtactgtctccttttataatgtcacaaaccatggcttccccatctacactttctctaaatattactttcccactactctttgtccatattttaatccttgcaactgtgtaattcctatgaccctgcgtcgtccaagctcttgaatattcttctgttcccacccacttctgataagtaccctgaggcttatcagcatgtgattctcccttctgatcttctgtttttctgtgttctcaattcttttgttgttttttggtttttgaatcttttttgagatggaatctcgctctgtcgcccaggctggagtgcactggcgcaatctcggctcactgcaacctctgcctcctgggttcaagcgaacctcctgcctcagcatcccaagtagctgggattacaggcacccaccaccatgcccaactaatttttgtatttttatagagatagggtttcaccgtgttggccaggctgatctcgaactcctgaccgcaagtgatccacccgcctcggtctcccaaagtgctgggattacagatgtgagccgccgcgcccagacagttctttcgttttaaacagttactcagtactaggatgcacccagtggtgagagtaagcatctttgactgatgacaggtcttgaggtggatagggggcgctttcagtattttgccattaagcatagtatttgatgcaggttttttttgattgatgcaggggatcaaatttaggaagttctgatctgttaatttactacaagtttttgtataaaatgaaaactcgtattctacctatgtcttttctgtaaattattgagacaattgtgtatcatttttgttctgttaatgtggcttagtacattgatttacttcaatttgttaccacaacttgctgaaatacaccattattatttgttgtatgcaatactggatttattttgataacgtattgtttagattttgttctcatctatgttaatgaaagaaattggcctgtatttttacattcttgtaatatctttgccaggttctataaaatgcaataataagcaaataaattactttgtttttgtataagtatgtataggattgagctctaaaaccaaaccattataatgataatttgggtagcttcaaactcaaattgaagagagtcttcactacaatcttcactacaacctttggccttcctctctacatttaagagtagcaatagaacaataaaaaaaaa

SEQ ID NO: 195118 - DNA, 2951 bp, Homo sapiens
  Payload ID: 18523
  Gene Name: tripartite motif containing 6
  Uniprot ID: Q9C030
  ENST ID: ENST00000445329
  CDS Start-End: 400-1341
ggagcagagtcgtgcgtggttgagtttagataaaagccgagtgagcgcgctctgttccttaagattagtttaaggtgccttggattgctctgaagagctttgaccacctgatattgcttacatctggaacttcttggcttctcattccccagatgtgcgggtcagagagaccatggagaaaaactgcagctcttctgtcaggaggatgggaaggtcatttgctggctttgtgagcggtctcaggagcaccgtggtcaccacacgttcctcgtggaggaggttgcccaggagtaccaggagaagtttcaggagtctctaaagaagctgaagaacgaggagcaggaagctgagaagctaacagcttttatcagagagaagaaaacatcctggaagaatcagatggagcctgagagatgcaggatccagacagagtttaatcagctgcgaaatatcctagacagagtggagcaacgggagctgaaaaagctggaacaggaagagaagaaggggctacgaattatagaagaggctgagaatgatctggtccaccagacccagtcgctgcgagagctcatctcggatctggagcgtcgatgtcaggggtcaacaatggagctgctgcaggatgtgagtgatgtcacagaaaggagtgagttctggaccctgaggaagccagaagctctccctacaaagctgagaagtatgttccgagccccagatctgaaaaggatgctgcgagtgtgtagagagctgacagatgtccaaagctactgggttgacgtgaccctgaatccacacacagctaatttaaatcttgtcctggctaaaaaccggagacaagtgaggtttgtgggagctaaagtatctggaccttcctgtctggaaaagcattatgactgtagtgtcctgggctcccagcacttctcctctggtaagcattactgggaggtagatgtggccaagaagactgcctggatcctgggggtatgcagcaattcactgggacctacattctctttcaaccattttgctcaaaatcacagtgcttactccaggtatcagcctcagagtggatactgggtgattgggttacagcataaccatgaatatagggcctatgaggattcttccccttccctgcttctctccatgacagtgccccctcgccgtgttggggttttcttagattatgaggctggtactgtctccttttataatgtcacaaaccatggcttccccatctacactttctctaaatattactttcccactactctttgtccatattttaatccttgcaactgtgtaattcctatgaccctgcgtcgtccaagctcttgaatattcttctgttcccacccacttctgataagtaccctgaggcttatcagcatgtgattctcccttctgatcttctgtttttctgtgttctcaattcttttgttgttttttggtttttgaatcttttttgagatggaatctcgctctgtcgcccaggctggagtgcactggcgcaatctcggctcactgcaacctctgcctcctgggttcaagcgaacctcctgcctcagcatcccaagtagctgggattacaggcacccaccaccatgcccaactaatttttgtatttttatagagatagggtttcaccgtgttggccaggctgatctcgaactcctgaccgcaagtgatccacccgcctcggtctcccaaagtgctgggattacagatgtgagccgccgcgcccagacagttctttcgttttaaacagttactcagtactaggatgcacccagtggtgagagtaagcatctttgactgatgacaggtcttgaggtggatagggggcgctttcagtattttgccattaagcatagtatttgatgcaggttttttttgattgatgcaggggatcaaatttaggaagttctgatctgttaatttactacaagtttttgtataaaatgaaaactcgtattctacctatgtcttttctgtaaattattgagacaattgtgtatcatttttgttctgttaatgtggcttagtacattgatttacttcaatttgttaccacaacttgctgaaatacaccattattatttgttgtatgcaatactggatttattttgataacgtattgtttagattttgttctcatctatgttaatgaaagaaattggcctgtatttttacattcttgtaatatctttgccaggttctataaaatgcaataataagcaaataaattactttgtttttgtataagtatgtataggattgagctctaaaaccaaaccattataatgataatttgggtagcttcaaactcaaattgaagagagtcttcactacaatcttcactacaacctttggccttcctctctacatttaagagtagcaatagaacaataaaaaaaaatacgtctttcaaattaattgcagtaaaaacaaaagagtagtggggagagaaaaacaatccaatacatatttttctctcagaatagaaagaaaacacaaagagaaaatatgaacaatataaagcacttaaaggaagaggatgatttcttccagcttttccacactctctttatgcgcaggaacaaacagctgttgagtgagctgctatgactttggtagagaggtgcaatatgttttttgaaccagctataaaagaaattaagaggtacatgtgagggtagaaacaaatatcaaggatgagaatggcactggctgtcccatatggtatccaggagccaccaatgtctgttgagtacttcatacatgcctagtctgaattgagatgtgctcaatgtataaaatatataccagatttcaaatacctacttcaaaaaataatgtaaaatatctcactaataacttttcctttgtgtattgcaatgataatatgttggctctattggattaaataaagtatgttattcatttta

SEQ ID NO: 195119 - DNA, 468 bp, Homo sapiens
  Payload ID: 18523
  Gene Name: tripartite motif containing 6
  ENST ID: ENST00000424369
  CDS Start-End: 175-468
tgagtctttcggcctgggtggaggacgcggctgcttcaagtccttggctctgatccaggccacagattccaggagaagtttcaggagtctctaaagaagctgaagaacgaggagcaggaagctgagaagctaacagcttttatcagagagaagaaaacatcctggaagaatcagatggagcctgagagatgcaggatccagacagagtttaatcagctgcgaaatatcctagacagagtggagcaacgggagctgaaaaagctggaacaggaagagaagaaggggctacgaattatagaagaggctgagaatgatctggtccaccagacccagtcgctgcgagagctcatctcggatctggagcgtcgatgtcaggggtcaacaatggagctgctgcaggatgtgagtgatgtcacagaaaggagtgagttctggaccctgaggaagccagaagctctccctacaaag

SEQ ID NO: 195120 - DNA, 1398 bp, Homo sapiens
  Payload ID: 18523
  Gene Name: tripartite motif containing 6
  Uniprot ID: Q9C030
  ENST ID: ENST00000506134
  CDS Start-End: 212-1153
aagattagtttaaggtgccttggattgctctgaagagctttgaccacctgatattgcttacatctggaacttcttggcttctcattccccagatgtgcgggtcagagaggagaagtttcaggagtctctaaagaagctgaagaacgaggagcaggaagctgagaagctaacagcttttatcagagagaagaaaacatcctggaagaatcagatggagcctgagagatgcaggatccagacagagtttaatcagctgcgaaatatcctagacagagtggagcaacgggagctgaaaaagctggaacaggaagagaagaaggggctacgaattatagaagaggctgagaatgatctggtccaccagacccagtcgctgcgagagctcatctcggatctggagcgtcgatgtcaggggtcaacaatggagctgctgcaggatgtgagtgatgtcacagaaaggagtgagttctggaccctgaggaagccagaagctctccctacaaagctgagaagtatgttccgagccccagatctgaaaaggatgctgcgagtgtgtagagagctgacagatgtccaaagctactgggttgacgtgaccctgaatccacacacagctaatttaaatcttgtcctggctaaaaaccggagacaagtgaggtttgtgggagctaaagtatctggaccttcctgtctggaaaagcattatgactgtagtgtcctgggctcccagcacttctcctctggtaagcattactgggaggtagatgtggccaagaagactgcctggatcctgggggtatgcagcaattcactgggacctacattctctttcaaccattttgctcaaaatcacagtgcttactccaggtatcagcctcagagtggatactgggtgattgggttacagcataaccatgaatatagggcctatgaggattcttccccttccctgcttctctccatgacagtgccccctcgccgtgttggggttttcttagattatgaggctggtactgtctccttttataatgtcacaaaccatggcttccccatctacactttctctaaatattactttcccactactctttgtccatattttaatccttgcaactgtgtaattcctatgaccctgcgtcgtccaagctcttgaatattcttctgttcccacccacttctgataagtaccctgaggcttatcagcatgtgattctcccttctgatcttctgtttttctgtgttctcaattcttttgttgttttttggtttttgaatcttttttgagatggaatctcgctctgtcgcccaggctggagtgcactggcgcaatctcggctcactgcaacctctgcctcctgggttcaagcgaacctcctgcctcagcatcccaagtagctg

SEQ ID NO: 195121 - DNA, 1060 bp, Homo sapiens
  Payload ID: 18523
  Gene Name: tripartite motif containing 6
  Uniprot ID: Q9C030
  ENST ID: ENST00000515022
  CDS Start-End: 116-1057
aagattagtttaaggtgccttggattgctctgaagagctttgaccacctgatattgcttacatctggaacttcttggcttctcattccccagatgtgcgggtcagagagaatcagatggagcctgagagatgcaggatccagacagagtttaatcagctgcgaaatatcctagacagagtggagcaacgggagctgaaaaagctggaacaggaagagaagaaggggctacgaattatagaagaggctgagaatgatctggtccaccagacccagtcgctgcgagagctcatctcggatctggagcgtcgatgtcaggggtcaacaatggagctgctgcaggatgtgagtgatgtcacagaaaggagtgagttctggaccctgaggaagccagaagctctccctacaaagctgagaagtatgttccgagccccagatctgaaaaggatgctgcgagtgtgtagagagctgacagatgtccaaagctactgggttgacgtgaccctgaatccacacacagctaatttaaatcttgtcctggctaaaaaccggagacaagtgaggtttgtgggagctaaagtatctggaccttcctgtctggaaaagcattatgactgtagtgtcctgggctcccagcacttctcctctggtaagcattactgggaggtagatgtggccaagaagactgcctggatcctgggggtatgcagcaattcactgggacctacattctctttcaaccattttgctcaaaatcacagtgcttactccaggtatcagcctcagagtggatactgggtgattgggttacagcataaccatgaatatagggcctatgaggattcttccccttccctgcttctctccatgacagtgccccctcgccgtgttggggttttcttagattatgaggctggtactgtctccttttataatgtcacaaaccatggcttccccatctacactttctctaaatattactttcccactactctttgtccatattttaatccttgcaactgtgtaattcctatgaccctgcgtcgtccaagctcttgaata

SEQ ID NO: 195122 - DNA, 1767 bp, Homo sapiens
  Payload ID: 18523
  Gene Name: tripartite motif containing 6
  Uniprot ID: Q9C030
  ENST ID: ENST00000507320
  CDS Start-End: 468-1409
gtctttcggcctgggtggaggacgcggctgcttcaagtccttggctctgatccaggccacagattccagaccatggagaaaaactgcagctcttctgtcaggaggatgggaaggtcatttgctggctttgtgagcggtctcaggagcaccgtggtcaccacacgttcctcgtggaggaggttgcccaggagtaccaggagaagtttcaggagtctctaaagaagctgaagaacgaggagcaggaagctgagaagctaacagcttttatcagagagaagaaaacatcctggaaggcaagggagactttttctgaagatgtcctggggcaggaatcatggcaggtcataggagctgagggcaaaggagtccttgtcctgtctgtcctctgatgccatgactagaagagcttccctttgcctggtcctccactatattccttccaaacagggggaggagaggagaatcagatggagcctgagagatgcaggatccagacagagtttaatcagctgcgaaatatcctagacagagtggagcaacgggagctgaaaaagctggaacaggaagagaagaaggggctacgaattatagaagaggctgagaatgatctggtccaccagacccagtcgctgcgagagctcatctcggatctggagcgtcgatgtcaggggtcaacaatggagctgctgcaggatgtgagtgatgtcacagaaaggagtgagttctggaccctgaggaagccagaagctctccctacaaagctgagaagtatgttccgagccccagatctgaaaaggatgctgcgagtgtgtagagagctgacagatgtccaaagctactgggttgacgtgaccctgaatccacacacagctaatttaaatcttgtcctggctaaaaaccggagacaagtgaggtttgtgggagctaaagtatctggaccttcctgtctggaaaagcattatgactgtagtgtcctgggctcccagcacttctcctctggtaagcattactgggaggtagatgtggccaagaagactgcctggatcctgggggtatgcagcaattcactgggacctacattctctttcaaccattttgctcaaaatcacagtgcttactccaggtatcagcctcagagtggatactgggtgattgggttacagcataaccatgaatatagggcctatgaggattcttccccttccctgcttctctccatgacagtgccccctcgccgtgttggggttttcttagattatgaggctggtactgtctccttttataatgtcacaaaccatggcttccccatctacactttctctaaatattactttcccactactctttgtccatattttaatccttgcaactgtgtaattcctatgaccctgcgtcgtccaagctcttgaatattcttctgttcccacccacttctgataagtaccctgaggcttatcagcatgtgattctcccttctgatcttctgtttttctgtgttctcaattcttttgttgttttttggtttttgaatcttttttgagatggaatctcgctctgtcgcccaggctggagtgcactggcgcaatctcggctcactgcaacctctgcctcctgggttcaagcgaacctcctgcctcagcatcccaagtagctgggattacaggcacccaccaccatgcccaactaatttttgtatttttatagagatagggtttcaccgtgttggccaggctgatctcgaactcctgaccgcaagtgatccacccg

SEQ ID NO: 195123 - DNA, 2949 bp, Homo sapiens
  Payload ID: 18523
  Gene Name: tripartite motif containing 6
  ENST ID: ENST00000618326
  CDS Start-End: 153-1340
ggagcagagtcgtgcgtggttgagtttagataaaagccgagtgagcgcgctctgttccttaagattagtttaaggtgccttggattgctctgaagagctttgaccacctgatattgcttacatctggaacttcttggcttctcattccccagatgtgcgggtcagagagaccatggagaaaaactgcagctcttctgtcaggaggatgggaaggtcatttgctggcttgtgagcggtctcaggagcaccgtggtcaccacacgttcctcgtggaggaggttgcccaggagtaccaggagaagtttcaggagtctctaaagaagctgaagaacgaggagcaggaagctgagaagctaacagcttttatcagagagaagaaaacatcctggaagaatcagatggagcctgagagatgcaggatccagacagagtttaatcagctgcgaaatatcctagacagagtggagcaacgggagctgaaaaagctggaacaggaagagaagaaggggctacgaattatagaagaggctgagaatgatctggtccaccagacccagtcgctgcgagagctcatctcggatctggagcgtcgatgtcaggggtcaacaatggagctgctgcaggatgtgagtgatgtcacagaaaggagtgagttctggaccctgaggaagccagaagctctccctacaaagctgagaagtatgttccgagccccagatctgaaaaggatgctgcgagtgtgtagagagctgacagatgtccaaagctactgggttgacgtgaccctgaatccacacacagctaatttaaatcttgtcctggctaaaaaccggagacaagtgaggtttgtgggagctaaagtatctggaccttcctgtctggaaaagcattatgactgtagtgtcctgggctcccagcacttctcctctggtaagcattactgggaggtagatgtggccaagaagactgcctggatcctgggggtatgcagcaattcactgggacctacattctctttcaaccattttgctcaaaatcacagtgcttactccaggtatcagcctcagagtggatactgggtgattgggttacagcataaccatgaatatagggcctatgaggattcttccccttccctgcttctctccatgacagtgccccctcgccgtgttggggttttcttagattatgaggctggtactgtctccttttataatgtcacaaaccatggcttccccatctacactttctctaaatattactttcccactactctttgtccatattttaatccttgcaactgtgtaattcctatgaccctgcgtcgtccaagctcttgaatattcttctgttcccacccacttctgataagtaccctgaggcttatcagcatgtgattctcccttctgatcttctgtttttctgtgttctcaattcttttgttgttttttggtttttgaatcttttttgagatggaatctcgctctgtcgcccaggctggagtgcactggcgcaatctcggctcactgcaacctctgcctcctgggttcaagcgaacctcctgcctcagcatcccaagtagctgggattacaggcacccaccaccatgcccaactaatttttgtatttttatagagatagggtttcaccgtgttggccaggctgatctcgaactcctgaccgcaagtgatccacccgcctcggtctcccaaagtgctgggattacagatgtgagccgccgcgcccagacagttctttcgttttaaacagttactcagtactaggatgcacccagtggtgagagtaagcatctttgactgatgacaggtcttgaggtggatagggggcgctttcagtattttgccattaagcatagtatttgatgcaggttttttttgattgatgcaggggatcaaatttaggaagttctgatctgttaatttactacaagtttttgtataaaatgaaaactcgtattctacctatgtcttttctgtaaattattgagacaattgtgtatcatttttgttctgttaatgtggcttagtacattgatttacttcaatttgttaccacaacttgctgaaatacaccattattatttgttgtatgcaatactggatttattttgataacgtattgtttagattttgttctcatctatgttaatgaaagaaattggcctgtatttttacattcttgtaatatctttgccaggttctataaaatgcaataataagcaaataaattactttgtttttgtataagtatgtataggattgagctctaaaaccaaaccattataatgataatttgggtagcttcaaactcaaattgaagagagtcttcactacaatcttcactacaacctttggccttcctctctacatttaagagtagcaatagaacaataaaaaaaaatacgtctttcaaattaattgcagtaaaaacaaaagagtagtggggagagaaaaacaatccaatacatatttttctctcagaatagaaagaaaacacaaagagaaaatatgaacaatataaagcacttaaaggaagaggatgatttcttccagcttttccacactctctttatgcgcaggaacaaacagctgttgagtgagctgctatgactttggtagagaggtgcaatatgttttttgaaccagctataaaagaaattaagaggtacatgtgagggtagaaacaaatatcaaggatgagaatggcactggctgtcccatatggtatccaggagccaccaatgtctgttgagtacttcatacatgcctagtctgaattgagatgtgctcaatgtataaaatatataccagatttcaaatacctacttcaaaaaataatgtaaaatatctcactaataacttttcctttgtgtattgcaatgataatatgttggctctattggattaaataaagtatgttattcatttt

SEQ ID NO: 195124 - DNA, 3005 bp, Homo sapiens
  Payload ID: 18523
  Gene Name: tripartite motif containing 6
  ENST ID: ENST00000621176
  CDS Start-End: 1-1389
atgacttcaccagtactggtggacatacgagaagaggtgacctgccctatctgcctggagctcctaacagaacccctgagcatagactgtggccacagcttctgccaagcctgcatcacaccaaatggcagggaatcagtgattggtcaagaaggggaaagaagctgccctgtgtgccagaccagctaccagccagggaacctgcggcctaatcggcatctggccaacatagtgaggcggctcagagaggaggatgggaaggtcatttgctggctttgtgagcggtctcaggagcaccgtggtcaccacacgttcctcgtggaggaggttgcccaggagtaccaggagaagtttcaggagtctctaaagaagctgaagaacgaggagcaggaagctgagaagctaacagcttttatcagagagaagaaaacatcctggaagaatcagatggagcctgagagatgcaggatccagacagagtttaatcagctgcgaaatatcctagacagagtggagcaacgggagctgaaaaagctggaacaggaagagaagaaggggctacgaattatagaagaggctgagaatgatctggtccaccagacccagtcgctgcgagagctcatctcggatctggagcgtcgatgtcaggggtcaacaatggagctgctgcaggatgtgagtgatgtcacagaaaggagtgagttctggaccctgaggaagccagaagctctccctacaaagctgagaagtatgttccgagccccagatctgaaaaggatgctgcgagtgtgtagagagctgacagatgtccaaagctactgggttgacgtgaccctgaatccacacacagctaatttaaatcttgtcctggctaaaaaccggagacaagtgaggtttgtgggagctaaagtatctggaccttcctgtctggaaaagcattatgactgtagtgtcctgggctcccagcacttctcctctggtaagcattactgggaggtagatgtggccaagaagactgcctggatcctgggggtatgcagcaattcactgggacctacattctctttcaaccattttgctcaaaatcacagtgcttactccaggtatcagcctcagagtggatactgggtgattgggttacagcataaccatgaatatagggcctatgaggattcttccccttccctgcttctctccatgacagtgccccctcgccgtgttggggttttcttagattatgaggctggtactgtctccttttataatgtcacaaaccatggcttccccatctacactttctctaaatattactttcccactactctttgtccatattttaatccttgcaactgtgtaattcctatgaccctgcgtcgtccaagctcttgaatattcttctgttcccacccacttctgataagtaccctgaggcttatcagcatgtgattctcccttctgatcttctgtttttctgtgttctcaattcttttgttgttttttggtttttgaatcttttttgagatggaatctcgctctgtcgcccaggctggagtgcactggcgcaatctcggctcactgcaacctctgcctcctgggttcaagcgaacctcctgcctcagcatcccaagtagctgggattacaggcacccaccaccatgcccaactaatttttgtatttttatagagatagggtttcaccgtgttggccaggctgatctcgaactcctgaccgcaagtgatccacccgcctcggtctcccaaagtgctgggattacagatgtgagccgccgcgcccagacagttctttcgttttaaacagttactcagtactaggatgcacccagtggtgagagtaagcatctttgactgatgacaggtcttgaggtggatagggggcgctttcagtattttgccattaagcatagtatttgatgcaggttttttttgattgatgcaggggatcaaatttaggaagttctgatctgttaatttactacaagtttttgtataaaatgaaaactcgtattctacctatgtcttttctgtaaattattgagacaattgtgtatcatttttgttctgttaatgtggcttagtacattgatttacttcaatttgttaccacaacttgctgaaatacaccattattatttgttgtatgcaatactggatttattttgataacgtattgtttagattttgttctcatctatgttaatgaaagaaattggcctgtatttttacattcttgtaatatctttgccaggttctataaaatgcaataataagcaaataaattactttgtttttgtataagtatgtataggattgagctctaaaaccaaaccattataatgataatttgggtagcttcaaactcaaattgaagagagtcttcactacaatcttcactacaacctttggccttcctctctacatttaagagtagcaatagaacaataaaaaaaaatacgtctttcaaattaattgcagtaaaaacaaaagagtagtggggagagaaaaacaatccaatacatatttttctctcagaatagaaagaaaacacaaagagaaaatatgaacaatataaagcacttaaaggaagaggatgatttcttccagcttttccacactctctttatgcgcaggaacaaacagctgttgagtgagctgctatgactttggtagagaggtgcaatatgttttttgaaccagctataaaagaaattaagaggtacatgtgagggtagaaacaaatatcaaggatgagaatggcactggctgtcccatatggtatccaggagccaccaatgtctgttgagtacttcatacatgcctagtctgaattgagatgtgctcaatgtataaaatatataccagatttcaaatacctacttcaaaaaataatgtaaaatatctcactaataacttttcctttgtgtattgcaatgataatatgttggctctattggattaaataaagtatgttattcattttacctgtt

SEQ ID NO: 195125 - DNA, 1867 bp, Homo sapiens
  Payload ID: 18524
  Gene Name: tripartite motif containing 60
  Uniprot ID: Q495X7
  ENST ID: ENST00000341062
  CDS Start-End: 196-1611
tcttttctcatccacagggatgaccgctgtattataacctgtggctagtttattgaagaagaaaatcattacacttagattcagacgggctcggccgggcgcggtggctcacgcctgtaatcccagcactttgggaggccgaggcgggtggatcatgaggtcaggagatcgagaccatcctggctaacaagctcgatggagtttgtgacagccctggtgaacctccaagaggagtctagctgtcccatctgtctggagtacttgaaagacccagtgaccatcaactgtgggcacaacttctgtcgctcctgcctcagtgtatcctggaaggatctagatgatacctttccctgtcctgtctgccgtttttgctttccatacaagagcttcaggaggaacccccagctccgtaatttgactgaaattgctaaacaactccagattaggaggagcaagagaaagaggcagaaagagaatgccatgtgtgaaaaacacaaccagtttctgaccctcttctgtgttaaagatctagagatcttatgtacacagtgcagtttctccactaaacaccagaagcactacatttgccctattaagaaagctgcctcttatcacagagaaattctagaaggtagccttgagcccttgaggaataatatagaacgagttgaaaaagtgataattctgcaaggcagcaaatcagtggagctgaaaaagaaggtagaatataagagggaagaaataaattctgagtttgagcaaataagattgtttttacagaatgaacaagagatgattcttaggcagatacaagatgaagagatgaacattttagcaaaactaaatgaaaaccttgtagaactttcagattatgtttccacattaaaacatctactgagggaggtagagggcaagtctgtgcagtcaaacctggaattactgacacaagctaagagtatgcaccacaagtatcaaaacctaaaatgccctgaactcttttcatttagattaacaaaatatggtttcagtcttcctcctcaatattctggcttggacagaattatcaagccatttcaagtagatgtgattctagatctcaacacagcacatcctcaacttcttgtctctgaggatagaaaagctgtgcgatatgaaagaaaaaaacgaaacatttgttatgacccaaggagattttatgtctgccctgctgtcctaggctctcagagatttagttctggccgacattactgggaagtagaagtgggaaacaaacctaaatggatattgggtgtgtgtcaagactgtcttcttaggaactggcaggatcagccatcagttctgggcggattctgggcaattgggcgatacatgaagagtggttatgttgcgtcaggtcctaagacaacccagcttctgccagtagtaaaacccagtaaaattggtatttttctggactatgaattgggtgatctttccttttataatatgaatgataggtctattctctatacttttaacgattgtttcacagaagccgtttggccttatttctatactggaacagattccgaacctcttaaaatctgctcagtatcagattctgaaagataaggaactggtaaatgggtctgtttcagtttttgtaggtaacttagccagtaaatttaatctcatttctggactctttaagttttaccactgaaaaccagagtcgatttttctcctaaatttttggcaactataagatgttcataatgccactttcatatattctatgaatatcaattgtcaggtgctttgatttctaagataaaatattttagaattatgttacttaacatgtccaataaaatgttttcaaattgcc

SEQ ID NO: 195126 - DNA, 1888 bp, Homo sapiens
  Payload ID: 18524
  Gene Name: tripartite motif containing 60
  Uniprot ID: Q495X7
  ENST ID: ENST00000512596
  CDS Start-End: 217-1632
acttccggtggagcagccaaccaccgcgctggtcaattgtatgcctaaaactcgaaaaccaaggcgcccagggttgtgtgagggtttccgctctgcgccccgcggggttccatgggtcctgcacagcatcaggcctgagccgccggtccaactgctccaggtcatcagtttgccccatcattggttaaggtggtattctctacattataaagctcgatggagtttgtgacagccctggtgaacctccaagaggagtctagctgtcccatctgtctggagtacttgaaagacccagtgaccatcaactgtgggcacaacttctgtcgctcctgcctcagtgtatcctggaaggatctagatgatacctttccctgtcctgtctgccgtttttgctttccatacaagagcttcaggaggaacccccagctccgtaatttgactgaaattgctaaacaactccagattaggaggagcaagagaaagaggcagaaagagaatgccatgtgtgaaaaacacaaccagtttctgaccctcttctgtgttaaagatctagagatcttatgtacacagtgcagtttctccactaaacaccagaagcactacatttgccctattaagaaagctgcctcttatcacagagaaattctagaaggtagccttgagcccttgaggaataatatagaacgagttgaaaaagtgataattctgcaaggcagcaaatcagtggagctgaaaaagaaggtagaatataagagggaagaaataaattctgagtttgagcaaataagattgtttttacagaatgaacaagagatgattcttaggcagatacaagatgaagagatgaacattttagcaaaactaaatgaaaaccttgtagaactttcagattatgtttccacattaaaacatctactgagggaggtagagggcaagtctgtgcagtcaaacctggaattactgacacaagctaagagtatgcaccacaagtatcaaaacctaaaatgccctgaactcttttcatttagattaacaaaatatggtttcagtcttcctcctcaatattctggcttggacagaattatcaagccatttcaagtagatgtgattctagatctcaacacagcacatcctcaacttcttgtctctgaggatagaaaagctgtgcgatatgaaagaaaaaaacgaaacatttgttatgacccaaggagattttatgtctgccctgctgtcctaggctctcagagatttagttctggccgacattactgggaagtagaagtgggaaacaaacctaaatggatattgggtgtgtgtcaagactgtcttcttaggaactggcaggatcagccatcagttctgggcggattctgggcaattgggcgatacatgaagagtggttatgttgcgtcaggtcctaagacaacccagcttctgccagtagtaaaacccagtaaaattggtatttttctggactatgaattgggtgatctttccttttataatatgaatgataggtctattctctatacttttaacgattgtttcacagaagccgtttggccttatttctatactggaacagattccgaacctcttaaaatctgctcagtatcagattctgaaagataaggaactggtaaatgggtctgtttcagtttttgtaggtaacttagccagtaaatttaatctcatttctggactctttaagttttaccactgaaaaccagagtcgatttttctcctaaatttttggcaactataagatgttcataatgccactttcatatattctatgaatatcaattgtcaggtgctttgatttctaagataaaatattttagaattatgttacttaacatgtccaataaaatgttttcaaattgcc

SEQ ID NO: 195127 - DNA, 389 bp, Homo sapiens
  Payload ID: 18524
  Gene Name: tripartite motif containing 60
  ENST ID: ENST00000507119
  CDS Start-End: 118-389
aaactcgaaaaccaaggcgcccagggttgtgtgagggtttccgctctgcgccccgcggggttccatgggtcctgcacagcatcaggcctgagccgccggtccaactgctccagctcgatggagtttgtgacagccctggtgaacctccaagaggagtctagctgtcccatctgtctggagtacttgaaagacccagtgaccatcaactgtgggcacaacttctgtcgctcctgcctcagtgtatcctggaaggatctagatgatacctttccctgtcctgtctgccgtttttgctttccatacaagagcttcaggaggaacccccagctccgtaatttgactgaaattgctaaacaactccagattaggaggagcaagagaaagaggca

SEQ ID NO: 195128 - DNA, 1674 bp, Homo sapiens
  Payload ID: 18524
  Gene Name: tripartite motif containing 60
  Uniprot ID: Q495X7
  ENST ID: ENST00000508504
  CDS Start-End: 234-1649
caggtcatcagtttgccccatcattggttaaggtggtattctctacattataaagggatgaccgctgtattataacctgtggctagtttattgaagaagaaaatcattacacttagattcagacgggctcggccgggcgcggtggctcacgcctgtaatcccagcactttgggaggccgaggcgggtggatcatgaggtcaggagatcgagaccatcctggctaacaagctcgatggagtttgtgacagccctggtgaacctccaagaggagtctagctgtcccatctgtctggagtacttgaaagacccagtgaccatcaactgtgggcacaacttctgtcgctcctgcctcagtgtatcctggaaggatctagatgatacctttccctgtcctgtctgccgtttttgctttccatacaagagcttcaggaggaacccccagctccgtaatttgactgaaattgctaaacaactccagattaggaggagcaagagaaagaggcagaaagagaatgccatgtgtgaaaaacacaaccagtttctgaccctcttctgtgttaaagatctagagatcttatgtacacagtgcagtttctccactaaacaccagaagcactacatttgccctattaagaaagctgcctcttatcacagagaaattctagaaggtagccttgagcccttgaggaataatatagaacgagttgaaaaagtgataattctgcaaggcagcaaatcagtggagctgaaaaagaaggtagaatataagagggaagaaataaattctgagtttgagcaaataagattgtttttacagaatgaacaagagatgattcttaggcagatacaagatgaagagatgaacattttagcaaaactaaatgaaaaccttgtagaactttcagattatgtttccacattaaaacatctactgagggaggtagagggcaagtctgtgcagtcaaacctggaattactgacacaagctaagagtatgcaccacaagtatcaaaacctaaaatgccctgaactcttttcatttagattaacaaaatatggtttcagtcttcctcctcaatattctggcttggacagaattatcaagccatttcaagtagatgtgattctagatctcaacacagcacatcctcaacttcttgtctctgaggatagaaaagctgtgcgatatgaaagaaaaaaacgaaacatttgttatgacccaaggagattttatgtctgccctgctgtcctaggctctcagagatttagttctggccgacattactgggaagtagaagtgggaaacaaacctaaatggatattgggtgtgtgtcaagactgtcttcttaggaactggcaggatcagccatcagttctgggcggattctgggcaattgggcgatacatgaagagtggttatgttgcgtcaggtcctaagacaacccagcttctgccagtagtaaaacccagtaaaattggtatttttctggactatgaattgggtgatctttccttttataatatgaatgataggtctattctctatacttttaacgattgtttcacagaagccgtttggccttatttctatactggaacagattccgaacctcttaaaatctgctcagtatcagattctgaaagataaggaactggtaaatgggtctgtttca

SEQ ID NO: 195129 - DNA, 1582 bp, Homo sapiens
  Payload ID: 18525
  Gene Name: tripartite motif containing 61
  Uniprot ID: Q5EBN2
  ENST ID: ENST00000329314
  CDS Start-End: 614-1243
aactgccaaccaccgcgcaggctgagccccaggcaggaagcagcccacttggtggggttggggtatgagtccttcctcgcgggggctcggtgggtcctgagtattctttggccggatttgctgatccgtctgctccagcataggttcacaaagtacagtccgcaggccagcagcatcatctgggaacttaggaaaaaaccagccctactgagtcagaaactggggatgtggcccaggcaatcttttaccaagacctccaggtgattataatgcaaggaaggattccctatcttggacctgaggctgctttcttgaagaaaacttgactttatttcatttagtgggaagagcagcagcccagctattaagttctaatatgcaataggctgcaggctgtgaagtgttcgtggcagtagactctgaagctaaggagctgagggcttaacaagtttctagaagctgccatcaacatgccaagtcagtaaaactgatagttgatcagatttcaaggtctggggagtatatccactgtgtactgggtcttgagctctagagagctaggccttgctaaaataaaagaattaccttacctaccatctttgttcaagtctcaatggaatttgttacggccctggctgacctccgagcagaggctagctgtcccatctgtctggactacttgaaagacccagtgaccatcagctgtgggcataacttctgtctctcctgcatcattatgtcctggaaggatctacatgatagtttcccctgccccttttgccacttttgctgtccagaaaggaaatttataagcaatccccagctgggtagtttgactgaaattgctaagcaactccagataagaagcaagaagaggaagaggcaggaagagaagcatgtgtgtaagaagcataatcaggttttgactttcttctgtcagaaagacctagagcttttatgtccaaggtgcagtttgtccactgatcaccagcatcactgtgtttggcccataaagaaggctgcctcctatcataggaaaaaactggaggaatacaatgcaccgtggaaggagagagtggaactaattgaaaaagtcataactatgcaaaccaggaaatcactggaactgaagaaaaagatggagtctccttctgtcaccaggctggagtgcagttgcacgatctcggctcacttcaacctccgcctcccgggatcaagcgattcttctgcctctggctcctgagtagctgggactacagagatggttgcccaggctggtctggaactcctgacctcaagcgatcttcctgccttgacctcccaaagtgctgggattatagccatgctgccaaccatgtgtagggtatgtatatgttcctataccataataaaattttaattacatttgtaaggtatgtaattatatgtatttctgtataatatgtacatataaatatgctaattaatacaagaacatattgaattataatcaatatatataattttagatgtatattggaatgtttatctttctaataatacaaaactgatggttaaaaaataaaatgcacaaactccccaa

SEQ ID NO: 195130 - DNA, 630 bp, Homo sapiens
  Payload ID: 18525
  Gene Name: tripartite motif containing 61
  Uniprot ID: Q5EBN2
  ENST ID: ENST00000616332
  CDS Start-End: 1-630
atggaatttgttacggccctggctgacctccgagcagaggctagctgtcccatctgtctggactacttgaaagacccagtgaccatcagctgtgggcataacttctgtctctcctgcatcattatgtcctggaaggatctacatgatagtttcccctgccccttttgccacttttgctgtccagaaaggaaatttataagcaatccccagctgggtagtttgactgaaattgctaagcaactccagataagaagcaagaagaggaagaggcaggaagagaagcatgtgtgtaagaagcataatcaggttttgactttcttctgtcagaaagacctagagcttttatgtccaaggtgcagtttgtccactgatcaccagcatcactgtgtttggcccataaagaaggctgcctcctatcataggaaaaaactggaggaatacaatgcaccgtggaaggagagagtggaactaattgaaaaagtcataactatgcaaaccaggaaatcactggaactgaagaaaaagatggagtctccttctgtcaccaggctggagtgcagttgcacgatctcggctcacttcaacctccgcctcccgggatcaagcgattcttctgcctctggctcctga

SEQ ID NO: 195131 - DNA, 3437 bp, Homo sapiens
  Payload ID: 18526
  Gene Name: tripartite motif containing 62
  Uniprot ID: Q9BVG3
  ENST ID: ENST00000291416
  CDS Start-End: 235-1662
ccactacctctagactgccctcccgggctggcgtcccacggagtctcagccgcgcaccccttcctcgcgttaccctccttccggacagcaccccctcccttctccggtagctcctacccctgcctgtgcgggcctcgtccccgcgcccagccctcggtgctgcctccgacagcgccgcgctctctcagccgcccccctgcccctcgggcccccctctctgctgcccctggcgccatggcgtgcagcctcaaggacgagctgctgtgctccatctgcctgagcatctaccaggacccggtgagcctgggctgcgagcattacttctgccgccgctgcatcacggagcactgggtgcggcaggaggcgcagggcgcccgcgactgccccgagtgccggcgcacgttcgccgagcccgcgctggcgcccagcctcaagctggccaacatcgtggagcgctacagctccttcccgctggacgccatcctcaacgcgcgccgcgccgcgcgaccctgccaggcgcacgacaaggtcaagctcttctgcctcacggaccgcgcgcttctctgcttcttctgcgacgagcctgcactgcacgagcagcatcaggtcaccggcatcgacgacgccttcgacgagctgcagagggagctgaaggaccaacttcaggcccttcaagacagcgagcgggaacacaccgaagcgctgcagctgctcaagcgacaactggcggagaccaagtcttccaccaagagcctgcggaccactatcggcgaggccttcgagcggctgcaccggctgctgcgtgaacgccagaaggccatgctagaggagctggaggcggacacggcccgcacgctgaccgacatcgagcagaaagtccagcgctacagccagcagctgcgcaaggtccaggagggagcccagatcctgcaggagcggctggctgaaaccgaccggcacaccttcctggctggggtggcctcactgtccgagcggctcaagggaaaaatccatgagaccaacctcacatatgaagacttcccgacctccaagtacacaggccccctgcagtacaccatctggaagtccctgttccaggacatccacccagtgccagccgccctaaccctggacccgggcacagcccaccagcgcctgatcctgtcggacgactgcaccattgtggcttacggcaacttgcacccacagccactgcaggactcgccaaagcgcttcgatgtggaggtgtcggtgctgggttctgaagccttcagtagtggcgtccactactgggaggtggtggtggcggagaagacccagtgggtgatcgggctggcacacgaagccgcaagccgcaagggcagcatccagatccagcccagccgcggcttctactgcatcgtgatgcacgatggcaaccagtacagcgcctgcacggagccctggacgcggcttaacgtccgggacaagcttgacaaggtgggtgtcttcctggactatgaccaaggcttgctcatcttctacaatgctgatgacatgtcctggctctacaccttccgcgagaagttccctggcaagctctgctcttacttcagccctggccagagccacgccaatggcaagaacgttcagccgctgcggatcaacaccgtccgcatctagtccaggcagaaggagaccacaacctcctgggaccactgccacctgcaagagccctgcccaggagatagaagacctggactccagcccaccgtggccactggagacctcaggccagttgtttaccctccagcctccagtctgtaaaatggaggttgcattccctacttcctaaactctcttccagcatcgatgttctgtagctctgaccttgatagggatacagctttgatccaaggatgtgacatggcttctcctcagggcaacccctgcccaaccctcatccccatcttctcaggggcaggggactaccttccagtgtctccctccagcccagccctgacctcaggaagtgtcagagcatggccagtagttggcagcccgaaagacacacagcaccctcttatgtcccatggcctaagacttacccctgaccaagctagtgatgggccatttacccttgaccccagtccacagtggtcacaggtagtacctggtcctagggttgcctgagagccaacctctcctgccacccccacaccaagaactatatggttcctacttctcccactgatctgctggtcagtgatgatgctgtggcctgtggaaggcacctggtagttgagtccacacattatagtcatgtgccaccaccttcctgcccacaggccgagggacagggtgagggtatacccaaagctgatgcagagcccattagcctaaaagcaactgcaggacaagcctccctggatgatcgaggtccccagtagctctgaacaagagtccagccaaccctcttcagccaggcctctgtgacctgctagggtgcaggaggcttccagaagcagttgttgtaattaggacccaagcactgggaggggctgttggctggaccccttgtcagacttggcatctatctcagttaggatcctgctgcagaaaacaagagccacttgtagctggtttaattagacaaggatttactacctggcccctggtggcttgcaaaattgttggaagagctggagaagcagactctgctgaatttccaggaactcccagcgccagattcatcatgtctgttgtgaccaggaaagctgcccccatctgcaggaagccactatgccagaaagctgctgactgcagaactaggctccctctgccacggtccgtgccagccaatagatgtcctgaggcctgcccctctcccacttcactcagttcccaaatctaaatttttacaagagattctgtttgggggaacttaagtcagatccagaaccttggctgcaagggagtctgggaaatgtcatttccctagaaggaagttagggtgggtggagcaagccccacctgcgtttttctgccacagcatccaatcgtgaagaactcgggagagggtggagtccacatctagggttgtcctgccccttggctctatccctgcccagaggtgggaactggaggagtgggctgcaagactgagcctaaatgtctccccggccttgacttttctttctagtcctggggcctagattctgcacttggggtctctgacacaacacaccatcccaaagtagccggaagagctaaacacagggggttcttaaaatggctgcccccgccacccgggcctcccttgggcaaaaggaattgtcagccctaccccaacccttcaactaccagaatctgggccaccccagcagtatttttatttaaaatgttgcccattttatgagttatgatcaatttgtattaaattaaagttacagatgtca

SEQ ID NO: 195132 - DNA, 1638 bp, Homo sapiens
  Payload ID: 18526
  Gene Name: tripartite motif containing 62
  Uniprot ID: Q9BVG3
  ENST ID: ENST00000543586
  CDS Start-End: 99-1163
tctcaggttcctaacccccagagaggggatccgattcagtctcagccgccccctccaggcctcatgtgaccattggagcccttcccaaggcttccttcatgccagagaagacagcagtggatcagccttggacgcaagccctgagggagctgaaggaccaacttcaggcccttcaagacagcgagcgggaacacaccgaagcgctgcagctgctcaagcgacaactggcggagaccaagtcttccaccaagagcctgcggaccactatcggcgaggccttcgagcggctgcaccggctgctgcgtgaacgccagaaggccatgctagaggagctggaggcggacacggcccgcacgctgaccgacatcgagcagaaagtccagcgctacagccagcagctgcgcaaggtccaggagggagcccagatcctgcaggagcggctggctgaaaccgaccggcacaccttcctggctggggtggcctcactgtccgagcggctcaagggaaaaatccatgagaccaacctcacatatgaagacttcccgacctccaagtacacaggccccctgcagtacaccatctggaagtccctgttccaggacatccacccagtgccagccgccctaaccctggacccgggcacagcccaccagcgcctgatcctgtcggacgactgcaccattgtggcttacggcaacttgcacccacagccactgcaggactcgccaaagcgcttcgatgtggaggtgtcggtgctgggttctgaagccttcagtagtggcgtccactactgggaggtggtggtggcggagaagacccagtgggtgatcgggctggcacacgaagccgcaagccgcaagggcagcatccagatccagcccagccgcggcttctactgcatcgtgatgcacgatggcaaccagtacagcgcctgcacggagccctggacgcggcttaacgtccgggacaagcttgacaaggtgggtgtcttcctggactatgaccaaggcttgctcatcttctacaatgctgatgacatgtcctggctctacaccttccgcgagaagttccctggcaagctctgctcttacttcagccctggccagagccacgccaatggcaagaacgttcagccgctgcggatcaacaccgtccgcatctagtccaggcagaaggagaccacaacctcctgggaccactgccacctgcaagagccctgcccaggagatagaagacctggactccagcccaccgtggccactggagacctcaggccagttgtttaccctccagcctccagtctgtaaaatggaggttgcattccctacttcctaaactctcttccagcatcgatgttctgtagctctgaccttgatagggatacagctttgatccaaggatgtgacatggcttctcctcagggcaacccctgcccaaccctcatccccatcttctcaggggcaggggactaccttccagtgtctccctccagcccagccctgacctcaggaagtgtcagagcatggccagtagttggcagcccgaaagacacacagcaccctcttatgtcccatggcctaagacttacccctgaccaagctagtgatgggccatttacccttgaccccagtccacagt

SEQ ID NO: 195133 - DNA, 1770 bp, Homo sapiens
  Payload ID: 18527
  Gene Name: tripartite motif containing 63, E3 ubiquitin protein ligase
  Uniprot ID: Q969Q1
  ENST ID: ENST00000374272
  CDS Start-End: 140-1201
gacagaattcgggcaccaggagaaggaagccaacaggatccgacccggtgttttgtgacaaaggcaagacccccaggtctacttagagcaaagttagtagaggaggcagctaggcgtggctctcattccttcccacagaatggattataagtcgagcctgatccaggatgggaatcccatggagaacttggagaagcagctgatctgccctatctgcctggagatgtttaccaagccagtggtcatcttgccgtgccagcacaacctgtgccggaagtgtgccaatgacatcttccaggctgcaaatccctactggaccagccggggcagctcagtgtccatgtctggaggccgtttccgctgccccacctgccgccacgaggtgatcatggatcgtcacggagtgtacggcctgcagaggaacctgctggtggagaacatcatcgacatctacaaacaggagtgctccagtcggccgctgcagaagggcagtcaccccatgtgcaaggagcacgaagatgagaaaatcaacatctactgtctcacgtgtgaggtgcccacctgctccatgtgcaaggtgtttgggatccacaaggcctgcgaggtggccccattgcagagtgtcttccagggacaaaagactgaactgaataactgtatctccatgctggtggcggggaatgaccgtgtgcagaccatcatcactcagctggaggattcccgtcgagtgaccaaggagaacagtcaccaggtaaaggaagagctgagccagaagtttgacacgttgtatgccatcctggatgagaagaaaagtgagttgctgcagcggatcacgcaggagcaggagaaaaagcttagcttcatcgaggccctcatccagcagtaccaggagcagctggacaagtccacaaagctggtggaaactgccatccagtccctggacgagcctgggggagccaccttcctcttgactgccaagcaactcatcaaaagcattgtggaagcttccaagggctgccagctggggaagacagagcagggctttgagaacatggacttctttactttggatttagagcacatagcagacgccctgagagccattgactttgggacagatgaggaagaggaagaattcattgaagaagaagatcaggaagaggaagagtccacagaagggaaggaagaaggacaccagtaaggagctggatgaatgagaggcccccagatgcagagagactggagagggtggggaggggcccagcggccttggtgacaggcccagggtgggaggggtcggggcccctggaggggcaatggggaggtgatgtcttctctctgctcagagagcagggactagggtaggaccctcaccgctgcgtccagcagacactgaaccagaattggaaacgtgcttgaaacaatcacacaggacacttttctacattggtgcaaaatggaatattttgtacatttttaaaatgtgatttttgtatatacttgtatatgtatgccaatttggtgctttttgtaaaggaacttttgtataataatgcctggtcgttgggtgacctgcgattgtcagaaagaggggaaggaagccaggttgatacagctgcccacttcctttcctgagcaggaggatggggtagcactcacagggacgatgtgctgtatttcagtgcctatcccagacatacggggtggtaactgagtttgtgttatatgttgttttaataaatgcacaatgctctcttcctgttcttcaaa

SEQ ID NO: 195134 - DNA, 2691 bp, Homo sapiens
  Payload ID: 18528
  Gene Name: tripartite motif containing 64
  Uniprot ID: A6NGJ6
  ENST ID: ENST00000533122
  CDS Start-End: 3-1352
acatggattcagacgacctgcaagtcttccagaatgagctcatttgctgcatttgcgtgaactacttcatagatccggtcaccattgactgtgggcacagcttttgcaggccctgcctctgcctctgctcagaagaaggcagagcaccaatgcgctgcccttcgtgcagaaaaatctcagagaagcccaacttcaacaccaatgtggtactcaaaaagctgtcttccctagccagacagaccagacctcagaacatcaacagctcagacaatatctgtgtgctccatgaggagactaaggagctcttctgtgaggctgacaagagattgctctgtgggccctgctctgagtcaccagagcacatggctcacagccacagcccaataggatgggctgctgaggaatgcagggagaaacttataaaggaaatggactatttatgggaaatcaatcaagagacaagaaacaatctaaatcaggaaactagaacatttcattcgttaaaggactatgtgtcagtaaggaagaggataatcactattcaatatcaaaagatgcctatatttctcgatgaggaggagcaacggcatctgcaggcactggaaagagaagcagaagagcttttccaacaactacaagacagtcaagtgagaatgacccaacatttagaaaggatgaaagacatgtacagagagctgtgggagacatgccacgtgcctgacgtggagctgctccaggatgtgagaaatgtatcagcaaggactgatttggcacagatgcaaaagccccagccagtgaacccagagctcacttcatggtgcataactggagtcctagacatgctcaacaacttcagagtggatagtgctctgagcacggaaatgattccttgctatataagcctttctgaggatgtgagatatgtgatatttggagatgaccatctcagtgctcccacggatccccagggagtggacagctttgctgtgtggggagcgcaagcattcacctccggcaagcattactgggaggtggatgtgaccctctcctccaactggattctgggagtctgtcaagattccaggactgcagatgccaatttcgttattgattctgatgaaagattttttttaatttcctcaaagaggagcaatcactatagtctctccaccaactctccacctttaattcagtatgtgcaaaggcctctgggtcaagttggggtgtttctggattatgataatggatctgtgagtttttttgatgtttctaaaggttctcttatctatggttttcctccttcctccttctcttcccctctgaggcctttcttttgctttggttgtacatgaaaagttggtttcacgatgatttattgtgacctcccacatatgaggcaaatactgtcctaagacactatgtgcgagagcctgtgagctcattgtaacttcatggaatgtaattactatgtggttatgaatgggataaccaccttgaatgtgtacttttgttaattaaattattttaattaataagttattgtggaatctttactagaacatcaataatggttttttcgtactagttttgttgagattcattcatttactgtaaaagtcatgttctaatgtatttaattcagatattgttagtatatcacacttgagcagccatcagagctctctactacctgtgaacttttatcacttccagaagaatcccaatacacattaacattaattctccttttaccctcccccattccttgacagcacttaatctactttttatgtttttgcattcaggtaaataaaatcatacaatgtaagttctttttttaatctgatttctttttcagagagtatgttttcagtttgtacacactgtaaaccatttgtcttagtcgtatatttcaaccaggctggggtagaataatgaagtggtggatatctcatcttacaaagaataaaaggagtgctttttttctttttaagtctgagcaagttaggttgacctcacagactttattatgtctcaacaacctagttattaatcacatttcagctcatacaacagtttttcagtgctgggttgctctgctgttacatcttctctgaatatattatatcaggttataatattaagaaaactcttatacttattactaccagattgaaaagtccaagggggcaatggcagtatttgtcttctttgctaatatattacaattattcaatgcaatttttagaatagattacacagtaaataagatgagtaaatggataagtagaggagttaacatgtataaatactattctaacattaagaaacttttccaaaatataagtaacaaaataggacagaacatactaatgaatatctatcaaaagataagaaataaattgattttcagattcatatcaaagataacactattatgttggggtttaaaataattgtagcataatttttacagggttgatttcaattgtcttaggttttttcatataaactatggaaagaggaaggttcctatataagatgatggggaacaggaacaggacttagaataatggaggctgtccttatttaaactgacatataattacttgctaagcataaagtggtataaaccttcttatgcagtagaaagaacaaactttggttacatttcaaataagaatccagatg

SEQ ID NO: 195135 - DNA, 2689 bp, Homo sapiens
  Payload ID: 18529
  Gene Name: tripartite motif containing 64B
  Uniprot ID: A6NI03
  ENST ID: ENST00000329862
  CDS Start-End: 1-1350
atggattcagacgacctgcaagtcttccagaatgagctcatttgctgcatttgcgtgaactacttcatagatccggtcaccattgactgtgggcacagcttttgcaggccctgcctctgcctctgctcagaagaaggcagagcaccaatgcgctgcccttcgtgcagaaaaacctcagagaagcccaacttcaacaccaatctggtactcaaaaagctgtcttccctagccagacagaccagacctcagaacatcaacagctcagacaatatctgtgtgctccatgaggagactaaggagctcttctgtgaggctgacaagagattgctctgtgggccctgctctgagtcaccagagcacatggctcacagccacagcccaataggatgggctgctgaggaatgcagggagaaacttataaaggaaatggactatttatgggaaatcaatcaagagacaagaaacaatctaaatcaggaaactagcacatttcattcgttaaaggactatgtgtcagtaaggaagaggataatcactattcaatatcaaaagatgcctatatttctcgatgaggaggagcaacggcatctgcaggcactggaaagagaagcagaagagcttttccaacaactacaagacagtcaagtgagaatgacccaacatttagaaaggatgaaagacatgtacagagagctgtgggagacatgccacatgcctgacgtggtgctgctccaggatgtgagaaatgtatcagcaaggactgatttggcacagatgcaaaagccccagccagtgaacccagagctcacttcatggtgcataactggagtcctagacatgctcaacaacttcagagtggatagtgctctgagcacggaaatgattccttgctatataagcctttctgaggatgtgagatatgtgatatttggagatgaccatctcagtgctcccacggatccccagggagtggacagctttgctgtgtggggagcgcaagcattcacctccggcaagcattactgggaggtggatgtgaccctctcctccaactggattctgggagtctgtcgagattccaggactgcagatgccaatttcgttattgattctgatgaaagattttttttaatttcctcaaagaggagcaatcactatagtctctccaccaactctccacctttaattcagtatgtgcaaaggcctctgggtcgagttggggtgtttctggattatgataatggatctgtgagtttttttgatgtttctaaaggttctcttatctatggttttcctccttcctccttctcttcccctctgaggcctttcttttgctttggttgtacatgaaaagttggtttcacgatgatttattgtgacctcccacatatgaggcaaatactgtcctaagacactatgtgcgagagcctgtgagctcattgtaacttcatggaatgtaattactatgtggttatgaatgggataaccaccttgaatgtgtacttttgttaattaaattattttaattaataagttattgtggaatctttactagaacatcaataatggtttttttgtactagttttgttgagattcattcatttactgtaaaagtcatgttctaatgtatttaattcagatattgttagtatatcacacttgagcagccatcagagctctctactacctgtgaacttttatcacttccagaagaatcccaatacacattaacattaattctccttttaccctcccccattccttgacagcacttaatctactttttatgtttttgcattcaggtaaataaaatcatacaatgtaagttctttttttaatctgatttctttttcagagagtatgttttcagtttgtacacactgtaaaccatttgtcttagtcgtatatttcaaccaggctggggtagaataatgaagtggtggatatctcatcttacaaagaataaaaagagtgctttttttctttttaagtctgagcaagttaggttgacctcacagactttattatgtctcaacaacctagttattaatcacatttcagctcatacaacagtttttcagtgctgggttgctctgctattacatcttctctgaatatattatatcaggttataatattaagaaaactcttatacttattactaccagattgaaaagtccaagggggcaatggcagtatttgtcttctttgctaatatattacaattattcaatgcaatttttagaatagattacacagtaaataagatgagtaaatggataagtagaggagttaacatgtataaatactattctaacattaagaaacttttccaaaatataagtaacaaaataggacagaacatactaatgaatatctatcaaaagataagaaataaattgattttcagattcatatcaaagataacactattatgttggggtttaaaataattgtagcataatttttacagggttgatttcaattgtcttaggttttttcatataaactatggaaagaggaaggttcctatataagatgatggggaacaggaacaggacttagaataatggaggctgtccttatttaaactgacatataattacttgctaagcataaagtggtataaaccttcttatgcagtagaaagaacaaactttggttacatttcaaataagaatccagatg

SEQ ID NO: 195136 - DNA, 1344 bp, Homo sapiens
  Payload ID: 18530
  Gene Name: tripartite motif containing 64C
  ENST ID: ENST00000530230
  CDS Start-End: 1-1344
atggattcagacaccctgcgagtcttccagaatgagctcatttgctgcatttgcgtgaactacttcatagacccggtcaccactgactgtgtgcacagcttttgcaggccctgcctctgcctctgctcagaagaaggcagagcaccaatgcgctgccctttgtgcagaaaaatctcagagaagcccaacttcaacaccaatgtggcactcaaaaagctggcttccctagccagacagaccagacctcagaacatcaacagctcagacaatatctgtgtgctccatgaggagactaaggagctcttctgtgaggctgacaagagattgctctgtgggccctgctctgagtcaccagagcacatggctcacagccacagcccaataggatgggctgctgaggaatgcagggtacagaaacttataaaggaaatggactatttatggaaaatcaatcaagagacacaaaacaatctaaatcaggaaactagcaaattttgttcattagtggaagacaaaagaaatagaatagtatatagatatcaaaagatgcatatatttctcgatgaggaggagcaacggcatctgcaggcactggaaagagaagcaaaagagcttttccaacaactacaagacagtcaagtgagaatgacccaacatttagaagggatgaaagacatgtacagagagctgtgggagacataccacatgcctgacgtggagctgctccaggatgtgggaaatatatcggcaagaactgatttggcacagatgccaaagccccagccagtgaacccagagctcacttcatggtgcataactggagtcctagacatgctcaacaacttcagagtggataatgctctgagtacagaaatgactccttgctatataagcctttctgaggatgtgagacgtgtgatatttggagatgaccatcgcagtgcacccatggatccccaaggagtggagagctttgctgtgtggtgtgcgcaagcattcacctccggcaagcattactgggaagtggatgtgacccactcctccaactggattctgggagtctgtcgagattctaggacagcagataccaatatagttattgattctgacaaaacatttttttcaatttcttcaaagacgagcaatcactatagtctctccaccaattctccacctttaatccagtatgtgcaaaggcctctgggttgggttggggtgtttctggattatgataatggatctgtgagtttttttgatgtttctaaaggttctcttatctatggttttcctccttcctccttctcttcccctctgaggcctttcttttgctttggttgtacatga

SEQ ID NO: 195137 - DNA, 1353 bp, Homo sapiens
  Payload ID: 18530
  Gene Name: tripartite motif containing 64C
  ENST ID: ENST00000617704
  CDS Start-End: 1-1353
atggattcagacaccctgcgagtcttccagaatgagctcatttgctgcatttgcgtgaactacttcatagacccggtcaccactgactgtgtgcacagcttttgcaggccctgcctctgcctctgctcagaagaaggcagagcaccaatgcgctgccctttgtgcagaaaaatctcagagaagcccaacttcaacaccaatgtggcactcaaaaagctggcttccctagccagacagaccagacctcagaacatcaacagctcagacaatatctgtgtgctccatgaggagactaaggagctcttctgtgaggctgacaagagattgctctgtgggccctgctctgagtcaccagagcacatggctcacagccacagcccaataggatgggctgctgaggaatgcagggtacagaaacttataaaggaaatggactatttatggaaaatcaatcaagagacacaaaacaatctaaatcaggaaactagcaaattttgttcattagtggactatgtgtcattaaggaaggtgataatcactattcagtatcaaaagatgcatatatttctcgatgaggaggagcaacggcatctgcaggcactggaaagagaagcaaaagagcttttccaacaactacaagacagtcaagtgagaatgacccaacatttagaagggatgaaagacatgtacagagagctgtgggagacataccacatgcctgacgtggagctgctccaggatgtgggaaatatatcggcaagaactgatttggcacagatgccaaagccccagccagtgaacccagagctcacttcatggtgcataactggagtcctagacatgctcaacaacttcagagtggataatgctctgagtacagaaatgactccttgctatataagcctttctgaggatgtgagacgtgtgatatttggagatgaccatcgcagtgcacccatggatccccaaggagtggagagctttgctgtgtggtgtgcgcaagcattcacctccggcaagcattactgggaagtggatgtgacccactcctccaactggattctgggagtctgtcgagattctaggacagcagataccaatatagttattgattctgacaaaacatttttttcaatttcttcaaagacgagcaatcactatagtctctccaccaattctccacctttaatccagtatgtgcaaaggcctctgggttgggttggggtgtttctggattatgataatggatctgtgagtttttttgatgtttctaaaggttctcttatctatggttttcctccttcctccttctcttcccctctgaggcctttcttttgctttggttgtacatga

SEQ ID NO: 195138 - DNA, 3439 bp, Homo sapiens
  Payload ID: 18531
  Gene Name: tripartite motif containing 65
  Uniprot ID: Q6PJ69
  ENST ID: ENST00000269383
  CDS Start-End: 67-1620
agcgcgcgaggcccgcggtccctttaagacgcccggggcccgcctggctctcgccgccgccgggccatggccgcgcagctgctggaggagaagctgacctgcgccatctgcctggggctctaccaggacccagtgacgctgccctgcggccacaacttctgcggggcctgcatccgggactggtgggaccgctgcggaaaggcgtgccccgagtgccgggagccctttcccgacggcgccgagctgcgccgcaacgtggccctcagcggcgtgctggaggtggtgcgcgccgggcccgcccgggatcccggccccgatcccggccccggccccgaccctgccgcgcgctgcccccgccacgggcggccgctggagctcttctgccggaccgagggccgctgtgtgtgcagcgtgtgcaccgtgcgcgagtgtcgcctccacgagcgggcgctgctggatgccgagcgcctcaagcgcgaggcccagctgagagccagcctggaggttacccagcagcaggccacccaggccgaaggccagctactagagctgcgcaagcaaagcagccagatccagaactcggcctgcatcttggcctcctgggtctccggcaagttcagcagcctgctacaggccctggaaatacagcacacgacagcactgaggagcatcgaggtggccaagacgcaggcgctggcacaggctcgagacgaggagcagcggctgcgggtccatttggaggctgtggctcgccatggctgcaggatccgggagctcctggagcaggtggatgagcagaccttcctgcaggaatcgcagctcctccagcccccagggcctcttgggccactgacccctctgcagtgggatgaagaccaacagctgggtgacctgaagcagttgctaagccggctgtgtggcctcctcttggaagaggggagccaccctggggcaccagccaagcctgtggacttagcccccgtggaggccccaggtcccctggcaccggtcccaagcacagtttgtccactgaggaggaaactctggcagaattatcgcaatctgacctttgatccagtcagcgccaaccgtcacttctatctgtcgcgccaggaccagcaggtgaagcactgtcgtcagtcccggggcccaggcgggcccggcagctttgagctctggcaggtgcaatgtgcccagagcttccaggccgggcaccactactgggaggtgcgcgcgtcagaccactcggtgacactgggcgtctcctacccgcaactgccacggtgcaggctggggccccacacagacaacattggccggggaccctgctcctgggggctctgcgtccaggaggacagcctccaggcctggcacaacggggaagcccagcgcctcccaggggtgtcagggcggctcctgggcatggatttggacctggcctcaggctgcctcaccttctacagcctggagccccagacccagcccctgtacaccttccatgccctcttcaaccagcccctcacccccgtcttctggctcctcgagggtaggaccctgaccctgtgccatcagccaggggctgtgttccctctggggccccaggaagaggtgctcagctgaagaaggcatgggatggagccctggcatagctgccaccatgcctatgtgcccaagagctgcccagcttcagcttggggactggaggaccagctgttggcctctctgttaactcagaaagagatgggaggttgggggaggtgagcataaacgcagagttcactgttgcagcctttttgaaggggacacagtctaggagggggataaatgggatgcccttgccccagagagaacccagttctaggtactgtctgggcctgggaggcgagagcagtgcccaggggacttctgggcttacaggacagcgtgtgtgacaaaattcagatctacctgaacttgcctctggagatgataagggccaaaggagcagtcagggaggggcggtgagccagagtagtcccagggggagacagattcctccctcctccccgcctgcagctctctttaattttttgtaacatttggagagacgtccgtcctgtcttgtagtctttttattttgtgcatccttataattgtattctacaaacaattttgttttctgcatttaaacatttttgtgtttttaggagatggtcttgctctgtcactcaggctggagtacagtggcacaatcatggctcactgcagcctcgagctcctgagctcaaaggatcctcccacctcagcctccagagtagctcagattacagtgttttctgaagtttcctgacttaacataagcatttttcacatgattgaaaattttcactgattgctgtagtcattctaatgactatcaagtttatttatccattattggacatttaaatttctttctttttagctatacaaacattgatgtgttttttttgagacaggatctccatctgtcacccaggctggtgtgcaggggtgcggtcatgggctcatgggattctcctacctcagcctcctgagtagctgggattacaggtgtatgccaccacgcctggcttatgatgaatatttctgagtgggatgtttggccacatttatggtcatgtatgtaggctgttacctcaagtgagtcactcagggaacaatgagcacttgaagatttttttatacaaaaggccacagtgaggccaccttgagtcaagccgactaaggcccctcaaccctgtcactaagcagcacgtgacactggcaggaccttcatctccagcatcccacccctgggtgtgggactttggggcagccgtgtgtgcaggtgtcggcacaggctagctcctcctggtttggtgtggtgtttgccattgcagagcaagctgccacgaagacccctgggcatgattttgcttgtatttccggaagtggggttgctgggtcatagggcaggtgtaattttttttacttgaaatgttccacttcttgttctgggaggtggttccaagggtgtctgcttttggccaggcgcagtggctcacgcttgtaatcccagcactttgggaggccgaggcaggcggatcacaaggtcaggagttcgagaccagcctggccaacaaggcaaaaccccgtctctactaaaaatacaaaaattagccgggcatggtggtgtgcgcctgtaatcccagctactggggaggctgaggcagaagaatcgcttgaacccaggaggtgaggttgcagtgagctgagattgcaccactggactacagcctgggtgacagagcgagactctgtctcaaaaaaaaaaaaaaaaagggagggctgtctgctttttgtaacttgaaaaactggacatctatgttatatgtactcatggataaatatttcacaataaaactttttaaaaggataa

SEQ ID NO: 195139 - DNA, 865 bp, Homo sapiens
  Payload ID: 18531
  Gene Name: tripartite motif containing 65
  ENST ID: ENST00000543309
  CDS Start-End: 1-865
gggcgctgctggatgccgagcgcctcaagcgcgaggcccagctgagagccagcctggaggttacccagcagcaggccacccaggccgaaggccagctactagagctgcgcaagcaaagcagccagatccagaactcggcctgcatcttggcctcctgggtctccggcaagttcagcagcctgctacaggccctggaaatacagcacacgacagcactgaggagcatcgaggtggccaagacgcaggcgctggcacaggctcgagacgaggagcagcggctgcgggtccatttggaggctgtggctcgccatggctgcaggatccgggagctcctggagcaggtggatgagcagaccttcctgcaggaatcgcagctcctccagcccccagggcctcttgggccactgacccctctgcagtgggatgaagaccaacagctgggtgacctgaagcagttgctaagccggctgtgtggcctcctcttggaagaggggagccaccctggggcaccagccaagcctgtggacttagcccccgtggattatcgcaatctgacctttgatccagtcagcgccaaccgtcacttctatctgtcgcgccaggaccagcaggtgaagcactgtcgtcagtcccggggcccaggcgggcccggcagctttgagctctggcaggtgcaatgtgcccagagcttccaggccgggcaccactactgggaggtgcgcgcgtcagaccactcggtgacactgggcgtctcctacccgcaactgccacggtgcaggctggggccccacacagacaacattggccggggaccctgctcctgggggctctgcgtccaggaggacagcctccaggcctggcacaa

SEQ ID NO: 195140 - DNA, 886 bp, Homo sapiens
  Payload ID: 18531
  Gene Name: tripartite motif containing 65
  ENST ID: ENST00000540128
  CDS Start-End: 1-733
gctgacctgcgccatctgcctggggctctaccaggacccagtgacgctgccctgcggccacaacttctgcggggcctgcatccgggactggtgggaccgctgcggaaaggcgtgccccgagtgccgggagccctttcccgacggcgccgagctgcgccgcaacgtggccctcagcggcgtgctggaggtggtgcgcgccgggcccgcccgggatcccggccccgatcccggccccggccccgaccctgccgcgcgctgcccccgccacgggcggccgctggagctcttctgccggaccgagggccgctgtgtgtgcagcgtgtgcaccgtgcgcgagtgtcgcctccacgagcgggcgctgctggatgccgagcgcctcaagcgcgaggcccagctgagagccagcctggaggttacccagcagcaggccacccaggccgaaggccagctactagagctgcgcaagcaaagcagccagatccagaactcggcctgcatcttggcctcctgggtctccggcaagttcagcagcctgctacaggccctggaaatacagcacacgacagcactgaggagcatcgaggtggccaagacgcaggcgctggcacaggctcgagacgaggagcagcggctgcgggtccatttggaggctgtggctcgccatggctgcaggatccgggagctcctggagcaggtggatgagcagaccttcctgcagattatcgcaatctgacctttgatccagtcagcgccaaccgtcacttctatctgtcgcgccaggaccagcaggtgaagcactgtcgtcagtcccggggcccaggcgggcccggcagctttgagctctggcaggtgcaatgtgcccagagcttccaggccgggcaccact

SEQ ID NO: 195141 - DNA, 644 bp, Homo sapiens
  Payload ID: 18531
  Gene Name: tripartite motif containing 65
  ENST ID: ENST00000591668
  CDS Start-End: 1-412
gctcctggagcaggtggatgagcagaccttcctgcaggaatcgcagctcctccagcccccagggcctcttgggccactgacccctctgcagtgggatgaagaccaacagctgggtgacctgaagcagttgctaagccggctgtgtggcctcctcttggaagaggggagccaccctggggcaccagccaagcctgtggacttagcccccgtggaggccccaggtcccctggcaccggtcccaagcacagtttgtccactgaggaggaaactctggcagaattatcgcaatctgacctttgatccagtcagcgccaaccgtcacttctatctgtcgcgccaggaccagcaggttgaatcctgttccctgaaaaagacgtattcggatcctaacccccaggacctgtggctgtgaccttatttggaaatagagtattttcagatgtgactgagttaagatgagggcatactggagtagagcgtgccctaatccaacaactggtgtcctgataagaggaaatgggcaccgggcacagtggctcacgcctgtaatcctagcactttgggaggctgaggcaggcagattactcgagcccagcagtttgagtgggcaacagagcaagactccctaaaaaaaaaaaaaaaaa

SEQ ID NO: 195142 - DNA, 396 bp, Homo sapiens
  Payload ID: 18531
  Gene Name: tripartite motif containing 65
  ENST ID: ENST00000592642
  CDS Start-End: 1-273
ccactgacccctctgcagtgggatgaagaccaacagctgggtgacctgaagcagttgctaagccggctgtgtggcctcctcttggaagaggggagccaccctggggcaccagccaagcctgtggacttagcccccgtggattatcgcaatctgacctttgatccagtcagcgccaaccgtcacttctatctgtcgcgccaggaccagcaggttgaatcctgttccctgaaaaagacgtattcggatcctaacccccaggacctgtggctgtgaccttatttggaaatagagtattttcagatgtgactgagttaagatgagggcatactggagtagagcgtgccctaatccaacaactggtgtcctgataagaggaaatgggcaccgggcacagtg

SEQ ID NO: 195143 - DNA, 9753 bp, Homo sapiens
  Payload ID: 18532
  Gene Name: tripartite motif containing 66
  Uniprot ID: O15016
  ENST ID: ENST00000299550
  CDS Start-End: 196-3846
gacagatttcaatgtctgttgaaggcccccccacaccctccttcagtgccgggggcatggagggatatcttgggctcctgctgttttttaaaatgatgcgagctcatctcctgtcctgggtgtgaacgagtatatcttaccagggatgtaactgaacatttttttctgcattgtgttcctactgagcaacccaagatggccaggaactgctctgagtgcaaggagaagagggcagcacatatcctctgcacctactgcaatcgctggctgtgcagctcttgcacagaggaacaccgacacagccctgtccccgggggcccattctttcctcgggcccagaagggatctccaggagtgaatggtggtcccggagacttcaccttgtattgtcctctacacacacaggaagtactcaagctattctgtgagacatgtgatatgctcacttgccatagctgcctagtggtggaacacaaagaacacaggtgcagacatgttgaagaagttttgcaaaaccagaggatgcttctggaaggtgtgactacacaggtggcacataagaaatccagtctacagacatctgcaaagcaaattgaggacaggatttttgaagtgaagcatcagcataggaaggtggaaaaccagatcaaaatggccaagatggttctgatgaatgagctgaacaaacaggccaatgggctaatagaggaattagaggggattactaatgagagaaagcggaagctggaacagcagttacagagcatcatggttctcaaccgtcagtttgagcatgtgcagaatttcatcaactgggctgtctgcagcaaaaccagtgtcccttttcttttcagcaaagagctgattgtgtttcagatgcagcgattgctggagacaagttgtaacacagatcctggctccccttggagtatcagattcacctgggagcctaacttctggaccaagcagctagcttctcttggctgcataactactgaaggtggacaaatgtccagggcagatgctcctgcttatggaggcttacaggggtcatcacccttttatcaaagccaccagtctccagtggctcagcaagaggctcttagccacccctcacacaagttccagtctccagcagtgtgctcctcatctgtgtgctgctcccactgctccccagtctcgccttccctcaaaggccaggtccccccacccagcatacacccagcccacagcttcaggcagccccctgagatggtgccccagcagctggggtctctgcagtgctctgccctgctgcccagggagaaagagctggcctgcagccctcatccaccaaagctgctgcagccctggctggaaacccagccccccgtggagcaggagagcacatcccagcggctggggcagcagctgacttcccagcccgtgtgcattgtccccccacaggatgttcagcaaggagcccatgcccagcccaccttacagacaccctctatccaagtccagtttggccaccaccagaagctgaagctcagtcactttcagcagcagccacagcagcagctaccacctccaccaccacccctcccccatcccccacctccccttccccctcccccacagcagccacacccacctcttcctccatcccagcatctggcttctagtcagcacgagagccctcctggccctgcctgttctcagaacatggacataatgcatcacaagtttgagctggaggaaatgcagaaggacttggagcttcttctccaggctcaacagcccagcctgcaactgagtcagaccaaatctcctcagcatcttcagcaaaccattgtggggcagatcaactacatcgtgaggcagccagcacctgtccagtcccagagccaggaggagaccctgcaggctacagatgagcccccagcatctcagggctcaaagccggctctccctcttgacaagaatactgctgctgccttgccccaggcgtctggggaagaaacccctctcagtgtccccccagtggacagcaccatccagcactcctctccaaatgtggtgagaaagcactccacctcgctgagcatcatgggcttttccaacactctggagatggagttgtcatctaccaggttggagaggcccctagagccacagatccagagtgtgagcaacctgacagctggtgccccccaggcagtaccaagcctgctgagtgctccccccaaaatggtgtccagcctgacaagtgttcaaaaccaggccatgcccagcctgacaaccagtcacctacagactgtgcccagccttgtgcatagcacattccagtccatgcccaacctgataagtgactcccctcaggctatggcaagcctggcaagtgatcaccctcaggctgggcccagcctaatgtctggtcacacccaggctgtgccgagtctggcaacttgtcctctgcagagcatccctccagtttctgacatgcagccagaaactgggtccagctccagttctggccgaacttcagggagcctgtgtcccagagatggggctgatccctccctggagaatgctctgtgtaaggtaaaactggaggagccaattaacctctctgtgaagaaacctccactggcgccagtggtcagcacgtctacagctctgcagcagtaccagaacccaaaagagtgtgagaattttgaacaaggagccctagagctggatgcaaaagagaaccagagcatcagagccttcaatagtgagcataagattccctatgtgcgactggagcgactcaagatctgtgctgcctcctcaggagagatgcctgtgttcaaactgaagccacagaagaatgatcaggatgggagcttcctgctgatcatcgagtgtggcactgagtcctccagcatgtccattaaggtcagccaggacagactgtctgaggccacccaggccccaggtctggagggaagaaaggtcactgtcacttctttggctgggcagcggccaccagaagtggagggcacatctcctgaagaacacagactcattcctcgaaccccaggagccaagaagggccccccagccccaatagagaatgaggacttctgtgctgtttgcctcaatggcggagagttactgtgctgtgaccgctgccccaaagtgttccacctctcctgccatgtgccagccttgctcagcttcccagggggagagtgggtgtgtaccttgtgccgcagcctgacccagcccgagatggagtacgactgtgagaatgcctgctataaccagcctggaatgcgggcatctcctggcctaagcatgtatgaccagaagaagtgtgagaagctggtattgtccttgtgctgcaataacctcagcctgcccttccatgaacctgtcagccccctggcccggcattattaccagattatcaagaggcccatggacctgtcaatcatccggaggaagctgcaaaagaaggacccagctcactataccaccccagaggaggtggtatcagatgtgcgcctcatgttctggaactgtgctaagttcaattatcctgactccgaggttgcagaggctggccgctgcctggaagtgttctttgagggctggttgaaggagatctacccggagaaacggtttgcccagccaaggcaggaggactcagactccgaggaggtgtctagtgagagtggatgttccactccccagggcttcccgtggcctccctacatgcaggagggcatccaacccaagaggcggcgacgacatatggagaatgaaagagcaaaaagaatgtcatttcgcctggccaacagcatctctcaggtgtgagagccaaaaggagactgggcactctggcagctgttgtcccatactgtcgaccattcctccccatcttgcagcttatcctcttcagagtgtggatggtagatgagtcttgttgaactgtgtagtgctcttctttgccatttgcatctacagcatttatttgggagccgtagtacatccactacagagaagatttcagtaataaacaggaaagaggaaggtatttattattaccagagtaatcagatgtataggctccacttgacaagaccacacctggttaggctcgggaaaacctactttccttggtgaatttttttctgcctgggaaagcagacccgtctaaccttttagtgtccagggctcaggagccatgtatacatctgaactcctcctgggctcagaagtgggtaaaagaagggagagaggtttagacatatggcaggactgtgatccctggcccagcacagccaaagactgtcactgtttgcctttgcttgtcctgtctggatagaggcacctgccatgtgcagactagtggaggcttctagaggccataggtctcaatttgtgcctatttgggttctaacggttttcagggtatttgttttgcatagtcactttcctgatgttgacataggtggctgctgtgaaaatgctgtggatggtgtgacattcttgactgagctgggtggctgtggagagaccacttaaatcttctggttcagatttcacttacagacttagtaagatgtccacttcagagcccgccctctgtgctacttactctgggctaatcacacttctttagggtgagaacctgccttcctagaagtgactgttggtgcttgtcagtggccatacccttcatcatcctcattcagaggtatggatcgtgagttctgcttgtgaatactgtgagacagctgctgtctgcttcaggtccagagttccatgggtggagagagtaacccacaaccagctcactcctctgggcctctcctcctgcttaaagattctagttctcaacctctccaagttcatgagccaaagatcagaagtgagtcttctgaccagcccgcctccaggctgtctacagccccaaaaaagccaacacttttctggcagccctttttgttggaggttagagaaggcctcagggaccaacaggggccagatctagacattcctgggggaagtttgtctaaggtggacagggggaaaaatcaagaggcaaaaagccagtgtcctttggtgaccatgaagcaacctcagagccttagttctcctagaatgcagagagaagcattctggaagccatgggaacaggagctcgaggctgcatcctgaatgcatctgcatggccctcgcagggtgtttgtgaggatactggaggtcaggctacctcccaagcaagggcttggttgagaaggaacccattgctcatattgttgggggagctatgaacctgacatgtcagtggccaggactgagacagctctccctggtcctgtcattgcatggctaatttcaggggagtctgaggtcatggctttatttttgctaacagatgaagttcaaggatgttcttgtttgtagggcctttgctaatgagcagttttttaattagaaaacatttcttctctctttgtgagttgatggtattgctcatttccttctctacccaacctgagagatcatcttcactttaaagcaaaccatgccccttggcttgccattctttcagcagcacatgccacgttctaagcagatgggcttccgtgatcccgttttctagtttggggtaactgagtcttgaatgctttactagtccggcaatctttggacttaggcttctgccctttgagactcacatgactttctggtttggggtctggtcatttccctttcaatttttgaatctccttctctgttcagttggcttggcaaagtaccctctgttctcatgtcactaattcctgctctaggtcatctttcctttgtgcagcccacattcccaccatcctgtgaactttgttgtacttggtgttgggcaactggtgagtgttgtgacaggctcagacctgatccttcctcaggagcaattggagaccacaaatttaaagcagaaatacctgttaaaagcttggctttccttatatgagtgaggctcccagcttgggtgtggcctcctgggctcacggatcagcttgctgggccagagggggtcttagtaatgtgctagagagacacatgctcccttctcatcgtagagagcctgcatgctgagaggctccctttacacacctgcctctcgctggcttttcctttagacctagccaccagtgttttgaatcatggttttgttttgtttttgcatgcaaaaaccagaacatgacttagaaattaaaaaaaaaaaaatcctactagccaagtgactgcctgcagaggctcttcattaacatttgggctgatcctgcttttgacttattcccataatggcccagttttgaagtcagccaagtccttttgtccttgacaacatcatgcagtggaaatacggtgagttctagattcttatgggacagcatgcagccctagaggaaaaattgacttcttgggtatgctgagaaataagacagtaaaatggcttcagttgatgcaaggggattttagttaaaaattggttcaggatttttaaattttattttattttttggctgggcgcggtggctcacgcctgtaatcccagcactttgggaggctgaggtgggtggatcacctaaggacagcagttcgagaccagcctggccaacatagtgaaaccctgtctctactaaaaatacaaatatcagccaggtgtgatggcacatgcctgtaatcccagctacttgggaggctgaggcaggagaattgcttgaatccgggaggtggaggttgcagtgagctgagatcatgccattgcattccagcctgggcaacagaacgagactccgtctcaaaaaaaaaaaaattggttcaggatgaacttgcagagcactcttccacagaacatggttaggttagccctgcctgacttctagcaattgctaactatacaccttgcctgcctctaggacccctacctgagtggcaaccataccttccatatgctctgttccatggcagtccctgccatcccccaccagcggactctggctccctccctgtacccatttctagcaacagctccttgcctggctgctaagacggaggcgcctccttgtttgttcctgggctctgttctgctccctctctcactccatggagtcacttatagtcttcctttctgaacgccagaattgagcctttgctccttctggatcaccccttcctgggcttcttctccatccctcagtactgctaaaattgccctgctcctttagtccatttccatgacctcagccctctctctcctctccttgtcttttaactttctcctggacttcttcctctccccagcatgaacccagagcctatcacacactgatgtttttgtcagcatcctgaactttctcatgcccttcaactttatttatttatttatttatttattttttattttttgagagagagagtctcactctgtcatgcaggctggagtgcagtggtatgatgtcggctcattgcaacctctgccttctgggctcaggtgatcctcccatctcagcctcctgagtagctgggactacaggtgcatgccaccatgcctggctaatttttctactttaggtagagatggagtttcgccatgttgctcaagctggtatcaacactcctgggctcaagcagtctgcttcccttggcctcccaaagtgctgggattacaggcgtgagccactgcgccaggcgtatccccttcaattttgctgaaactatcagccattctccattttcggcatcatcatatttgctgcttccacctcctgggctgctatgcatgacagattcacagttggcagcctcagttgagctctcagtgttgactggaaattctttaacttgttgtgatccctttttttttccccacccatgcctccatctttgtcctccacaaatgactgagctcactgtctacttcacagaagacagcccctaaagcaagagcttccttgcctgctgttcctctctcccctctcattcatctgtgtctgtaactctccccaacccctccattcttgctcctatttaattctctatatcttgaatcctgttgtatgtcctccaagactgctccctcgcttactccactgctcccactccctggagtctccagcctctgtctccactggttacctccacacagcctgcaaacaagttctccacaagattaaaacagcatttctcagagtctgttaccccttacacattttccttgttaaccaagttacttttaaaaagatcctttttaaactgattcttcctcagctgttcttcagccctctatactttttcataaaagtcaccagtgactgcccagttgccaaatagaatgaatacctttcagtgctcagctgtcttgacctctccgcagcatttcacaccacccaccaaccctcagtgaaacaacctcctcccttagcttttatgacaccacaagtctctggattctcagagaatccagaaaaacaagtctctggattctctcctcttacctctcagcccacacaggctgagctgtccttgaaacctagatgggggaaatgtctgtggctgtctgtggtctcttcttttcaggagttgggtagggaggaagaatcacagctgctcctgcttcctctgtctgtctctctatttcctgagtcccttccttttcctgaactcagttctcctcatgccaaccatgtttatgagctcctgctgggaggacagcatctgtgagtccttccctctgtctctcccagacaacacagaggttttagcctgtttgctaagagaccccatctaagtcagcccaagggtgtggattaggttttacagcatccaggccgcagtctggctaaactggattaccaggctggtgggcagctcctcaccatgatcctgcaccagttagagcctgctgtagttgggaaggagcctgggattgtggtaagatgtgtttccgtgcatgtcagtgctgctaaccaggaggagaacctggcagggtgggtgcctgctgctgataacattcggatggagggagactagggagcgcggtggctgctcccttgctggggctcagctggagtcagcatgactccttatatcagggcctttcccacctgtgctgatcaccaccacctgcttgctccagttgtttctggagttggaggcagctattggttgctttcttggaggtaaggaggtatatactagaaagatatctgatttgagagtctgaacaccaaaatttttggctctttccattatgagctgtgtaaccttggatacagtttcctcatctataaagttgtggtgggagaatggctgagaacagtgatctctcagctctccagctgtaaagatgttaattatgattttaactctcaagatcaggccacataaggaacaggggaattccaggggtgggacacagctgggggagtccagaccagggcagggaaaggagactcacaagccaaacagagctgctttggggaaagttcttatcagctggtgctgcttcctgagccatatgcccattcctcaagctgtacccctttcttggctatgtaggatgagttcctcctaggcccttgttaggagtggctattggattctaagcggttggggcatgagggaggatattttaaagggaagtatagctgattttaaaagaacctatacattcaagaacaaataaaaaacagcacttttctttaccaagaa

SEQ ID NO: 195144 - DNA, 10086 bp, Homo sapiens
  Payload ID: 18532
  Gene Name: tripartite motif containing 66
  ENST ID: ENST00000402157
  CDS Start-End: 442-4179
atttgctccgtaaggactgcttccagggcttgatacaggagctagggcagattgccaaggctcatgagactgttgcagatgccacagcctagctgagattctccccagcaactaggaagatgggtctgcgtcacctctcaggtactgaggagaccagctgggcaagatcttcaaaagctaatgatggggaccagagcaaagacatatgaacaggtatttaaaatgcaatgtgatattcgttgtactggaaggatgttcagggtgctgcgggaacccagaagagggactaattaactcatcccgggggaaattgatcttgctgctcaaaggtggaacatttgaacagagctcatctcctgtcctgggtgtgaacgagtatatcttaccagggatgtaactgaacatttttttctgcattgtgttcctactgagcaacccaagatggccaggaactgctctgagtgcaaggagaagagggcagcacatatcctctgcacctactgcaatcgctggctgtgcagctcttgcacagaggaacaccgacacagccctgtccccgggggcccattctttcctcgggcccagaagggatctccaggagtgaatggtggtcccggagacttcaccttgtattgtcctctacacacacaggaagtactcaagctattctgtgagacatgtgatatgctcacttgccatagctgcctagtggtggaacacaaagaacacagacatgttgaagaagttttgcaaaaccagaggatgcttctggaaggtgtgactacacaggtggcacataagaaatccagtctacagacatctgcaaagcaaattgaggacaggatttttgaagtgaagcatcagcataggaaggtggaaaaccagatcaaaatggccaagatggttctgatgaatgagctgaacaaacaggccaatgggctaatagaggaattagaggggattactaatgagagaaagcggaagctggaacagcagttacagagcatcatggttctcaaccgtcagtttgagcatgtgcagaatttcatcaactgggctgtctgcagcaaaaccagtgtcccttttcttttcagcaaagagctgattgtgtttcagatgcagcgattgctggagacaagttgtaacacagatcctggctccccttggagtatcagattcacctgggagcctaacttctggaccaagcagctagcttctcttggctgcataactactgaaggtggacaaatgtccagggcagatgctcctgcttatggaggcttacaggggtcatcacccttttatcaaagccaccagtctccagtggctcagcaagaggctcttagccacccctcacacaagttccagtctccagcagtgtgctcctcatctgtgtgctgctcccactgctccccagtctcgccttccctcaaaggccaggtccccccacccagcatacacccagcccacagcttcaggcagccccctgagatggtgccccagcagctggggtctctgcagtgctctgccctgctgcccagggagaaagagctggcctgcagccctcatccaccaaagctgctgcagccctggctggaaacccagccccccgtggagcaggagagcacatcccagcggctggggcagcagctgacttcccagcccgtgtgcattgtccccccacaggatgttcagcaaggagcccatgcccagcccaccttacagacaccctctatccaagtccagtttggccaccaccagaagctgaagctcagtcactttcagcagcagccacagcagcagctaccacctccaccaccacccctcccccatcccccacctccccttccccctcccccacagcagccacacccacctcttcctccatcccagcatctggcttctagtcagcacgagagccctcctggccctgcctgttctcagaacatggacataatgcatcacaagtttgagctggaggaaatgcagaaggacttggagcttcttctccaggctcaacagcccagcctgcaactgagtcagaccaaatctcctcagcatcttcagcaaaccattgtggggcagatcaactacatcgtgaggcagccagcacctgtccagtcccagagccaggaggagaccctgcaggctacagatgagcccccagcatctcagggctcaaagccggctctccctcttgacaagaatactgctgctgccttgccccaggcgtctggggaagaaacccctctcagtgtccccccagtggacagcaccatccagcactcctctccaaatgtggtgagaaagcactccacctcgctgagcatcatgggcttttccaacactctggagatggagttgtcatctaccaggttggagaggcccctagagccacagatccagagtgtgagcaacctgacagctggtgccccccaggcagtaccaagcctgctgagtgctccccccaaaatggtgtccagcctgacaagtgttcaaaaccaggccatgcccagcctgacaaccagtcacctacagactgtgcccagccttgtgcatagcacattccagtccatgcccaacctgataagtgactcccctcaggctatggcaagcctggcaagtgatcaccctcaggctgggcccagcctaatgtctggtcacacccaggctgtgccgagtctggcaacttgtcctctgcagagcatccctccagtttctgacatgcagccagaaactgggtccagctccagttctggccgaacttcagggagcctgtgtcccagagatggggctgatccctccctggagaatgctctgtgtaagatggaaagtgaggattccactcgcttcactgacttactgggacaaggtcccatagtccccggtctggatgctcccaaggacttggccatcccctcagaactggaggagccaattaacctctctgtgaagaaacctccactggcgccagtggtcagcacgtctacagctctgcagcagtaccagaacccaaaagagtgtgagaattttgaacaaggagccctagagctggatgcaaaagagaaccagagcatcagagccttcaatagtgagcataagattccctatgtgcgactggagcgactcaagatctgtgctgcctcctcaggagagatgcctgtgttcaaactgaagccacagaagaatgatcaggatgggagcttcctgctgatcatcgagtgtggcactgagtcctccagcatgtccattaaggtcagccaggacagactgtctgaggccacccaggccccaggtctggagggaagaaaggtcactgtcacttctttggctgggcagcggccaccagaagtggagggcacatctcctgaagaacacagactcattcctcgaaccccaggagccaagaagggccccccagccccaatagagaatgaggacttctgtgctgtttgcctcaatggcggagagttactgtgctgtgaccgctgccccaaagtgttccacctctcctgccatgtgccagccttgctcagcttcccagggggagagtgggtgtgtaccttgtgccgcagcctgacccagcccgagatggagtacgactgtgagaatgcctgctataaccagcctggaatgcgggcatctcctggcctaagcatgtatgaccagaagaagtgtgagaagctggtattgtccttgtgctgcaataacctcagcctgcccttccatgaacctgtcagccccctggcccggcattattaccagattatcaagaggcccatggacctgtcaatcatccggaggaagctgcaaaagaaggacccagctcactataccaccccagaggaggtggtatcagatgtgcgcctcatgttctggaactgtgctaagttcaattatcctgactccgaggttgcagaggctggccgctgcctggaagtgttctttgagggctggttgaaggagatctacccggagaaacggtttgcccagccaaggcaggaggactcagactccgaggaggtgtctagtgagagtggatgttccactccccagggcttcccgtggcctccctacatgcaggagggcatccaacccaagaggcggcgacgacatatggagaatgaaagagcaaaaagaatgtcatttcgcctggccaacagcatctctcaggtgtgagagccaaaaggagactgggcactctggcagctgttgtcccatactgtcgaccattcctccccatcttgcagcttatcctcttcagagtgtggatggtagatgagtcttgttgaactgtgtagtgctcttctttgccatttgcatctacagcatttatttgggagccgtagtacatccactacagagaagatttcagtaataaacaggaaagaggaaggtatttattattaccagagtaatcagatgtataggctccacttgacaagaccacacctggttaggctcgggaaaacctactttccttggtgaatttttttctgcctgggaaagcagacccgtctaaccttttagtgtccagggctcaggagccatgtatacatctgaactcctcctgggctcagaagtgggtaaaagaagggagagaggtttagacatatggcaggactgtgatccctggcccagcacagccaaagactgtcactgtttgcctttgcttgtcctgtctggatagaggcacctgccatgtgcagactagtggaggcttctagaggccataggtctcaatttgtgcctatttgggttctaacggttttcagggtatttgttttgcatagtcactttcctgatgttgacataggtggctgctgtgaaaatgctgtggatggtgtgacattcttgactgagctgggtggctgtggagagaccacttaaatcttctggttcagatttcacttacagacttagtaagatgtccacttcagagcccgccctctgtgctacttactctgggctaatcacacttctttagggtgagaacctgccttcctagaagtgactgttggtgcttgtcagtggccatacccttcatcatcctcattcagaggtatggatcgtgagttctgcttgtgaatactgtgagacagctgctgtctgcttcaggtccagagttccatgggtggagagagtaacccacaaccagctcactcctctgggcctctcctcctgcttaaagattctagttctcaacctctccaagttcatgagccaaagatcagaagtgagtcttctgaccagcccgcctccaggctgtctacagccccaaaaaagccaacacttttctggcagccctttttgttggaggttagagaaggcctcagggaccaacaggggccagatctagacattcctgggggaagtttgtctaaggtggacagggggaaaaatcaagaggcaaaaagccagtgtcctttggtgaccatgaagcaacctcagagccttagttctcctagaatgcagagagaagcattctggaagccatgggaacaggagctcgaggctgcatcctgaatgcatctgcatggccctcgcagggtgtttgtgaggatactggaggtcaggctacctcccaagcaagggcttggttgagaaggaacccattgctcatattgttgggggagctatgaacctgacatgtcagtggccaggactgagacagctctccctggtcctgtcattgcatggctaatttcaggggagtctgaggtcatggctttatttttgctaacagatgaagttcaaggatgttcttgtttgtagggcctttgctaatgagcagttttttaattagaaaacatttcttctctctttgtgagttgatggtattgctcatttccttctctacccaacctgagagatcatcttcactttaaagcaaaccatgccccttggcttgccattctttcagcagcacatgccacgttctaagcagatgggcttccgtgatcccgttttctagtttggggtaactgagtcttgaatgctttactagtccggcaatctttggacttaggcttctgccctttgagactcacatgactttctggtttggggtctggtcatttccctttcaatttttgaatctccttctctgttcagttggcttggcaaagtaccctctgttctcatgtcactaattcctgctctaggtcatctttcctttgtgcagcccacattcccaccatcctgtgaactttgttgtacttggtgttgggcaactggtgagtgttgtgacaggctcagacctgatccttcctcaggagcaattggagaccacaaatttaaagcagaaatacctgttaaaagcttggctttccttatatgagtgaggctcccagcttgggtgtggcctcctgggctcacggatcagcttgctgggccagagggggtcttagtaatgtgctagagagacacatgctcccttctcatcgtagagagcctgcatgctgagaggctccctttacacacctgcctctcgctggcttttcctttagacctagccaccagtgttttgaatcatggttttgttttgtttttgcatgcaaaaaccagaacatgacttagaaattaaaaaaaaaaaaatcctactagccaagtgactgcctgcagaggctcttcattaacatttgggctgatcctgcttttgacttattcccataatggcccagttttgaagtcagccaagtccttttgtccttgacaacatcatgcagtggaaatacggtgagttctagattcttatgggacagcatgcagccctagaggaaaaattgacttcttgggtatgctgagaaataagacagtaaaatggcttcagttgatgcaaggggattttagttaaaaattggttcaggatttttaaattttattttattttttggctgggcgcggtggctcacgcctgtaatcccagcactttgggaggctgaggtgggtggatcacctaaggacagcagttcgagaccagcctggccaacatagtgaaaccctgtctctactaaaaatacaaatatcagccaggtgtgatggcacatgcctgtaatcccagctacttgggaggctgaggcaggagaattgcttgaatccgggaggtggaggttgcagtgagctgagatcatgccattgcattccagcctgggcaacagaacgagactccgtctcaaaaaaaaaaaaattggttcaggatgaacttgcagagcactcttccacagaacatggttaggttagccctgcctgacttctagcaattgctaactatacaccttgcctgcctctaggacccctacctgagtggcaaccataccttccatatgctctgttccatggcagtccctgccatcccccaccagcggactctggctccctccctgtacccatttctagcaacagctccttgcctggctgctaagacggaggcgcctccttgtttgttcctgggctctgttctgctccctctctcactccatggagtcacttatagtcttcctttctgaacgccagaattgagcctttgctccttctggatcaccccttcctgggcttcttctccatccctcagtactgctaaaattgccctgctcctttagtccatttccatgacctcagccctctctctcctctccttgtcttttaactttctcctggacttcttcctctccccagcatgaacccagagcctatcacacactgatgtttttgtcagcatcctgaactttctcatgcccttcaactttatttatttatttatttatttattttttattttttgagagagagagtctcactctgtcatgcaggctggagtgcagtggtatgatgtcggctcattgcaacctctgccttctgggctcaggtgatcctcccatctcagcctcctgagtagctgggactacaggtgcatgccaccatgcctggctaatttttctactttaggtagagatggagtttcgccatgttgctcaagctggtatcaacactcctgggctcaagcagtctgcttcccttggcctcccaaagtgctgggattacaggcgtgagccactgcgccaggcgtatccccttcaattttgctgaaactatcagccattctccattttcggcatcatcatatttgctgcttccacctcctgggctgctatgcatgacagattcacagttggcagcctcagttgagctctcagtgttgactggaaattctttaacttgttgtgatccctttttttttccccacccatgcctccatctttgtcctccacaaatgactgagctcactgtctacttcacagaagacagcccctaaagcaagagcttccttgcctgctgttcctctctcccctctcattcatctgtgtctgtaactctccccaacccctccattcttgctcctatttaattctctatatcttgaatcctgttgtatgtcctccaagactgctccctcgcttactccactgctcccactccctggagtctccagcctctgtctccactggttacctccacacagcctgcaaacaagttctccacaagattaaaacagcatttctcagagtctgttaccccttacacattttccttgttaaccaagttacttttaaaaagatcctttttaaactgattcttcctcagctgttcttcagccctctatactttttcataaaagtcaccagtgactgcccagttgccaaatagaatgaatacctttcagtgctcagctgtcttgacctctccgcagcatttcacaccacccaccaaccctcagtgaaacaacctcctcccttagcttttatgacaccacaagtctctggattctcagagaatccagaaaaacaagtctctggattctctcctcttacctctcagcccacacaggctgagctgtccttgaaacctagatgggggaaatgtctgtggctgtctgtggtctcttcttttcaggagttgggtagggaggaagaatcacagctgctcctgcttcctctgtctgtctctctatttcctgagtcccttccttttcctgaactcagttctcctcatgccaaccatgtttatgagctcctgctgggaggacagcatctgtgagtccttccctctgtctctcccagacaacacagaggttttagcctgtttgctaagagaccccatctaagtcagcccaagggtgtggattaggttttacagcatccaggccgcagtctggctaaactggattaccaggctggtgggcagctcctcaccatgatcctgcaccagttagagcctgctgtagttgggaaggagcctgggattgtggtaagatgtgtttccgtgcatgtcagtgctgctaaccaggaggagaacctggcagggtgggtgcctgctgctgataacattcggatggagggagactagggagcgcggtggctgctcccttgctggggctcagctggagtcagcatgactccttatatcagggcctttcccacctgtgctgatcaccaccacctgcttgctccagttgtttctggagttggaggcagctattggttgctttcttggaggtaaggaggtatatactagaaagatatctgatttgagagtctgaacaccaaaatttttggctctttccattatgagctgtgtaaccttggatacagtttcctcatctataaagttgtggtgggagaatggctgagaacagtgatctctcagctctccagctgtaaagatgttaattatgattttaactctcaagatcaggccacataaggaacaggggaattccaggggtgggacacagctgggggagtccagaccagggcagggaaaggagactcacaagccaaacagagctgctttggggaaagttcttatcagctggtgctgcttcctgagccatatgcccattcctcaagctgtacccctttcttggctatgtaggatgagttcctcctaggcccttgttaggagtggctattggattctaagcggttggggcatgagggaggatattttaaagggaagtatagctgattttaaaagaacctatacattcaagaacaaataaaaaacagcacttttctttaccaagaa

SEQ ID NO: 195145 - DNA, 858 bp, Homo sapiens
  Payload ID: 18532
  Gene Name: tripartite motif containing 66
  ENST ID: ENST00000530502
  CDS Start-End: 1-858
gctggatgcaaaagagaaccagagcatcagagccttcaatagtgagcataagattccctatgtgcgactggagcgactcaagatctgtgctgcctcctcaggagagatgcctgtgttcaaactgaagccacagaagaatgatcaggatgggagcttcctgctgatcatcgagtgtggcactgagtcctccagcatgtccattaagcggccaccagaagtggagggcacatctcctgaagaacacagactcattcctcgaaccccaggagccaagaagggccccccagccccaatagagaatgaggacttctgtgctgtttgcctcaatggcggagagttactgtgctgtgaccgctgccccaaagtgttccacctctcctgccatgtgccagccttgctcagcttcccagggggagagtgggtgtgtaccttgtgccgcagcctgacccagcccgagatggagtacgactgtgagaatgcctgctataaccagcctggaatgcgggcatctcctggcctaagcatgtatgaccagaagaagtgtgagaagctggtattgtccttgtgctgcaataacctcagcctgcccttccatgaacctgtcagccccctggcccggcattattaccagattatcaagaggcccatggacctgtcaatcatccggaggaagctgcaaaagaaggacccagctcactataccaccccagaggaggtggtatcagatgtgcgcctcatgttctggaactgtgctaagttcaattatcctgactccgaggttgcagaggctggccgctgcctggaagtgttctttgagggctggttgaaggagatctacccggagaaacggtttgccca

SEQ ID NO: 195146 - DNA, 3936 bp, Homo sapiens
  Payload ID: 18533
  Gene Name: tripartite motif containing 67
  Uniprot ID: Q6ZTA4
  ENST ID: ENST00000366653
  CDS Start-End: 1-2352
atggaggaagagctgaagtgtcccgtgtgcggctctctgtttcgggagcctatcatcctgccctgttcccacaatgtctgcctgccttgcgctcgcaccatcgcggtgcagaccccggacggtgagcagcacctgccccagccgctcctgctttcccggggatcggggctgcaggcgggcgccgccgccgctgcctctctggagcacgacgctgcggctggcccggcctgcggcggtgcaggcgggagtgcagctggcggcctcggcggcggtgcgggaggtggcggagaccacgcggacaagctcagcttgtacagcgagacagacagcggctacgggtcctacaccccgagcctcaagtcccccaacggggttcgcgtgctgcccatggtgcccgcaccacccggctcctcggctgcggcggctcggggtgccgcctgctcctcgctgtcctcgtcttcgagctccatcacgtgcccgcagtgccaccgcagcgcatccctggaccaccgcggcctgcgcggcttccagcgcaaccggctgctcgaggccatcgtgcagcggtaccagcagggccgcggggccgtgccggggacgtctgcagccgcggcggtggccatctgccagctgtgcgaccgcaccccgccagagccagcagccacgctctgcgagcagtgcgacgtcctctactgctctgcctgccagctcaagtgccatccatcccggggacccttcgccaagcatcgcctggtgcagccgccgccgccgccgccgccgcccgccgaggcagcctccgggcccactggcaccgcccagggcgcccccagcggaggcggcggctgcaagagcccgggaggcgcgggggcgggggcgactgggggcagcacggcccgcaagttccccacgtgtcccgagcatgaaatggagaactacagcatgtactgcgtgagctgtcgaaccccggtgtgttatctgtgcctggaggagggccggcacgccaagcacgaggtgaagccgctgggggccatgtggaagcagcacaaggcacaactatctcaggccttaaatggagtttcagataaggcaaaggaagcaaaggagtttctggttcagctaaagaacatattgcagcagatccaggaaaacggactggactacgaagcctgcctcgttgctcagtgtgatgcccttgtggatgctttaactcgtcagaaagccaagctgctcaccaaggtgactaaagagagggaacacaagttgaagatggtttgggaccagatcaatcactgcacattgaagctgcgtcagtccaccggactgatggagtactgcctggaggtgatcaaggagaacgacccctccgggttcttacagatctcagatgctctgatcaagcgcgtccaggtgtctcaggagcagtgggtcaaaggcgccctggagccgaaagtgtctgcggagtttgatctgactttggacagcgagccgctgctgcaggccatccaccagctggacttcattcagatgaaatgtagggtgccacccgtccccctactgcagctggagaaatgctgcacccgtaacaacagcgtcacgctggcctggaggatgccacccttcacccacagccccgtggacggctacatcctggagctggacgacggtgccgggggacagttccgggaagtgtacgtcggtaaggagactttgtgtaccatcgacggtcttcacttcaacagcacctacaacgcccgagtcaaagctttcaactcttctggtgtcgggccttacagtaaaactgtcgtcctgcagacatccgatgtggcctggttcacatttgaccccaactctgggcatcgggacatcattttatccaatgacaaccagacagccacctgcagcagctatgacgaccgggtggtgctgggcacagctgcgttctccaagggcgtgcactactgggagctgcacgtggaccggtacgacaaccacccagaccccgccttcggggtggccagggccagcgtggtcaaggacatgatgctgggcaaggatgacaaggcctgggccatgtatgtggacaacaaccgcagctggttcatgcactgcaactcccacaccaacaggacggaaggtggcgtgtgcaagggggccaccgtgggcgtgctgctggacctgaataagcacactctcaccttcttcatcaacgggcagcagcagggccccacagccttcagccacgtggacggggtcttcatgccagccctcagcctcaaccgcaacgtgcaggtcaccctgcacacaggattggaagtgccgactaacctggggcggccaaagctgtcaggcaattagccccgctccagctcggcactgtgcctgtgacagtgacattcacaggcaaaacgcccaccattctcactaagctcaaataacccacaaaagcaggatatgcaaatcatgggtgcaacctggcagcgtggagtgtcatagaaacacattttcttggggacgcagggaatgggtccacgggccatgctcacagctgccactgtcagtggcaaaggaaggtacgtgtgtcacccttattccacccagacattacgaacactccccaagaaggacctttctcaagggagtcagcattcgggcttcatgtctatgtttcctgccatctgttttcaaagcttgtctttttttggagggagaggaaggtagactttgagactggcctcctgagagcggcagtcaggagctgcgctgtaatcccacgccccgggtgttggccctccgtggggaccttgcctcctcagagtcccgagattgcagattctcatcatgctgagaaagttatcttttagcttcttggtcctagagtctttagtagcacctgccacttgcagacccaatgcaggattgatagaaagggacattaatcattcatgcttgacttttgcctctctcactgaagtgttagaaccttttaaaatggcttcctttattaatcagccaattgtgttctctctctctcttcctccatccttcatttcttctccctccctccttctctttctctcttcttctctctctccttccttccctcctttgctctctctttcttcctttcctccttctctcttactttcctccatccctgcctctttcttccctctttcgctctctttccctccctccttctctctctctctcacacacacacaggcatgacagtctcctaaaattaattcactcagttcttagttcttaaatccacgtgaaaacacaagaattttaacaactatgtcataggtcttcgcctggtgatggctcctttctgaaactggcagcccaagaagttaactgaaaatgcatccagattgctcttctgagctgaaccactctcagactcataagcatttaaaatgggagaccctgggaaagcctgttctagtcagtccaccctattgtcattatgaaagcatcatgaacacaagtggcccctgtggcaggccgggacggctctgccctgatgcagtgggcgggatctctggggaaggcaggaaatagaagggcagtatcaggtaccttgtctcccagcttcccactgtgagactgggtgtgccgagtctgacctgccagggcaggactctggaaacaccaggcttctcccttgagatccacattgattcatccacacctctcagagacagctcatggcaggggttttgagcctgccaggctcttgttcccagggaacccttcctctcctccctcctctcatcttcccagtcacctgccacctccagctccacctggtagtaacatttctctctccttttaaaaagaatatattttgtcaagcattttatttctgaggctgagaagtgacttgtcaatttgctggactggatttttataaaattcgcccattcaccagca

SEQ ID NO: 195147 - DNA, 2166 bp, Homo sapiens
  Payload ID: 18533
  Gene Name: tripartite motif containing 67
  Uniprot ID: Q6ZTA4
  ENST ID: ENST00000449018
  CDS Start-End: 1-2166
atggaggaagagctgaagtgtcccgtgtgcggctctctgtttcgggagcctatcatcctgccctgttcccacaatgtctgcctgccttgcgctcgcaccatcgcggtgcagaccccggacggcgggagtgcagctggcggcctcggcggcggtgcgggaggtggcggagaccacgcggacaagctcagcttgtacagcgagacagacagcggctacgggtcctacaccccgagcctcaagtcccccaacggggttcgcgtgctgcccatggtgcccgcaccacccggctcctcggctgcggcggctcggggtgccgcctgctcctcgctgtcctcgtcttcgagctccatcacgtgcccgcagtgccaccgcagcgcatccctggaccaccgcggcctgcgcggcttccagcgcaaccggctgctcgaggccatcgtgcagcggtaccagcagggccgcggggccgtgccggggacgtctgcagccgcggcggtggccatctgccagctgtgcgaccgcaccccgccagagccagcagccacgctctgcgagcagtgcgacgtcctctactgctctgcctgccagctcaagtgccatccatcccggggacccttcgccaagcatcgcctgggcgcccccagcggaggcggcggctgcaagagcccgggaggcgcgggggcgggggcgactgggggcagcacggcccgcaagttccccacgtgtcccgagcatgaaatggagaactacagcatgtactgcgtgagctgtcgaaccccggtgtgttatctgtgcctggaggagggccggcacgccaagcacgaggtgaagccgctgggggccatgtggaagcagcacaaggcacaactatctcaggccttaaatggagtttcagataaggcaaaggaagcaaaggagtttctggttcagctaaagaacatattgcagcagatccaggaaaacggactggactacgaagcctgcctcgttgctcagtgtgatgcccttgtggatgctttaactcgtcagaaagccaagctgctcaccaaggtgactaaagagagggaacacaagttgaagatggtttgggaccagatcaatcactgcacattgaagctgcgtcagtccaccggactgatggagtactgcctggaggtgatcaaggagaacgacccctccgggttcttacagatctcagatgctctgatcaagcgcgtccaggtgtctcaggagcagtgggtcaaaggcgccctggagccgaaagtgtctgcggagtttgatctgactttggacagcgagccgctgctgcaggccatccaccagctggacttcattcagatgaaatgtagggtgccacccgtccccctactgcagctggagaaatgctgcacccgtaacaacagcgtcacgctggcctggaggatgccacccttcacccacagccccgtggacggctacatcctggagctggacgacggtgccgggggacagttccgggaagtgtacgtcggtaaggagactttgtgtaccatcgacggtcttcacttcaacagcacctacaacgcccgagtcaaagctttcaactcttctggtgtcgggccttacagtaaaactgtcgtcctgcagacatccgatgtggcctggttcacatttgaccccaactctgggcatcgggacatcattttatccaatgacaaccagacagccacctgcagcagctatgacgaccgggtggtgctgggcacagctgcgttctccaagggcgtgcactactgggagctgcacgtggaccggtacgacaaccacccagaccccgccttcggggtggccagggccagcgtggtcaaggacatgatgctgggcaaggatgacaaggcctgggccatgtatgtggacaacaaccgcagctggttcatgcactgcaactcccacaccaacaggacggaaggtggcgtgtgcaagggggccaccgtgggcgtgctgctggacctgaataagcacactctcaccttcttcatcaacgggcagcagcagggccccacagccttcagccacgtggacggggtcttcatgccagccctcagcctcaaccgcaacgtgcaggtcaccctgcacacaggattggaagtgccgactaacctggggcggccaaagctgtcaggcaattag

SEQ ID NO: 195148 - DNA, 9320 bp, Homo sapiens
  Payload ID: 18533
  Gene Name: tripartite motif containing 67
  ENST ID: ENST00000444294
  CDS Start-End: 859-3204
gggaggggattcccgagccagccggacgctcgccctccgcccgccggctgcagcgtcgcgcggcccaaggtcagaggcgccgcaggagcagcagctgggaaccagggaagcgggtcaatcccggccgcagggagaaagccccagggcgcagtcagccggcgtccacagccgcccaggagtagggtgagcggctgtctccgggccggtcgggtcccgccgaggtggccgcggccccagcgacccggcgggtggcggcccaggggtcggcgagcaggcagctggagccccaccttcggctcccgggcgctgtccgccgcctcgtggtgctgatcccagccccacggctgagcggccttcgcacctgcctgtctcacctcgctatcaccccgataaggagttgggccggggcagaaggggggcctcggggtagccgcccaccggagccaggggctgaagcagcgagcgcacagcagcccggccgctggtcctggggtggagaggaggcgcgcgctgcagccggcggcggcgctggtgctgattcatcacctaaagctcctcgcaggccaccgcgagggcagccgaccggctccggaatctggccgcaggttgaagccgctggtgcgggaccctcgggcaggaggtgaggaccccctcccttctctcgcccctcaatcatcttagggcggtggctacaggacagagagaggggcgtgcccctcggctgtgaagtgggcatgcccgtgtgatgcccccgcccgtcgtctcaccggggcgcaccgcgctggtcctcctccgccagtctcccgagctccggccattcatccccagcgcagagcagcgctggcagccggcgccgcgatggaggaagagctgaagtgtcccgtgtgcggctctctgtttcgggagcctatcatcctgccctgttcccacaatgtctgcctgccttgcgctcgcaccatcgcggtgcagaccccggacggtgagcagcacctgccccagccgctcctgctttcccggggatcggggctgcaggcgggcgccgccgccgctgcctctctggagcacgacgctgcggctggcccggcctgcggcggtgcaggcgggagtgcagctggcggcctcggcggcggtgcgggaggtggcggagaccacgcggacaagctcagcttgtacagcgagacagacagcggctacgggtcctacaccccgagcctcaagtcccccaacggggttcgcgtgctgcccatggtgcccgcaccacccggctcctcggctgcggcggctcggggtgccgcctgctcctcgctgtcctcgtcttcgagctccatcacgtgcccgcagtgccaccgcagcgcatccctggaccaccgcggcctgcgcggcttccagcgcaaccggctgctcgaggccatcgtgcagcggtaccagcagggccgcggggccgtgccggggacgtctgcagccgcggcggtggccatctgccagctgtgcgaccgcaccccgccagagccagcagccacgctctgcgagcagtgcgacgtcctctactgctctgcctgccagctcaagtgccatccatcccggggacccttcgccaagcatcgcctggtgcagccgccgccgccgccgccgccgcccgccgaggcagcctccgggcccactggcaccgcccagggcgcccccagcggaggcggcggctgcaagagcccgggaggcgcgggggcgggggcgactgggggcagcacggcccgcaagttccccacgtgtcccgagcatgaaatggagaactacagcatgtactgcgtgagctgtcgaaccccggtgtgttatctgtgcctggaggagggccggcacgccaagcacgaggtgaagccgctgggggccatgtggaagcagcacaaggcacaactatctcaggccttaaatggagtttcagataaggcaaaggaagcaaaggagtttctggttcagctaaagaacatattgcagcagatccaggaaaacggactggactacgaagcctgcctcgttgctcagtgtgatgcccttgtggatgctttaactcgtcagaaagccaagctgctcaccaaggtgactaaagagagggaacacaagttgaagatggtttgggaccagatcaatcactgcacattgaagctgcgtcagtccaccggactgatggagtactgcctggaggtgatcaaggagaacgacccctccgggttcttacagatctcagatgctctgatcaagcgcgtccaggtgtctcaggagcagtgggtcaaaggcgccctggagccgaaagtgtctgcggagtttgatctgactttggacagcgagccgctgctgcaggccatccaccagctggacttcattcagatgaaattgccacccgtccccctactgcagctggagaaatgctgcacccgtaacaacagcgtcacgctggcctggaggatgccacccttcacccacagccccgtggacggctacatcctggagctggacgacggtgccgggggacagttccgggaagtgtacgtcggtaaggagactttgtgtaccatcgacggtcttcacttcaacagcacctacaacgcccgagtcaaagctttcaactcttctggtgtcgggccttacagtaaaactgtcgtcctgcagacatccgatgtggcctggttcacatttgaccccaactctgggcatcgggacatcattttatccaatgacaaccagacagccacctgcagcagctatgacgaccgggtggtgctgggcacagctgcgttctccaagggcgtgcactactgggagctgcacgtggaccggtacgacaaccacccagaccccgccttcggggtggccagggccagcgtggtcaaggacatgatgctgggcaaggatgacaaggcctgggccatgtatgtggacaacaaccgcagctggttcatgcactgcaactcccacaccaacaggacggaaggtggcgtgtgcaagggggccaccgtgggcgtgctgctggacctgaataagcacactctcaccttcttcatcaacgggcagcagcagggccccacagccttcagccacgtggacggggtcttcatgccagccctcagcctcaaccgcaacgtgcaggtcaccctgcacacaggattggaagtgccgactaacctggggcggccaaagctgtcaggcaattagccccgctccagctcggcactgtgcctgtgacagtgacattcacaggcaaaacgcccaccattctcactaagctcaaataacccacaaaagcaggatatgcaaatcatgggtgcaacctggcagcgtggagtgtcatagaaacacattttcttggggacgcagggaatgggtccacgggccatgctcacagctgccactgtcagtggcaaaggaaggtacgtgtgtcacccttattccacccagacattacgaacactccccaagaaggacctttctcaagggagtcagcattcgggcttcatgtctatgtttcctgccatctgttttcaaagcttgtctttttttggagggagaggaaggtagactttgagactggcctcctgagagcggcagtcaggagctgcgctgtaatcccacgccccgggtgttggccctccgtggggaccttgcctcctcagagtcccgagattgcagattctcatcatgctgagaaagttatcttttagcttcttggtcctagagtctttagtagcacctgccacttgcagacccaatgcaggattgatagaaagggacattaatcattcatgcttgacttttgcctctctcactgaagtgttagaaccttttaaaatggcttcctttattaatcagccaattgtgttctctctctctcttcctccatccttcatttcttctccctccctccttctctttctctcttcttctctctctccttccttccctcctttgctctctctttcttcctttcctccttctctcttactttcctccatccctgcctctttcttccctctttcgctctctttccctccctccttctctctctctctcacacacacacaggcatgacagtctcctaaaattaattcactcagttcttagttcttaaatccacgtgaaaacacaagaattttaacaactatgtcataggtcttcgcctggtgatggctcctttctgaaactggcagcccaagaagttaactgaaaatgcatccagattgctcttctgagctgaaccactctcagactcataagcatttaaaatgggagaccctgggaaagcctgttctagtcagtccaccctattgtcattatgaaagcatcatgaacacaagtggcccctgtggcaggccgggacggctctgccctgatgcagtgggcgggatctctggggaaggcaggaaatagaagggcagtatcaggtaccttgtctcccagcttcccactgtgagactgggtgtgccgagtctgacctgccagggcaggactctggaaacaccaggcttctcccttgagatccacattgattcatccacacctctcagagacagctcatggcaggggttttgagcctgccaggctcttgttcccagggaacccttcctctcctccctcctctcatcttcccagtcacctgccacctccagctccacctggtagtaacatttctctctccttttaaaaagaatatattttgtcaagcattttatttctgaggctgagaagtgacttgtcaatttgctggactggatttttataaaattcgcccattcaccagcaccaactgtgcgtccttggttctgccttcctgttcagacaccgcgcctgctttctgagtaactgcctgccggagccatgcaggtaccccccctccactcagcaggcccgacaatcctacctcaaagctcatgctcttggtctgcaaggctgcttggtccgctgtctctgcagatgtggccggcaaggccagctgccccgtctccaggagctgctcggtgctgtgttgcagtctctgctgcggagcctgggagctatctgcttcatggaagtctaggtcttgcctcttccttgtcatctcaccaagcggtttctgggtctcctcctcccatcccagagccctgtccagagctcttggtggtgacacacaagacctgggaccctgtgtccttgcccgcacctctgcctctgtctcccatatccctgcagcttcatccttagccatagctctgggtggcctttgcttggagcatggagacgatccctaaagattgaggatgaagaggagccaccactttcctggggccaaggaagccatcagctttgggaagtgtctagctctcttctgaaaaaaaaacaggcctacaccctgcccccagaatgagagtgggctaggcagggctgcctggtgacagcagcttctcacaggggagccctggggaaggctgtggagcctccaccatcaccacagcccaggtcaccaggtggccccagctctgcagaagaatcgcccatcattggagcacaagttgcctggggctaccctgaacctaacccctttgagggagcagcatccaggtcaggagagaagtggaaagtgcaggagggtaatgccctcaaatccggtggcctctttcagaaaaaagttccctgaagtccagagaggtgcagccaggactccctcctccccactgccaccctgagcttgggggctgggattctcccttttctgactcctccaggagcccagaagcaatacggccgatgccagggacagcatccagctctccttcacagacacctctcctgtcttcagcacaaaacaccttcaatgttctgacttcaaagagaacgacaggtccgtgccacacacttgtgtttttgagggatcagaaaagtgaagaaggaacttatcaattcctcatggccaggaaggtcccgggtttcagagtagaaatgacagacaggtcatggaattctcatccaccatcgaattccataacacgttacatcatggtggcacatttgtacatacatataaatgatatcaagatgaggcttttgttgggctggctgaggagtaacttggtgtaaatctatcaagcagtttcagtgaaaaaggaattcaaagtagtttaaaaatgtcgagttccattgcattgtaaatagtgcctctgtaatgtggttctgcagttgttctttgctagtgagcaagcttggtcaaagtgtatgccttttccttttaaaattaatctcttccgaaaatatccactagcacctcactgcatacatagcatcccagctcctaattcaaagcaggggaaggtatttccccaaagcctgcttttcctctctctgttctccttgggaaaataatgattccaattaaagaggacaccagtaatactgacccacaaggtaactgacctaaacactataaaactgtatatatttccaggctgcatcttcagcctgatatgtactttgtagttgcaacagcgccctaggtgccctatggcccaccaagtttgaggagggtggtgctttccggattgagcctgggcaggctctgtggagctcaccaagagagctgggggcaggcccaccctcctctttgcgccctttctctccctcttggtgcccctgccctccgccccaccacagcactctcaggaaaggatcagaatgcaggatctttgtgtatttcttccagggatatttgcatttaagccttaattctcattgcaagcgaaaggcttggtccccctgggaaggcgggtttcggcaccggtgggcaggtggttcagtgtcaaggaggctgctgctggtcccatggccacctgctggctttgaggtagtgagggagggtcaatccttagggggagtcaacatgtgaatgctaaagaacactgctgcacagcccgtggggtggcgccagggtttctcaacctctactgacattttgcgataggttctgtatgccgtaggatgtttagcaacatccctggtctctacccatcatctgccagtagcaacccccaagttaggtgtgacaaccaaaagtatctgtcgacattgctaggtatctcctgggggcctccacaagttgagaaccaccaggttatgccagtggtttgtcatgcatggatctgtagagggactgtggcgctccggctgctttgttccatagaaagcctgtatgtgacaaagctgccagcctttatcttgatacccaagcccaggattttccatgtgtcttcagggggcaggtaggggaaaatggggtgagccacctccaacagatgccaacctgttgggtcttgaattttcactcactgaagatgccccctgcccgctccccacttcctagaaagcaaaactcgttacctttgttttccttggccacattttactggaagcaacaggaacttcttaatgggtttgtggccctcaattggtttttaaaaaaatctaacagatcttattggcaaatattcaagatggtgatgctggaaaatttcaggacttttcttttgcaagtgagccggtagctgtgtttgttgaccacattctttggcagttcctcccagaagatcaaaggatcctgcagctttaacctaatatctaggctgtaaaaatatgagggcaggtttcgggcaggatgtattgatcagacaccaagttcagccctcggttacttccctcttttaacctggctttaatagtgattcatggtatgagtgggggccaatctcttatcctttctgtgcctcagtatccccacctgaaatgagactagtcatactaacctacctcctctgatgtattgtgaggattatacaataacatttttaaagaaaaaaagtgcagtctttcatctctggcatctaagctaatgattcccattcagtgactcaaacctgtggggggcgttccagtgttctctgaccagtgtcttccatccaagcctccttgtgaccagggcaaggagctgcctggcctccagtgggtaaaatagacctttaagacaggtttcctatgaccatagaaagtaacaccccatatgtttccattcccggcgaggcctgtttgaatggcgctctgtgtgagtgctatgaacaggctacctgtcagcagtctcactgcgaggcctcaaggcctctgtgagcagaagcccctttaaaccaaggaaggacactaacccaggcctctgccttctttgttacctaagttctggtatctaaggggtctctcatctcacagcttgcctcctttgtttcgaggggtctctgcagtgtgaatgggtttgaaatccagtgtggatagcacgaagagatgcaactgagccgaagttttgaaggctggttgggctagtgggtcatcatgtcactttcagatgactgataaccgctgggactgctggggcttcaccagcacgagctatgcaggttgggggaggccctggctttttcaatgattgacgttgacatcagtcaggagctgggagttgagacctccagggaagtctcgtccggatccatcgctcttctctcaaggagcacagtcctgggaaaggcctagggacctgtgggccggtgatgcgggcactgcagaccaggccaggccctcgggtaaagctctgaggagaggccaaaaccaggcttcaggttcgggaaggtgactgcttgcaactgcagtagcaggaacatgtcaggtgcttactgggtgagacccagccggggaagcctctccaactcctcctagccctggaaaccagacacccagagccccaggctttctcggcacccagaagaagtggggagcgggcaaagcagaaaacattcaatgcatgatgtaggattgctgcgttggcactaagctgttgtattaagcatgagaggtgtttgtttaacgttggcaaagggatttaacaagaaacaaaaagcttcgcgtccttgttttgaccgtcgacagaagtccaattttcttgcctttctttatccccatttctcctccctccccttcccccatcacatccactttcggtcactcgttgttggtatttggtggcagctcttggtcctattgctgtggatgttccactgaaaacacggggggtagcggggagtggtaaggaaagcaacttttttctaatttttgtattggtatccacaagcgtttgtattttttgaattgcaaacactgtgttttctggtctttgggggttagttgaactttctgtattaccttttggaaaacctgagttttaccacagtcttaagcagatttgaaataaattcttttgacactgccaa

SEQ ID NO: 195149 - DNA, 3352 bp, Homo sapiens
  Payload ID: 18534
  Gene Name: tripartite motif containing 68
  Uniprot ID: Q6AZZ1
  ENST ID: ENST00000300747
  CDS Start-End: 291-1748
attggctgccgtcccgcgagcggggcctagagccgggtgtagtattctgggagctgcgggctactgggcctgcgctgccgggctttgggttctgggcctctgccgctctctggccctaagtgctgagctgccgggaacggcagcttctgacgctgggccattggacgctgcggaaccaggcttcttcactttgagtttccgccgcgaagcgccagtccgggccgaggagggagcctttactacttctccctggtttcattcatgttctgaggagggtgtgagaaggaaccatggatcccacagccttggtggaagccattgtggaagaagtggcctgtcccatctgtatgaccttcctgagggagcccatgagcattgactgtggccacagcttctgccacagctgtctctctggactctgggagatcccaggagaatcccagaactggggttacacctgtcccctctgtcgagctcctgtccagccaaggaacctgcggcctaattggcagctggccaatgttgtagaaaaagtccgtctgctaaggctacatccaggaatggggctgaagggtgacctgtgtgagcgccatggggaaaagctgaagatgttctgcaaagaggatgtcttgataatgtgtgaggcctgcagccagtccccagagcatgaggcccacagtgttgtgccaatggaggatgttgcctgggagtacaagtgggaacttcatgaggccctcgaacatctgaagaaagagcaagaagaggcctggaagcttgaagttggtgaaaggaaacgaactgccacctggaagatacaggtggaaacccgaaaacagagtattgtatgggagtttgaaaaataccagcgattactagagaaaaagcagccaccacatcggcagctgggggcagaggtagcagcagctctggccagcctacagcgggaggcagcggagaccatgcagaaactggagttgaaccatagcgagctcatccagcagagccaggtcctgtggaggatgattgcagagttgaaagagaggtcgcagaggcctgtccgctggatgttgcaggatattcaggaagtgttaaacaggagcaaatcttggagcttgcagcagccagaaccaatctccctggagttgaagacagattgccgtgtgctggggctaagagagatcctgaagacttatgcagctgatgtgcgcttggatccagatactgcttactcccgtctcatcgtgtctgaggacagaaaacgtgtgcactatggagacaccaaccagaaactgccagacaatcctgagagattttaccgctataatatcgtcctgggaagccagtgcatctcctcaggccggcactactgggaggtggaggtgggagacaggtctgagtggggcctgggagtatgtaagcaaaatgtagaccggaaggaggtggtctacttatccccccactatggattctgggtgataaggctgaggaagggaaatgagtaccgagcaggcaccgatgagtacccaatcctgtccttgccggtccctcctcgccgggtgggaatcttcgtggattatgaggcccatgacatttctttctacaatgtgactgactgtggctcccacatcttcactttcccccgctatcccttccctgggcgcctcctgccctattttagtccttgctacagcattggaaccaacaacactgctcctctggccatctgctccctggatggggaggactaagaaagctaccaccctaaccagagaggcttggaattgggcctggcccccatggggcttggaggaccgagccactgacaggtatcccctgaaactgagctgagcccagtatccaaggattcctctgtctgatcctttggtctttgctaccaggctgaagtctgtcatgaaaccacttattttaaaaagcagaggcccagtcaaatgagcattgcatcccatgagggaagcacgacagggctgatggtgaggatcagagcagttctaaggtgactcgttggggtaaggatcaggactttgtccatgtagtagccaaccaccctcttccctgattcccgtccggtgtcacagttcagtcagtgaggatgatgaagtagatacagtcttcaggacaccattagatgggctttcccaataggccaaaaaaatgctgcgcatacccagagctggttgttgtgctgaggccagtcagaggatgcttcccctgaggtttgctataactaagcaacctttatgtgactctcaccttctgacctcctggcaagagaaattcagtgcagcagggggacacagacctgcccaagccaccccactgccgttccctctctgagcacaagctgggcaaatcactgtcccttggactccaggagaccagtgtcctagtcttgccttttttctctaagtggcaggatcagaaaacctgcgagctttagtttgtattttcactttatgaatgaggaaactgaaatggccttaagggagcaagttatttctttttttttgacacggagtctcactctgttgcccaggctggagtgcagtggcacgatctcggctcactgcaggctctgcctcctgggttcacgccattctcctgcctcagcttcccgagtagctgggactacaggcgcccaccacgacgcctggctcatttttttgtatttttagtagagacggagtttcaccatgttagctaggatggtctcgatctcctgacctcatgatccgccctcctcagcctcccacagtgctgggattagaggcatgagccactgcgcccggcccctggagcaagttatttcttacaaagctgctgaaggtaagattatcaaaattataaagcatttttcacactcaagtgaaacaaggttgacaaactcacttcgcaggtcacatgcctatacatcacttattatatttgggtctgaaacttctcacatgtttgggaggttttatgtgtcctcattgggaaaatgggtgtaattcagcataaaacctcatatgattgtcctgcctcatggagctgttgtatagatcccagatccatcccatgatttgttcctgtctgaggcatagaggcaggcaagccgtggattttgcacatggtgactttcccactgtgccatgatacagtctgcatcttatagcagtgcctttgtctcagggcctctgctggcagtctagaccttttgggcagaaaggagcttcaaatggctgtgataaggaatattaaaaattgtgtttctactttaattgtattggctgttcatgtatgtaggagttaaaataggccaaactggagaaataaacgcattctgtccaccatg

SEQ ID NO: 195150 - DNA, 3187 bp, Homo sapiens
  Payload ID: 18534
  Gene Name: tripartite motif containing 68
  ENST ID: ENST00000531101
  CDS Start-End: 236-799
gcgggctactgggcctgcgctgccgggctttgggttctgggcctctgccgctctctggccctaagtgctgagctgccgggaacggcagcttctgacgctgggccattggacgctgcggaaccaggcttcttcactttgagtttccgccgcgaagcgccagtccgggccgaggagggagcctttactacttctccctggtttcattcatgttctgaggagggtgtgagaaggaaccatggatcccacagccttggtggaagccattgtggaagaagtggcctgtcccatctgtatgaccttcctgagggagcccatgagcattgactgtggccacagcttctgccacagctgtctctctggactctgggagatcccaggagaatcccagaactggggttacacctgtcccctctgtcgagctcctgtccagccaaggaacctgcggcctaattggcagctggccaatgttgtagaaaaagtccgtctgctaaggctacatccaggaatggggctgaagggtgacctgtgtgagcgccatggggaaaagctgaagatgttctgcaaagaggatgtcttgataatgtgtgaggcctgcagccagtccccagagcatgaggcccacagtgttgtgccaatggaggatgttgcctgggagtacaagtgggaacttcatgaggccctcgaacatctgaagaaagagcaagaagaggcctggaagcttgaagttggtgaaaggaaacgaactgccacctggaaggcaggtggaaacccgaaaacagagtattgtatgggagtttgaaaaataccagcgattactagagaaaaagcagccaccacatcggcagctgggggcagaggtagcagcagctctggccagcctacagcgggaggcagcggagaccatgcagaaactggagttgaaccatagcgagctcatccagcagagccaggtcctgtggaggatgattgcagagttgaaagagaggtcgcagaggcctgtccgctggatgttgcaggatattcaggaagtgttaaacaggagcaaatcttggagcttgcagcagccagaaccaatctccctggagttgaagacagattgccgtgtgctggggctaagagagatcctgaagacttatgcagctgatgtgcgcttggatccagatactgcttactcccgtctcatcgtgtctgaggacagaaaacgtgtgcactatggagacaccaaccagaaactgccagacaatcctgagagattttaccgctataatatcgtcctgggaagccagtgcatctcctcaggccggcactactgggaggtggaggtgggagacaggtctgagtggggcctgggagtatgtaagcaaaatgtagaccggaaggaggtggtctacttatccccccactatggattctgggtgataaggctgaggaagggaaatgagtaccgagcaggcaccgatgagtacccaatcctgtccttgccggtccctcctcgccgggtgggaatcttcgtggattatgaggcccatgacatttctttctacaatgtgactgactgtggctcccacatcttcactttcccccgctatcccttccctgggcgcctcctgccctattttagtccttgctacagcattggaaccaacaacactgctcctctggccatctgctccctggatggggaggactaagaaagctaccaccctaaccagagaggcttggaattgggcctggcccccatggggcttggaggaccgagccactgacaggtatcccctgaaactgagctgagcccagtatccaaggattcctctgtctgatcctttggtctttgctaccaggctgaagtctgtcatgaaaccacttattttaaaaagcagaggcccagtcaaatgagcattgcatcccatgagggaagcacgacagggctgatggtgaggatcagagcagttctaaggtgactcgttggggtaaggatcaggactttgtccatgtagtagccaaccaccctcttccctgattcccgtccggtgtcacagttcagtcagtgaggatgatgaagtagatacagtcttcaggacaccattagatgggctttcccaataggccaaaaaaatgctgcgcatacccagagctggttgttgtgctgaggccagtcagaggatgcttcccctgaggtttgctataactaagcaacctttatgtgactctcaccttctgacctcctggcaagagaaattcagtgcagcagggggacacagacctgcccaagccaccccactgccgttccctctctgagcacaagctgggcaaatcactgtcccttggactccaggagaccagtgtcctagtcttgccttttttctctaagtggcaggatcagaaaacctgcgagctttagtttgtattttcactttatgaatgaggaaactgaaatggccttaagggagcaagttatttctttttttttgacacggagtctcactctgttgcccaggctggagtgcagtggcacgatctcggctcactgcaggctctgcctcctgggttcacgccattctcctgcctcagcttcccgagtagctgggactacaggcgcccaccacgacgcctggctcatttttttgtatttttagtagagacggagtttcaccatgttagctaggatggtctcgatctcctgacctcatgatccgccctcctcagcctcccacagtgctgggattagaggcatgagccactgcgcccggcccctggagcaagttatttcttacaaagctgctgaaggtaagattatcaaaattataaagcatttttcacactcaagtgaaacaaggttgacaaactcacttcgcaggtcacatgcctatacatcacttattatatttgggtctgaaacttctcacatgtttgggaggttttatgtgtcctcattgggaaaatgggtgtaattcagcataaaacctcatatgattgtcctgcctcatggagctgttgtatagatcccagatccatcccatgatttgttcctgtctgaggcatagaggcaggcaagccgtggattttgcacatggtgactttcccactgtgccatgatacagtctgcatcttatagcagtgcctttgtctcagggcctctgctggcagtctagaccttttgggcagaaaggagcttcaaatggctgtg

SEQ ID NO: 195151 - DNA, 874 bp, Homo sapiens
  Payload ID: 18534
  Gene Name: tripartite motif containing 68
  ENST ID: ENST00000526337
  CDS Start-End: 449-874
agagccgggtgtagtattctgggagctgcgggctactgggcctgcgctgccgggctttgggttctgggcctctgccgctctctggccctaagtgctgagctgccgggaacggcagcttctgacgctgggccattggacgctgcggaaccaggcttcttcactttgagtttccgccgcgaagcgccagtccgggccgaggagggagtgggaacttcatgaggccctcgaacatctgaagaaagagcaagaagaggcctggaagcttgaagttggtgaaaggaaacgaactgccacctggaagatacaggtggaaacccgaaaacagagtattgtatgggagtttgaaaaataccagcgattactagagaaaaagcagccaccacatcggcagctgggggcagaggtagcagcagctctggccagcctacagcgggaggcagcggagaccatgcagaaactggagttgaaccatagcgagctcatccagcagagccaggtcctgtggaggatgattgcagagttgaaagagaggtcgcagaggcctgtccgctggatgttgcaggatattcaggaagtgttaaacaggagcaaatcttggagcttgcagcagccagaaccaatctccctggagttgaagacagattgccgtgtgctggggctaagagagatcctgaagacttatgcagctgatgtgcgcttggatccagatactgcttactcccgtctcatcgtgtctgaggacagaaaacgtgtgcactatggagacaccaaccagaaactgccagacaatcctgagagattttaccgctataatatcgtcctgggaagccagtgcatctcctcaggccggcactactgggaggtggaggtggga

SEQ ID NO: 195152 - DNA, 764 bp, Homo sapiens
  Payload ID: 18534
  Gene Name: tripartite motif containing 68
  ENST ID: ENST00000533021
  CDS Start-End: 170-764
gctgagctgccgggaacggcagcttctgacgctgggccattggacgctgcggaaccaggcttcttcactttgagtttccgccgcgaagcgccagtccgggccgaggagggagcctttactacttctccctggtttcattcatgttctgaggagggtgtgagaaggaaccatggatcccacagccttggtggaagccattgtggaagaagtggcctgtcccatctgtatgaccttcctgagggagcccatgagcattgactgtggccacagcttctgccacagctgtctctctggactctgggagatcccaggagaatcccagaactggggttacacctgtcccctctgtcgagctcctgtccagccaaggaacctgcggcctaattggcagctggccaatgttgtagaaaaagtccgtctgctaaggctacatccaggaatggggctgaagggtgacctgtgtgagcgccatggggaaaagctgaagatgttctgcaaagaggatgtcttgataatgtgtgaggcctgcagccagtccccagagcatgaggcccacagtgttgtgccaatggaggatgttgcctgggagtacaagatacaggtggaaacccgaaaacagagtattgtatgggagtttgaaaaataccagcgattactagagaaaaagcagccaccacatcggcagctgggggcagaggtagcagcagctctggccagcctacagcgggaggcagcggagaccatgcagaaactggagttgaacc

SEQ ID NO: 195153 - DNA, 1901 bp, Homo sapiens
  Payload ID: 18535
  Gene Name: tripartite motif containing 69
  Uniprot ID: Q86WT6
  ENST ID: ENST00000329464
  CDS Start-End: 344-1846
ggggagctatgaaccttaagattagaccactaactcgaatctaaatgagctgcccttgtctcctacaaaagaaaagttgggcaggtagggtattctaatgagggtttctctttctcttaagcaaatgatgatcaaagttaactgacaaactgtcacggaatctgccagacctcactctggccttgctgcttctctccagctcctgaacttttctttcttccatcatgctctgagcccattccttgaaaactaaaaggtccctgactcccagtctgcagccatcctgggcctgctgagctctgattcaagtgcctgcctctgccccttggtgggctgaagcttcatggaggtatccaccaacccctcctccaacatcgatccaggcgactatgttgaaatgaatgattcaatcacccacctaccctctaaagtggtgatacaagatattactatggagctacactgccctctgtgcaatgattggttccgagacccactgatgctaagctgtggccacaacttctgtgaagcctgtatccaagacttttggaggctgcaagcaaaggaaacattctgtcctgagtgtaagatgctatgtcagtataacaactgtacattcaaccctgtactggacaagttggtagagaagattaagaagttacccttactcaagggccatccacagtgcccagagcatggagagaacctgaaactgttcagtaaaccagatgggaaactgatctgctttcaatgcaaggatgctcggttgtctgtggggcagtctaaggagttcctgcaaatctctgatgctgtccatttcttcacggaggagcttgccatccaacagggtcaactggagacaactctgaaggagcttcagaccctgaggaacatgcagaaggaagctattgctgctcacaaggaaaacaagctacatctgcagcaacatgtgtccatggagtttctaaagctgcatcagttcctgcacagcaaagaaaaggacattttaactgagctccgggaagaggggaaagccttgaatgaggagatggagttgaatctgagccagcttcaggagcaatgtctcttagccaaggatatgttggtgagcattcaggcaaagacggaacaacagaactccttcgactttctcaaagacatcacaactctcttacatagcttggagcaaggaatgaaggtgctggcaaccagagagcttatttccagaaagctgaacctgggccagtacaaaggtcctatccagtacatggtatggagggaaatgcaggacactctctgcccaggcctgtctccactaactctggaccctaaaacagctcacccaaatctggtgctctccaaaagccaaaccagcgtctggcatggtgacattaagaagataatgcctgatgatcctgagaggtttgactcaagtgtggctgtactgggctcaagaggcttcacctctggaaagtggtactgggaagtagaagtagcaaagaagacaaaatggacagttggagttgtcagagaatccatcattcggaagggcagctgtcctctaactcctgagcaaggattctggcttttaagactaaggaaccaaactgatctaaaggctctggatttgccttctttcagtctgacactgactaacaacctcgacaaggtgggcatatacctggattatgaaggaggacagttgtccttctacaatgctaaaaccatgactcacatttacaccttcagtaacactttcatggagaaactttatccctacttctgcccctgccttaatgatggtggagagaataaagaaccattgcacatcttacatccacagtaatgagtcataatattatacaaattcagagtgttattaaagaggtattgaaatattt

SEQ ID NO: 195154 - DNA, 1222 bp, Homo sapiens
  Payload ID: 18535
  Gene Name: tripartite motif containing 69
  Uniprot ID: Q86WT6
  ENST ID: ENST00000338264
  CDS Start-End: 140-1165
gaacttttctttcttccatcatgctctgagcccattccttgaaaactaaaaggtccctgactcccagtctgcagccatcctgggcctgctgagctctgattcaagtgcctgcctctgccccttggtgggctgaagcttcatggaggaggagcttgccatccaacagggtcaactggagacaactctgaaggagcttcagaccctgaggaacatgcagaaggaagctattgctgctcacaaggaaaacaagctacatctgcagcaacatgtgtccatggagtttctaaagctgcatcagttcctgcacagcaaagaaaaggacattttaactgagctccgggaagaggggaaagccttgaatgaggagatggagttgaatctgagccagcttcaggagcaatgtctcttagccaaggatatgttggtgagcattcaggcaaagacggaacaacagaactccttcgactttctcaaagacatcacaactctcttacatagcttggagcaaggaatgaaggtgctggcaaccagagagcttatttccagaaagctgaacctgggccagtacaaaggtcctatccagtacatggtatggagggaaatgcaggacactctctgcccaggcctgtctccactaactctggaccctaaaacagctcacccaaatctggtgctctccaaaagccaaaccagcgtctggcatggtgacattaagaagataatgcctgatgatcctgagaggtttgactcaagtgtggctgtactgggctcaagaggcttcacctctggaaagtggtactgggaagtagaagtagcaaagaagacaaaatggacagttggagttgtcagagaatccatcattcggaagggcagctgtcctctaactcctgagcaaggattctggcttttaagactaaggaaccaaactgatctaaaggctctggatttgccttctttcagtctgacactgactaacaacctcgacaaggtgggcatatacctggattatgaaggaggacagttgtccttctacaatgctaaaaccatgactcacatttacaccttcagtaacactttcatggagaaactttatccctacttctgcccctgccttaatgatggtggagagaataaagaaccattgcacatcttacatccacagtaatgagtcataatattatacaaattcagagtgttattaaagaggtattgaaatatttta

SEQ ID NO: 195155 - DNA, 391 bp, Homo sapiens
  Payload ID: 18535
  Gene Name: tripartite motif containing 69
  ENST ID: ENST00000561170
  CDS Start-End: 1-391
gagcaatgtctcttagccaaggatatgttggacatcacaactctcttacatagcttggagcaaggaatgaaggtgctggcaaccagagagcttatttccagaaagctgaacctgggccagtacaaaggtcctatccagtacatggtatggagggaaatgcaggacactctctgcccaggcctgtctccactaactctggaccctaaaacagctcacccaaatctggtgctctccaaaagccaaaccagcgtctggcatggtgacattaagaagataatgcctgatgatcctgagaggtttgactcaagtgtggctgtactgggctcaagaggcttcacctctggaaagtggtactgggaagtagaagtagcaaagaagacaaaatggacag

SEQ ID NO: 195156 - DNA, 1017 bp, Homo sapiens
  Payload ID: 18535
  Gene Name: tripartite motif containing 69
  ENST ID: ENST00000561043
  CDS Start-End: 171-962
actctggccttgctgcttctctccagctcctgaacttttctttcttccatcatgctctgagcccattccttgaaaactaaaaggtccctgactcccagtctgcagccatcctgggcctgctgagctctgattcaagtgcctgcctctgccccttggtgggctgaagcttcatggaggaggagcttgccatccaacagggtcaactggagacaactctgaaggagcttcagaccctgaggaacatgcagaaggaagctattgctgctcacaaggacatcacaactctcttacatagcttggagcaaggaatgaaggtgctggcaaccagagagcttatttccagaaagctgaacctgggccagtacaaaggtcctatccagtacatggtatggagggaaatgcaggacactctctgcccaggcctgtctccactaactctggaccctaaaacagctcacccaaatctggtgctctccaaaagccaaaccagcgtctggcatggtgacattaagaagataatgcctgatgatcctgagaggtttgactcaagtgtggctgtactgggctcaagaggcttcacctctggaaagtggtactgggaagtagaagtagcaaagaagacaaaatggacagttggagttgtcagagaatccatcattcggaagggcagctgtcctctaactcctgagcaaggattctggcttttaagactaaggaaccaaactgatctaaaggctctggatttgccttctttcagtctgacactgactaacaacctcgacaaggtgggcatatacctggattatgaaggaggacagttgtccttctacaatgctaaaaccatgactcacatttacaccttcagtaacactttcatggagaaactttatccctacttctgcccctgccttaatgatggtggagagaataaagaaccattgcacatcttacatccacagtaatgagtcataatattatacaaattcagagtgttattaaagaggtattgaaatattt

SEQ ID NO: 195157 - DNA, 2486 bp, Homo sapiens
  Payload ID: 18535
  Gene Name: tripartite motif containing 69
  Uniprot ID: Q86WT6
  ENST ID: ENST00000559390
  CDS Start-End: 929-2431
agtgttttagcctatccagttccgggagtttgcacgcagacgctctgcttcgtgaccttggctctgctctgtgggcgccgcccccagcctgggcgcgtccatcgtcgagtaccttctcctctgcctccccctccctctgcttctatctctctccaattgccctccctggcctgcggccgcccggtcctccttcccagcccagtgcagccaggcacccgggttcggcttgctcaggtctctgtccgggactgggaagccacggagggccgggaaagtggcacactcctggagctcaagcttcctactctctcatcgctgaataactaccgggcaggactgggtggaacagacagcatatttaggtcattgatgggctgctgggtggatggagctggaaagtgatgggcactgctttctggggctgcccaggttccttccgagggctcgcttttcctgggcagagcgggaaagaggaggggcaggccggtcgcgaaacgcaaatagtcgagaatagcgatccggggagaagcaggtgtctgtggggcccaagagaagtaccatctcgagcatccttagtccagaaatggggagctatgaaccttaagattagaccactaactcgaatctaaatgagctgcccttgtctcctacaaaagaaaagttgggcaggtagggtattctaatgagggtttctctttctcttaagcaaatgatgatcaaagttaactgacaaactgtcacggaatctgccagacctcactctggccttgctgcttctctccagctcctgaacttttctttcttccatcatgctctgagcccattccttgaaaactaaaaggtccctgactcccagtctgcagccatcctgggcctgctgagctctgattcaagtgcctgcctctgccccttggtgggctgaagcttcatggaggtatccaccaacccctcctccaacatcgatccaggcgactatgttgaaatgaatgattcaatcacccacctaccctctaaagtggtgatacaagatattactatggagctacactgccctctgtgcaatgattggttccgagacccactgatgctaagctgtggccacaacttctgtgaagcctgtatccaagacttttggaggctgcaagcaaaggaaacattctgtcctgagtgtaagatgctatgtcagtataacaactgtacattcaaccctgtactggacaagttggtagagaagattaagaagttacccttactcaagggccatccacagtgcccagagcatggagagaacctgaaactgttcagtaaaccagatgggaaactgatctgctttcaatgcaaggatgctcggttgtctgtggggcagtctaaggagttcctgcaaatctctgatgctgtccatttcttcacggaggagcttgccatccaacagggtcaactggagacaactctgaaggagcttcagaccctgaggaacatgcagaaggaagctattgctgctcacaaggaaaacaagctacatctgcagcaacatgtgtccatggagtttctaaagctgcatcagttcctgcacagcaaagaaaaggacattttaactgagctccgggaagaggggaaagccttgaatgaggagatggagttgaatctgagccagcttcaggagcaatgtctcttagccaaggatatgttggtgagcattcaggcaaagacggaacaacagaactccttcgactttctcaaagacatcacaactctcttacatagcttggagcaaggaatgaaggtgctggcaaccagagagcttatttccagaaagctgaacctgggccagtacaaaggtcctatccagtacatggtatggagggaaatgcaggacactctctgcccaggcctgtctccactaactctggaccctaaaacagctcacccaaatctggtgctctccaaaagccaaaccagcgtctggcatggtgacattaagaagataatgcctgatgatcctgagaggtttgactcaagtgtggctgtactgggctcaagaggcttcacctctggaaagtggtactgggaagtagaagtagcaaagaagacaaaatggacagttggagttgtcagagaatccatcattcggaagggcagctgtcctctaactcctgagcaaggattctggcttttaagactaaggaaccaaactgatctaaaggctctggatttgccttctttcagtctgacactgactaacaacctcgacaaggtgggcatatacctggattatgaaggaggacagttgtccttctacaatgctaaaaccatgactcacatttacaccttcagtaacactttcatggagaaactttatccctacttctgcccctgccttaatgatggtggagagaataaagaaccattgcacatcttacatccacagtaatgagtcataatattatacaaattcagagtgttattaaagaggtattgaaatattt

SEQ ID NO: 195158 - DNA, 1211 bp, Homo sapiens
  Payload ID: 18535
  Gene Name: tripartite motif containing 69
  Uniprot ID: Q86WT6
  ENST ID: ENST00000558329
  CDS Start-End: 319-1158
acctcactctggccttgctgcttctctccagctcctgaacttttctttcttccatcatgctctgagcccattccttgaaaactaaaaggtccctgactcccagtctgcagccatcctgggcctgctgagctctgattcaagtgcctgcctctgccccttggtgggctgaagcttcatggaggaggagcttgccatccaacagggtcaactggagacaactctgaaggagcttcagaccctgaggaacatgcagaaggaagctattgctgctcacaaggtttccaggaaaacaagctacatctgcagcaacatgtgtccatggagtttctaaagctgcatcagttcctgcacagcaaagaaaaggacattttaactgagctccgggaagaggggaaagccttgaatgaggagatggagttgaatctgagccagcttcaggagcaatgtctcttagccaaggatatgttggacatcacaactctcttacatagcttggagcaaggaatgaaggtgctggcaaccagagagcttatttccagaaagctgaacctgggccagtacaaaggtcctatccagtacatggtatggagggaaatgcaggacactctctgcccaggcctgtctccactaactctggaccctaaaacagctcacccaaatctggtgctctccaaaagccaaaccagcgtctggcatggtgacattaagaagataatgcctgatgatcctgagaggtttgactcaagtgtggctgtactgggctcaagaggcttcacctctggaaagtggtactgggaagtagaagtagcaaagaagacaaaatggacagttggagttgtcagagaatccatcattcggaagggcagctgtcctctaactcctgagcaaggattctggcttttaagactaaggaaccaaactgatctaaaggctctggatttgccttctttcagtctgacactgactaacaacctcgacaaggtgggcatatacctggattatgaaggaggacagttgtccttctacaatgctaaaaccatgactcacatttacaccttcagtaacactttcatggagaaactttatccctacttctgcccctgccttaatgatggtggagagaataaagaaccattgcacatcttacatccacagtaatgagtcataatattatacaaattcagagtgttattaaagaggtattgaaatat

SEQ ID NO: 195159 - DNA, 1262 bp, Homo sapiens
  Payload ID: 18535
  Gene Name: tripartite motif containing 69
  Uniprot ID: Q86WT6
  ENST ID: ENST00000560442
  CDS Start-End: 319-1209
acctcactctggccttgctgcttctctccagctcctgaacttttctttcttccatcatgctctgagcccattccttgaaaactaaaaggtccctgactcccagtctgcagccatcctgggcctgctgagctctgattcaagtgcctgcctctgccccttggtgggctgaagcttcatggaggaggagcttgccatccaacagggtcaactggagacaactctgaaggagcttcagaccctgaggaacatgcagaaggaagctattgctgctcacaaggtttccaggaaaacaagctacatctgcagcaacatgtgtccatggagtttctaaagctgcatcagttcctgcacagcaaagaaaaggacattttaactgagctccgggaagaggggaaagccttgaatgaggagatggagttgaatctgagccagcttcaggagcaatgtctcttagccaaggatatgttggtgagcattcaggcaaagacggaacaacagaactccttcgactttctcaaagacatcacaactctcttacatagcttggagcaaggaatgaaggtgctggcaaccagagagcttatttccagaaagctgaacctgggccagtacaaaggtcctatccagtacatggtatggagggaaatgcaggacactctctgcccaggcctgtctccactaactctggaccctaaaacagctcacccaaatctggtgctctccaaaagccaaaccagcgtctggcatggtgacattaagaagataatgcctgatgatcctgagaggtttgactcaagtgtggctgtactgggctcaagaggcttcacctctggaaagtggtactgggaagtagaagtagcaaagaagacaaaatggacagttggagttgtcagagaatccatcattcggaagggcagctgtcctctaactcctgagcaaggattctggcttttaagactaaggaaccaaactgatctaaaggctctggatttgccttctttcagtctgacactgactaacaacctcgacaaggtgggcatatacctggattatgaaggaggacagttgtccttctacaatgctaaaaccatgactcacatttacaccttcagtaacactttcatggagaaactttatccctacttctgcccctgccttaatgatggtggagagaataaagaaccattgcacatcttacatccacagtaatgagtcataatattatacaaattcagagtgttattaaagaggtattgaaatat

SEQ ID NO: 195160 - DNA, 1222 bp, Homo sapiens; identical to SEQ ID NO: 195154
  Payload ID: 18535
  Gene Name: tripartite motif containing 69
  Uniprot ID: Q86WT6
  ENST ID: ENST00000618398
  CDS Start-End: 140-1165

SEQ ID NO: 195161 - DNA, 1901 bp, Homo sapiens
  Payload ID: 18535
  Gene Name: tripartite motif containing 69
  ENST ID: ENST00000621836
  CDS Start-End: 344-1846
ggggagctatgaaccttaagattagactactaactcgaatctaaatgagctgcccttgtctcctacaaaagaaaagttgggcaggtagggtattctaatgagggtttctctttctcttaagcaaatgatgatcaaagttaactgacaaactgtcacggaatctgccagacctcactctggccttgctgcttctctccagctcctgaacttttctttcttccatcatgctctgagcccattccttgaaaactaaaaggtccctgactcccagtctgcagccatcctgggcctgctgagctctgattcaagtgcctgcctctgccccttggtgggctgaagcttcatggaggtatccaccaacccctcctccaacatcaatccaggcgactatgttgaaatgaatgattcaatcacccacctaccctctaaagtggtgatacaagatattactatggagctacactgccctctgtgcaatgattggttccgagacccactgatgctaagctgtggccacaacttctgtgaagcctgtatccaagacttttggaggctgcaagcaaaggaaacattctgtcctgagtgtaagatgctatgtcagtataacaactgtacattcaaccctgtactggacaagttggtagagaagattaagaagttacccttactcaagggccatccacagtgcccagagcatggagagaacctgaaactgttcagtaaaccagatgggaaactgatctgctttcaatgcaaggatgctcggttgtctgtggggcagtctaaggagttcctgcaaatctctgatgctgtccatttcttcacggaggagcttgccatccaacagggtcaactggagacaactctgaaggagcttcagaccctgaggaacatgcagaaggaagctattgctgctcacaaggaaaacaagctacatctgcagcaacatgtgtccatggagtttctaaagctgcatcagttcctgcacagcaaagaaaaggacattttaactgagctccgggaagaggggaaagccttgaatgaggagatggagttgaatctgagccagcttcaggagcaatgtctcttagccaaggatatgttggtgagcattcaggcaaagacggaacaacagaactccttcgactttctcaaagacatcacaactctcttacatagcttggagcaaggaatgaaggtgctggcaaccagagagcttatttccagaaagctgaacctgggccagtacaaaggtcctatccagtacatggtatggagggaaatgcaggacactctctgcccaggcctgtctccactaactctggaccctaaaacagctcacccaaatctggtgctctccaaaagccaaaccagcgtctggcatggtgacattaagaagataatgcctgatgatcctgagaggtttgactcaagtgtggctgtactgggctcaagaggcttcacctctggaaagtggtactgggaagtagaagtagcaaagaagacaaaatggacagttggagttgtcagagaatccatcattcggaagggcagctgtcctctaactcctgagcaaggattctggcttttaagactaaggaaccaaactgatctaaaggctctggatttgccttctttcagtctgacactgactaacaacctcgacaaggtgggcatatacctggattatgaaggaggacagttgtccttctacaatgctaaaaccatgactcacatttacaccttcagtaacactttcatggagaaactttatccctacttctgcccctgccttaatgatggtggagagaataaagaaccattgcacatcttacatccacagtaatgagtcataatattatacaaattcagagtgttattaaagaggtattgaaatattt

SEQ ID NO: 195162 - DNA, 1017 bp, Homo sapiens; identical to SEQ ID NO: 195156
  Payload ID: 18535
  Gene Name: tripartite motif containing 69
  ENST ID: ENST00000633859
  CDS Start-End: 171-962

SEQ ID NO: 195163 - DNA, 1262 bp, Homo sapiens; identical to SEQ ID NO: 195159
  Payload ID: 18535
  Gene Name: tripartite motif containing 69
  Uniprot ID: Q86WT6
  ENST ID: ENST00000633106
  CDS Start-End: 319-1209

SEQ ID NO: 195164 - DNA, 2486 bp, Homo sapiens
  Payload ID: 18535
  Gene Name: tripartite motif containing 69
  ENST ID: ENST00000633414
  CDS Start-End: 929-2431
agtgttttagcctatccagttccgggagtttgcacgcagacgctctgcttcgtgaccttggctctgctctgtgggcgccgcccccagcctgggcgcgtccatcgtcgagtaccttctcctctgcctccccctccctctgcttctatctctctccaattgccctccctggcctgcggccgcccggtcctccttcccagcccagtgcagccaggcacccgggttcggcttgctcaggtctctgtccgggactgggaagccacggagggccgggaaagtggcacactcctggagctcaagcttcctactctctcatcgctgaataactaccgggcaggactgggtggaacagacagcatatttaggtcattgatgggctgctgggtggatggagctggaaagtgatgggcactgctttctggggctgcccaggttccttccgagggctcgcttttcctgggcagagcgggaaagaggaggggcaggccggtcgcgaaacgcaaatagtcgagaatagcgatccggggagaagcaggtgtctgtggggcccaagagaagtaccatctcgagcatccttagtccagaaatggggagctatgaaccttaagattagactactaactcgaatctaaatgagctgcccttgtctcctacaaaagaaaagttgggcaggtagggtattctaatgagggtttctctttctcttaagcaaatgatgatcaaagttaactgacaaactgtcacggaatctgccagacctcactctggccttgctgcttctctccagctcctgaacttttctttcttccatcatgctctgagcccattccttgaaaactaaaaggtccctgactcccagtctgcagccatcctgggcctgctgagctctgattcaagtgcctgcctctgccccttggtgggctgaagcttcatggaggtatccaccaacccctcctccaacatcaatccaggcgactatgttgaaatgaatgattcaatcacccacctaccctctaaagtggtgatacaagatattactatggagctacactgccctctgtgcaatgattggttccgagacccactgatgctaagctgtggccacaacttctgtgaagcctgtatccaagacttttggaggctgcaagcaaaggaaacattctgtcctgagtgtaagatgctatgtcagtataacaactgtacattcaaccctgtactggacaagttggtagagaagattaagaagttacccttactcaagggccatccacagtgcccagagcatggagagaacctgaaactgttcagtaaaccagatgggaaactgatctgctttcaatgcaaggatgctcggttgtctgtggggcagtctaaggagttcctgcaaatctctgatgctgtccatttcttcacggaggagcttgccatccaacagggtcaactggagacaactctgaaggagcttcagaccctgaggaacatgcagaaggaagctattgctgctcacaaggaaaacaagctacatctgcagcaacatgtgtccatggagtttctaaagctgcatcagttcctgcacagcaaagaaaaggacattttaactgagctccgggaagaggggaaagccttgaatgaggagatggagttgaatctgagccagcttcaggagcaatgtctcttagccaaggatatgttggtgagcattcaggcaaagacggaacaacagaactccttcgactttctcaaagacatcacaactctcttacatagcttggagcaaggaatgaaggtgctggcaaccagagagcttatttccagaaagctgaacctgggccagtacaaaggtcctatccagtacatggtatggagggaaatgcaggacactctctgcccaggcctgtctccactaactctggaccctaaaacagctcacccaaatctggtgctctccaaaagccaaaccagcgtctggcatggtgacattaagaagataatgcctgatgatcctgagaggtttgactcaagtgtggctgtactgggctcaagaggcttcacctctggaaagtggtactgggaagtagaagtagcaaagaagacaaaatggacagttggagttgtcagagaatccatcattcggaagggcagctgtcctctaactcctgagcaaggattctggcttttaagactaaggaaccaaactgatctaaaggctctggatttgccttctttcagtctgacactgactaacaacctcgacaaggtgggcatatacctggattatgaaggaggacagttgtccttctacaatgctaaaaccatgactcacatttacaccttcagtaacactttcatggagaaactttatccctacttctgcccctgccttaatgatggtggagagaataaagaaccattgcacatcttacatccacagtaatgagtcataatattatacaaattcagagtgttattaaagaggtattgaaatattt

SEQ ID NO: 195165 - DNA, 1211 bp, Homo sapiens; identical to SEQ ID NO: 195158
  Payload ID: 18535
  Gene Name: tripartite motif containing 69
  Uniprot ID: Q86WT6
  ENST ID: ENST00000631740
  CDS Start-End: 319-1158

SEQ ID NO: 195166 - DNA, 391 bp, Homo sapiens; identical to SEQ ID NO: 195155
  Payload ID: 18535
  Gene Name: tripartite motif containing 69
  ENST ID: ENST00000631458
  CDS Start-End: 1-391

SEQ ID NO: 195167 - DNA, 2840 bp, Homo sapiens
  Payload ID: 18536
  Gene Name: tripartite motif containing 7
  Uniprot ID: Q9C029
  ENST ID: ENST00000274773
  CDS Start-End: 63-1598
gcgtcctgtgaggtccagtggccgcccaggcgcgaccagatctgggtgcgcggagagcgcgcatggcggctgtgggaccgcggaccggccccggaaccggcgccgaggctctagcgctggcggcagagctgcagggcgaggcgacgtgctccatctgcctagagctctttcgtgagccggtgtccgtcgagtgcggccacagcttctgccgcgcctgcatagggcgctgctgggagcgcccgggcgcggggtctgttggggccgccacccgcgcgccccccttcccactgccctgtccgcagtgccgcgagcccgcgcgccccagtcagctgcggcccaaccggcagctggcggcagtggccacgctcctgcggcgcttcagcctgcccgcggctgccccgggagagcacgggtctcaggcggccgcggcccgggcagcggctgcccgctgcgggcagcatggcgaacccttcaagctctactgccaggacgacggacgcgccatctgcgtggtgtgcgaccgcgcccgcgagcaccgcgagcacgccgtgctgccgctggacgaggcggtgcaggaggccaaggagctcttggagtccaggctgagggtcttgaagaaggaactggaggactgtgaggtgttccggtccacggaaaagaaggagagcaaggagctgctgaaacagatggcagcggagcaggagaaggtgggggcagagttccaggcactgagggctttcctggtggagcaggagggtcggctgctaggccgcctggaggaactgtcccgggaggtggcacagaagcagaatgagaacctggcccagctcggggttgagatcacccagctgtccaagctcagcagccagatccaggagacagctcaaaagcctgaccttgactttctccaggaattcaaaagcacgctgagcaggtgtagcaatgtgcctggccccaagccaaccacagtctcttctgagatgaagaataaagtctggaatgtttctctcaagacctttgtcttaaaagggatgctgaagaagttcaaagaggaccttcggggagagctggagaaagaggagaaagtggagctcaccttggatcccgacacggccaacccgcgcctcatcctctctctggatcttaagggcgtgcgcctcggcgagcgggcccaggacctgcccaaccacccctgccgcttcgacaccaacacccgcgtcctggcgtcctgcggcttctcctcgggccggcatcactgggaggtggaggtgggctctaaggacggctgggcctttggcgtggcccgcgagagcgtgcgccgaaagggcctgacgcccttcactcccgaggagggcgtctgggccctgcagctcaacggcggccagtactgggccgtgaccagccccgagcggtcgcccctcagctgcgggcacctgtcgcgcgtgcgggtggccctggacctggaggtgggagccgtgtccttctacgctgtggaggacatgcgccacctctacaccttccgcgtcaacttccaggagcgcgtgttcccgcttttctctgtttgctccacgggcacctacttgcgaatctggccttgaggggcactgctggggagctcctgtctctgggctgccggtgggaggggatgtcgcctccccagagatgcctggtccgtcttgggtctgccctccgtgctcctgacccctgctgcccaagagagcctgctacagacacaaccccgaggcaggagagtgactgtggccaaccgagcaggggaacaggggctttggactcctgagggtgttcccttcctgaggtcacatgtggatttggccagagccttcaggaggtggaggccggtgaggtcaggagcccagctctccagggggcttctgccctgactgggaagggtgcctggctccctaaaacaatgtcaaagccagtcctgctgttctctgttgccagggggcaggtctgggcctgggccaaccacgtttgttatcatggctgctgccttctggacagctgccagctctgccttgagaggttgtgggacctctggatccagctgacctgacaggtcatctactcagggaggagccctgtgctcccagctcagaggacagtctgggccagaactggaaggagacatctgtcccgtctttgagtgacaagcccgggacaacagccagtgggcatcacggctctccagcactccttagccggaggatacagagtgatgggtgcatcctgaccaatgcgacaaccaacacgtgctctcacaaacccctgactcccgcactttccagtgccaaagtacaaacgctgcttggataaggagagcaaagcttctggaactttatttactctttctttttaattttcttttaagagactgggtcttgctatgttgcccaggctggtcttgaactcctggcctcaagtgatcctccagtttccatctccctaagagctgggattacaggtgtgagccgctgtacccgaactttttttgtttttgcttctggaactttgaaacacaaaacacaagttggcacttacaattttaaagatgcagccagctctaaacaacacacagagcacaaatatgctcctgacggactcaggaaaatgccaacagcagagcaccctggtgccaaggccttctcagcccatgccctggagggcattcccctggccagcctcagccccttgtctacttgttctccagcttctgggtagctgggcttctggaagggtggcagtgggctactccctgctcagcgctcccctgggaagggggtgaggagatgaaaatgaaactatgagctgtctttgga

SEQ ID NO: 195168 - DNA, 1228 bp, Homo sapiens
  Payload ID: 18536
  Gene Name: tripartite motif containing 7
  Uniprot ID: Q9C029
  ENST ID: ENST00000334421
  CDS Start-End: 184-849
ccgtagtcaacgtgcgcctcccctcccggctcccagccgggcgcgccccgggctcgagtctctgcctgcccagtggcagccccgcccttcctctcccagtgggccctcggcgcccagctccgcgtcctgtgaggtccagtggccgcccaggcgcgaccagatctgggtgcgcggagagcgcgcatggcggctgtgggaccgcggaccggccccggaaccggcgccgaggctctagcgctggcggcagagctgcagggcgaggcgacgtgctccatctgcctagagctctttcgtgagccggtgtccgtcgagtgcggccacagcttctgccgcgcctgcatagggcgctgctgggagcgcccgggcgcggggtctgttggggccgccacccgcgcgccccccttcccactgccctgtccgcagtgccgcgagcccgcgcgccccagtcagctgcggcccaaccggcagctggcggcagtggccacgctcctgcggcgcttcagcctgcccgcggctgccccgggagagcacgggtctcaggcggccgcggcccgggcagcggctgcccgctgcgggcagcatggcgaacccttcaagctctactgccaggacgacggacgcgccatctgcgtggtgtgcgaccgcgcccgcgagcaccgcgagcacgccgtgctgccgctggacgaggcggtgcaggaggccaaggagctcttggagtccaggctgagggtcttgaagaaggaactggaggactgtgaggtgttccggtccacggaaaagaaggagagcaaggagctgctggtgagccaggcacccgcaggccccccgtgggacattacagaggcctgagaactcagcaccagggctcggtgtgtgtggtgttggagtgtgtgctatggaaccgcagaatcgatttcagaaagataatagagtccatattatatagggtgtccacataattgttgtacaaaccagagctttttaaagtgaaaagcagtgctaaaataattattgcaaaacaactggcttaaactggagctgtcccagcgaatcaggacgctcagtcactctgatattacgtaacataccagttagggcctgcggaagcatcttgtaatggaacacattactatttctgcagagaaacatggatattcaataagtgggaatattaatacaataaagagcctcatggcatgttttgtcaacaaaacagtagtgaaaaaaa

SEQ ID NO: 195169 - DNA, 2851 bp, Homo sapiens
  Payload ID: 18536
  Gene Name: tripartite motif containing 7
  Uniprot ID: Q9C029
  ENST ID: ENST00000393315
  CDS Start-End: 699-1610
tgcgcgacgtcccccacggacttggcgatgttcttcctgtctgttcggagcctctagcctggtctgcgtctccgcagctctctgcccgcgggaagtctccggcacagccacgcagccgctgcccccactcttatctctttccccgaagcgggctctgctcaaagtccccacctcgtggaactgagtgagaggacctcgccaagatgtccagggagggggctcccgggttaagccgcgcacctagagccgtctgactgtgccaacgctgtcgattctgggggccctttctttgctattttctcgctgagcctcagcgagggtgtgtgcaggggtgagggcggggcggggaggctcgggcggcagtccccagtctctccttgctggcccatcctgctccaactctcccagccacggggcttcctggtgggggggcggagagtagaggagacgactaggggtagggctgccggagcttgtgtttcagtctggctggtccagcagatgcttttggggaagcaagatcccgagaccttcagagtcacctcgcagtgtaacctgtagcctgtagagatgacttctacccggcctccccctcagagctcttggagtccaggctgagggtcttgaagaaggaactggaggactgtgaggtgttccggtccacggaaaagaaggagagcaaggagctgctgaaacagatggcagcggagcaggagaaggtgggggcagagttccaggcactgagggctttcctggtggagcaggagggtcggctgctaggccgcctggaggaactgtcccgggaggtggcacagaagcagaatgagaacctggcccagctcggggttgagatcacccagctgtccaagctcagcagccagatccaggagacagctcaaaagcctgaccttgactttctccaggaattcaaaagcacgctgagcaggtgtagcaatgtgcctggccccaagccaaccacagtctcttctgagatgaagaataaagtctggaatgtttctctcaagacctttgtcttaaaagggatgctgaagaagttcaaagaggaccttcggggagagctggagaaagaggagaaagtggagctcaccttggatcccgacacggccaacccgcgcctcatcctctctctggatcttaagggcgtgcgcctcggcgagcgggcccaggacctgcccaaccacccctgccgcttcgacaccaacacccgcgtcctggcgtcctgcggcttctcctcgggccggcatcactgggaggtggaggtgggctctaaggacggctgggcctttggcgtggcccgcgagagcgtgcgccgaaagggcctgacgcccttcactcccgaggagggcgtctgggccctgcagctcaacggcggccagtactgggccgtgaccagccccgagcggtcgcccctcagctgcgggcacctgtcgcgcgtgcgggtggccctggacctggaggtgggagccgtgtccttctacgctgtggaggacatgcgccacctctacaccttccgcgtcaacttccaggagcgcgtgttcccgcttttctctgtttgctccacgggcacctacttgcgaatctggccttgaggggcactgctggggagctcctgtctctgggctgccggtgggaggggatgtcgcctccccagagatgcctggtccgtcttgggtctgccctccgtgctcctgacccctgctgcccaagagagcctgctacagacacaaccccgaggcaggagagtgactgtggccaaccgagcaggggaacaggggctttggactcctgagggtgttcccttcctgaggtcacatgtggatttggccagagccttcaggaggtggaggccggtgaggtcaggagcccagctctccagggggcttctgccctgactgggaagggtgcctggctccctaaaacaatgtcaaagccagtcctgctgttctctgttgccagggggcaggtctgggcctgggccaaccacgtttgttatcatggctgctgccttctggacagctgccagctctgccttgagaggttgtgggacctctggatccagctgacctgacaggtcatctactcagggaggagccctgtgctcccagctcagaggacagtctgggccagaactggaaggagacatctgtcccgtctttgagtgacaagcccgggacaacagccagtgggcatcacggctctccagcactccttagccggaggatacagagtgatgggtgcatcctgaccaatgcgacaaccaacacgtgctctcacaaacccctgactcccgcactttccagtgccaaagtacaaacgctgcttggataaggagagcaaagcttctggaactttatttactctttctttttaattttcttttaagagactgggtcttgctatgttgcccaggctggtcttgaactcctggcctcaagtgatcctccagtttccatctccctaagagctgggattacaggtgtgagccgctgtacccgaactttttttgtttttgcttctggaactttgaaacacaaaacacaagttggcacttacaattttaaagatgcagccagctctaaacaacacacagagcacaaatatgctcctgacggactcaggaaaatgccaacagcagagcaccctggtgccaaggccttctcagcccatgccctggagggcattcccctggccagcctcagccccttgtctacttgttctccagcttctgggtagctgggcttctggaagggtggcagtgggctactccctgctcagcgctcccctgggaagggggtgaggagatgaaaatgaaactatgagctgtctttgg

SEQ ID NO: 195170 - DNA, 2320 bp, Homo sapiens
  Payload ID: 18536
  Gene Name: tripartite motif containing 7
  Uniprot ID: Q9C029
  ENST ID: ENST00000393319
  CDS Start-End: 778-1767
ctgcagcctgcctggaagctgaaggaaaggtgggggcattgtaggacaccttgaacccaggtctcccaacttcacaggactcccttcctccgcccaggagttttaaggaagaggaacttcctggtgggacatattgagtgccaaacgtgtgttcacataaaaaatcaagagatcagggcatgagtctgcatctgaaaactcgagtaaaaaatccggtgtatgctgttaatggaaagaacagaatatgacacttgcatgccgcatattctcacttcgttccttgggggtgtgctgctacctctggtcactggcatcggacttttcttccttctttctactttcctacatctcccaagttttgtattttgagcatgtgttagcattataactgctaaacaggaaagatggcctttaaaaagaaagtgaagtgtaaaagtttgagggtgatgaaataaatgtgcttgaggaagaaaaagcaatctcagtttaatcctatggttgccccaggaggcactaatttatcccttctgcttttcaagtgaggaagctgcagcttggcgtagttctggggggagtatgaagctgccttggtttaggtgatggagcacaggtccacagacatgtgtgggtgcatctgtggcaggggagaaaagagcatgtgtccagactacagcttgttcagagctgggacactgacaatagagcacgcactgcgtgcgtaggtgggtgtgtctccgatcctccagcagtgacagggacgaagccttgccctgtgggatgactcaggccactggccaaatgttatgtctccatgttcaagtccctctccaacttctcctcctgggacagaaacagatggcagcggagcaggagaaggtgggggcagagttccaggcactgagggctttcctggtggagcaggagggtcggctgctaggccgcctggaggaactgtcccgggaggtggcacagaagcagaatgagaacctggcccagctcggggttgagatcacccagctgtccaagctcagcagccagatccaggagacagctcaaaagcctgaccttgactttctccaggaattcaaaagcacgctgagcaggtgtagcaatgtgcctggccccaagccaaccacagtctcttctgagatgaagaataaagtctggaatgtttctctcaagacctttgtcttaaaagggatgctgaagaagttcaaagaggaccttcggggagagctggagaaagaggagaaagtggagctcaccttggatcccgacacggccaacccgcgcctcatcctctctctggatcttaagggcgtgcgcctcggcgagcgggcccaggacctgcccaaccacccctgccgcttcgacaccaacacccgcgtcctggcgtcctgcggcttctcctcgggccggcatcactgggaggtggaggtgggctctaaggacggctgggcctttggcgtggcccgcgagagcgtgcgccgaaagggcctgacgcccttcactcccgaggagggcgtctgggccctgcagctcaacggcggccagtactgggccgtgaccagccccgagcggtcgcccctcagctgcgggcacctgtcgcgcgtgcgggtggccctggacctggaggtgggagccgtgtccttctacgctgtggaggacatgcgccacctctacaccttccgcgtcaacttccaggagcgcgtgttcccgcttttctctgtttgctccacgggcacctacttgcgaatctggccttgaggggcactgctggggagctcctgtctctgggctgccggtgggaggggatgtcgcctccccagagatgcctggtccgtcttgggtctgccctccgtgctcctgacccctgctgcccaagagagcctgctacagacacaaccccgaggcaggagagtgactgtggccaaccgagcaggggaacaggggctttggactcctgagggtgttcccttcctgaggtcacatgtggatttggccagagccttcaggaggtggaggccggtgaggtcaggagcccagctctccagggggcttctgccctgactgggaagggtgcctggctccctaaaacaatgtcaaagccagtcctgctgttctctgttgccagggggcaggtctgggcctgggccaaccacgtttgttatcatggctgctgccttctggacagctgccagctctgccttgagaggttgtgggacctctggatccagctgacctgacaggtcatctactcagggaggagccctgtgctcccagctcagaggacagtctgggccagaactggaaggagaca

SEQ ID NO: 195171 - DNA, 1954 bp, Homo sapiens
  Payload ID: 18536
  Gene Name: tripartite motif containing 7
  Uniprot ID: Q9C029
  ENST ID: ENST00000422067
  CDS Start-End: 490-1401
tgcgcgacgtcccccacggacttggcgatgttcttcctgtctgttcggagcctctagcctggtctgcgtctccgcagctctctgcccgcgggaagtctccggcacagccacgcagccgctgcccccactcttatctctttccccgaagcgggctctgctcaaagtccccacctcgtggaactgagtgagaggacctcgccaagatgtccagggagggggctcccgggttaagccgcgcacctagagccgtctgactgtgccaacgctgtcgattctgggggccctttctttgctattttctcgctgagcctcagcgagggagctcttggagtccaggctgagggtcttgaagaaggaactggaggactgtgaggtgttccggtccacggaaaagaaggagagcaaggagctgctggtgagccaggcacccgcaggccccccgtgggacattacagaggcctgagaactcagcaccagggctcgaaacagatggcagcggagcaggagaaggtgggggcagagttccaggcactgagggctttcctggtggagcaggagggtcggctgctaggccgcctggaggaactgtcccgggaggtggcacagaagcagaatgagaacctggcccagctcggggttgagatcacccagctgtccaagctcagcagccagatccaggagacagctcaaaagcctgaccttgactttctccaggaattcaaaagcacgctgagcaggtgtagcaatgtgcctggccccaagccaaccacagtctcttctgagatgaagaataaagtctggaatgtttctctcaagacctttgtcttaaaagggatgctgaagaagttcaaagaggaccttcggggagagctggagaaagaggagaaagtggagctcaccttggatcccgacacggccaacccgcgcctcatcctctctctggatcttaagggcgtgcgcctcggcgagcgggcccaggacctgcccaaccacccctgccgcttcgacaccaacacccgcgtcctggcgtcctgcggcttctcctcgggccggcatcactgggaggtggaggtgggctctaaggacggctgggcctttggcgtggcccgcgagagcgtgcgccgaaagggcctgacgcccttcactcccgaggagggcgtctgggccctgcagctcaacggcggccagtactgggccgtgaccagccccgagcggtcgcccctcagctgcgggcacctgtcgcgcgtgcgggtggccctggacctggaggtgggagccgtgtccttctacgctgtggaggacatgcgccacctctacaccttccgcgtcaacttccaggagcgcgtgttcccgcttttctctgtttgctccacgggcacctacttgcgaatctggccttgaggggcactgctggggagctcctgtctctgggctgccggtgggaggggatgtcgcctccccagagatgcctggtccgtcttgggtctgccctccgtgctcctgacccctgctgcccaagagagcctgctacagacacaaccccgaggcaggagagtgactgtggccaaccgagcaggggaacaggggctttggactcctgagggtgttcccttcctgaggtcacatgtggatttggccagagccttcaggaggtggaggccggtgaggtcaggagcccagctctccagggggcttctgccctgactgggaagggtgcctggctccctaaaacaatgtcaaagccagtcctgctgttctctgttgccagggggcaggtctgggcctgggccaaccacgtttgttatcatggctgctgccttctggacagctgccagctctgccttgagaggttgtgggacctctggatccagctgacctgacaggtcatctactcagggaggagccctgtgctcccagctcagaggacagtctgggccagaactggaaggagaca

SEQ ID NO: 195172 - DNA, 8685 bp, Homo sapiens
  Payload ID: 18537
  Gene Name: tripartite motif containing 71, E3 ubiquitin protein ligase
  Uniprot ID: Q2Q1W2
  ENST ID: ENST00000383763
  CDS Start-End: 64-2670
gctctctcctcctcctcctcctcttcctctctggtctcctccctcctccgggctgggttgcaaatggcttcgttccccgagaccgatttccagatctgcttgctgtgcaaggagatgtgcggctcgccggcgccgctctcctccaactcgtccgcgtcgtcgtcctcctcgcagacgtccacgtcgtcggggggcggcggcgggggccctggggcggcggcgcgccgcctacacgtcctgccctgcctgcacgccttctgccgcccctgcctcgaggcgcaccggctgccggcggcgggcggcggcgcggcgggagagccgctcaagctgcgctgccccgtgtgcgaccagaaagtagtgctagccgaggcggcgggtatggacgcgctgccttcgtccgccttcctgcttagcaacctgctcgacgcggtggtggccactgccgacgagccgccgcccaagaacgggcgcgccggcgctccggcgggagcgggcggccacagcaaccaccggcaccacgctcaccacgcgcacccgcgcgcgtccgcctccgcgccgccactcccgcaggcgccgcagccgcccgcgccttcccgctcggcacccggcggccctgccgcttccccgtcggcgctgctgctccgccgtcctcacggctgcagctcgtgcgatgagggcaacgcagcttcttcgcgctgcctcgactgccaggagcacctgtgcgacaactgcgtccgagcgcaccagcgcgtgcgcctcaccaaggaccactacatcgagcgcggcccgccgggtcccggtgccgcagcagcggcgcagcagctcgggctcgggccgccctttcccggcccgcccttctccatcctctcagtgtttcccgagcgcctcggcttctgccagcaccacgacgacgaggtgctgcacctgtactgtgacacttgctctgtacccatctgtcgtgagtgcacaatgggccggcatgggggccacagcttcatctacctccaggaggcactgcaggactcacgggcactcaccatccagctgctggcagatgcccagcagggacgacaggcaatccagctgagcatcgagcaggcccagacggtggcggaacaggtggagatgaaggcgaaggttgtgcagtcggaggtcaaagccgtgacggcgaggcataagaaagccctggaggaacgcgagtgtgagctgctgtggaaggtagaaaagatccgccaggtgaaagccaagtctctgtacctgcaggtggagaagctgcggcaaaacctcaacaagcttgagagcaccatcagtgccgtgcagcaggtcctggaggagggtagagcgctagacatcctactggcccgagaccggatgctggcccaggtgcaggagctgaagaccgtgcggagcctcctgcagccccaggaagacgaccgagtcatgttcacaccccccgatcaggcactgtaccttgccatcaagtcttttggctttgttagcagcggggcctttgccccactcaccaaggccacaggcgatggcctcaagcgtgccctccagggtaaggtggcctccttcacagtcattggttatgaccacgatggtgagccccgcctctcaggaggcgacctgatgtcggctgtggtcctgggccctgatggcaacctgtttggtgcagaggtgagtgatcagcagaatgggacatacgtggtgagttaccgaccccagctggagggtgagcacctggtatctgtgacactgtgcaaccagcacattgagaacagccctttcaaggtggtggtcaagtcaggccgcagctacgtgggcattgggctcccgggcctgagcttcggcagtgagggtgacagcgatggcaagctctgccgcccttggggtgtgagtgtagacaaggagggctacatcattgtcgccgaccgcagcaacaaccgcatccaggtgttcaagccctgcggcgccttccaccacaaattcggcaccctgggctcccggcctgggcagttcgaccgaccagccggcgtggcctgtgacgcctcacgcaggatcgtggtggctgacaaggacaatcatcgcatccagatcttcacgttcgagggccagttcctcctcaagtttggtgagaaaggaaccaagaatgggcagttcaactacccttgggatgtggcggtgaattctgagggcaagatcctggtctcagacacgaggaaccaccggatccagctgtttgggcctgatggtgtcttcctaaacaagtatggcttcgagggggctctctggaagcactttgactccccacggggtgtggccttcaaccatgagggccacttggtggtcactgacttcaacaaccaccggctcctggttattcaccccgactgccagtcggcacgctttctgggctcggagggcacaggcaatgggcagttcctgcgcccacaaggggtagctgtggaccaggaagggcgcatcattgtggcggattccaggaaccatcgggtacagatgtttgaatccaacggcagcttcctgtgcaagtttggtgctcaaggcagcggctttgggcagatggaccgcccttccggcatcgccatcacccccgacggaatgatcgttgtggtggactttggcaacaatcgaatcctcgtcttctaattgcatttcctaggtttctgtgtttggggtgtgtgtgcgtgtctctctctctctctctctctttctctttctctctctttttgaatttcaaagaagaaacagtctcagggaaatttcttttttcttttttttttttaaagagaacaagaaaagtacaacattgcttaagtcctacctcatctttatttttttacagatgaatgtacttatcttttctgcagggattgagcctgtgaagtgataatttctatctacctcataaatctttacatttccttctgcaacaggccctcttcccctcctcagtggagtttgcatttccctcttcccctgcgtggggcatgatatgcacaagcctggcatctgtatggctgggagggcactggatgtgtgtggtggggtgtattctgtagattgagccaaggaaacacaaaaaaaaactactaagtaaaaaaacaaaaaactataaaacatggaaaaaataggatttgaaatgcataattatagaatacctgtgttcttgagaatactgtttatatggggtttagattatgttgtgttgttttgatctttttggaaaatcttctctttttaaatgctgcaacagagaaatttcctctgttctctgtttatacctcagtgtgtttaacatcctcttctgcatcgtttcttgatcttagacgttgtggctgtggcttgctagccaagaaaagcagacccttcatattttagggtatataatctttgtttcttttaagggagggtgtgtgcatgtttgtttcaaagccatcttgcacccaagtagtaaagctgaaaatgacacactgcctcccaaagaacctctccttttcacactttggtttcttaaaaaagtatatagatggtagctcaggatttttgattaaacatattctcaaaagttatgctttcttattttgctgttaggttataaagggttaaatggaaggaaaaaggaaattaacctcgttctcagagagagggttttcaggcatgggctgacgtggacatgaatgtgggtggacatgcgtgtgctgagggagtcagggagcacattaaagaacaaggcacccccaaactataggaactccacagaaagggcagggtctgccctgacccgcgagtgcatgttgttctgtagtgctaggggtttcttttcctaagaagagtaggcaaaggaaagaacttttattttacaagcacaattttttcctgctttgaaagttcagggaaatagaaggtttgaaagtcaaattaataccaacagcccagtcccacaccctctgcttgggtcactttttataggattgtttgcacccaggccatgctttaggacctcatggttaacatgaatccccccgccccctctccccccaaggcctttgaccataaaggatctagaaaccaaattgtcccaacctgaaatgtaggatgtaatgtcttttcttaaacctgtaactcggtaccaaagaatgaaaatttaaggctcccactgcagaactgtggggtagaatctgtgtcactttacaggattggttggttgtaagctggacttgggtacaaaacttgtgcttctgggcattgtctgtctttcaagtgcaaagcagatgtagctgataccctgcttgtcagaacccagtgggttcctgcaatgccccaaatactgaaataagaaccaaattctggaggagccctcctcagggaaaagagggactctcaaacaaacgtcagtgacttacaagggagacctcttgtttaaagacttatggatcaacttctgttcctctgtttaagagaaatttctattgcaaaatgggtatcgttttaaatgagcagaacagattaacaaatggagcaatttgtttctgttatcccaatagaaaaggagatgatggggacagtgtgacaagtcaatcaagttgcttttcccgtacacctcttttggacgtttaatttactactactacaagctactctgtctcttcccattgctttaattctagggtttctgagtgaccaaaatgggaaggaaaaaaaaaacctcatctcacagaggagaactgcatgcaataaaagattcaaaagttggaaagtagcttcaaactgctgctggctcccagctgctgttacagggtgggaaggtgttaggaaatgttgtttgttagaagctccttttactgtagaatttaatagtgaatccttccccaatgcctattcagttgccttttggccgttaagctctaagttctttggtaaagagttaatataattaaacatttttactgttttctattttggagtaacttggtgctgatcttccttccctttccccagctgcccaacaagccaccctttaaacaccaaagacaactggttttaaatgcttgaaaaaaattttattgaggagatggatcttgattaaaatcttttcatcatcattttcattctgctcttttctttctaatttccccagatgtaggaaaattttgggacctgaatgagaaatgttcttggtgcataacagtaactagagctccttatttgacattttactatggatgtgatcgaaaagccaagattttcgctccatggctgaaattatcaggtcttaatttacagacttgtaaatttgcaggcttagagcaactagaactatcccctgaaataggtgtgtaggtcagagatactacctctttgtcctcagtggtggtatatctatctccttacctttctgtacccaaaatggtgcatgactggtatttgagaaacatggtcacatttggaaagcttttgtttttaaaacattggcggtttttcctgcccgtggttgactcctgacccatagggattggtgcgaagcactttggagagtgtttattgtatgatgtgaaatgttctaaatcaaagaaagatgataaaagccaacatttggcagtccctagtgtgaaactgtgaaaagtacctgtgtttaaatgcataatctcctgcccgggtaatgccaggtagccaggagttgggtcaaagaagggagtcgtcatcctgatggaaaaaataaggtcctgggtattatgaggtaggagaataaaaaggtttctggggagtaagtatgacaattactagtccccatggaggtctgatctggtcaggtggcaagggttgggtggggtatgatgtaagctcagtttatgtgtggagatgcccattgggtttggatatataggtttgagtattgagatgtttaaaggacatctaacccataggtaaaaactacttttgcttgacactgacttaacatttcaaaagtgttatttttggtcccaagatctaatgctgtctcagaacatgtgccctgttgtggctgcaagtggcactcaagttgactagagcacagtgacctgggttgtaccccaagtgcactaactcctcaatgcccttttaagtctaacttatttgggaaacacataacaaagggtaccataaaccgaatccaaattacgtgttgggccaaaaatgttgccagaactgaggcactttgtgatggagttgcaagagatagcttgagatcggctcagtctgatttattctagttaagccaaagcttaattatttgaggaggaaagtcttttaggcttgaagcagcaaaatactgtttatatatgtgttaccttcctcgttggaagattctacgattgctctgttctggtaggtggtgaaagatatgccaaagttttaggcttgtttttctgatcttatttttttaatccagtggtgccaaaaagtatttagggtatgtttaaggtatatttaaaacatcactctgaatgagtttccaacagtctggggctgtataaaagtcacactcttgtacttgcaggtgatggtgtcacagggccagggcctccagagctctacggctttctctggttttctatagggccaagggcacaggacgcagcattccagaccacactgactgcttttgctgagtttctacctcacttgtggcaagtcatctacctcatgttagcatctgacaggtctcaaaaagaatagtattaatccagtgggcagtgggtgggagtgggaagctacctctaaaagaaatgttaccataaatctacaactgatttctcccaggagaaatgttctacttaccttgaaagagaaatgtcaggcaaatgtagtcataaatccaagtagttcttagcaatctggcttttccccctcaaaaagaattatgcataccattactgttgttcagtattatgaaactactggttaatctgacctattggaggacttaactacaaataaagacctttaggtctctttctcttcaagagaaaaatattttatctgtatttcgaatgtctgcaaataataccctttaggagcaattctaaaggtctagatcttggaaacatcaaatatttgaagggaatgagaatcctcttgacttcatgattgtatttgtagctctctggacccggcaggacgttcatcaccatgatgttgcaacaatcactgttttgactgagcagtgactgttgaagtgtgtattgctcttttgttttgtttttatttttttctaccaaaggtaacatgttgacgggttttttttttccttgtttattaaatacttgataaagttgagaagcacattaccaggatatactgtattgaccctcccacctctcttctgccctaatttttggttgtttggaagagaggagggtcctaagaccactgtcattatcatgaggggcttataaatgtcatggtgaagaaatacctcaatgatgtctatttttaaaactgatcttacgggttaacaagccagcctggtgggatattttccatcatcatttaaccaataatggttctaaaagttttgtgtatccacatggtcttagacctccttttaatgattgtattaacttacaagctcaggtagtatttttcttaagactctatctcagagcacactgactgaatgttgatgtgtgtagcaaagtgtttactttctttaaataaccagctctgtaactctgtaagttctttgtgtttctagcagtctgtgtagttgtctttcttcagaggaagatttttcacatttctggggttttcttgcttttagggtggtaagattcctttctttttttcccttttctcctaaaatcgatgcaggtaagggtgggtgggtaaggggtgttgttttttaactagcatgttagttatacttgggtgggtgggagggttgttaaactgaatcttgcttaatactgtccattagctctcatgccgggtcagcaaaatgctttaatttttaactgcagaacatgtgactcggttgagtctttttgtcttttttttttttaaataaacaattgggggaattaatgtgggcaagttgccttatgttagaatgactaagttaaacctcttaatttgtatttgtccaaggcagacatgatataaggaatatgcactaccgtagtaactcccctggccgcagaaaccacactgcaagcctgtccggggtggggtgctgactgccatttgccacttttaaatgggcactgccgtggtaatgtgaatcccatcaatgcagtagatgggtggggaaatgaagatttccccccaaacctttaggcaaaagtgagtttttgtttggttgattttgggtttttttcccccctcctcttttggctttcacattttaaatcttaaatgttactattgcaggccgcaggcatgacaggcaatgagcaggtgaagaaccaatggaaaagtgttcaaaaactcctgtgttagctaacaggcttctgaatgtatcactgtggtccacagagaaggctggaggaggtagcaaggagatgctgtatcagctactacagccttaaaacaaagttggtgtctctttggactttaaaattgttcctatgcagcttattttatttttgtttaatcaaataaacgagggtttttccatggcta

SEQ ID NO: 195173 - DNA, 8500 bp, Homo sapiens
  Payload ID: 18538
  Gene Name: tripartite motif containing 72, E3 ubiquitin protein ligase
  Uniprot ID: Q6ZMU5
  ENST ID: ENST00000322122
  CDS Start-End: 285-1718
ttttagaacggtttccggaagtgatgggagggattgggcagggcagctaaatatagtcctggggccatggctcagtctgggagggtcttccgctgagcactgtgtgcccatcacgcgtggtgtccactgccagctgcccctgtgagtccctgtccttgcttggagcctgctgcttgtctcagatccttggacccagccctgaccccagtccagctaagctcaaccctgaccggtcctccttcgagactctttcagcctaagatctccaaccagacctgcccgccatgtcggctgcgcccggcctcctgcaccaggagctgtcctgcccgctgtgcctgcagctgttcgacgcgcccgtgacagccgagtgcggccacagtttctgccgcgcctgcctaggccgcgtggccggggagccggcggcggatggcaccgttctctgcccctgctgccaggcccccacgcggccgcaggcactcagcaccaacctgcagctggcgcgcctggtggaggggctggcccaggtgccgcagggccactgcgaggagcacctggacccgctgagcatctactgcgagcaggaccgcgcgctggtgtgcggagtgtgcgcctcactcggctcgcaccgcggtcatcgcctcctgcctgccgccgaggcccacgcacgcctcaagacacagctgccacagcagaaactgcagctgcaggaggcatgcatgcgcaaggagaagagtgtggctgtgctggagcatcagctggtggaggtggaggagacagtgcgtcagttccggggggccgtgggggagcagctgggcaagatgcgggtgttcctggctgcactggagggctccttggaccgcgaggcagagcgtgtacggggtgaggcaggggtcgccttgcgccgggagctggggagcctgaactcttacctggagcagctgcggcagatggagaaggtcctggaggaggtggcggacaagccgcagactgagttcctcatgaaatactgcctggtgaccagcaggctgcagaagatcctggcagagtctcccccacccgcccgtctggacatccagctgccaattatctcagatgacttcaaattccaggtgtggaggaagatgttccgggctctgatgccagcgctggaggagctgacctttgacccgagctctgcgcacccgagcctggtggtgtcttcctctggccgccgcgtggagtgctcggagcagaaggcgccgccggccggggaggacccgcgccagttcgacaaggcggtggcggtggtggcgcaccagcagctctccgagggcgagcactactgggaggtggatgttggcgacaagccgcgctgggcgctgggcgtgatcgcggccgaggccccccgccgcgggcgcctgcacgcggtgccctcgcagggcctgtggctgctggggctgcgcgagggcaagatcctggaggcacacgtggaggccaaggagccgcgcgctctgcgcagccccgagaggcggcccacgcgcattggcctttacctgagcttcggcgacggcgtcctctccttctacgatgccagcgacgccgacgcgctcgtgccgctttttgccttccacgagcgcctgcccaggcccgtgtaccccttcttcgacgtgtgctggcacgacaagggcaagaatgcccagccgctgctgctcgtgggtcccgaaggcgccgaggcctgagccgccggacgggtagtggaggggcgcgggggcctgggttgaagcttaggtctccttggtcgggtctgacgggagaagggtggggagcgggttgccagggcccagggggctgggaactgggggatctcccagaatactgacaagcgtggggtaggactggcttggtggctcatgcctgtaatcccagcactttgggagacggaggcgggtggatcacctgaggtcaggagttcaagaccagcctggccaacatggtgaaactcctctctactgaaaatacaaaaatgagctgggcgcggtggcatacgcctgtaatcccagctagttgggaggctgaggcaggataattgcttgaacccaggaggtggaggttgcagtgagcagacattgcggcactgcactctagcctgggtgacaagagtgagactctgtctcaaaaaaaaaaaaaagtgtgggggttggcatggcctggggactgctggtgaggggttggagtgacgctggggacaagacccagtggggtagggagatctggagtcaggtcagtggggaaatcagaatttgggaaccaggaggcctgagaattccaggaagaaactaaggttgagcgagggagggacagggccaggttgggggattgatgggaggagcttgagaacctgtagataaggggctccttttgcctcacactcccctcctccttaggccttgggtcccccgctccagattcaccttacccaaaagccttctccttagttctccaccttaggcatgcattaaaatcacctttttaaagcccttagccatgacttgttaaagcatagggtgctaagtttctgatttagtaggttggacaggtcaaaaatgctcatttcttttttttatttcttttttttttttttttttttttttttgagacagagtcttgctctgtcactcaaggctagagtgcagtggtgccatctcggctcactgcaacctctgcctccagggttcaagcaattctcatgcctcagcctcccaagtagctgggactacagacgcccgccaccacacctggctatttatttttatttttagtaggggtttcactatgttggccaagctggtctcgaactcctgacctcaagtgattcacccgccttggcctcccatagtgctgggattacagacatgagccactgcacctggctgaaaatgctcatttttttttttttaatttagtttttgtagaaatggtgtctcgttacattgcccaggctgatcttgaactcttggcctcaggtgatcctcctgccttggccttccaagtgctgggattacaggtgtgagccaccacgccctgccaaaaatgtgcatttctagcaggttcccaggtgacgctgctggccacaggggctgacgctgcgggaagccctgacctagtgcacaacccattgggctcttcactgtcagtgtagaggcataggtccaaaatatgtttccccagtcaaaaacatgtaaggtttgcaccaggagtggaaggaaacaaacaaacataaaccaaagcaaagacacttaagggctgggtactcatgcctgtaaacccaacactttgggagtttgaggcaggaggctcatttgaggccaggagtttgagaccagcctggggaacatagtgagaccctgttgcaacaaaaaccagaaaaacaacaaaaagaagacattggaaaatggctggagctgattctaggtgaataaacaaccctcgacttaacttgctttgcctctgggatatgtttatcgagcgtcttgaacgttgaggaagccagccaagagaaagagcctgatgccaaggtcacactggtccctgctgctcatggggaagagaaggcccccaactagatgtcccagaactggccgctccccacttacttgctggttcacaccttctttggttttagcgcacagggcatttcttgggctctggagtaaccactgaggccagagtgagagtccctcttccctggagggagaggcctttggggatccagacaggcttctctcctgagggaagacgctggcctggggtcactcattttcacggggagggtgtgctggcgggatgggtggaagggcctggggccccggcagcccattgcggaggttttctcgggagatggtgggtatgggactaagggtgaaagggaagttgtgagttgggtaagaaaggcctgaggatctggcaggggaaggcggcacacctgggtgtgtctcccagaggaaggcctgtggagccctggcttcaggagacagaagagaggattaacggtagaagctctttcatgttagaaaataaaacaatatagctaagggattatttggttgtaaaatccaacaccattaataaaactgttatattctgactccttcctcattaaatccacatgaaaagacatgtgacctactgcaaggcctcctaattgccctccagcctttaatcctgacttggtaatgtttccaaaaatgcaaatgtggtcacgggactcagttgctcaaaactttcaacaactccctcttgcctacaggataaagcccccagtctttggcttagcatttgagctgttctgccattttttttgttggttggtttgtttgttttgtttgagacagagtctcgctctgtcgcccaggctggagtgcagtggtgtgatcaccgtaacctccgcctcctaggttcaagggattctcctgcctcagcctcccgagtagctgggattacaggtgcccgccaggctggtctcgaactcctgacctcaggtgatccacccattttggcctcccaaagtgctgggattacaggctggccttccagcttcatctgtttttagttaaaaaacaatttttttttttgagacaaggtcttgctctgtcgcacaggctggagtgcaatggtgtgattgtggctcactgcagccttgacctcctgggctcacatgatcctcccactccagcctcctgagtagataggatggcaggcacccatcaccatgcctgactattttttattttttgtattttggtagagatgaggtctcactatgttgctcatgctggtctcgagctcctggcctcaagcgatcctcccatcttggcttcccaaagtgttgggattacaggtgtgagccactgagcccagcccagcttcatcttttattttattattattttttgagatggagtctcaccgtgtcacccaggttagagtgcagtggtgtgatcttggctcactgcaacctctgcctcccaggttcaagtgatcctcctgcctcagcctcccgagtagctgggactataggcaggtgacactacgcctagctgatttttgtatttctagtggggacaggggcttcactatgttggccagcctggtctcgaactcctgacctcaggggatcccccaactcggcctcccaaagtactaggattacaggcttgaaccgccgcgcccagccccagcttcatcttaaaaagaaaagttctctgttttaatatctaacagggcaaatattgaaagataaaaccacataacaaaagctctttgggatcctagtgttggggaaaggctgctgtccattgactgtcactgaactctctgtcattgctcaggctaaggactggccacagtgagggagggacctgtggtctcctgtgttgctcctcaccctgtagactgtgggctgtgggctgtgtccagcctcaccttggatcaccgccctgtgcatgtctacactctggctatgctgaactgaactgctggggtctctgcacctccttttttttttttttttttttgagatgcagtcttgctctgtcgcccaggctggagtgcaatggtgctatctcagctcactgcaacctctgcctcccaggttcaagtgattctcctgcctcagcctccgcagtagctaggattacaggcacccaccaccacgccaggttagttttttcatttttatttgtatttttagtagaggcggggttttgccatgttggccaggctgatctcgaactcctgacctcaaatgatctgcccgcctcagcctcccaaagtgctgggattacaggcatgagctgtcgggcctggcccctgcacttcttttttaggaatgtcagttccctcccacttatccttcatggctctcccaaaacaccaccatttcctgtcctctcttgaccttctaggcctccaggaagaatcagttactctcctctctggatcgcccagcagctcctccaccatgtgtagcccacggcattgaattgtctacacacaggccatggtgtctggagggatggtggtatctgagacccaaagcctccttctgaggaaatgggtactctgagaagcagatgccaagataggattaaatgggcagagattttaggagggaagatgcccatgtgagggaagatggggagggccatcagaccgtgtcgcaagtctgctgttcgtgtgggagggagggagggaaggctcttgtggcgtctccggcagccagagccaccgtccaaacactcctgtgccttccgggacccgggctggctttagtctccctgcagagctgagtaatgtatgctgccttttgttggaattatatcaggaaactttctttcgaagctgccacaggttctttctgcgtatagttgccccagcttgagctgcatgcattgaaggaaatggcccatggctgactgagtgaggtgggctttgtgggaaaagctgcgtaatccaggtggtccttgtcgggtggggctgcctgacccaggcagggtctccctggggatgtaggaaggtgaaatgtgaacagagaaaggagttcctccagcacatgtgttctaaagcaccagcgtcccctccgtgagtccctcctctccacgggaacgctggaaacccccagaaactggctgccaagacatttcctgtgtttcctgacatctttaggtagcataatagcaaacttgaacctgccaaggccatgataaaactgcaagcaagaacatttatcgtggccaggtgcagtggctcacgcctgtaatcccagcacttttggaggttgaggcgggtgaatcacctgaggtcaggagttcgagaccagtctggtcaacatggtgaaaccccatctttactaaaaatacaaaaattagccaggcatggtggtgcatgcctgcaatcccagctactcaggaggctgaggcaggagaatcacttgaacctgggaggcagaggttccgatgagctgagatcgggccactgcattccagtctgggtgagagagttaaaacaggaattaaaagaaattaaagaatgtgtaagcaaaaactcagttgtatgtaagaaaaccccattcaccctgaggaagagaaagagctaaagtcctttaaaaattaactgcctgtttttctgtggatagtgagccttatctctctccctttcccaggcattgtgaagaccctgtttctctagctgtgcagctgcaaggtcactaggcagataaactcaagtcataaaacatgtttttccttgaaaagtaaaaaatgatgtaatgcatgtctcaactgaataactgtctttgtttcttgcttctgtaatatgcttccccctgcacagatctccccctgccccacaaaatgcttaaaaggtaaccggagccgggcgtggtggctcacgcctgtaatcccagcactttgggaggctgaggcaggcggatcatgaggtcaggagatcgagaccgtcctggttaacatgttgaaaccccgtctctactaaaaatacaaaaaattagccgggcgtggtggcaggcacctgtagtcccagctacttgggaggctgaggcaggagaatggcctgaacccgggaggcggagcttgcagtgagccgagatggcgccactacactccagcctgggtgacagagcgagactccgcctcaaaaaaaaaaaaaaaaaaaggtaaccggactctttgttcagggctcagtctttttggatgttaatctgaccgggccagtgcacctaactaaataataaataataagtatcctcctcaacctcttggtctctctgattcctaaattatcccactgcagaatgagactctgtctcaaaggaaaaaaaagaaaatttattgagaccttattatgcgtcaatagctctctattcagaatctcactgatcttcgcaaccctggatctcacaacaacgagagccccactaggttgcctcttttgttttgttttgttttttttttgagatggagtctcactgtctcccaggctggagtgcagtggcgtgatctcggctcactgcaacctccgccctctgggttcacgccattctcctgcctcagcctcccaagtagctgggactacaggcgcccgccaccatgcctggttaatttttttgtatttttagtagagacggggtttcaccatgtttgccaggatggtctccatctcctgacctcgtgatccgcccgcctcggcctcccaaagtgctgggattacaggcgtgagccaccgcgtccggcttaggttgcctcttatactgggttcacgcatcccctgggtgcatgacagtctgaccacaaaggaccccggtccacagaagcatgatgcatcttggagtatcgactttatgccaatattcttcttcttgatactggtggtggtgagaaagttgggtaatttaaccaaaagtaaaaatcaagatgtcacgttcccattaaaacaaacatagagtaca

SEQ ID NO: 195174 - DNA, 1573 bp, Homo sapiens
  Payload ID: 18538
  Gene Name: tripartite motif containing 72, E3 ubiquitin protein ligase
  Uniprot ID: Q6ZMU5
  ENST ID: ENST00000613872
  CDS Start-End: 215-1024
ctcagtctgggagggtcttccgctgagcactgtgtgcccatcacgcgtggtgtccactgccagctgcccctgtgagtccctgtccttgcttggagcctgctgcttgtctcagatccttggacccagccctgaccccagtccagctaagctcaaccctgaccggtcctccttcgagactctttcagcctaagatctccaaccagacctgcccgccatgtcggctgcgcccggcctcctgcaccaggagctgtcctgcccgctgtgcctgcagctgttcgacgcgcccgtgacagccgagtgcggccacagtttctgccgcgcctgcctaggccgcgtggccggggagccggcggcggatggcaccgttctctgcccctgctgccaggcccccacgcggccgcaggcactcagcaccaacctgcagctggcgcgcctggtggaggggctggcccaggtgccgcagggccactgcgaggagcacctggacccgctgagcatctactgcgagcaggaccgcgcgctggtgtgcggagtgtgcgcctcactcggctcgcaccgcggtcatcgcctcctgcctgccgccgaggcccacgcacgcctcaagacacagctgccacagcagaaactgcagctgcaggaggcatgcatgcgcaaggagaagagtgtggctgtgctggagcatcagctggtggaggtggaggagacagtgcgtcagttccggggggccgtgggggagcagctgggcaagatgcgggtgttcctggctgcactggagggctccttggaccgcgaggcagagcgtgtacggggtgaggcaggggtcgccttgcgccgggagctggggagcctgaactcttacctggagcagctgcggcagatggagaaggtcctggaggaggtggcggacaagccgcagactgagttcctcatgaaatactgcctggtgaccagcaggctgcagaagatcctggcagagtctcccccacccgcccgtctggacatccagctgccaattatctcctgacctcaagtgattcacccgccttggcctcccatagtgctgggattacagacatgagccactgcacctggctgaaaatgctcatttttttttttttaatttagtttttgtagaaatggtgtctcgttacattgcccaggctgatcttgaactcttggcctcaggtgatcctcctgccttggccttccaagtgctgggattacaggtgtgagccaccacgccctgccaaaaatgtgcatttctagcaggttcccaggtgacgctgctggccacaggggctgacgctgcgggaagccctgacctagtgcacaacccattgggctcttcactgtcagtgtagaggcataggtccaaaatatgtttccccagtcaaaaacatgtaaggtttgcaccaggagtggaaggaaacaaacaaacataaaccaaagcaaagacacttaagggctgggtactcatgcctgtaaacccaacactttgggagtttgaggcaggaggctcatttgaggccaggagtttgagaccagcctggggaacatagtgagaccctgttgc

SEQ ID NO: 195175 - DNA, 1358 bp, Homo sapiens
  Payload ID: 18539
  Gene Name: tripartite motif containing 73
  Uniprot ID: Q86UV7
  ENST ID: ENST00000323819
  CDS Start-End: 201-953
gagcatgatggggcatgtgcgggagcgccaggcggggcatgtaaccagagcgtgcggggcatgatggggcacggacatggggggttaggtggggcacgtaattggagctcgcggggcaggatggggcatctaactggagcgacagagagcacgatggggcacttacaggggccggaggctggcccgggcagtgagtgtggatggcttggcaggtgagcctgctggagctggaggaccggcttcagtgtcccatctgcctggaggtcttcaaggagtccctaatgctacagtgcggccactcctactgcaagggctgcctggtttccctgtcctaccacctggacaccaaggtgcgctgccccatgtgctggcaggtggtggacggcagcagctccttgcccaacgtctccctggcctgggtgatcgaagccctgaggctccctggggacccggagcccaaggtctgcgtgcaccaccggaacccgctcagccttttctgcgagaaggaccaggagctcatctgtggcctctgcggtctgctgggctcccaccaacaccacccggtcacgcccgtctccaccgtctgcagccgcatgaaggaggagctcgcagccctcttctctgagctgaagcaggagcagaagaaggtggatgagctcatcgccaaactggtgaaaaaccggacccgaatcgtcaatgagtcggatgtcttcagctgggtgatccgccgcgagttccaggagctgcgccacccggtggacgaggagaaggcccgctgcctggaggggatagggggtcacacccgtggcctggtggcctccctggacatgcagctggagcaggcccagggaacccgggagcggctggcccaagccgagtgtgtgctggaacagttcggcaatgaggaccaccatgagttcatctggaagttccactccatggcctccaggtaataaccttggagagagctcagccagggtctggtggctgcgggcacgggcatctcagctccactggttcctccattcagcttaaccagcgcctcccaagcagctgcctatagctggctctataactgagcctggggaagatagaggaaagtcacgtccctgccttcaagggtctcgcagacaggtggggaggcagatggtgaactgtgggtacctagaacagcagaagttcactcaagctacagaaatactagaggagggtagctcatgcctgcaatcccagtactttgggaggccaaggcaggagtattgctggaggccgggagttcgagaccagcctggccaatgtagtaacacccccgtctctacaaaaaatacaaaaataaaaaaattagttgggcatggtgg

SEQ ID NO: 195176 - DNA, 1425 bp, Homo sapiens
  Payload ID: 18539
  Gene Name: tripartite motif containing 73
  ENST ID: ENST00000450434
  CDS Start-End: 661-1020
ggatgacgtccttcagcacgccccggtcccccgagatgtccagcatcctctgacttaaccgctcgtacagggactgatggagaatgaaagccaggcctcagagccgcagacccacccggccacccctcagcgtctacgcccccgaaacgtctgggccctcacctggccgggggcgtcgtccccttccaggactccctggtttaacgcgcttccccccatgtcctagctgccctccctgtggcgtgagccttcggcctggtgcgccccgctgcccttcctggctgtgactctggtggggttccgaaggcccctttatgcccggcagacccctaccgacggcggcattacattctggggccacgaggaggcactcatcgtttcgttccaaccgccgccaacggccctggccctcgcgagctctggaactacagaggtcgcacggtggtggacggcagcagctccttgcccaacgtctccctggcctgggtgatcgaagccctgaggctccctggggacccggagcccaaggtctgcgtgcaccaccggaacccgctcagccttttctgcgagaaggaccaggagctcatctgtggcctctgcggtctgctgggctcccaccaacaccacccggtcacgcccgtctccaccgtctgcagccgcatgaaggaggagctcgcagccctcttctctgagctgaagcaggagcagaagaaggtggatgagctcatcgccaaactggtgaaaaaccggacccgaatcgtcaatgagtcggatgtcttcagctgggtgatccgccgcgagttccaggagctgcgccacccggtggacgaggagaaggcccgctgcctggaggggatagggggtcacacccgtggcctggtggcctccctggacatgcagctggagcaggcccagggaacccgggagcggctggcccaagccgagtgtgtgctggaacagttcggcaatgaggaccaccatgagttcatctggaagttccactccatggcctccaggtaataaccttggagagagctcagccagggtctggtggctgcgggcacgggcatctcagctccactggttcctccattcagcttaaccagcgcctcccaagcagctgcctatagctggctctataactgagcctggggaagatagaggaaagtcacgtccctgccttcaagggtctcgcagacaggtggggaggcagatggtgaactgtgggtacctagaacagcagaagttcactcaagctacagaaatactagaggagggtagctcatgcctgcaatcccagtactttgggaggccaaggcaggagtattgctggaggccgggagttcgagaccagcctggccaatgtagtaacacccccgtctctacaaaaaatacaaaaataaaaaaattagttgggcatggtgg

SEQ ID NO: 195177 - DNA, 1286 bp, Homo sapiens
  Payload ID: 18539
  Gene Name: tripartite motif containing 73
  ENST ID: ENST00000447409
  CDS Start-End: 140-889
ggcgtccagctgcacttcccacttctgactctgtgcctgctgttccctgctgggaagaagaaaagccagtgatgctggcttgaggccatagtgggaggcccagtggatcctgagaagctagcccgggcagtgagtgtggatggcttggcaggtgagcctgctggagctggaggaccggcttcagtgtcccatctgcctggaggtcttcaaggagtccctaatgctacagtgcggccactcctactgcaagggctgcctggtttccctgtcctaccacctggacaccaaggtgcgctgccccatgtgctggcaggtggtggacggcagcagctccttgcccaacgtctccctggcctgggtgatcgaagccctgaggctccctggggacccggagcccaaggtctgcgtgcaccaccggaacccgctcagccttttctgcgagaaggaccaggagctcatctgtggcctctgcggtctgctgggctcccaccaacaccacccggtcacgcccgtctccaccgtctgcagccgcatgaaggaggagctcgcagccctcttctctgagctgaagcaggagcagaagaaggtggatgagctcatcgccaaactggtgaaaaaccggacccgaatcgtcaatgagtcggatgtcttcagctgggtgatccgccgcgagttccaggagctgcgccacccggtggacgaggagaaggcccgctgcctggaggggatagggggtcacacccgtggcctggtggcctccctggacatgcagctggagcaggcccagggaacccgggagcggctggcccaagccgagtgtgtgctggaacagttcggcaatgaggaccaccatgagttcatctggttccactccatggcctccaggtaataaccttggagagagctcagccagggtctggtggctgcgggcacgggcatctcagctccactggttcctccattcagcttaaccagcgcctcccaagcagctgcctatagctggctctataactgagcctggggaagatagaggaaagtcacgtccctgccttcaagggtctcgcagacaggtggggaggcagatggtgaactgtgggtacctagaacagcagaagttcactcaagctacagaaatactagaggagggtagctcatgcctgcaatcccagtactttgggaggccaaggcaggagtattgctggaggccgggagttcgagaccagcctggccaatgtagtaacacccccgtctctacaaaaaatacaaaaataaaaaaattagttggg

SEQ ID NO: 195178 - DNA, 1321 bp, Homo sapiens
  Payload ID: 18539
  Gene Name: tripartite motif containing 73
  ENST ID: ENST00000430211
  CDS Start-End: 74-922
atctaactggagcgacagagagcacgatggggcacttacaggggccggaggctggcccgggcagtgagtgtggatggcttggcaggtgagcctgctggagctggaggaccggcttcagtgtcccatctgcctggaggtcttcaaggagtccctaatgctacagtgcggccactcctactgcaagggctgcctggtttccctgtcctaccacctggacaccaaggtgcgctgccccatgtgctggcaggtggtggacggcagcagctccttgcccaacgtctccctggcctgggtgatcgaagccctgaggctccctggggacccggagcccaaggtctgcgtgcaccaccggaacccgctcagccttttctgcgagaaggaccaggagctcatctgtggcctctgcggtctgctgggctcccaccaacaccacccggtcacgcccgtctccaccgtctgcagccgcatgaaggaggagctcgcagccctcttctctgagctgaagcaggagcagaagaaggtggatgagctcatcgccaaactggtgaaaaaccggacccgaatcgtcaatgagtcggatgtcttcagctgggtgatccgccgcgagttccaggagctgcgccacccggtggacgaggagaaggcccgctgcctggaggggatagggggtcacacccgtggcctggtggcctccctggacatgcagctggagcaggcccagggaacccgggagcggctggcccaagccgagtgtgtgctggaacagttcggcaatgaggaccaccatgagttcatctggaagttccactccatggcctccagattgacaaagactgaagaactggagaagaagtggcgaaacgggctcgcagcgtcgcattccctaccccagcaggtgcgcccgcagcgtcgcactccctagcccggcagaacgtgaagcagctgtacgcgctggtgtgcgaaacgcagcgctactccgccgtgctggatgccgtgatctccagcgccggcctcctcagtgcgaagaagctgcagccgcacctggccaagggtaggggcggggcggggaagtgaaccccgacggtcagcgctttgtcatctggtttcagccccgctgccgtgcacggcgggactggagcaagtcgctcacctgaaatgagtatgagcagaccttccctgggttacgaattgagatgggatgaaaatgctttaacttcgagtgttttgaaggattaaataaccgaagtacaaagtagtagtagcggagacagtaaggaagtcgggcgtggcggcgcgcacctgtggtcccagctactcggaa

SEQ ID NO: 195179 - DNA, 1169 bp, Homo sapiens
  Payload ID: 18539
  Gene Name: tripartite motif containing 73
  Uniprot ID: Q86UV7
  ENST ID: ENST00000437796
  CDS Start-End: 20-772
gcccgggcagtgagtgtggatggcttggcaggtgagcctgctggagctggaggaccggcttcagtgtcccatctgcctggaggtcttcaaggagtccctaatgctacagtgcggccactcctactgcaagggctgcctggtttccctgtcctaccacctggacaccaaggtgcgctgccccatgtgctggcaggtggtggacggcagcagctccttgcccaacgtctccctggcctgggtgatcgaagccctgaggctccctggggacccggagcccaaggtctgcgtgcaccaccggaacccgctcagccttttctgcgagaaggaccaggagctcatctgtggcctctgcggtctgctgggctcccaccaacaccacccggtcacgcccgtctccaccgtctgcagccgcatgaaggaggagctcgcagccctcttctctgagctgaagcaggagcagaagaaggtggatgagctcatcgccaaactggtgaaaaaccggacccgaatcgtcaatgagtcggatgtcttcagctgggtgatccgccgcgagttccaggagctgcgccacccggtggacgaggagaaggcccgctgcctggaggggatagggggtcacacccgtggcctggtggcctccctggacatgcagctggagcaggcccagggaacccgggagcggctggcccaagccgagtgtgtgctggaacagttcggcaatgaggaccaccatgagttcatctggaagttccactccatggcctccaggtaataaccttggagagagctcagccagggtctggtggctgcgggcacgggcatctcagctccactggttcctccattcagcttaaccagcgcctcccaagcagctgcctatagctggctctataactgagcctggggaagatagaggaaagtcacgtccctgccttcaagggtctcgcagacaggtggggaggcagatggtgaactgtgggtacctagaacagcagaagttcactcaagctacagaaatactagaggagggtagctcatgcctgcaatcccagtactttgggaggccaaggcaggagtattgctggaggccgggagttcgagaccagcctggccaatgtagtaacacccccgtctctacaaaaaatacaaaaataaaaaaattagttggg

SEQ ID NO: 195180 - DNA, 1350 bp, Homo sapiens
  Payload ID: 18540
  Gene Name: tripartite motif containing 74
  Uniprot ID: Q86UV6
  ENST ID: ENST00000285805
  CDS Start-End: 201-953
gagcatgatggggcatgtgcgggagcgccaggcggggcatgtaaccagagcgtgcggggcatgatggggcacggacatggggggttaggtggggcacgtaattggagctcgcggggcaggatggggcatctaactggagcgacagagagcacgatggggcacttacaggggccggaggctggcccgggcagtgagtgtggatggcttggcaggtgagcctgctggagctggaggactggcttcagtgtcccatctgcctggaggtcttcaaggagtccctaatgctacagtgcggccactcctactgcaagggctgcctggtttccctgtcctaccacctggacaccaaggtgcgctgccccatgtgctggcaggtggtggacggcagcagctccttgcccaacgtctccctggcctgggtgatcgaagccctgaggctccctggggacccggagcccaaggtctgcgtgcaccaccggaacccgctcagccttttctgcgagaaggaccaggagctcatctgtggcctctgcggtctgctgggctcccaccaacaccacccggtcacgcccgtctccaccgtctgcagccgcatgaaggaggagctcgcagccctcttctctgagctgaagcaggagcagaagaaggtggatgagctcatcgccaaactggtgaaaaaccggacccgaatcgtcaatgagtcggatgtcttcagctgggtgatccgccgcgagttccaggagctgcgccacccggtggacgaggagaaggcccgctgcctggaggggatagggggtcacacccgtggcctggtggcctccctggacatgcagctggagcaggcccagggaacccgggagcggctggcccaagccgagtgtgtgctggaacagttcggaaatgaggaccaccatgagttcatctggaagttccactccatggcctccaggtaataaccttggagagagctcagccagggtctggtggctgcgggcacgggcatctcagctccactggttcctccattcagcttaaccagcgcctcccaagcagctgcctatagctggctctataactgagcctggggaagatagaggaaagtcacgtccctgccttcaagggtctcgcagacaggtggggaggcagatggtgaactgtgggtacctagaacagcagaagttcactcaagctacagaaatactagaggagggtagctcatgcctgcaatcccagtactttgggaggccaaggcaggagtattgctggaggccgggagttcgagaccagcctggccaatgtagtaacacccccgtctctacaaaaaatacaaaaataaaaaaattagttggg

SEQ ID NO: 195181 - DNA, 1286 bp, Homo sapiens
  Payload ID: 18540
  Gene Name: tripartite motif containing 74
  Uniprot ID: Q86UV6
  ENST ID: ENST00000395244
  CDS Start-End: 140-889
ggcgtccagctgcacttcccacttctgactctgtgcctgctgttccctgctgggaagaagaaaagccagtgatgctggcttgaggccatagtgggaggcccagtggatcctgagaagctagcccgggcagtgagtgtggatggcttggcaggtgagcctgctggagctggaggactggcttcagtgtcccatctgcctggaggtcttcaaggagtccctaatgctacagtgcggccactcctactgcaagggctgcctggtttccctgtcctaccacctggacaccaaggtgcgctgccccatgtgctggcaggtggtggacggcagcagctccttgcccaacgtctccctggcctgggtgatcgaagccctgaggctccctggggacccggagcccaaggtctgcgtgcaccaccggaacccgctcagccttttctgcgagaaggaccaggagctcatctgtggcctctgcggtctgctgggctcccaccaacaccacccggtcacgcccgtctccaccgtctgcagccgcatgaaggaggagctcgcagccctcttctctgagctgaagcaggagcagaagaaggtggatgagctcatcgccaaactggtgaaaaaccggacccgaatcgtcaatgagtcggatgtcttcagctgggtgatccgccgcgagttccaggagctgcgccacccggtggacgaggagaaggcccgctgcctggaggggatagggggtcacacccgtggcctggtggcctccctggacatgcagctggagcaggcccagggaacccgggagcggctggcccaagccgagtgtgtgctggaacagttcggaaatgaggaccaccatgagttcatctggttccactccatggcctccaggtaataaccttggagagagctcagccagggtctggtggctgcgggcacgggcatctcagctccactggttcctccattcagcttaaccagcgcctcccaagcagctgcctatagctggctctataactgagcctggggaagatagaggaaagtcacgtccctgccttcaagggtctcgcagacaggtggggaggcagatggtgaactgtgggtacctagaacagcagaagttcactcaagctacagaaatactagaggagggtagctcatgcctgcaatcccagtactttgggaggccaaggcaggagtattgctggaggccgggagttcgagaccagcctggccaatgtagtaacacccccgtctctacaaaaaatacaaaaataaaaaaattagttggg

SEQ ID NO: 195182 - DNA, 1353 bp, Homo sapiens
  Payload ID: 18541
  Gene Name: tripartite motif containing 77
  Uniprot ID: I1YAP6
  ENST ID: ENST00000398290
  CDS Start-End: 1-1353
atggcttctgctatcacgcagtgttctaccagtgagctcacctgctcgatctgcacagactatttgacagaccctgtcaccatttgttgtgggcacagattttgtagtccctgtctctgcctcttgtgggaagatacactaactcctaattgctgccctgtgtgcagggaaatatcacagcaaatgtacttcaaacgcattatttttgctgagaaacaagttattcctacaagagaatcagtcccctgccagttatcaagctctgccatgctgatctgtaggagacaccaggaaatcaagaacctcatctgtgaaactgataggagcctgctgtgttttctatgctctcaatccccaaggcatgctactcacaaacactatatgacaagggaggctgatgaatactataggaagaaactcctgattcaaatgaagtccatctggaaaaaaaaacagaaaaatcaaagaaatctaaacagagagaccaacataatcggaacatgggaagtttttataaatttgcggagcatgatgatcagtgctgaatatcctaaggtgtgtcaatacctccgtgaagaagagcaaaagcacgtagagagcctggcaagagaaggcaggataatttttcagcaactcaagagaagtcaaactagaatggctaagatgggtatactcctgagagaaatgtatgagaaactgaaggaaatgagctgtaaagcagatgtgaacctgcctcaggatttgggagacgtaatgaaaaggaatgagtttctgaggctggccatgcctcagcctgtgaacccacagctcagtgcatggaccatcactggggtgtcagaaaggcttaacttcttcagagtgtatatcaccttggatcgtaagatatgcagtaatcacaagcttctgttcgaagacctaaggcatttgcagtgcagccttgatgatacagacatgtcctgtaatccaacaagtacacagtatacttcttcatggggagctcagatcctcagctctggcaaacattactgggaggtggatgtgaaagactcttgtaattgggttataggactttgcagagaagcctggacaaagaggaatgacatgcgacttgactctgagggtatctttctactcctgtgtctcaaagtggatgaccatttcagtctcttctctacctccccactgttacctcactatattccaaggccccaaggctggctaggggtgttcctggattatgaatgtgggatagtgagctttgttaatgttgcccaaagttccctcatttgtagtttcctctcacgcatcttctattttcctctcagacctttcatttgccacggatctaaataa

SEQ ID NO: 195183 - DNA, 705 bp, Homo sapiens
  Payload ID: 18541
  Gene Name: tripartite motif containing 77
  ENST ID: ENST00000534392
  CDS Start-End: 1-705
tccccaaggcatgctactcacaaacactatatgacaagggaggctgatgaatactataggaagaaactcctgattcaaatgaagtccatctggaaaaaaaaacagaaaaatcaaagaaatctaaacagagagaccaacataatcggaacatgggaagatttgggagacgtaatgaaaaggaatgagtttctgaggctggccatgcctcagcctgtgaacccacagctcagtgcatggaccatcactggggtgtcagaaaggcttaacttcttcagagtgtatatcaccttggatcgtaagatatgcagtaatcacaagcttctgttcgaagacctaaggcatttgcagtgcagccttgatgatacagacatgtcctgtaatccaacaagtacacagtatacttcttcatggggagctcagatcctcagctctggcaaacattactgggaggtggatgtgaaagactcttgtaattgggttataggactttgcagagaagcctggacaaagaggaatgacatgcgacttgactctgagggtatctttctactcctgtgtctcaaagtggatgaccatttcagtctcttctctacctccccactgttacctcactatattccaaggccccaaggctggctaggggtgttcctggattatgaatgtgggatagtgagctttgttaatgttgcccaaagttccctcatt

SEQ ID NO: 195184 - DNA, 2831 bp, Homo sapiens
  Payload ID: 18542
  Gene Name: tripartite motif containing 8
  Uniprot ID: Q9BZR9
  ENST ID: ENST00000302424
  CDS Start-End: 123-1778
agcgaccgtcggggccggctggggccggagctcggggctcggtgggcctacagcggctccggacggacccccggggctggggagtcggggaggcctgccccggccccctgcccgcggccgccatggcggagaattggaagaactgcttcgaggaggagctcatctgccctatctgcctgcacgttttcgtggagccagtgcagctgccgtgcaaacacaacttctgccggggctgcatcggcgaggcgtgggccaaggacagcggcctcgtacgctgcccagagtgcaaccaggcctacaaccagaagccgggcctggagaagaacctgaagctcaccaacatcgtggagaagttcaatgccctgcacgtggagaagccgccggcggcgctgcactgcgtgttctgccgccgcggccccccgctgcccgcgcagaaggtctgcctgcgctgcgaggcgccctgctgccagtcccacgtgcagacgcacctgcagcagccctccaccgcccgcgggcacctcctggtggaggcggacgacgtgcgggcctggagctgcccgcagcacaacgcctaccgcctctaccactgcgaggccgagcaggtggccgtgtgccagtactgctgctactacagcggcgcgcatcagggacactcggtgtgcgacgtggagatccgaaggaatgaaatccggaagatgctcatgaagcagcaggaccggctggaggagcgagagcaggacattgaggaccagctgtacaaactcgagtcagacaagcgcctggtggaggagaaagtgaaccaactgaaggaggaagttcggctgcagtacgagaagctgcaccagctgctggacgaggacctgcggcagacagtggaggtcctagacaaggcccaggccaagttctgcagcgagaacgcagcgcaggcgctgcacctcggggagcgcatgcaggaggccaagaagctgctgggctccctgcagctgctctttgataagacggaggatgtcagcttcatgaagaacaccaagtctgtgaaaatcctgatggacaggacccagacctgcacgagcagcagcctttcccccactaagatcggccacctgaactccaagctcttcctgaacgaagtggccaagaaggagaagcagctgcggaaaatgctagaaggccccttcagcacgccggtgcccttcctgcagagtgtccccctgtacccttgcggcgtgagcagctctggggcggaaaagcgcaagcactcaacggccttcccagaggccagtttcctagagacgtcgtcgggccctgtgggcggccagtacggggcggcgggcacagccagcggtgagggccagtctgggcagcccctggggccctgcagctccacgcagcacttggtggccctgccgggcggcgcccaaccagtgcactcaagccccgtgttccccccatcgcagtatcccaatggctccgccgcccagcagcccatgctcccccagtatggcggccgcaagattctcgtctgttctgtggacaactgttactgttcttccgtggccaaccatggcggccaccagccctacccccgctccggccactttccctggacagtgccctcgcaggagtactcacacccgctcccgcccacaccctccgtcccccagtcccttcccagcctggcggtcagagactggcttgacgcctcccagcagcccggccaccaggatttctacagggtgtatgggcagccgtccaccaaacactacgtgacgagctaacgccacgcaggcggcggggcgctggggaatcttcctccccagcccccgggctcgggagttatgcatccagagacctgcccttctaccttcctcgcctcccctcttcctcattccattgccccaggtcttttccttttggattttgttttggttttggctttgtttttgatttttttttattatgaatctcctggacgcagaggtgacagtgggagctggcctgggccaggacggcaggtggccctggagatgggaaagtgtctgtgtcgaggcgctgagctctctctctgtttctccttttttcctctactccttccccttcacacccccgtggctggaaggaacctcggcttccctgaaagcttgggggtcccacccttcttaccccacccgggaggaacgcccagggccccgggcttgtttctcctcttgttttccttttgggcagtttgatcactgatcgagtaaggaatgacctttagattgtgcgacttttgtttttgtttttttaaatttttttaaaccaagaatgatttctcctgcttccttctcctcaccatcttcccagacggagttcaaaggccacttctcaagcagcttttggcaccttcagcctcagagtggaatcttttaaagacaggacccctatgtccaggaaaggggaaaaggaactttgccaatgatagtgaccacagcaaaagcaaataataataatattaataataataaagagaaataaaataataaaataaaaaacaatagcacagcccttgttgaggtcagcagggaggaggggctgcccggagttgggtccttgcctggattttgacacagcaacttcctgtagtgagcactttgtatgaatcgtggacttcctgttctcaaggcgcaggtatttattctgtatctgtctagagcacacaccaaaatccaaccttctaataaacatgatggcgcagtcccactccctgcctcgcctgttcccctatcccccccaggcctgggatcttcaggcgtcggtgtggggaggggcccctgccctccttgccttga

SEQ ID NO: 195185 - DNA, 891 bp, Homo sapiens
  Payload ID: 18542
  Gene Name: tripartite motif containing 8
  ENST ID: ENST00000462202
  CDS Start-End: 1-891
gcactgcgtgttctgccgccgcggccccccgctgcccgcgcagaaggtctgcctgcgctgcgaggcgccctgctgccagtcccacgtgcagacgcacctgcagcagccctccaccgcccgcgggcacctcctggtggaggcggacgacgtgcgggcctggagctgcccgcagcacaacgcctaccgcctctaccactgcgaggccgagcaggtggccgtgtgccagtactgctgctactacagcggcgcgcatcagggacactcggtgtgcgacgtggagatccgaaggaatgaaatccgggagaaagtgaaccaactgaaggaggaagttcggctgcagtacgagaagctgcaccagctgctggacgaggacctgcggcagacagtggaggtcctagacaaggcccaggccaagttctgcagcgagaacgcagcgcaggcgctgcacctcggggagcgcatgcaggaggccaagaagctgctgggctccctgcagctgctctttgataagacggaggatgtcagcttcatgaagaacaccaagtctgtgaaaatcctgatggacaggacccagacctgcacgagcagcagcctttcccccactaagatcggccacctgaactccaagctcttcctgaacgaagtggccaagaaggagaagcagctgcggaaaatgctagaaggccccttcagcacgccggtgcccttcctgcagagtgtccccctgtacccttgcggcgtgagcagctctggggcggaaaagcgcaagcactcaacggccttcccagaggccagtttcctagagacgtcgtcgggccctgtgggcggccagtacggggcggcgggcacagccagcggtgagggccagtctgggcagcccctggggccctg

SEQ ID NO: 195186 - DNA, 5284 bp, Homo sapiens
  Payload ID: 18543
  Gene Name: tripartite motif containing 9
  Uniprot ID: Q9C026
  ENST ID: ENST00000298355
  CDS Start-End: 1123-3255
aaactacgggcactcagaaatagacaaactgttcttgcctcaaccgaaccaaaggcccagcgggcctcgaaaaagctcagccaggtgctttgggaggccgcgaggaggaagaaggatccgtggaaggaagcacgttcacaccacggcactgaggcctctgggccgagctataatttaaagcatgaaacgaaggggtcatagattctgactaatgctgaccatttccatcggttacccagttgaatctcatgtcgacactaggaaatcgactttatacatgctctttaggaaacgagggacgcaggatgaaagaagccaagagtgtcgccagggcttgcgccagcgccgtcagactcccgggatgggggagctccagggcacggcgtcagcggattcacggagaaggagaaaagccccactgccgtgcagaagcctaggcccgggtgagacgcctgcgaaggctgccagcagcggaagagaaggggcgtcctccgtgctgcgcagcactcgcccgcggtaggtgggcgcggagctcagagctgggagccaaacgcaaacgctggcgagaagccccagccccctccggcagcccactcgctgcggggaggggtttctcacgcccccagctcctgggagactgcaccggaggtcggaagtaagccgggcgaggatgaatcatcccgcctaactcctccttcccggtcccctagcctccgcacgccggcccccttcagagatcttgcagccgcgagcgaagactgccctatcctcagactctaccgaaccccctgtggcctgcggagacgaggagacggacgggtctggtggccaatgagagcttcgatctcttgccccccgcccaatgggccgctgctcatgggccggggcgggactaggagggcaggtaggggcggtccgggctggcgcgcggcgcggcggctacgcggctgcggctcacagagctagcgcctctctgggtgtccgtgccagtgctgcgcgggaaggcaccaccaccacagccgccgccgctggccagggtgctggacaagacgggcccgtcggccacctcgccagctcaggcacccgctgcagccgtcgctgtctcctcccagaccggtccccatggaggagatggaagaggagttgaaatgccccgtgtgcggctccttctatcgggagcccatcatcctgccctgctctcacaatttgtgtcaggcgtgcgcccgcaacatcctggtgcagaccccagagtctgaatccccccagagccatcgggccgcgggctccggggtctccgactatgactatctggacctggacaagatgagcctatacagcgaggcggacagcggctatggctcctacggggggttcgccagcgcccccactaccccgtgccagaagtcccccaacggcgtccgcgtgtttcccccggctatgccgccaccggccacccacttgtcaccggccctggccccggtgccccgcaactcctgtatcacctgcccccagtgtcaccgcagcctcatcctggatgaccgggggctccgcggcttccccaagaatcgcgtactggaaggggtaattgaccgctaccagcagagcaaagccgcggccctcaagtgccagctctgcgagaaggcgcccaaggaagccaccgtcatgtgcgaacagtgcgatgtcttctactgcgatccgtgccgcctgcgctgccacccgccccgggggcccctagccaagcaccgcctggtgcccccggcccagggtcgtgtgagccggaggctgagcccacgcaaggtctccacctgcacagaccacgagctggagaaccacagcatgtactgcgtgcaatgcaagatgcccgtgtgctaccagtgcttggaggagggcaaacactccagccacgaagtcaaggctctgggggccatgtggaaactacataagagccagctctcccaggcgctgaacggactgtcagacagggccaaagaagccaaggagtttctggtacagctgcgcaacatggtccagcagatccaggagaacagtgtggagtttgaagcctgtctggtggcccaatgtgatgccctcatcgatgccctcaacagaagaaaagcccagctgctggcccgcgtcaacaaggagcatgagcacaagctgaaggtggttcgagatcagatctctcactgcacagtgaaattgcgccagaccacaggtctcatggagtactgcttggaggtgattaaggaaaatgatcctagtggttttttgcagatttctgacgccctcataagaagagtgcacctgactgaggatcagtggggtaaaggcacactcactccaaggatgaccacggactttgacttgagtctggacaacagccctctgctgcaatccatccaccagctggatttcgtgcaagtgaaagcttcctctccagtcccagcaacccctatcctacagctggaggaatgttgtacccacaacaacagcgctacgttgtcctggaaacagccacctctgtccacggtgcccgccgatggatacattctggagctggatgatggcaacggtggtcaattccgggaggtgtatgtggggaaggagacaatgtgcactgtggatggtcttcacttcaacagcacatacaacgctcgggtcaaggccttcaacaaaacaggagtcagcccgtacagcaagaccctggtcctccaaacgtctgaggtggcctggtttgctttcgaccctggctcggcgcactcggacatcatcctctccaatgacaacctgacagtgacctgtagtagctatgatgaccgggtggtgctagggaagactggcttctccaagggcatccactactgggagctcacggtagatcgctatgacaaccaccctgatcctgcctttggtgtggctcgcatggacgtgatgaaggatgtgatgttaggaaaagacgacaaagcttgggcaatgtatgtggacaataaccggagctggttcatgcacaacaactcgcacaccaacagaactgagggagggatcacaaaaggggccacaattggggtcctcctcgacttaaatagaaaaaacttgacattttttatcaacgatgaacaacaaggtcccatagcatttgataacgtggagggcctcttcttccctgcggtcagcctgaacaggaacgtgcaggtcacgctgcacaccgggctcccagtccccgacttctactccagcagagcatcaatagcctaaggatgtgccgtggaggcgccagctgcctgttcttacctccgcctgcgagagccacagcaaggagctcagccagccgtggtggggtgcagagttggcaggagtgggagaaggaggagagaaaagctggtcctctgcagtctttacacccacagctctgcccttttccctttcaacctctcctccgctgtcatgcctgcttccgcttccatgtccaacaattctaaccaacaaaggacctagacagcccaccaagtcacttggttcccactcccagattttgcttttatttaacttaattttttatgtaggtgagttatattttctttcttttctgatcaggttattggtgacttactggactggcaccgccaggagaaaattctcctgctaactttttttcttaagctttctgtcaaacaatgaggttgtagggggaggtagggaagaatgagctgaatttgtagcatacagcttacctgctagaatgttcttaccctcttacctctcctgtagcgttagctctgcagagctaagctttgggagaatgaatctatcactgagaagttttactactcattgaagcacaaaaatatccgctacacaggttcacatcagggtaggatcgttaggatggctctataattaggataggccagaaccctggccactgtataaaattggaaagtctctaagacacaggcaaaccaggggacttaatgatttggttcgtttatttaataaaagcttttaattgagaacctactattgaccaggcactgttcaagacactagaacattatgttctagacactgtggggacacagtggtgaacagacaggcatggtctctgcccttcggagcttatattccagtaggagaaaaagcaaaaataaaataattataaatggtcatatgtactagaaaggaaatgggcaagggtcaaagagactcatgggcaagatctttcaggcttcctagaatgatgctaaaaatccacacattctggccatagcaccagaaatgtaccaactcaatgccttttcagctgcactatttaattatggtacctgctgccactcatcacagagcccttcttggtagaaatgatgtcagcattcttatttgctgatgctgctatgataccacgccttaaaaattgacagttgaaaaaaaaaagagtgaccagagggcaaaggacccattctcagtaatgggagatcttgagttgcagtccacagcattcacattctcaggataaacatgcttgtctccatatatactatctgtgcctgttatgaatgaaaaatccatccactctgctgccattcacagcctaattttctggagtagtccaaacaatgtttggaaaaacatgggactgtatgtcattactatgactgatagcagaataataatgcatcttacttctatatagagatagacttacataggttacccttgaaattcattagtttgtcataaagttttaggaaaggtaggacccggaaagaagttctaattagttgtctaaatatttttcagtgagccaagaaattcaccatgaaaaaacaagaataacaaatagaagggaagagataggatgggaaagctaacaaattaaagttttggcaaaaaggaatatatgtaaatagctaattatttacttttgtgcttactttatttagattatttctatcagttacaatctttttctagttaagtgtacctaatttatggaatgggtgctatcctgtttatgtgtgtcttggtttttcttggctacagaaaaactgttgcagggcaacactagtttgatatttgatttactctccaatgagactcaatggctgggccgtggtagactcatagttcctcttgttctttattaaattcatcctgctaattagatttctagtgacttgtaacatgtagtttacactgaattgcaattacagatgcatacaactactatactagaaaaaattgtcatttctgatgtgccaataaatgatttttatgagagaataaa

SEQ ID NO: 195187 - DNA, 3312 bp, Homo sapiens
  Payload ID: 18543
  Gene Name: tripartite motif containing 9
  Uniprot ID: Q9C026
  ENST ID: ENST00000338969
  CDS Start-End: 391-2799
agagatcttgcagccgcgagcgaagactgccctatcctcagactctaccgaaccccctgtggcctgcggagacgaggagacggacgggtctggtggccaatgagagcttcgatctcttgccccccgcccaatgggccgctgctcatgggccggggcgggactaggagggcaggtaggggcggtccgggctggcgcgcggcgcggcggctacgcggctgcggctcacagagctagcgcctctctgggtgtccgtgccagtgctgcgcgggaaggcaccaccaccacagccgccgccgctggccagggtgctggacaagacgggcccgtcggccacctcgccagctcaggcacccgctgcagccgtcgctgtctcctcccagaccggtccccatggaggagatggaagaggagttgaaatgccccgtgtgcggctccttctatcgggagcccatcatcctgccctgctctcacaatttgtgtcaggcgtgcgcccgcaacatcctggtgcagaccccagagtctgaatccccccagagccatcgggccgcgggctccggggtctccgactatgactatctggacctggacaagatgagcctatacagcgaggcggacagcggctatggctcctacggggggttcgccagcgcccccactaccccgtgccagaagtcccccaacggcgtccgcgtgtttcccccggctatgccgccaccggccacccacttgtcaccggccctggccccggtgccccgcaactcctgtatcacctgcccccagtgtcaccgcagcctcatcctggatgaccgggggctccgcggcttccccaagaatcgcgtactggaaggggtaattgaccgctaccagcagagcaaagccgcggccctcaagtgccagctctgcgagaaggcgcccaaggaagccaccgtcatgtgcgaacagtgcgatgtcttctactgcgatccgtgccgcctgcgctgccacccgccccgggggcccctagccaagcaccgcctggtgcccccggcccagggtcgtgtgagccggaggctgagcccacgcaaggtctccacctgcacagaccacgagctggagaaccacagcatgtactgcgtgcaatgcaagatgcccgtgtgctaccagtgcttggaggagggcaaacactccagccacgaagtcaaggctctgggggccatgtggaaactacataagagccagctctcccaggcgctgaacggactgtcagacagggccaaagaagccaaggagtttctggtacagctgcgcaacatggtccagcagatccaggagaacagtgtggagtttgaagcctgtctggtggcccaatgtgatgccctcatcgatgccctcaacagaagaaaagcccagctgctggcccgcgtcaacaaggagcatgagcacaagctgaaggtggttcgagatcagatctctcactgcacagtgaaattgcgccagaccacaggtctcatggagtactgcttggaggtgattaaggaaaatgatcctagtggttttttgcagatttctgacgccctcataagaagagtgcacctgactgaggatcagtggggtaaaggcacactcactccaaggatgaccacggactttgacttgagtctggacaacagccctctgctgcaatccatccaccagctggatttcgtgcaagtgaaagtcccagcaacccctatcctacagctggaggaatgttgtacccacaacaacagcgctacgttgtcctggaaacagccacctctgtccacggtgcccgccgatggatacattctggagctggatgatggcaacggtggtcaattccgggaggtgtatgtggggaaggagacaatgtgcactgtggatggtcttcacttcaacagcacatacaacgctcgggtcaaggccttcaacaaaacaggagtcagcccgtacagcaagaccctggtcctccaaacgtctgaggacacagattcagaagaacagaccctcccttttccagtgccttcggaaagattgccgctccgtagaatgagtcctttctcctccacccttaatctacaacccagcttccccgggagatcctactttgatttccgatcctcaccccaccagctgagcttgcattcctctttacagtctctcaatgcaccgggatgcaattttgagacacaatctgcaccttactctcaattagttgacattaaaaagctgttggcagtggcctggtttgctttcgaccctggctcggcgcactcggacatcatcctctccaatgacaacctgacagtgacctgtagtagctatgatgaccgggtggtgctagggaagactggcttctccaagggcatccactactgggagctcacggtagatcgctatgacaaccaccctgatcctgcctttggtgtggctcgcatggacgtgatgaaggatgtgatgttaggaaaagacgacaaagcttgggcaatgtatgtggacaataaccggagctggttcatgcacaacaactcgcacaccaacagaactgagggagggatcacaaaaggggccacaattggggtcctcctcgacttaaatagaaaaaacttgacattttttatcaacgatgaacaacaaggtcccatagcatttgataacgtggagggcctcttcttccctgcggtcagcctgaacaggaacgtgcaggtaagcaccctgcccctgaggttaaacagctgttgctggctaccggttcaaaggctgcccagggccgttcaatccaaccgaagagagggaagctgacagcgtaaggcccagaccaagatatgaaggagaggaggagagaaagggatcagcactggcaacttattttattccacgccaagcataagcaccttctttatacttggacgcagactagttaatagcacataggaaactagaattctcttcatggttggctaatgatcatctctgtagctctagtttcacctctaaatagaaacgaaagcctttaaccaactggcatgaaaacaaatagaatgacttaacaaagctcaggagtgcctgagaagaggtgagggtgtaagactgaagcattagtatcattatcagaaaatctgagcatcttctctgcactcttgtttggctctgttaggtcctaaggggtagaaaacatagtccctacctacaacttagtcaattattatttattatagaataaaacaacagcttctcatttattcattcagcaaatatctatagaatgcctttaatgtgccaggcacagttataagtgtctgggatacatcagtg

SEQ ID NO: 195188 - DNA, 3726 bp, Homo sapiens
  Payload ID: 18543
  Gene Name: tripartite motif containing 9
  Uniprot ID: Q9C026
  ENST ID: ENST00000360392
  CDS Start-End: 138-1790
gccagtgctgcgcgggaaggcaccaccaccacagccgccgccgctggccagggtgctggacaagacgggcccgtcggccacctcgccagctcaggcacccgctgcagccgtcgctgtctcctcccagaccggtccccatggaggagatggaagaggagttgaaatgccccgtgtgcggctccttctatcgggagcccatcatcctgccctgctctcacaatttgtgtcaggcgtgcgcccgcaacatcctggtgcagaccccagagtctgaatccccccagagccatcgggccgcgggctccggggtctccgactatgactatctggacctggacaagatgagcctatacagcgaggcggacagcggctatggctcctacggggggttcgccagcgcccccactaccccgtgccagaagtcccccaacggcgtccgcgtgtttcccccggctatgccgccaccggccacccacttgtcaccggccctggccccggtgccccgcaactcctgtatcacctgcccccagtgtcaccgcagcctcatcctggatgaccgggggctccgcggcttccccaagaatcgcgtactggaaggggtaattgaccgctaccagcagagcaaagccgcggccctcaagtgccagctctgcgagaaggcgcccaaggaagccaccgtcatgtgcgaacagtgcgatgtcttctactgcgatccgtgccgcctgcgctgccacccgccccgggggcccctagccaagcaccgcctggtgcccccggcccagggtcgtgtgagccggaggctgagcccacgcaaggtctccacctgcacagaccacgagctggagaaccacagcatgtactgcgtgcaatgcaagatgcccgtgtgctaccagtgcttggaggagggcaaacactccagccacgaagtcaaggctctgggggccatgtggaaactacataagagccagctctcccaggcgctgaacggactgtcagacagggccaaagaagccaaggagtttctggtacagctgcgcaacatggtccagcagatccaggagaacagtgtggagtttgaagcctgtctggtggcccaatgtgatgccctcatcgatgccctcaacagaagaaaagcccagctgctggcccgcgtcaacaaggagcatgagcacaagctgaaggtggttcgagatcagatctctcactgcacagtgaaattgcgccagaccacaggtctcatggagtactgcttggaggtgattaaggaaaatgatcctagtggttttttgcagatttctgacgccctcataagaagagtgcacctgactgaggatcagtggggtaaaggcacactcactccaaggatgaccacggactttgacttgagtctggacaacagccctctgctgcaatccatccaccagctggatttcgtgcaagtgaaagcttcctctccagtcccagcaacccctatcctacagctggaggaatgttgtacccacaacaacagcgctacgttgtcctggaaacagccacctctgtccacggtgcccgccgatggatacattctggagctggatgatggcaacggtggtcaattccgggaggtgtatgtggggaaggagacaatgtgcactgtggatggtcttcacttcaacagcacatacaacgctcgggtcaaggccttcaacaaaacaggagtcagcccgtacagcaagaccctggtcctccaaacgtctgagggtaaggcccttcagcagtatccctcagagcgagaactgcgtggcatctaaagtggctggcaagcccggaggtaaccccaccactgcccacattcctgaagtgtttccatgacttgctctgcattctgcacagagccgctgttcctctcctgcctttagagagcctatggtatgtggatgtgatcaaaccaaagattccacatcggcagttccaatggcttgggccggcggcttcctttgataacaatctaaataagctgcagttgaagaagctgaaaaatgaaggcctgaatgtgcccctggtgtgtaagacaaatgtatctaggctctagagcaggctcccattctccaccgatacacatcatgtgccagttttgcccagatgattctaaattactctgtagtacttgcttgttctgagggtgggacctaggttctttccagtcgtggatttgtatgactgaatgtgtttcaaatgggtggtggggtgctagagctgtttagagagggcctgttggctgctcctggcttacccacttagactgcctccgtttcatacccaaagcggaggccgtcagcaccaggattgagacttcctgtgggcaccaaacaggaagagaccagcaacttcgcattacccgccattttcatctttgccagtcccttcagtcttggctaggctaccgagagccaccatacaaggttcatctctagagaatttttgcttcttagctatactttaaatattttggtcatcaaagacaagtaatgtgtctcagatgagaggcttgaatttgatggccagatataacctctgaggcttttaacattttcattttaagagtaagcaagacacatgaaattaaacctacaaggaggtatttgtggctggtgccaaagcattctgacactttggggtgtcattttaatcaaagaaatcacccccccacctcaccgggattctccataacttccctctgcagaactaattatgttgattttgttcaagttcaagatgttagctaaaagaactatggtggtgttttttttcccacttcccacaaacctcaacatgtgccagtcaccctaaaatgcttcacatggttaaaaacaagcacaattttgaatcctacagcaaggatgaaaggcccctagccgtgaaaacagtgctttggggagcagttgtcagtctaagtgatgctattccaagagaaggatatgctgagggaaaatgcccacatgacctgttcccatttggagtacagtgatgtggtagctacagcttcccccagaattatcattttagcaccttctctcagggatgacctatcagtttgagagcagttgcctcttttctcaaaataccatactaactgctaaagccctccaagagtctttcctagatgcaacgcagaaggcccttgctggtgatggcctcatttcccatgtgtgtacaaggtggtttgattgaagagtgaagtgcatgcctgcagagcagagagaaatttgtagcaatgttgctaatatgtgttatcagatctgcgggaaaactatttctattcataatacatcatgggaatcatactattctggtaaaaatcagttattagcataacagcctgagcacttatgtctctcgtttcatcctgcaggaggatgtagcgcctcagtttattttaatgttcataagattatggtgtctaatttaataaattacaggattggaactgcgatccttggtaccacagtcacagaactgggggtcattttctagatgaaacaaacggaacaagttctcttccaacaaagaaactgtactgtagaaattaatttcctccatgaattttatatattgtgtacaaatataaggtatgtatctgaatacaaagaaaagcctatcatcatatagatatcagtattctctgttactgcacagaagtaattttctcatgatgaaataaagttcacacacatactttctccataa

SEQ ID NO: 195189 - DNA, 1797 bp, Homo sapiens
  Payload ID: 18544
  Gene Name: tripartite motif family-like 1
  Uniprot ID: Q8N9V2
  ENST ID: ENST00000332517
  CDS Start-End: 141-1547
acagaagagataagggtttcttgtcataacaacataggaacaggtcacccgcgtgttactcaaaactgtaggacggcagtgagggctttgctaatcccagaacagaggtgtaacctggctgcatatccagcctcgagaaaatgtctacagcagatctgatggagaacctcagggaggaactcacctgtttcatctgcttagactatttcagcagcccagtgaccaccgagtgtgggcacagcttttgtctggtgtgtctcctcaggagctgggaggaacataacacacctttatcttgtcctgagtgctggaggaccttggagggcccgcatttccagtcaaacgagcgtctggggaggctggccagcatcgccaggcagctccggtcccaggtgctgcagagcgaggatgagcagggcagctacgggaggatgcccaccactgccaaggcgctctccgatgacgagcagggtggaagcgccttcgtagcccagagccatggtgcaaacagagtgcatctctccagcgaggctgaggagcatcacagagagaaactccaggaaatcctgaatcttttgcgtgtaaggagaaaggaagctcaggctgtactaacccatgagaaggagagagtgaaactgtgccaggaagaaacaaagacttgtaaacaggttgttgtgtcagaatacatgaaaatgcaccagttcctgaaggaagaggagcagctgcaactccagctactagaacaggaagagaaagagaacatgaggaagctgaggaacaatgagatcaaactgacccagcaaatcagaagcctaagcaaaatgatcgcacagattgagtcctcaagtcaaagctcggctttcgaatctcttgaggaagtgagaggagccctggaaaggagcgagccactcttgcttcagtgtccagaggccaccaccacagagctgagtctgtgccgcatcacgggaatgaaggagatgctaagaaaattcagcacggagataacgctggacccagccacagctaatgcctatctcgtgttgtcggaggatctgaagagtgtgaaatatgggggaagcagacagcagctacccgacaacccggaaagatttgaccagtctgcgactgtgctgggtactcagatcttcaccagtgggagacactactgggaggtggaggtgggaaacaagaccgagtgggaagtgggcatctgcaaggactctgtgagcagaaaggggaatctccccaagccacctggggacctgttctcactaataggtttaaaaatcggagatgattacagcctctgggtctcgtcacctttgaaaggtcagcacgtcagagagcctgtgtgtaaggttggtgtcttcctggactatgaatctggacatatagcattctacaacgggacggatgaatccctcatctacagcttcccgcaggcttctttccaagaggccctcaggcctatcttttccccctgcctcccaaatgaggggacaaacacagaccctctcaccatctgctcactgaacagccacgtctgaggggcgtgccctgagccgtcacagcgggcgatgtctgagaccaagacacaactattaagacgatgaaggcatcgacagtattaatgtcaggtgatctgaaataaactcccgtaaccccaccccacccccaagagtttccattaacttgatcccattatgaacagccacattacacaatcaacttcaaccccaatagaagagagctgatcatattctgtgtctttaagtaaatgtattctctgggctaccc

SEQ ID NO: 195190 - DNA, 1305 bp, Homo sapiens
  Payload ID: 18545
  Gene Name: tripartite motif family-like 2
  ENST ID: ENST00000326754
  CDS Start-End: 1-1269
tgcttccagtcccaggagcacaaacatcacatggtgtgtgggatacaagaggctgctgagaattacaggaagttattccaggaaatattgaacacatcgagggagaaacttgaagcagctaaaagcatattgactgatgagcaagaaagaatggcgatgattcaggaagaggaacaaaattttaaaaagatgattgagtctgagtatagtatgagactccggttgttgaatgaagagtgtgagcagaatctccagagacagcaggaatgcatatctgacttgaacctgagagaaacccttctgaatcaagcgatcaagcttgccaccgagctagaggagatgttccaggaaatgctacagagactgggccgtgtggggagagagaacatggagaaactgaaggagagtgaagccagggcttctgaacaggtccgcagcctcctaaagctcatcgtggagcttgagaaaaagtgtggggaaggcaccttggcattgctcaagtgccttgatcttgaaattcggcctccagaactgcgagaaatgaatttctgctgtgcagaagctactcagtctatgaatgcaaaatactctttagaaaggagcaagtcactgctgcttgagcatctggagcccgctcatatcacagacctgagtttatgccacataagaggactcagcagcatgttcagagtactccagagacatttaacattggatcctgaaacagctcatccctgcctggcactatctgaggacctgagaactatgagattgagacatgggcagcaggatggggctggcaacccagaaagattggatttcagtgccatggtgctggctgcggagagcttcacctcagggaggcactactgggaggtggacgtggaaaaggcaaccaggtggcaagtgggcatataccacggctctgcagacgcgaagggcagcacggccagagcttccggagagaaagtcttgctcacggggtcggtgatggggaccgagtggactctctgggtcttcccccctctgaaaaggctcttcctggaaaagaagttggacacagttggcgttttccttgactgcgaacacgggcagatatcattctacaatgtgaccgagatgtccctcatttacaatttctcccattgcgccttccaaggagctctcaggcctgtgttttccctctgtatcccaaatggagacacaagtccagactccctcaccatcttacaacatggtccttcttgtgatgctactgttagcccttaatcttctgtgtgtaaaatccaagaccacgagacacca

SEQ ID NO: 195191 - DNA, 1006 bp, Homo sapiens
  Payload ID: 18545
  Gene Name: tripartite motif family-like 2
  ENST ID: ENST00000503475
  CDS Start-End: 1-357
gaagaggaacaaaattttaaaaagatgattgagtctgagtatagtatgagactccggttgttgaatgaagagtgtgagcagaatctccagagacagcaggaatgcatatctgacttgaacctgagagaaacccttctgaatcaagcgatcaagcttgccaccgagctagaggagatgttccaggaaatgctacagagactgggccgtgtggggagagagaacatggagaaactgaaggagagtgaagccagggcttctgaacaggtccgcagcctcctaaagctcatcgtggagcttgagaaaaagtgtggggaaggcaccttggcattgctcaaggagcaagtcactgctgcttgagcatctggagcccgctcatatcacagacctgagtttatgccacataagaggactcagcagcatgttcagagtactccagagacatttaacattggatcctgaaacagctcatccctgcctggcactatctgaggacctgagaactatgagattgagacatgggcagcaggatggggctggcaacccagaaagattggatttcagtgccatggtgctggctgcggagagcttcacctcagggaggcactactgggaggtggacgtggaaaaggcaaccaggtggcaagtgggcatataccacggctctgcagacgcgaagggcagcacggccagagcttccggagagaaagtcttgctcacggggtcggtgatggggaccgagtggactctctgggtcttcccccctctgaaaaggctcttcctggaaaagaagttggacacagttggcgttttccttgactgcgaacacgggcagatatcattctacaatgtgaccgagatgtccctcatttacaatttctcccattgcgccttccaaggagctctcaggcctgtgttttccctctgtatcccaaatggagacacaagtccagactccctcaccatcttacaacatggtccttcttgtgatgctactgttagcccttaa

SEQ ID NO: 195192 - DNA, 1639 bp, Homo sapiens
  Payload ID: 18545
  Gene Name: tripartite motif family-like 2
  Uniprot ID: Q8N7C3
  ENST ID: ENST00000512729
  CDS Start-End: 226-1539
aagcaggcagctgccagaaatttgttggatttgaggagtccagagcgccgacccgctctgtctgcgtggacttatttccttggatcttcgtggactctgaagttgccaagtgtgtgtgcctgctccagaaaacaaaggaagccaccattttttctcattcacagtgcagggagatacctcagtagaagcatacagtccagtcttcaactagggacccctaccaggatgtccaaaaggctcagccctcagttacagcacaacatcacagaagatgcctattgtgaaacacacctggaaccaacacggctgttctgtgatgttgaccaaatcacactctgcagcaaatgcttccagtcccaggagcacaaacatcacatggtgtgtgggatacaagaggctgctgagaattacaggaagttattccaggaaatattgaacacatcgagggagaaacttgaagcagctaaaagcatattgactgatgagcaagaaagaatggcgatgattcaggaagaggaacaaaattttaaaaagatgattgagtctgagtatagtatgagactccggttgttgaatgaagagtgtgagcagaatctccagagacagcaggaatgcatatctgacttgaacctgagagaaacccttctgaatcaagcgatcaagcttgccaccgagctagaggagatgttccaggaaatgctacagagactgggccgtgtggggagagagaacatggagaaactgaaggagagtgaagccagggcttctgaacaggtccgcagcctcctaaagctcatcgtggagcttgagaaaaagtgtggggaaggcaccttggcattgctcaagaatgcaaaatactctttagaaaggagcaagtcactgctgcttgagcatctggagcccgctcatatcacagacctgagtttatgccacataagaggactcagcagcatgttcagagtactccagagacatttaacattggatcctgaaacagctcatccctgcctggcactatctgaggacctgagaactatgagattgagacatgggcagcaggatggggctggcaacccagaaagattggatttcagtgccatggtgctggctgcggagagcttcacctcagggaggcactactgggaggtggacgtggaaaaggcaaccaggtggcaagtgggcatataccacggctctgcagacgcgaagggcagcacggccagagcttccggagagaaagtcttgctcacggggtcggtgatggggaccgagtggactctctgggtcttcccccctctgaaaaggctcttcctggaaaagaagttggacacagttggcgttttccttgactgcgaacacgggcagatatcattctacaatgtgaccgagatgtccctcatttacaatttctcccattgcgccttccaaggagctctcaggcctgtgttttccctctgtatcccaaatggagacacaagtccagactccctcaccatcttacaacatggtccttcttgtgatgctactgttagcccttaatcttctgtgtgtaaaatccaagaccacgagacaccagaaagttggagaacaagactttgaaagaatttgtgtaaactaacccaataaaaagcgttccagg

SEQ ID NO: 195193 - DNA, 1242 bp, Homo sapiens
  Payload ID: 18545
  Gene Name: tripartite motif family-like 2
  ENST ID: ENST00000503141
  CDS Start-End: 1-357
gaagaggaacaaaattttaaaaagatgattgagtctgagtatagtatgagactccggttgttgaatgaagagtgtgagcagaatctccagagacagcaggaatgcatatctgacttgaacctgagagaaacccttctgaatcaagcgatcaagcttgccaccgagctagaggagatgttccaggaaatgctacagagactgggccgtgtggggagagagaacatggagaaactgaaggagagtgaagccagggcttctgaacaggtccgcagcctcctaaagctcatcgtggagcttgagaaaaagtgtggggaaggcaccttggcattgctcaaggagcaagtcactgctgcttgagcatctggagcccgctcatatcacagacctgagtttatgccacataagaggactcagcagcatgttcagagtactccagactgtttatggagcgagtcacaaacacagagaagatgtttaaaactgaagctatgcacagttacctgggggcagtgaaggagaatatactacttgaaagaagaagtcccaggaccaagccctgaaagatcacaatagttagaggctgggcagaaagagatgagaggaacagtcagagataggaagaagacgtattcatgcaggtgtgaggaattcattgagcctgcgtgttctcagcgacatttaacattggatcctgaaacagctcatccctgcctggcactatctgaggacctgagaactatgagattgagacatgggcagcaggatggggctggcaacccagaaagattggatttcagtgccatggtgctggctgcggagagcttcacctcagggaggcactactgggaggtggacgtggaaaaggcaaccaggtggcaagtgggcatataccacggctctgcagacgcgaagggcagcacggccagagcttccggagagaaagtcttgctcacggggtcggtgatggggaccgagtggactctctgggtcttcccccctctgaaaaggctcttcctggaaaagaagttggacacagttggcgttttccttgactgcgaacacgggcagatatcattctacaatgtgaccgagatgtccctcatttacaatttctcccattgcgccttccaaggagctctcaggcctgtgttttccctctgtatcccaaatggagacacaagtccagactccctcaccatcttacaacatggtccttcttgtgatgctactgttagcccttaa

SEQ ID NO: 195194 - DNA, 1329 bp, Homo sapiens
  Payload ID: 18546
  Gene Name: tripartite motif-containing 51
  Uniprot ID: Q9BSJ1
  ENST ID: ENST00000244891
  CDS Start-End: 222-1151
tgccatctctgtgtccccttaagcatgtctgttatgagcttccttgacttcacacctctcagatttgacaaacatgaggagaaacaaagcaaactctcttttctgtgggttaatttgtctctcattttgggtccttcgtatatcagagtgtgaatgatactttattgtcctcacttgtgcttcaattcgtggctgttttgcaggaggagctcctaaaaaaaatgcagtctttatgggaaaaagcttgtgaaaatctcagaaatctgaacatggaaaccacaagaaccagatgctggaaggattatgtgagtttaaggatagaagcaatcagagctgaatatcagaagatgcctgcatttctccatgaagaagagcaacatcacttggaaaggctgcgaaaggagggcgaggacatttttcagcaactcaatgaaagcaaagccagaatggaacattccagggagcttttaagaggaatgtatgaggatctgaagcaaatgtgccataaagcagatgtggagctactccaggcttttggagacatattacacaggtatgagtctctgctgctgcaagtgtctgagcctgtgaatccagagctcagtgcagggcccatcactggactgctggacagcctcagtggattcagagttgattttactctgcagcctgaaagagccaatagtcatatcttcctgtgtggagatttgagaagcatgaatgttggatgtgaccctcaagatgatcccgatatcactggaaaatctgaatgttttcttgtatggggggctcaggctttcacatctggcaaatattattgggaggttcatatgggggactcttggaattgggcttttggtgtctgtaacaattattggaaagagaagagacagaatgacaagatagatggagaggagggactctttcttcttggatgtgttaaggaggacactcactgcagtctctttaccacctccccacttgtggtgcaatatgttccaagacctaccagcacagtaggattattcctggattgtgaaggtagaaccgtgagctttgttgatgttgatcaaagttccctgatatacaccatccccaattgctccttctcacctcctctcaggcctatcttttgctgtagtcacttctgaccagagaaaagtcagaaatgtgcctgtatgctctgggaacctgtttatcccagaaagccctctttttcgcacctcatcaaacagaacaaataagttatatttaatgtctttagttgcattctaatgtcatcaaaactcatttatagtgtttctattaaatatggtgaaaacattaaaa

SEQ ID NO: 195195 - DNA, 1629 bp, Homo sapiens
  Payload ID: 18546
  Gene Name: tripartite motif-containing 51
  Uniprot ID: Q9BSJ1
  ENST ID: ENST00000449290
  CDS Start-End: 93-1451
gcagggaatgagctcctgatcttggggagtacttaaaagaattttttcttggaagaattactgcaggaaacattcatagaaccttgggaaacatgaattctggaatcttgcaagtcttccagagggcactcacctgtcccatctgcatgaactacttcctagacccagtcaccatagactgtgggcacagcttttgccggccctgtttgtacctcaactggcaagacacggcagttcttgctcagtgctctgaatgcaagaagacaacgcggcagagaaacctcaacactgacatttgtttgaagaacatggctttcattgccagaaaagccagcctccggcaattccttagctctgaggagcaaatatgtgggatgcacagagagacaaagaagatgttctgtgaagtggacaagagcctgctctgtttgccgtgctccaactctcaggagcaccggaatcacatacactgtcccattgagtgggctgctgaggaacgccgggaggagctcctaaaaaaaatgcagtctttatgggaaaaagcttgtgaaaatctcagaaatctgaacatggaaaccacaagaaccagatgctggaaggattatgtgagtttaaggatagaagcaatcagagctgaatatcagaagatgcctgcatttctccatgaagaagagcaacatcacttggaaaggctgcgaaaggagggcgaggacatttttcagcaactcaatgaaagcaaagccagaatggaacattccagggagcttttaagaggaatgtatgaggatctgaagcaaatgtgccataaagcagatgtggagctactccaggcttttggagacatattacacaggtatgagtctctgctgctgcaagtgtctgagcctgtgaatccagagctcagtgcagggcccatcactggactgctggacagcctcagtggattcagagttgattttactctgcagcctgaaagagccaatagtcatatcttcctgtgtggagatttgagaagcatgaatgttggatgtgaccctcaagatgatcccgatatcactggaaaatctgaatgttttcttgtatggggggctcaggctttcacatctggcaaatattattgggaggttcatatgggggactcttggaattgggcttttggtgtctgtaacaattattggaaagagaagagacagaatgacaagatagatggagaggagggactctttcttcttggatgtgttaaggaggacactcactgcagtctctttaccacctccccacttgtggtgcaatatgttccaagacctaccagcacagtaggattattcctggattgtgaaggtagaaccgtgagctttgttgatgttgatcaaagttccctgatatacaccatccccaattgctccttctcacctcctctcaggcctatcttttgctgtagtcacttctgaccagagaaaagtcagaaatgtgcctgtatgctctgggaacctgtttatcccagaaagccctctttttcgcacctcatcaaacagaacaaataagttatatttaatgtctttagttgcattctaatgtcatcaaaactcatttatagtgtttctattaaatatggtgaaaacattaaaa

SEQ ID NO: 195196 - DNA, 3536 bp, Homo sapiens
  Payload ID: 18547
  Gene Name: tripeptidyl peptidase I
  Uniprot ID: O14773
  ENST ID: ENST00000299427
  CDS Start-End: 62-1753
ggtggtggaatatagagctcatgtgatccgtcacatgacagcagatccgcggaagggcagaatgggactccaagcctgcctcctagggctctttgccctcatcctctctggcaaatgcagttacagcccggagcccgaccagcggaggacgctgcccccaggctgggtgtccctgggccgtgcggaccctgaggaagagctgagtctcacctttgccctgagacagcagaatgtggaaagactctcggagctggtgcaggctgtgtcggatcccagctctcctcaatacggaaaatacctgaccctagagaatgtggctgatctggtgaggccatccccactgaccctccacacggtgcaaaaatggctcttggcagccggagcccagaagtgccattctgtgatcacacaggactttctgacttgctggctgagcatccgacaagcagagctgctgctccctggggctgagtttcatcactatgtgggaggacctacggaaacccatgttgtaaggtccccacatccctaccagcttccacaggccttggccccccatgtggactttgtggggggactgcaccgttttcccccaacatcatccctgaggcaacgtcctgagccgcaggtgacagggactgtaggcctgcatctgggggtaaccccctctgtgatccgtaagcgatacaacttgacctcacaagacgtgggctctggcaccagcaataacagccaagcctgtgcccagttcctggagcagtatttccatgactcagacctggctcagttcatgcgcctcttcggtggcaactttgcacatcaggcatcagtagcccgtgtggttggacaacagggccggggccgggccgggattgaggccagtctagatgtgcagtacctgatgagtgctggtgccaacatctccacctgggtctacagtagccctggccggcatgagggacaggagcccttcctgcagtggctcatgctgctcagtaatgagtcagccctgccacatgtgcatactgtgagctatggagatgatgaggactccctcagcagcgcctacatccagcgggtcaacactgagctcatgaaggctgccgctcggggtctcaccctgctcttcgcctcaggtgacagtggggccgggtgttggtctgtctctggaagacaccagttccgccctaccttccctgcctccagcccctatgtcaccacagtgggaggcacatccttccaggaacctttcctcatcacaaatgaaattgttgactatatcagtggtggtggcttcagcaatgtgttcccacggccttcataccaggaggaagctgtaacgaagttcctgagctctagcccccacctgccaccatccagttacttcaatgccagtggccgtgcctacccagatgtggctgcactttctgatggctactgggtggtcagcaacagagtgcccattccatgggtgtccggaacctcggcctctactccagtgtttggggggatcctatccttgatcaatgagcacaggatccttagtggccgcccccctcttggctttctcaacccaaggctctaccagcagcatggggcaggactctttgatgtaacccgtggctgccatgagtcctgtctggatgaagaggtagagggccagggtttctgctctggtcctggctgggatcctgtaacaggctggggaacacccaacttcccagctttgctgaagactctactcaacccctgaccctttcctatcaggagagatggcttgtcccctgccctgaagctggcagttcagtcccttattctgccctgttggaagccctgctgaaccctcaactattgactgctgcagacagcttatctccctaaccctgaaatgctgtgagcttgacttgactcccaaccctaccatgctccatcatactcaggtctccctactcctgccttagattcctcaataagatgctgtaactagcattttttgaatgcctctccctccgcatctcatctttctcttttcaatcaggcttttccaaagggttgtatacagactctgtgcactatttcacttgatattcattccccaattcactgcaaggagacctctactgtcaccgtttactctttcctaccctgacatccagaaacaatggcctccagtgcatacttctcaatctttgctttatggcctttccatcatagttgcccactccctctccttacttagcttccaggtcttaacttctctgactactcttgtcttcctctctcatcaatttctgcttcttcatggaatgctgaccttcattgctccatttgtagatttttgctcttctcagtttactcattgtcccctggaacaaatcactgacatctacaaccattaccatctcactaaataagactttctatccaataatgattgatacctcaaatgtaagatgcgtgatactcaacatttcatcgtccaccttcccaaccccaaacaattccatctcgtttcttcttggtaaatgatgctatgctttttccaaccaagccagaaacctgtgtcatcttttcaccccaccttcaatcaacaagtcctcaatcaacaagtcctactgactgcacatcttaaatatatctttatcagtccacaagtccttccaattatatttcccaagtatatctagaacttatccacttatatccccactgctactaccttagtttagggctatattctcttgaaaaaaagtgtccttacttcctgccaatccccaagtcatcttccagagtaaaatgcaaatcccatcaggccacttggatgaaaacccttcaaggattactggatagaattcaggctttcccctccagcccccaatcatagctcacaaaccttccttgctatttgttcttaagtaaaaaatcatttttcctcctccctccccaaaccccaaggaactctcactcttgctcaagctgttccgtccccttaccacccctgatacaactgccaggttaatttccagaattcttgcaagactcagttcagaagtcaccttctttcgtgaatgttttgattccctgaggctactttattttggtatggctgaaaaatcctagattttctaaacaaaacctgtttgaatcttggttctgatatggactaggagagagactgggtcaagtaagcttatctccctgaggctgtttcctcgtctgttaagtgtgaatatcaatacctgcctttcataatcaccagggaataaagtggaataatgttgataacagtgcttggcacctggaagtaggtggcagatgttaacgcccttcctcccttgcactgcgccccctgtgcctacctctagcattgtaacgaccacgtagtattgaaatggccagtttacttgtctgccttcctttccaagaccgttggtgcctagaggactagaatcgtgtcctatttaactttgtgttcccaggtcctagctcaggagttggcaaataagaattaaatgtctgctacaccgaaaacctca

SEQ ID NO: 195197 - DNA, 560 bp, Homo sapiens
  Payload ID: 18547
  Gene Name: tripeptidyl peptidase I
  ENST ID: ENST00000436873
  CDS Start-End: 30-560
acatgacagcagatccgcggaagggcagaatgggactccaagcctgcctcctagggctctttgccctcatcctctctggcaaatgcagttacagcccggagcccgaccagcggaggacgctgcccccaggctgggtgtccctgggccgtgcggaccctgaggaagagctgagtctcacctttgccctgagacagcagaatgtggaaagactctcggagctggtgcaggctgtgtcggatcccagctctcctcaatacggaaaatacctgaccctagagaatgtggctgatctggtgaggccatccccactgaccctccacacggtgcaaaaatggctcttggcagccggagcccagaagtgccattctgtgatcacacaggactttctgacttgctggctgagcatccgacaagcagagctgctgctccctggggctgagtttcatcactatgtgggaggacctacggaaacccatgttgccggcatgagggacaggagcccttcctgcagtggctcatgctgctcagtaatgagtcagccctgccacatgtgcatactg

SEQ ID NO: 195198 - DNA, 561 bp, Homo sapiens
  Payload ID: 18547
  Gene Name: tripeptidyl peptidase I
  ENST ID: ENST00000528571
  CDS Start-End: 23-142
agcagatccgcggaagggcagaatgggactccaagcctgcctcctagggctctttgccctcatcctctctggcaaatgcagttacagcccggagcccgaccagcggaggacgaaaatacctgaccctagagaatgtggctgatctggtgaggccatccccactgaccctccacacggtgcaaaaatggctcttggcagccggagcccagaagtgccattctgtgatcacacaggactttctgacttgctggctgagcatccgacaagcagagctgctgctccctggggctgagtttcatcactatgtgggaggacctacggaaacccatgttgtaaggtccccacatccctaccagcttccacaggccttggccccccatgtggactttgtggggggactgcaccgttttcccccaacatcatccctgaggcaacgtcctgagccgcaggtgacagggactgtaggcctgcatctgggggtaaccccctctgtgatccgtaagcgatacaacttgacctcacaagacgtgggctctggcaccagcaataacagccaagcct

SEQ ID NO: 195199 - DNA, 578 bp, Homo sapiens
  Payload ID: 18547
  Gene Name: tripeptidyl peptidase I
  ENST ID: ENST00000528657
  CDS Start-End: 23-115
agcagatccgcggaagggcagaatgggactccaagcctgcctcctagggctctttgccctcatcctctctggcaaatgcagttacagcccggagcccgaccagcggaggacgtgagttgacttagcacagactgcccccttccccataccctgttctgcctcccactgtcctggtcctagcttctctcacccccgtgccagctcctagtacgcactccatagcttcatctctatgttcctagcctcagtcccctatcattcacctcatgtgatctgtatctgctcctaggatcctccccaaggtctcagctcctaatctggaaccttccatgaccaatattttccatctccaccctaaccaaagccatgtccctgacccctgaccctacaggctgcccccaggctgggtgtccctgggccgtgcggaccctgaggaagagctgagtctcacctttgccctgagacagcagaatgtggaaagactctcggagctggtgcaggctgtgtcggatcccagctctcctcaatacggtgccttttgggactgaggacaggatgtgggatgcggtggagggaca

SEQ ID NO: 195200 - DNA, 3536 bp, Homo sapiens
  Payload ID: 18547
  Gene Name: tripeptidyl peptidase I
  Uniprot ID: O14773
  ENST ID: ENST00000533371
  CDS Start-End: 800-1762
ggatcacgttggagggagcacacattgggagggtgggaacacaaggacaacgtagctcccactgaaacccacctgctgcccctacagcctcctagggctctttgccctcatcctctctggcaaatgcagttacagcccggagcccgaccagcggaggacgctgcccccaggctgggtgtccctgggccgtgcggaccctgaggaagagctgagtctcacctttgccctgagacagcagaatgtggaaagactctcggagctggtgcaggctgtgtcggatcccagctctcctcaatacggaaaatacctgaccctagagaatgtggctgatctggtgaggccatccccactgaccctccacacggtgcaaaaatggctcttggcagccggagcccagaagtgccattctgtgatcacacaggactttctgacttgctggctgagcatccgacaagcagagctgctgctccctggggctgagtttcatcactatgtgggaggacctacggaaacccatgttgtaaggtccccacatccctaccagcttccacaggccttggccccccatgtggactttgtggggggactgcaccgttttcccccaacatcatccctgaggcaacgtcctgagccgcaggtgacagggactgtaggcctgcatctgggggtaaccccctctgtgatccgtaagcgatacaacttgacctcacaagacgtgggctctggcaccagcaataacagccaagcctgtgcccagttcctggagcagtatttccatgactcagacctggctcagttcatgcgcctcttcggtggcaactttgcacatcaggcatcagtagcccgtgtggttggacaacagggccggggccgggccgggattgaggccagtctagatgtgcagtacctgatgagtgctggtgccaacatctccacctgggtctacagtagccctggccggcatgagggacaggagcccttcctgcagtggctcatgctgctcagtaatgagtcagccctgccacatgtgcatactgtgagctatggagatgatgaggactccctcagcagcgcctacatccagcgggtcaacactgagctcatgaaggctgccgctcggggtctcaccctgctcttcgcctcaggtgacagtggggccgggtgttggtctgtctctggaagacaccagttccgccctaccttccctgcctccagcccctatgtcaccacagtgggaggcacatccttccaggaacctttcctcatcacaaatgaaattgttgactatatcagtggtggtggcttcagcaatgtgttcccacggccttcataccaggaggaagctgtaacgaagttcctgagctctagcccccacctgccaccatccagttacttcaatgccagtggccgtgcctacccagatgtggctgcactttctgatggctactgggtggtcagcaacagagtgcccattccatgggtgtccggaacctcggcctctactccagtgtttggggggatcctatccttgatcaatgagcacaggatccttagtggccgcccccctcttggctttctcaacccaaggctctaccagcagcatggggcaggactctttgatgtaacccgtggctgccatgagtcctgtctggatgaagaggtagagggccagggtttctgctctggtcctggctgggatcctgtaacaggctggggaacacccaacttcccagctttgctgaagactctactcaacccctgaccctttcctatcaggagagatggcttgtcccctgccctgaagctggcagttcagtcccttattctgccctgttggaagccctgctgaaccctcaactattgactgctgcagacagcttatctccctaaccctgaaatgctgtgagcttgacttgactcccaaccctaccatgctccatcatactcaggtctccctactcctgccttagattcctcaataagatgctgtaactagcattttttgaatgcctctccctccgcatctcatctttctcttttcaatcaggcttttccaaagggttgtatacagactctgtgcactatttcacttgatattcattccccaattcactgcaaggagacctctactgtcaccgtttactctttcctaccctgacatccagaaacaatggcctccagtgcatacttctcaatctttgctttatggcctttccatcatagttgcccactccctctccttacttagcttccaggtcttaacttctctgactactcttgtcttcctctctcatcaatttctgcttcttcatggaatgctgaccttcattgctccatttgtagatttttgctcttctcagtttactcattgtcccctggaacaaatcactgacatctacaaccattaccatctcactaaataagactttctatccaataatgattgatacctcaaatgtaagatgcgtgatactcaacatttcatcgtccaccttcccaaccccaaacaattccatctcgtttcttcttggtaaatgatgctatgctttttccaaccaagccagaaacctgtgtcatcttttcaccccaccttcaatcaacaagtcctcaatcaacaagtcctactgactgcacatcttaaatatatctttatcagtccacaagtccttccaattatatttcccaagtatatctagaacttatccacttatatccccactgctactaccttagtttagggctatattctcttgaaaaaaagtgtccttacttcctgccaatccccaagtcatcttccagagtaaaatgcaaatcccatcaggccacttggatgaaaacccttcaaggattactggatagaattcaggctttcccctccagcccccaatcatagctcacaaaccttccttgctatttgttcttaagtaaaaaatcatttttcctcctccctccccaaaccccaaggaactctcactcttgctcaagctgttccgtccccttaccacccctgatacaactgccaggttaatttccagaattcttgcaagactcagttcagaagtcaccttctttcgtgaatgttttgattccctgaggctactttattttggtatggctgaaaaatcctagattttctaaacaaaacctgtttgaatcttggttctgatatggactaggagagagactgggtcaagtaagcttatctccctgaggctgtttcctcgtctgttaagtgtgaatatcaatacctgcctttcataatcaccagggaataaagtggaataatgttgataacagtgcttggcacctggaagtaggtggcagatgttaacgcccttcctcccttgcactgcgccccctgtgcctacctctagcattgtaacgaccacgtagtattgaaatggccagtttacttgtctgccttcctttccaagaccgttggtgcctagaggactagaatcgtgtcctatttaactttgtgttcccaggtcctagctcaggagttggcaaataagaattaaatgtctgctacaccg

SEQ ID NO: 195201 - DNA, 2418 bp, Homo sapiens
  Payload ID: 18547
  Gene Name: tripeptidyl peptidase I
  ENST ID: ENST00000611494
  CDS Start-End: 31-1701
cacatgacagcagatccgcggaagggcagaatgggactccaagcctgcctcctagggctctttgccctcatcctctctggcaaatgcagttacagcccggagcccgaccagcggaggacgctgcccccaggctgggtgtccctgggccgtgcggaccctgaggaagagctgagtctcacctttgccctgagacagcagaatgtggaaagactctcggagctggtgcaggctgtgtcggatcccagctctcctcaatacggaaaatacctgaccctagagaatgtggctgatctggtgaggccatccccactgaccctccacacggtgcaaaaatggctcttggcagccggagcccagaagtgccattctgtgatcacacaggactttctgacttgctggctgagcatccgacaagcagagctgctgctccctggggctgagtttcatcactatgtgggaggacctacggaaacccatgttgtaaggtccccacatccctaccagcttccacaggccttggccccccatgtggactttgtggggggactgcaccgttttcccccaacatcatccctgaggcaacgtcctgagccgcaggtgacagggactgtaggcctgcatctgggggtaaccccctctgtgatccgtaagcgatacaacttgacctcacaagacgtgggctctggcaccagcaataacagccaagcctgtgcccagttcctggagcagtatttccatgactcagacctggctcagttcatgcgcctcttcggtggcaactttgcacatcaggcatcagtagcccgtgtggttggacaacagggccggggccgggccgggattgaggccagtctagatgtgcagtacctgatgagtgctggtgccaacatctccacctgggtctacagtagccctggccggcatgagggacaggagcccttcctgcagtggctcatgctgctcagtaatgagtcagccctgccacatgtgcatactgtgagctatggagatgatgaggactccctcagcagcgcctacatccagcgggtcaacactgagctcatgaaggctgccgctcggggtctcaccctgctcttcgcctcaggtgacagtggggccgggtgttggtctgtctctggaagacaccagttccgccctaccttccctgcctccagcccctatgtcaccacagtgggaggcacatccttccaggaacctttcctcatcacaaatgaaattgttgactatatcagtggtggtggcttcagcaatgtgttcccacggccttcataccaggaggaagctgtaacgaagttcctgagctctagcccccacctgccaccatccagttacttcaatgccagtggccgtgcctacccagatgtggctgcactttctgatggctactgggtggtcagcaacagagtgcccattccatgggtgtccggaacctcggcctctactccagtgtttggggggatcctatccttgatcaatgagcacaggatccttagtggccgcccccctcttggctttctcaacccaaggctctaccagcagcatggggcaggactctttgatgtaacccgtggctgccatgagtcctgtctggatgaagaggtagagggccagggtttctgctctggtcctggctgggatcctgtaacaggctggggaacaccaacttcccagctttgctgaagactctactcaacccctgaccctttcctatcaggagagatggcttgtcccctgccctgaagctggcagttcagtcccttattctgccctgttggaagccctgctgaaccctcaactattgactgctgcagacagcttatctccctaaccctgaaatgctgtgagcttgacttgactcccaaccctaccatgctccatcatactcaggtctccctactcctgccttagattcctcaataagatgctgtaactagcattttttgaatgcctctccctccgcatctcatctttctcttttcaatcaggcttttccaaagggttgtatacagactctgtgcactatttcacttgatattcattccccaattcactgcaaggagacctctactgtcaccgtttactctttcctaccctgacatccagaaacaatggcctccagtgcatacttctcaatctttgctttatggcctttccatcatagttgcccactccctctccttacttagcttccaggtcttaacttctctgactactcttgtcttcctctctcatcaatttctgcttcttcatggaatgctgaccttcattgctccatttgtagatttttgctcttctcagtttactcattgtcccctggaacaaatcactgacatctacaaccattaccatctcactaaataagactttctatccaataatgattgatacctcaaatgt

SEQ ID NO: 195202 - DNA, 5447 bp, Homo sapiens
  Payload ID: 18548
  Gene Name: tripeptidyl peptidase II
  ENST ID: ENST00000376052
  CDS Start-End: 17-3805
cctccatcctgcgtccatggccaccgctgcgactgaggagcccttcccttttcacggtctcctgccgaagaaggagaccggagccgcctccttcctctgccgctacccggagtatgatgggcggggggtgctcatcgcagtcctggacacgggggtcgacccgggggctccgggcatgcaggttacaactgatggaaaaccaaaaatcgttgatatcattgatacaacaggaagtggcgatgtgaatactgctacagaagtagagccaaaggatggtgagattgttggcctttcaggaagagtgcttaagattcctgcaagctggacaaatccctcaggcaaatatcatattggcataaaaaatggctatgacttctatcctaaggcactcaaggaaaggatacagaaagaacggaaggaaaaaatctgggaccctgttcacagagtggcccttgcagaagcctgtagaaaacaggaagaatttgatgttgccaacaacggctcttctcaagcaaataaactaatcaaggaggaacttcaaagtcaagtggaattgctaaattcttttgagaagaaatacagcgatcctggccctgtatatgactgcttggtatggcatgatggcgaagtctggagagcctgcattgattctaatgaagatggggacttgagtaaatctaccgtgttgagaaactacaaagaagcccaagaatatggctcttttggcacagctgagatgttgaattactccgttaatatatacgatgatggaaacctgctctccattgtgaccagtggaggagctcatgggacacatgtagctagtatagctgctggacactttccagaagaacctgaacggaatggggtagctcctggtgctcaaattctttccatcaagattggtgatacaagactaagcacaatggaaacaggcacaggcctcataagagctatgatagaagttataaatcataagtgtgatcttgtcaactacagttacggagaagcaactcactggccaaattctgggagaatttgtgaagtaattaatgaagcagtatggaagcataatataatttatgtttcaagtgctggaaataatggtccatgcctgtctacagttggttgtccaggtggaactacatcaagtgtgataggtgttggtgcttatgtttctcctgatatgatggttgctgagtattcactgagagagaaattacctgcaaatcaatatacttggtcttctagaggacctagtgctgacggggcccttggtgtgagtatcagtgcgccaggaggagccattgcttctgttcctaactggacactgagagggacgcagctgatgaatggaacatctatgtcttcccccaatgcatgtggaggcattgccctgatcctttcaggtctgaaagctaataacattgactacacagttcattcagtcagaagagctctagaaaacactgcagtgaaggctgacaatatagaagtatttgctcaaggacatggtattattcaggttgataaagcctatgactacctcgttcagaatacatcatttgctaataaattaggttttactgttactgttggaaataaccgtggcatctacctccgagatcctgttcaggtggctgcaccttcagatcatggcgttggcattgaacctgtatttccggagaacacagaaaactctgaaaaaatatcccttcagcttcatttagctctgacttcaaattcatcttgggttcagtgtcccagccatttggaactcatgaatcaatgtagacacataaacatacgtgtggatcccaggggcttaagagaaggattgcattatacagaggtatgtggctatgatatagcatcccctaacgcaggtccgctcttcagagttccgatcactgcagttatagcagcaaaagtaaatgaatcatcacattatgatctagcctttacagatgtacactttaaacctggtcaaattcgaaggcattttattgaggttcctgagggtgcaacatgggctgaagtgacagtgtgttcgtgttcttctgaggtgtcagcaaagtttgttctacatgcagtccagcttgtgaagcaaagagcatatcgaagccatgaattctataagttttgttctcttccagagaaaggaacactgactgaagcttttcctgtcctaggtggaaaagcaattgaattttgcattgctcgttggtgggcaagtctcagtgatgtcaacattgattataccatttctttccatgggatagtgtgtactgctcctcagttaaacattcatgcatcggaaggaatcaaccgctttgatgttcagtcctccttgaaatacgaagatctggctccctgcataactttgaagaactgggtccaaacactgcgcccagtgagtgcaaaaacaaaacctttaggatcaagagatgttttgccaaataaccgtcaactttatgagatggtcctgacatataactttcatcaacccaagagtggggaagtaactccaagctgcccactactttgtgaactattatatgaatctgaatttgacagccaactgtggattatttttgaccagaacaaaagacagatgggttcaggcgatgcctatccacatcagtattctttgaaactggagaaaggagattatacaattcgactacagattcgccatgagcaaatcagtgatttggaacgccttaaagaccttccatttattgtttctcatagattgtctaataccttgagcttagatattcatgaaaatcatagttttgcacttctagggaagaagaaatcaagcaatttgacattaccacccaaatataaccagccattctttgttacttccttacctgatgataaaatacctaaaggggcaggacctggatgctatcttgcaggatccttaacattgtcaaagactgaactaggaaagaaagctgggcagtctgcagcaaaacgacaaggaaaatttaaaaaggatgtaatccctgttcattactacttaatacctccaccaacaaagactaagaatggcagcaaagataaggaaaaagattcagaaaaagagaaagatttaaaagaagagtttactgaagcattacgagatcttaaaattcagtggatgacaaagctggattctagtgacatttataacgaattgaaagaaacatatcctaattatcttcctctgtacgttgcacgacttcatcaattggatgctgaaaaggaacgaatgaaaagacttaatgaaattgttgatgcggcaaatgctgttatttctcatatagatcaaacagccctagcagtttatattgcaatgaagactgatcccaggcctgatgcagctactataaaaaatgacatggacaaacaaaaatccaccctcgtagatgccctttgtaggaaaggttgtgccctggcagaccatcttcttcacacccaggctcaagacggagccatttccactgatgcagaaggaaaggaggaggaaggagaaagtcctttggattctctggcagaaacattttgggaaactactaaatggactgatctctttgacaataaggttttgacatttgcatataaacatgcattagtaaataaaatgtatgggagaggccttaaatttgcaactaaacttgtggaagaaaaaccaacaaaagaaaactggaaaaattgtattcaactgatgaagttacttggatggacccattgtgcatcttttactgaaaactggctccccatcatgtatcctcccgattattgcgtattctaaaataggaaacaagactttaaattttaaaaaaggaagttttatagtgaatgggtataaaaacaaatttgtggcatttttagtctaatgcatgttttcatccactatccagtactgattattaaaatgacatgtatttatcagagaattcactgacgtgtggcttaatacatgtaaatctagacctctgacatcatggtgttttcttaatgcctcacattgctggcacggggatgtgccctgcctgccagcacctaggacttcgagttgggttgcagcttatgacatgcatgataggttttggaaggtaacttttaactgcaaacctataaagtactattttttattttataaatgaacagggttttaacgtgctcaactttaatttttttcaattgtatgaaggccttaaaaaagctacattaagcgtagctaaaattatttattggactaaaaactaacagaacttcatttccagaattttttttttttttttttttttttggcaaatgtttacattcaattaaggggaaaaagtagaaccagcacaaatgagtggcagttgctggagcataactgcttcaataaatcttcatcttggggtaattacaggcaagtcattttcacatcctcttgaggttcagagcatcagaatgaactctatgaatacatgtgtaagtgccagacagctgaatctttatcaggtattgtaaagatacacatatgatatgtttattaaaattgaaataatgtaaaacacatgaataaatttgcaaaaccaagatcacagtacaccatatgcactctggtaccttaatttttttttataaataataaaagtgaatattgaagcttcttaaagttggtcttaatttttcataaataaaatttggggttataacagaaataatacattaaatacatagacaaaaaaagttaaacataagataatctattttacagtgtttcttataggcttacaattatttgaatgtatttccagttcttgtatgattaacttttgtgcatatctaactttttattatttttatctttggctactgcacgtgcatctctcgtcattcctccaccaaataaacagacaaaagtagtattgaaaagtttacagtcccttatctaatggcaaattgtgtgtatgtatgatttttttatcttgttctcttaagatttactgctgcttaaaattactaccagtaatccttagtcactcccaactgtttctgctgtatctcatgaagtgttagagcgtttatgagaaacataaatacatgtataagcatattggtcacaccttctgggctagctagggtccaaagtctatccatgaaagctacatgcatgttctctctcacacactcatggactttcacctgcacacacatacaggtccccatttgtataggtttagtccagtaagagaatggagaagctcagtaaaggtaggatgacttcccaaggttatacggctgatcaactgttggaaattaattacagaccttgctttacaacccaggttttgctatttcaggtaagtactacctacagcaggaatcagtaacgtttggccctttaacccaaactggactgctgcctgtttttgtaaataaagttttattggaacaga

SEQ ID NO: 195203 - DNA, 3931 bp, Homo sapiens
  Payload ID: 18548
  Gene Name: tripeptidyl peptidase II
  Uniprot ID: P29144
  ENST ID: ENST00000376065
  CDS Start-End: 37-3786
gcagtttgccgcttcctcgtcctccatcctgcgtccatggccaccgctgcgactgaggagcccttcccttttcacggtctcctgccgaagaaggagaccggagccgcctccttcctctgccgctacccggagtatgatgggcggggggtgctcatcgcagtcctggacacgggggtcgacccgggggctccgggcatgcaggttacaactgatggaaaaccaaaaatcgttgatatcattgatacaacaggaagtggcgatgtgaatactgctacagaagtagagccaaaggatggtgagattgttggcctttcaggaagagtgcttaagattcctgcaagctggacaaatccctcaggcaaatatcatattggcataaaaaatggctatgacttctatcctaaggcactcaaggaaaggatacagaaagaacggaaggaaaaaatctgggaccctgttcacagagtggcccttgcagaagcctgtagaaaacaggaagaatttgatgttgccaacaacggctcttctcaagcaaataaactaatcaaggaggaacttcaaagtcaagtggaattgctaaattcttttgagaagaaatacagcgatcctggccctgtatatgactgcttggtatggcatgatggcgaagtctggagagcctgcattgattctaatgaagatggggacttgagtaaatctaccgtgttgagaaactacaaagaagcccaagaatatggctcttttggcacagctgagatgttgaattactccgttaatatatacgatgatggaaacctgctctccattgtgaccagtggaggagctcatgggacacatgtagctagtatagctgctggacactttccagaagaacctgaacggaatggggtagctcctggtgctcaaattctttccatcaagattggtgatacaagactaagcacaatggaaacaggcacaggcctcataagagctatgatagaagttataaatcataagtgtgatcttgtcaactacagttacggagaagcaactcactggccaaattctgggagaatttgtgaagtaattaatgaagcagtatggaagcataatataatttatgtttcaagtgctggaaataatggtccatgcctgtctacagttggttgtccaggtggaactacatcaagtgtgataggtgttggtgcttatgtttctcctgatatgatggttgctgagtattcactgagagagaaattacctgcaaatcaatatacttggtcttctagaggacctagtgctgacggggcccttggtgtgagtatcagtgcgccaggaggagccattgcttctgttcctaactggacactgagagggacgcagctgatgaatggaacatctatgtcttcccccaatgcatgtggaggcattgccctgatcctttcaggtctgaaagctaataacattgactacacagttcattcagtcagaagagctctagaaaacactgcagtgaaggctgacaatatagaagtatttgctcaaggacatggtattattcaggttgataaagcctatgactacctcgttcagaatacatcatttgctaataaattaggttttactgttactgttggaaataaccgtggcatctacctccgagatcctgttcaggtggctgcaccttcagatcatggcgttggcattgaacctgtatttccggagaacacagaaaactctgaaaaaatatcccttcagcttcatttagctctgacttcaaattcatcttgggttcagtgtcccagccatttggaactcatgaatcaatgtagacacataaacatacgtgtggatcccaggggcttaagagaaggattgcattatacagaggtatgtggctatgatatagcatcccctaacgcaggtccgctcttcagagttccgatcactgcagttatagcagcaaaagtaaatgaatcatcacattatgatctagcctttacagatgtacactttaaacctggtcaaattcgaaggcattttattgaggttcctgagggtgcaacatgggctgaagtgacagtgtgttcgtgttcttctgaggtgtcagcaaagtttgttctacatgcagtccagcttgtgaagcaaagagcatatcgaagccatgaattctataagttttgttctcttccagagaaaggaacactgactgaagcttttcctgtcctaggtggaaaagcaattgaattttgcattgctcgttggtgggcaagtctcagtgatgtcaacattgattataccatttctttccatgggatagtgtgtactgctcctcagttaaacattcatgcatcggaaggaatcaaccgctttgatgttcagtcctccttgaaatacgaagatctggctccctgcataactttgaagaactgggtccaaacactgcgcccagtgagtgcaaaaacaaaacctttaggatcaagagatgttttgccaaataaccgtcaactttatgagatggtcctgacatataactttcatcaacccaagagtggggaagtaactccaagctgcccactactttgtgaactattatatgaatctgaatttgacagccaactgtggattatttttgaccagaacaaaagacagatgggttcaggcgatgcctatccacatcagtattctttgaaactggagaaaggagattatacaattcgactacagattcgccatgagcaaatcagtgatttggaacgccttaaagaccttccatttattgtttctcatagattgtctaataccttgagcttagatattcatgaaaatcatagttttgcacttctagggaagaagaaatcaagcaatttgacattaccacccaaatataaccagccattctttgttacttccttacctgatgataaaatacctaaaggggcaggacctggatgctatcttgcaggatccttaacattgtcaaagactgaactaggaaagaaagctgatgtaatccctgttcattactacttaatacctccaccaacaaagactaagaatggcagcaaagataaggaaaaagattcagaaaaagagaaagatttaaaagaagagtttactgaagcattacgagatcttaaaattcagtggatgacaaagctggattctagtgacatttataacgaattgaaagaaacatatcctaattatcttcctctgtacgttgcacgacttcatcaattggatgctgaaaaggaacgaatgaaaagacttaatgaaattgttgatgcggcaaatgctgttatttctcatatagatcaaacagccctagcagtttatattgcaatgaagactgatcccaggcctgatgcagctactataaaaaatgacatggacaaacaaaaatccaccctcgtagatgccctttgtaggaaaggttgtgccctggcagaccatcttcttcacacccaggctcaagacggagccatttccactgatgcagaaggaaaggaggaggaaggagaaagtcctttggattctctggcagaaacattttgggaaactactaaatggactgatctctttgacaataaggttttgacatttgcatataaacatgcattagtaaataaaatgtatgggagaggccttaaatttgcaactaaacttgtggaagaaaaaccaacaaaagaaaactggaaaaattgtattcaactgatgaagttacttggatggacccattgtgcatcttttactgaaaactggctccccatcatgtatcctcccgattattgcgtattctaaaataggaaacaagactttaaattttaaaaaaggaagttttatagtgaatgggtataaaaacaaatttgtggcatttttagtctaatgcatgttttcatccactatccagtactgattattaaaatgacatgtatttatcagagaa

SEQ ID NO: 195204 - DNA, 1596 bp, Homo sapiens
  Payload ID: 18549
  Gene Name: triple QxxK/R motif containing
  Uniprot ID: Q629K1
  ENST ID: ENST00000378861
  CDS Start-End: 428-688
gtcccgcccctgcccctgagtgacagaaccgtggacagcaacatttcccacaggacacgaagtttgtcggcccttgccttggcagagctgagtaagaaaaatcaccaagaatattatttttggtatttggaattgaatttgccaggaatgcaagcactgctacctaactaaagaccttggctttggaaacatcttaccccttggcagctctccagagtttagacttggcagcatcaaagacacaacgcaagcaatatgaaacagaaaaacaagttggttggatagctgtcctccatgcagtcattcatgatccaggctgtcatcatcttcatcactcatgttcagagttaccctagaggtcatctccatttcatccagataaatgagtatgcaaggaacgtttttataggcattttggagatcaaagatgggtagaaaagatgctgctactataaaacttcctgttgatcagtacagaaaacaaattggtaaacaggattataaaaaaactaaacctattttacgagcaaccaaattaaaagcagaagcaaagaaaacagcaataggcataaaggaagttggccttgtacttgcagctatattggcactactactggctttctatgctttcttttatctcagactcaccacggatgttgaccctgatctggaccaagatgaagattagctaagcaacaatcaatgcatgaaagagaaataactttacgaaagcaccttttgggaccaaaactttcaatactgaaactgtaacatctttaattctttctgctaatattttcagtttgcagacatatgatttttgatagttgcataggatgtcaggaaaagaaccttacctagcaatgcagtatagtatgtgctactggatacttttatatatctttctgctttgacagccaccctatacatggtacatttagatgaaatgggaaccagatcctaaatttttcaaatgtcattgccaatttatgtgtataattccatcacttcctgatgagtaagtctatttttgttctatatacatcataagttagtatatattcttatttacagaaacatgctcaaatcacattcagaaagaacaaaaagtcatgggaaattttttattttacaacaaagccctgctttctttctggacgtattttacatcattagagagactatctgcacatacatctaccataatctttttccttctttgccaactgttcagtgcacatgtgctgcatcagaaatggcacctggatgacagaagctcaaagagtcacatatgtctctaaaatagagttcttttcctcttgggctgtctgaactggtgtaaatagaagctcagttgatcttggttttaattaacttattactctattaatataaccttggaattctattctaattatgttgttctggctgcttgtagtatcagttcgcccctcttgttagggagatatgtaacaatctgtcatttaattgagcagtctttttcacataacagtaatagcaaaaatcctacctactcagaatcatcttcttaggttgtctcctaaatctgaacaatacagttgttttataaaatta

SEQ ID NO: 195205 - DNA, 865 bp, Homo sapiens
  Payload ID: 18549
  Gene Name: triple QxxK/R motif containing
  ENST ID: ENST00000524037
  CDS Start-End: 284-448
gcggctggcttgtcccgcccctgcccctgagtgacagaaccgtggacagcaacatttcccacaggacacgaagtttgtcggcccttgccttggcagagctgagtaagaaaaatcaccaagaatattatttttggtatttggaattgaatttgccaggaatgcaagcactgctacctaactaaagaccttggctttggaaacatcttaccccttggcagctctccagagtttagacttggcagcatcaaagacacaacgcaagcaggcattttggagatcaaagatgggtagaaaagatgctgctactataaaacttcctgttgatcagtacagaaaacaaattggtaaacaggattataaaaaaactaaacctattttacgagcaaccaaattaaaagcagaagcaaagaaaacagcaataggcataaagactcaccacggatgttgaccctgatctggaccaagatgaagattagctaagcaacaatcaatgcatgaaagagaaataactttacgaaagcaccttttgggaccaaaactttcaatactgaaactgtaacatctttaattctttctgctaatattttcagtttgcagacatatgatttttgatagttgcataggatgtcaggaaaagaaccttacctagcaatgcagtatagtatgtgctactggatacttttatatatctttctgctttgacagccaccctatacatggtacatttagatgaaatgggaaccagatcctaaatttttcaaatgtcattgccaatttatgtgtataattccatcacttcctgatgagtaagtctatttttgttctatatacatcataagttagtatatattcttatttacagaaa

SEQ ID NO: 195206 - DNA, 598 bp, Homo sapiens
  Payload ID: 18549
  Gene Name: triple QxxK/R motif containing
  ENST ID: ENST00000519069
  CDS Start-End: 318-482
ctcttttccgcctcaccctttgggagtaggggtgtgcggctggcttgtcccgcccctgcccctgagtgacagaaccgtggacagcaacatttcccacaggacacgaagtttgtcggcccttgccttggcagagctgagcaatatgaaacagaaaaacaagttggttggatagctgtcctccatgcagtcattcatgatccaggctgtcatcatcttcatcactcatgttcagagttaccctagaggtcatctccatttcatccagataaatgagtatgcaaggaacgtttttatagcaggcattttggagatcaaagatgggtagaaaagatgctgctactataaaacttcctgttgatcagtacagaaaacaaattggtaaacaggattataaaaaaactaaacctattttacgagcaaccaaattaaaagcagaagcaaagaaaacagcaataggcataaagactcaccacggatgttgaccctgatctggaccaagatgaagattagctaagcaacaatcaatgcatgaaagagaaataactttacgaaagcaccttttgggaccaaaactttcaatactgaaactgtaacatct

SEQ ID NO: 195207 - DNA, 1882 bp, Homo sapiens
  Payload ID: 18549
  Gene Name: triple QxxK/R motif containing
  ENST ID: ENST00000517858
  CDS Start-End: 417-581
gcccctgagtgacagaaccgtggacagcaacatttcccacaggacacgaagtttgtcggcccttgccttggcagagctgagtaagaaaaatcaccaagaatattatttttggtatttggaattgaatttgccaggaatgcaagcactgctacctaactaaagaccttggctttggaaacatcttaccccttggcagctctccagagtttagacttggcagcatcaaagacacaacgcaagcaatatgaaacagaaaaacaagttggttggatagctgtcctccatgcagtcattcatgatccaggctgtcatcatcttcatcactcatgttcagagttaccctagaggtcatctccatttcatccagataaatgagtatgcaaggaacgtttttataggcattttggagatcaaagatgggtagaaaagatgctgctactataaaacttcctgttgatcagtacagaaaacaaattggtaaacaggattataaaaaaactaaacctattttacgagcaaccaaattaaaagcagaagcaaagaaaacagcaataggcataaagactcaccacggatgttgaccctgatctggaccaagatgaagattagctaagcaacaatcaatgcatgaaagagaaataactttacgaaagcaccttttgggaccaaaactttcaatactgaaactgtaacatctttaattctttctgctaatattttcagtttgcagacatatgatttttgatagttgcataggatgtcaggaaaagaaccttacctagcaatgcagtatagtatgtgctactggatacttttatatatctttctgctttgacagccaccctatacatggtacatttagatgaaatgggaaccagatcctaaatttttcaaatgtcattgccaatttatgtgtataattccatcacttcctgatgagtaagtctatttttgttctatatacatcataagttagtatatattcttatttacagaaacatgctcaaatcacattcagaaagaacaaaaagtcatgggaaattttttattttacaacaaagccctgctttctttctggacgtattttacatcattagagagactatctgcacatacatctaccataatctttttccttctttgccaactgttcagtgcacatgtgctgcatcagaaatggcacctggatgacagaagctcaaagagtcacatatgtctctaaaatagagttcttttcctcttgggctgtctgaactggtgtaaatagaagctcagttgatcttggttttaattaacttattactctattaatataaccttggaattctattctaattatgttgttctggctgcttgtagtatcagttcgcccctcttgttagggagatatgtaacaatctgtcatttaattgagcagtctttttcacataacagtaatagcaaaaatcctacctactcagaatcatcttcttaggttgtctcctaaatctgaacaatacagttgttttataaaattacattttgtctcttgagatttaatcaattagaactctttagggagaaaataaataatagaagaaaatatatgcctcatatttcatatgtaattatctgttgatataatttttcaatgtattttgtatttgtgggagcataatgacctgtacattcaatatttttactggtaattcaatttttaaatatgtttttacaatgcttgaacacataaaccttagaaaactggaaaatacgtgtccacagaaagagttattagctactaccttatgtaaagatgcatagaaaatgaaattgttggaaacatgtgcacaaagtgttttatattatatacattgtatttatgaagaataaataaaatattaag

SEQ ID NO: 195208 - DNA, 1829 bp, Homo sapiens
  Payload ID: 18549
  Gene Name: triple QxxK/R motif containing
  Uniprot ID: Q629K1
  ENST ID: ENST00000520430
  CDS Start-End: 282-542
gtgcggctggcttgtcccgcccctgcccctgagtgacagaaccgtggacagcaacatttcccacaggacacgaagtttgtcggcccttgccttggcagagctgagcaatatgaaacagaaaaacaagttggttggatagctgtcctccatgcagtcattcatgatccaggctgtcatcatcttcatcactcatgttcagagttaccctagaggtcatctccatttcatccagataaatgagtatgcaaggaacgtttttataggcattttggagatcaaagatgggtagaaaagatgctgctactataaaacttcctgttgatcagtacagaaaacaaattggtaaacaggattataaaaaaactaaacctattttacgagcaaccaaattaaaagcagaagcaaagaaaacagcaataggcataaaggaagttggccttgtacttgcagctatattggcactactactggctttctatgctttcttttatctcagactcaccacggatgttgaccctgatctggaccaagatgaagattagctaagcaacaatcaatgcatgaaagagaaataactttacgaaagcaccttttgggaccaaaactttcaatactgaaactgtaacatctttaattctttctgctaatattttcagtttgcagacatatgatttttgatagttgcataggatgtcaggaaaagaaccttacctagcaatgcagtatagtatgtgctactggatacttttatatatctttctgctttgacagccaccctatacatggtacatttagatgaaatgggaaccagatcctaaatttttcaaatgtcattgccaatttatgtgtataattccatcacttcctgatgagtaagtctatttttgttctatatacatcataagttagtatatattcttatttacagaaacatgctcaaatcacattcagaaagaacaaaaagtcatgggaaattttttattttacaacaaagccctgctttctttctggacgtattttacatcattagagagactatctgcacatacatctaccataatctttttccttctttgccaactgttcagtgcacatgtgctgcatcagaaatggcacctggatgacagaagctcaaagagtcacatatgtctctaaaatagagttcttttcctcttgggctgtctgaactggtgtaaatagaagctcagttgatcttggttttaattaacttattactctattaatataaccttggaattctattctaattatgttgttctggctgcttgtagtatcagttcgcccctcttgttagggagatatgtaacaatctgtcatttaattgagcagtctttttcacataacagtaatagcaaaaatcctacctactcagaatcatcttcttaggttgtctcctaaatctgaacaatacagttgttttataaaattacattttgtctcttgagatttaatcaattagaactctttagggagaaaataaataatagaagaaaatatatgcctcatatttcatatgtaattatctgttgatataatttttcaatgtattttgtatttgtgggagcataatgacctgtacattcaatatttttactggtaattcaatttttaaatatgtttttacaatgcttgaacacataaaccttagaaaactggaaaatacgtgtccacagaaagagttattagctactaccttatgtaaagatgcatagaaaatgaaattgttggaaacatgtgcacaaagtgttttatattatatacattgtatttatgaagaataaataaaatattaagattgttttcctgct

SEQ ID NO: 195209 - DNA, 556 bp, Homo sapiens
  Payload ID: 18549
  Gene Name: triple QxxK/R motif containing
  ENST ID: ENST00000522903
  CDS Start-End: 534-556
tcttttccgcctcaccctttgggagtaggggtgtgcggctggcttgtcccgcccctgcccctgagtgacagaaccgtggacagcaacatttcccacaggacacgaagtttgtcggcccttgccttggcagagctgagtttctggaggctgctcacattccttggcttatggcctccttcttccaacgtcaaagccagcaacattgcagcaatctgacttattttgttgtcatgtctcctgaccacatctggaagggttatctacttttgaagacacatccagataattcaggacaatctgtccattttgaggttcttcattgaatcatgtctgcaaagtcccttctgcaatctaagtaagaaaaatcaccaagaatattatttttggtatttggaattgaatttgccaggaatgcaagcactgctacctaactaaagaccttggctttggaaacatcttaccccttggcagctctccagagtttagacttggcagcatcaaagacacaacgcaaggcattttggagatcaaagatgggtagaaaagatgctgctac

SEQ ID NO: 195210 - DNA, 555 bp, Homo sapiens
  Payload ID: 18549
  Gene Name: triple QxxK/R motif containing
  Uniprot ID: Q629K1
  ENST ID: ENST00000519969
  CDS Start-End: 266-526
gtgctgaccgattactcgcggtcgcttacttgtcagtgcagctctctgggttctgccgttcccttttggggccccctttcccatgtaagaaaaatcaccaagaatattatttttggtatttggaattgaatttgccaggaatgcaagcactgctacctaactaaagaccttggctttggaaacatcttaccccttggcagctctccagagtttagacttggcagcatcaaagacacaacgcaagcaggcattttggagatcaaagatgggtagaaaagatgctgctactataaaacttcctgttgatcagtacagaaaacaaattggtaaacaggattataaaaaaactaaacctattttacgagcaaccaaattaaaagcagaagcaaagaaaacagcaataggcataaaggaagttggccttgtacttgcagctatattggcactactactggctttctatgctttcttttatctcagactcaccacggatgttgaccctgatctggaccaagatgaagattagctaagcaacaatcaatgcatgaaagagaa

SEQ ID NO: 195211 - DNA, 3672 bp, Homo sapiens
  Payload ID: 18549
  Gene Name: triple QxxK/R motif containing
  Uniprot ID: Q629K1
  ENST ID: ENST00000521988
  CDS Start-End: 320-580
cctcttttccgcctcaccctttgggagtaggggtgtgcggctggcttgtcccgcccctgcccctgagtgacagaaccgtggacagcaacatttcccacaggacacgaagtttgtcggcccttgccttggcagagctgagtaagaaaaatcaccaagaatattatttttggtatttggaattgaatttgccaggaatgcaagcactgctacctaactaaagaccttggctttggaaacatcttaccccttggcagctctccagagtttagacttggcagcatcaaagacacaacgcaagcaggcattttggagatcaaagatgggtagaaaagatgctgctactataaaacttcctgttgatcagtacagaaaacaaattggtaaacaggattataaaaaaactaaacctattttacgagcaaccaaattaaaagcagaagcaaagaaaacagcaataggcataaaggaagttggccttgtacttgcagctatattggcactactactggctttctatgctttcttttatctcagactcaccacggatgttgaccctgatctggaccaagatgaagattagctaagcaacaatcaatgcatgaaagagaaataactttacgaaagcaccttttgggaccaaaactttcaatactgaaactgtaacatctttaattctttctgctaatattttcagtttgcagacatatgatttttgatagttgcataggatgtcaggaaaagaaccttacctagcaatgcagtatagtatgtgctactggatacttttatatatctttctgctttgacagccaccctatacatggtacatttagatgaaatgggaaccagatcctaaatttttcaaatgtcattgccaatttatgtgtataattccatcacttcctgatgagtaagtctatttttgttctatatacatcataagttagtatatattcttatttacagaaacatgctcaaatcacattcagaaagaacaaaaagtcatgggaaattttttattttacaacaaagccctgctttctttctggacgtattttacatcattagagagactatctgcacatacatctaccataatctttttccttctttgccaactgttcagtgcacatgtgctgcatcagaaatggcacctggatgacagaagctcaaagagtcacatatgtctctaaaatagagttcttttcctcttgggctgtctgaactggtgtaaatagaagctcagttgatcttggttttaattaacttattactctattaatataaccttggaattctattctaattatgttgttctggctgcttgtagtatcagttcgcccctcttgttagggagatatgtaacaatctgtcatttaattgagcagtctttttcacataacagtaatagcaaaaatcctacctactcagaatcatcttcttaggttgtctcctaaatctgaacaatacagttgttttataaaattacattttgtctcttgagatttaatcaattagaactctttagggagaaaataaataatagaagaaaatatatgcctcatatttcatatgtaattatctgttgatataatttttcaatgtattttgtatttgtgggagcataatgacctgtacattcaatatttttactggtaattcaatttttaaatatgtttttacaatgcttgaacacataaaccttagaaaactggaaaatacgtgtccacagaaagagttattagctactaccttatgtaaagatgcatagaaaatgaaattgttggaaacatgtgcacaaagtgttttatattatatacattgtatttatgaagaataaataaaatattaagattgttttcctgctagccaagagaagaaatccttgggaaatatctaaggagtatatggggctttataagcactgtttctaaaagatattctctggtacttttgcaaaaagtcgactgtgactgtgtagcattatgttctgtagaatttttttcaagtagcataatttatttcattggtgtgaaaacagccaaaggttccaatatcctcacaaatcatttatgccaaacatctgagggcaaaatttagccggtgttatttactagattcttccctttgaactcacagactcaagagacagaccaagagttcttatatactcaccacagcggaccaatccaagtggcatttttaggaaaggttgcagcatttaatgccatgtggtatgtctgttcgtcaagtgggtggcaagggaatatccaagctggcattttggatatgatgggccttttactttcctgagtgacatgccacatgtcaagaaatactgctccccacccccccactcccatcacatttacgtgaacaattttcatttagttatttcccgttccatatggtgttaaaacagtcgtattaaataaagattatttctagttttcagtggtaatttaaatgagaggatatgtaataattgcttattagatacttatccaaatgaaatataacagagtttacagtacttaaaatggctggttatggtcttggaaatgtttgaaaattcattatcctgaaaaaaactttaccattctgttttacccttgaggtattttttggggaaaaatgtttttgataactattaatctaaatatagtataattataggcaaatttcactgcctagttttattgatatcctgagtctacagctagtccattcgtatgactgattgatttatgatagctccagagaaccataaatttcaaaggctaaactctctgattttagtaaatagtaggtaaagtgacacaatatatgtttacacaacactgttttcatgaaatgcaaactttgcaaaactcacattaactgggaagcagccaaccctctgtagagaaatcccagattgggagtctggtttgaatctttgaagacagaaaggtgatatccggcctgctgttttaaagggaccacacttttgaatacctactggtgtttggcagaaatctgagactggcaccagacacaaattttagacatgggtatcttccctccagtaattcactgctcagagtaatttagaagacaaaaacagaaaaaattgtaatgattttttaagtgttagaatatgtttgttaacatactctgcaaaataaatttcaactaatgcaatagacttaaaatatagcctatggaatactgtgattgaagtttgaaggcttgctggttcttattttgcatgcaagtttagacagggtaaagaatgtataaatttatttgagatgagatacagtattgtaaaaatataacctcatctagaattgcttttaaaacaagcaaaagcctattttagtacaaatgtagggtgggtagttgttttaaggtagcaaaatacttcaagattttctatctttttaatttttcatgaagacagaagaaatactttcaccccaaccaatgactgtaagatcttgagagtatgttcttactcatttctgtaattgcagtagtgtagtcatctgcatataaatttaataaatgcatgttaaaatttaagttgatgccttttagtcctctcagagtctgtcacagtttctttgtgtaaatgataaaaaagtttgaatttaatcaataaaacttaaaaatcacaatatcaatcaa

SEQ ID NO: 195212 - DNA, 737 bp, Homo sapiens
  Payload ID: 18549
  Gene Name: triple QxxK/R motif containing
  Uniprot ID: Q629K1
  ENST ID: ENST00000524107
  CDS Start-End: 410-670
tttgtcggcccttgccttggcagagctgaggtgtgtgtccggcgagtgcgaggggattggggagaccctgcccgggaagctcggggtccgggaatgaaagcgggcgcacctctttagcgagccctaaagcgtttgggagacgatcgttccgtccctgggagcggcacttggtggggctgggcggagggaggctctgcaagagaaacccggagtccgggaaacccagtagtaagaaaaatcaccaagaatattatttttggtatttggaattgaatttgccaggaatgcaagcactgctacctaactaaagaccttggctttggaaacatcttaccccttggcagctctccagagtttagacttggcagcatcaaagacacaacgcaagcaggcattttggagatcaaagatgggtagaaaagatgctgctactataaaacttcctgttgatcagtacagaaaacaaattggtaaacaggattataaaaaaactaaacctattttacgagcaaccaaattaaaagcagaagcaaagaaaacagcaataggcataaaggaagttggccttgtacttgcagctatattggcactactactggctttctatgctttcttttatctcagactcaccacggatgttgaccctgatctggaccaagatgaagattagctaagcaacaatcaatgcatgaaagagaaataactttacgaaagcaccttttgggaccaaaactttc

SEQ ID NO: 195213 - DNA, 1808 bp, Homo sapiens
  Payload ID: 18549
  Gene Name: triple QxxK/R motif containing
  Uniprot ID: Q629K1
  ENST ID: ENST00000520686
  CDS Start-End: 246-506
actccggcaattctggcctctccagcctcttgcctttcttctgaggggagccttttatcctgctgtaagaaaaatcaccaagaatattatttttggtatttggaattgaatttgccaggaatgcaagcactgctacctaactaaagaccttggctttggaaacatcttaccccttggcagctctccagagtttagacttggcagcatcaaagacacaacgcaagcaggcattttggagatcaaagatgggtagaaaagatgctgctactataaaacttcctgttgatcagtacagaaaacaaattggtaaacaggattataaaaaaactaaacctattttacgagcaaccaaattaaaagcagaagcaaagaaaacagcaataggcataaaggaagttggccttgtacttgcagctatattggcactactactggctttctatgctttcttttatctcagactcaccacggatgttgaccctgatctggaccaagatgaagattagctaagcaacaatcaatgcatgaaagagaaataactttacgaaagcaccttttgggaccaaaactttcaatactgaaactgtaacatctttaattctttctgctaatattttcagtttgcagacatatgatttttgatagttgcataggatgtcaggaaaagaaccttacctagcaatgcagtatagtatgtgctactggatacttttatatatctttctgctttgacagccaccctatacatggtacatttagatgaaatgggaaccagatcctaaatttttcaaatgtcattgccaatttatgtgtataattccatcacttcctgatgagtaagtctatttttgttctatatacatcataagttagtatatattcttatttacagaaacatgctcaaatcacattcagaaagaacaaaaagtcatgggaaattttttattttacaacaaagccctgctttctttctggacgtattttacatcattagagagactatctgcacatacatctaccataatctttttccttctttgccaactgttcagtgcacatgtgctgcatcagaaatggcacctggatgacagaagctcaaagagtcacatatgtctctaaaatagagttcttttcctcttgggctgtctgaactggtgtaaatagaagctcagttgatcttggttttaattaacttattactctattaatataaccttggaattctattctaattatgttgttctggctgcttgtagtatcagttcgcccctcttgttagggagatatgtaacaatctgtcatttaattgagcagtctttttcacataacagtaatagcaaaaatcctacctactcagaatcatcttcttaggttgtctcctaaatctgaacaatacagttgttttataaaattacattttgtctcttgagatttaatcaattagaactctttagggagaaaataaataatagaagaaaatatatgcctcatatttcatatgtaattatctgttgatataatttttcaatgtattttgtatttgtgggagcataatgacctgtacattcaatatttttactggtaattcaatttttaaatatgtttttacaatgcttgaacacataaaccttagaaaactggaaaatacgtgtccacagaaagagttattagctactaccttatgtaaagatgcatagaaaatgaaattgttggaaacatgtgcacaaagtgttttatattatatacattgtatttatgaagaataaataaaatattaagattgttttcctgctagccaagagaagaaa

SEQ ID NO: 195214 - DNA, 559 bp, Homo sapiens
  Payload ID: 18549
  Gene Name: triple QxxK/R motif containing
  ENST ID: ENST00000522925
  CDS Start-End: 318-559
tcttttccgcctcaccctttgggagtaggggtgtgcggctggcttgtcccgcccctgcccctgagtgacagaaccgtggacagcaacatttcccacaggacacgaagtttgtcggcccttgccttggcagagctgagtaagaaaaatcaccaagaatattatttttggtatttggaattgaatttgccaggaatgcaagcactgctacctaactaaagaccttggctttggaaacatcttaccccttggcagctctccagagtttagacttggcagcatcaaagacacaacgcaagcaggcattttggagatcaaagatgggtagaaaagatgctgctactataaaacttcctgttgatcagtacagaaaacaaattggtaaacaggattataaaaaaactaaacctattttacgagcaaccaaattaaaagcagaagcaaagaaaacagcaataggcataaagtctactttttttttcttcccaggaagttggccttgtacttgcagctatattggcactactactggctttctatgctttcttttatctcagactca

SEQ ID NO: 195215 - DNA, 805 bp, Homo sapiens
  Payload ID: 18549
  Gene Name: triple QxxK/R motif containing
  ENST ID: ENST00000517751
  CDS Start-End: 581-805
cgaggggattggggagaccctgcccgggaagctcggggtccgggaatgaaagcgggcgcacctctttagcgagccctaaagcgtttgggagacgatcgttccgtccctgggagcggcacttggtggggctgggcggagggaggctctgcaagagaaacccggagtccgggaaacccagtagtttctggaggctgctcacattccttggcttatggcctccttcttccaacgtcaaagccagcaacattgcagcaatctgacttattttgttgtcatgtctcctgaccacatctggaagggttatctacttttgaagacacatccagataattcaggacaatctgtccattttgaggttcttcattgaatcatgtctgcaaagtcccttctgcaatctaagtaagaaaaatcaccaagaatattatttttggtatttggaattgaatttgccaggaatgcaagcactgctacctaactaaagaccttggctttggaaacatcttaccccttggcagctctccagagtttagacttggcagcatcaaagacacaacgcaagcaggcattttggagatcaaagatgggtagaaaagatgctgctactataaaacttcctgttgatcagtacagaaaacaaattggtaaacaggattataaaaaaactaaacctattttacgagcaaccaaattaaaagcagaagcaaagaaaacagcaataggcataaaggaagttggccttgtacttgcagctatattggcactactactggctttctatgctttcttttatctcagactcaccacg

SEQ ID NO: 195216 - DNA, 3563 bp, Homo sapiens
  Payload ID: 18549
  Gene Name: triple QxxK/R motif containing
  Uniprot ID: Q629K1
  ENST ID: ENST00000518748
  CDS Start-End: 316-576
ctcttttccgcctcaccctttgggagtaggggtgtgcggctggcttgtcccgcccctgcccctgagtgacagaaccgtggacagcaacatttcccacaggacacgaagtttgtcggcccttgccttggcagagctgagtaagaaaaatcaccaagaatattatttttggtatttggaattgaatttgccaggaatgcaagcactgctacctaactaaagaccttggctttggaaacatcttaccccttggcagctctccagagtttagacttggcagcatcaaagacacaacgcaaggcattttggagatcaaagatgggtagaaaagatgctgctactataaaacttcctgttgatcagtacagaaaacaaattggtaaacaggattataaaaaaactaaacctattttacgagcaaccaaattaaaagcagaagcaaagaaaacagcaataggcataaaggaagttggccttgtacttgcagctatattggcactactactggctttctatgctttcttttatctcagactcaccacggatgttgaccctgatctggaccaagatgaagattagctaagcaacaatcaatgcatgaaagagaaataactttacgaaagcaccttttgggaccaaaactttcaatactgaaactgtaacatctttaattctttctgctaatattttcagtttgcagacatatgatttttgatagttgcataggatgtcaggaaaagaaccttacctagcaatgcagtatagtatgtgctactggatacttttatatatctttctgctttgacagccaccctatacatggtacatttagatgaaatgggaaccagatcctaaatttttcaaatgtcattgccaatttatgtgtataattccatcacttcctgatgagtaagtctatttttgttctatatacatcataagttagtatatattcttatttacagaaacatgctcaaatcacattcagaaagaacaaaaagtcatgggaaattttttattttacaacaaagccctgctttctttctggacgtattttacatcattagagagactatctgcacatacatctaccataatctttttccttctttgccaactgttcagtgcacatgtgctgcatcagaaatggcacctggatgacagaagctcaaagagtcacatatgtctctaaaatagagttcttttcctcttgggctgtctgaactggtgtaaatagaagctcagttgatcttggttttaattaacttattactctattaatataaccttggaattctattctaattatgttgttctggctgcttgtagtatcagttcgcccctcttgttagggagatatgtaacaatctgtcatttaattgagcagtctttttcacataacagtaatagcaaaaatcctacctactcagaatcatcttcttaggttgtctcctaaatctgaacaatacagttgttttataaaattacattttgtctcttgagatttaatcaattagaactctttagggagaaaataaataatagaagaaaatatatgcctcatatttcatatgtaattatctgttgatataatttttcaatgtattttgtatttgtgggagcataatgacctgtacattcaatatttttactggtaattcaatttttaaatatgtttttacaatgcttgaacacataaaccttagaaaactggaaaatacgtgtccacagaaagagttattagctactaccttatgtaaagatgcatagaaaatgaaattgttggaaacatgtgcacaaagtgttttatattatatacattgtatttatgaagaataaataaaatattaagattgttttcctgctagccaagagaagaaatccttgggaaatatctaaggagtatatggggctttataagcactgtttctaaaagatattctctggtacttttgcaaaaagtcgactgtgactgtgtagcattatgttctgtagaatttttttcaagtagcataatttatttcattggtgtgaaaacagccaaaggttccaatatcctcacaaatcatttatgccaaacatctgagggcaaaatttagccggtgttatttactagattcttccctttgaactcacagactcaagagacagaccaagagttcttatatactcaccacagcggaccaatccaagtggcatttttaggaaaggttgcagcatttaatgccatgtggtatgtctgttcgtcaagtgggtggcaagggaatatccaagctggcattttggatatgatgggccttttactttcctgagtgacatgccacatgtcaagaaatactgctccccacccccccactcccatcacatttacgtgaacaattttcatttagttatttcccgttccatatggtgttaaaacagtcgtattaaataaagattatttctagttttcagtggtaatttaaatgagaggatatgtaataattgcttattagatacttatccaaatgaaatataacagagtttacagtacttaaaatggctggttatggtcttggaaatgtttgaaaattcattatcctgaaaaaaactttaccattctgttttacccttgaggtattttttggggaaaaatgtttttgataactattaatctaaatatagtataattataggcaaatttcactgcctagttttattgatatcctgagtctacagctagtccattcgtatgactgattgatttatgatagctccagagaaccataaatttcaaaggctaaactctctgattttagtaaatagtaggtaaagtgacacaatatatgtttacacaacactgttttcatgaaatgcaaactttgcaaaactcacattaactgggaagcagccaaccctctgtagagaaatcccagattgggagtctggtttgaatctttgaagacagaaaggtgatatccggcctgctgttttaaagggaccacacttttgaatacctactggtgtttggcagaaatctgagactggcaccagacacaaattttagacatgggtatcttccctccagtaattcactgctcagagtaatttagaagacaaaaacagaaaaaattgtaatgattttttaagtgttagaatatgtttgttaacatactctgcaaaataaatttcaactaatgcaatagacttaaaatatagcctatggaatactgtgattgaagtttgaaggcttgctggttcttattttgcatgcaagtttagacagggtaaagaatgtataaatttatttgagatgagatacagtattgtaaaaatataacctcatctagaattgcttttaaaacaagcaaaagcctattttagtacaaatgtagggtgggtagttgttttaaggtagcaaaatacttcaagattttctatctttttaatttttcatgaagacagaagaaatactttcaccccaaccaatgactgtaagatcttgagagtatgttcttactcatttctgtaattgcagtagtgtagtcatctgcatataaatttaataaatgcatgttaaaatttaa

SEQ ID NO: 195217 - DNA, 1630 bp, Homo sapiens
  Payload ID: 18549
  Gene Name: triple QxxK/R motif containing
  ENST ID: ENST00000523580
  CDS Start-End: 136-300
gggagtaggggtgtgcggctggcttgtcccgcccctgcccctgagtgacagaaccgtggacagcaacatttcccacaggacacgaagtttgtcggcccttgccttggcagagctgaggcattttggagatcaaagatgggtagaaaagatgctgctactataaaacttcctgttgatcagtacagaaaacaaattggtaaacaggattataaaaaaactaaacctattttacgagcaaccaaattaaaagcagaagcaaagaaaacagcaataggcataaagactcaccacggatgttgaccctgatctggaccaagatgaagattagctaagcaacaatcaatgcatgaaagagaaataactttacgaaagcaccttttgggaccaaaactttcaatactgaaactgtaacatctttaattctttctgctaatattttcagtttgcagacatatgatttttgatagttgcataggatgtcaggaaaagaaccttacctagcaatgcagtatagtatgtgctactggatacttttatatatctttctgctttgacagccaccctatacatggtacatttagatgaaatgggaaccagatcctaaatttttcaaatgtcattgccaatttatgtgtataattccatcacttcctgatgagtaagtctatttttgttctatatacatcataagttagtatatattcttatttacagaaacatgctcaaatcacattcagaaagaacaaaaagtcatgggaaattttttattttacaacaaagccctgctttctttctggacgtattttacatcattagagagactatctgcacatacatctaccataatctttttccttctttgccaactgttcagtgcacatgtgctgcatcagaaatggcacctggatgacagaagctcaaagagtcacatatgtctctaaaatagagttcttttcctcttgggctgtctgaactggtgtaaatagaagctcagttgatcttggttttaattaacttattactctattaatataaccttggaattctattctaattatgttgttctggctgcttgtagtatcagttcgcccctcttgttagggagatatgtaacaatctgtcatttaattgagcagtctttttcacataacagtaatagcaaaaatcctacctactcagaatcatcttcttaggttgtctcctaaatctgaacaatacagttgttttataaaattacattttgtctcttgagatttaatcaattagaactctttagggagaaaataaataatagaagaaaatatatgcctcatatttcatatgtaattatctgttgatataatttttcaatgtattttgtatttgtgggagcataatgacctgtacattcaatatttttactggtaattcaatttttaaatatgtttttacaatgcttgaacacataaaccttagaaaactggaaaatacgtgtccacagaaagagttattagctactaccttatgtaaagatgcatagaaaatgaaattgttggaaacatgtgcacaaagtgttttatattatatacattgtatttatgaagaataaataaaatattaagattgttttcctgctagccaagagaagaaa

SEQ ID NO: 195218 - DNA, 774 bp, Homo sapiens
  Payload ID: 18549
  Gene Name: triple QxxK/R motif containing
  Uniprot ID: Q629K1
  ENST ID: ENST00000521617
  CDS Start-End: 127-387
ggtgtgcggctggcttgtcccgcccctgcccctgagtgacagaaccgtggacagcaacatttcccacaggacacgaagtttgtcggcccttgccttggcagagctgaggcattttggagatcaaagatgggtagaaaagatgctgctactataaaacttcctgttgatcagtacagaaaacaaattggtaaacaggattataaaaaaactaaacctattttacgagcaaccaaattaaaagcagaagcaaagaaaacagcaataggcataaaggaagttggccttgtacttgcagctatattggcactactactggctttctatgctttcttttatctcagactcaccacggatgttgaccctgatctggaccaagatgaagattagctaagcaacaatcaatgcatgaaagagaaataactttacgaaagcaccttttgggaccaaaactttcaatactgaaactgtaacatctttaattctttctgctaatattttcagtttgcagacatatgatttttgatagttgcataggatgtcaggaaaagaaccttacctagcaatgcagtatagtatgtgctactggatacttttatatatctttctgctttgacagccaccctatacatggtacatttagatgaaatgggaaccagatcctaaatttttcaaatgtcattgccaatttatgtgtataattccatcacttcctgatgagtaagtctatttttgttctatatacatcataagttagtatatattcttatttacaga

SEQ ID NO: 195219 - DNA, 3510 bp, Homo sapiens
  Payload ID: 18549
  Gene Name: triple QxxK/R motif containing
  Uniprot ID: Q629K1
  ENST ID: ENST00000537541
  CDS Start-End: 160-420
ctcttttccgcctcaccctttgggagtaggggtgtgcggctggcttgtcccgcccctgcccctgagtgacagaaccgtggacagcaacatttcccacaggacacgaagtttgtcggcccttgccttggcagagctgagcaggcattttggagatcaaagatgggtagaaaagatgctgctactataaaacttcctgttgatcagtacagaaaacaaattggtaaacaggattataaaaaaactaaacctattttacgagcaaccaaattaaaagcagaagcaaagaaaacagcaataggcataaaggaagttggccttgtacttgcagctatattggcactactactggctttctatgctttcttttatctcagactcaccacggatgttgaccctgatctggaccaagatgaagattagctaagcaacaatcaatgcatgaaagagaaataactttacgaaagcaccttttgggaccaaaactttcaatactgaaactgtaacatctttaattctttctgctaatattttcagtttgcagacatatgatttttgatagttgcataggatgtcaggaaaagaaccttacctagcaatgcagtatagtatgtgctactggatacttttatatatctttctgctttgacagccaccctatacatggtacatttagatgaaatgggaaccagatcctaaatttttcaaatgtcattgccaatttatgtgtataattccatcacttcctgatgagtaagtctatttttgttctatatacatcataagttagtatatattcttatttacagaaacatgctcaaatcacattcagaaagaacaaaaagtcatgggaaattttttattttacaacaaagccctgctttctttctggacgtattttacatcattagagagactatctgcacatacatctaccataatctttttccttctttgccaactgttcagtgcacatgtgctgcatcagaaatggcacctggatgacagaagctcaaagagtcacatatgtctctaaaatagagttcttttcctcttgggctgtctgaactggtgtaaatagaagctcagttgatcttggttttaattaacttattactctattaatataaccttggaattctattctaattatgttgttctggctgcttgtagtatcagttcgcccctcttgttagggagatatgtaacaatctgtcatttaattgagcagtctttttcacataacagtaatagcaaaaatcctacctactcagaatcatcttcttaggttgtctcctaaatctgaacaatacagttgttttataaaattacattttgtctcttgagatttaatcaattagaactctttagggagaaaataaataatagaagaaaatatatgcctcatatttcatatgtaattatctgttgatataatttttcaatgtattttgtatttgtgggagcataatgacctgtacattcaatatttttactggtaattcaatttttaaatatgtttttacaatgcttgaacacataaaccttagaaaactggaaaatacgtgtccacagaaagagttattagctactaccttatgtaaagatgcatagaaaatgaaattgttggaaacatgtgcacaaagtgttttatattatatacattgtatttatgaagaataaataaaatattaagattgttttcctgctagccaagagaagaaatccttgggaaatatctaaggagtatatggggctttataagcactgtttctaaaagatattctctggtacttttgcaaaaagtcgactgtgactgtgtagcattatgttctgtagaatttttttcaagtagcataatttatttcattggtgtgaaaacagccaaaggttccaatatcctcacaaatcatttatgccaaacatctgagggcaaaatttagccggtgttatttactagattcttccctttgaactcacagactcaagagacagaccaagagttcttatatactcaccacagcggaccaatccaagtggcatttttaggaaaggttgcagcatttaatgccatgtggtatgtctgttcgtcaagtgggtggcaagggaatatccaagctggcattttggatatgatgggccttttactttcctgagtgacatgccacatgtcaagaaatactgctccccacccccccactcccatcacatttacgtgaacaattttcatttagttatttcccgttccatatggtgttaaaacagtcgtattaaataaagattatttctagttttcagtggtaatttaaatgagaggatatgtaataattgcttattagatacttatccaaatgaaatataacagagtttacagtacttaaaatggctggttatggtcttggaaatgtttgaaaattcattatcctgaaaaaaactttaccattctgttttacccttgaggtattttttggggaaaaatgtttttgataactattaatctaaatatagtataattataggcaaatttcactgcctagttttattgatatcctgagtctacagctagtccattcgtatgactgattgatttatgatagctccagagaaccataaatttcaaaggctaaactctctgattttagtaaatagtaggtaaagtgacacaatatatgtttacacaacactgttttcatgaaatgcaaactttgcaaaactcacattaactgggaagcagccaaccctctgtagagaaatcccagattgggagtctggtttgaatctttgaagacagaaaggtgatatccggcctgctgttttaaagggaccacacttttgaatacctactggtgtttggcagaaatctgagactggcaccagacacaaattttagacatgggtatcttccctccagtaattcactgctcagagtaatttagaagacaaaaacagaaaaaattgtaatgattttttaagtgttagaatatgtttgttaacatactctgcaaaataaatttcaactaatgcaatagacttaaaatatagcctatggaatactgtgattgaagtttgaaggcttgctggttcttattttgcatgcaagtttagacagggtaaagaatgtataaatttatttgagatgagatacagtattgtaaaaatataacctcatctagaattgcttttaaaacaagcaaaagcctattttagtacaaatgtagggtgggtagttgttttaaggtagcaaaatacttcaagattttctatctttttaatttttcatgaagacagaagaaatactttcaccccaaccaatgactgtaagatcttgagagtatgttcttactcatttctgtaattgcagtagtgtagtcatctgcatataaatttaataaatgcatgttaaaatttaagttgatgccttttagtcctctcagagtctgtcacagtttctttgtgtaaatgataaaaaagtttgaatttaatcaataaaacttaaaaatcacaatatcaatc

SEQ ID NO: 195220 - DNA, 1978 bp, Homo sapiens
  Payload ID: 18550
  Gene Name: TRK-fused gene
  Uniprot ID: Q92734
  ENST ID: ENST00000240851
  CDS Start-End: 341-1543
gtcctgggtatgtccacgcgcaataaggaggggcgaaaggacatttttttttttcttgctcccgcctctgttcttcccccacctgccacgtacagagcccaagttctcgctaggcttgttgggtcagcgcgattggccggggcccgcgcgagcctgcgagcgaggtgcggcggtcgcgaagggcaaccgagggggccgtgaccaccgcctccccgcgacgccccagtccagtggcctcgcgtccgcccattcagcggagacctgcggagaggcggcggccgcggcctccgcaagccgtctttctctagagttgtatatatagaacatcctggagtccaccatgaacggacagttggatctaagtgggaagctaatcatcaaagctcaacttggggaggatattcggcgaattcctattcataatgaagatattacttatgatgaattagtgctaatgatgcaacgagttttcagaggaaaacttctgagtaatgatgaagtaacaataaagtataaagatgaagatggagatcttataacaatttttgatagttctgacctttcctttgcaattcagtgcagtaggatactgaaactgacattatttgttaatggccagccaagaccccttgaatcaagtcaggtgaaatatctccgtcgagaactgatagaacttcgaaataaagtgaatcgtttattggatagcttggaaccacctggagaaccaggaccttccaccaatattcctgaaaatgatactgtggatggtagggaagaaaagtctgcttctgattcttctggaaaacagtctactcaggttatggcagcaagtatgtctgcttttgatcctttaaaaaaccaagatgaaatcaataaaaatgttatgtcagcgtttggcttaacagatgatcaggtttcagggccacccagtgctcctgcagaagatcgttcaggaacacccgacagcattgcttcctcctcctcagcagctcacccaccaggcgttcagccacagcagccaccatatacaggagctcagactcaagcaggtcagattgaaggtcagatgtaccaacagtaccagcaacaggccggctatggtgcacagcagccgcaggctccacctcagcagcctcaacagtatggtattcagtattcagcaagctatagtcagcagactggacctcaacaacctcagcagttccagggatatggccagcaaccaacttcccaggcaccagctcctgccttttctggtcagcctcaacaactgcctgctcagccgccacagcagtaccaggcgagcaattatcctgcacaaacttacactgcccaaacttctcagcctactaattatactgtggctcctgcctctcaacctggaatggctccaagccaacctggggcctatcaaccaagaccaggttttacttcacttcctggaagtaccatgacccctcctccaagtgggcctaatccttatgcgcgtaaccgtcctccctttggtcagggctatacccaacctggacctggttatcgataaggaggctcctctacaccaattaatgtagctgctagctattggcctcccaaaagactccagtactattttaatttgtattgaagaagttcagaaatttaaaagcagagcattttttatgatatcattgttggtgttaattgaaagtataatttgctggaacacaaagaccaaaatgaaagttttttcctccctgcttaaaaatgtagcagcttcttagttactttggaacactactcttacatgtataaagtgattgacttgactttctagcttcccttgtccggaggatattaaaatgctagggtgaggtttagccatcttacttggctttttactattaacatgatgtactaaagtagagccctttgagaatacaagatattatgtataaaatgtaacactgatgataggttaataaagatgattgaatccatt

SEQ ID NO: 195221 - DNA, 1716 bp, Homo sapiens
  Payload ID: 18550
  Gene Name: TRK-fused gene
  Uniprot ID: Q92734
  ENST ID: ENST00000418917
  CDS Start-End: 115-1305
agggactcttcggcctaggcagccgggacccagccagccctgcgcctcgcgccgtcgcgcatgcgtcctggtctttctctagagttgtatatatagaacatcctggagtccaccatgaacggacagttggatctaagtgggaagctaatcatcaaagctcaacttggggaggatattcggcgaattcctattcataatgaagatattacttatgatgaattagtgctaatgatgcaacgagttttcagaggaaaacttctgagtaatgatgaagtaacaataaagtataaagatgaagatggagatcttataacaatttttgatagttctgacctttcctttgcaattcagtgcagtaggatactgaaactgacattatttgttaatggccagccaagaccccttgaatcaagtcaggtgaaatatctccgtcgagaactgatagaacttcgaaataaagtgaatcgtttattggatagcttggaaccacctggagaaccaggaccttccaccaatattcctgaaaatgatactgtggatggtagggaagaaaagtctgcttctgattcttctggaaaacagtctactcaggttatggcagcaagtatgtctgcttttgatcctttaaaaaaccaagatgaaatcaataaaaatgttatgtcagcgtttggcttaacagatgatcaggtttcagggccacccagtgctcctgcagaagatcgttcaggaacacccgacagcattgcttcctcctcctcagcagctcacccaccaggcgttcagccacagcagccaccatatacaggagctcagactcaagcaggtcagatgtaccaacagtaccagcaacaggccggctatggtgcacagcagccgcaggctccacctcagcagcctcaacagtatggtattcagtattcagcaagctatagtcagcagactggacctcaacaacctcagcagttccagggatatggccagcaaccaacttcccaggcaccagctcctgccttttctggtcagcctcaacaactgcctgctcagccgccacagcagtaccaggcgagcaattatcctgcacaaacttacactgcccaaacttctcagcctactaattatactgtggctcctgcctctcaacctggaatggctccaagccaacctggggcctatcaaccaagaccaggttttacttcacttcctggaagtaccatgacccctcctccaagtgggcctaatccttatgcgcgtaaccgtcctccctttggtcagggctatacccaacctggacctggttatcgataaggaggctcctctacaccaattaatgtagctgctagctattggcctcccaaaagactccagtactattttaatttgtattgaagaagttcagaaatttaaaagcagagcattttttatgatatcattgttggtgttaattgaaagtataatttgctggaacacaaagaccaaaatgaaagttttttcctccctgcttaaaaatgtagcagcttcttagttactttggaacactactcttacatgtataaagtgattgacttgactttctagcttcccttgtccggaggatattaaaatgctagggtgaggtttagccatcttacttggctttttactattaacatgatgtactaaagtagagccctttgagaatacaagatattatgtataaaatgtaacactgatgatagg

SEQ ID NO: 195222 - DNA, 1783 bp, Homo sapiens
  Payload ID: 18550
  Gene Name: TRK-fused gene
  Uniprot ID: Q92734
  ENST ID: ENST00000476228
  CDS Start-End: 160-1350
ggcaaccgagggggccgtgaccaccgcctccccgcgacgccccagtccagtggcctcgcgtccgcccattcagcggagacctgcggagaggcggcggccgcggcctccgcaagccgtctttctctagagttgtatatatagaacatcctggagtccaccatgaacggacagttggatctaagtgggaagctaatcatcaaagctcaacttggggaggatattcggcgaattcctattcataatgaagatattacttatgatgaattagtgctaatgatgcaacgagttttcagaggaaaacttctgagtaatgatgaagtaacaataaagtataaagatgaagatggagatcttataacaatttttgatagttctgacctttcctttgcaattcagtgcagtaggatactgaaactgacattatttgttaatggccagccaagaccccttgaatcaagtcaggtgaaatatctccgtcgagaactgatagaacttcgaaataaagtgaatcgtttattggatagcttggaaccacctggagaaccaggaccttccaccaatattcctgaaaatgatactgtggatggtagggaagaaaagtctgcttctgattcttctggaaaacagtctactcaggttatggcagcaagtatgtctgcttttgatcctttaaaaaaccaagatgaaatcaataaaaatgttatgtcagcgtttggcttaacagatgatcaggtttcagggccacccagtgctcctgcagaagatcgttcaggaacacccgacagcattgcttcctcctcctcagcagctcacccaccaggcgttcagccacagcagccaccatatacaggagctcagactcaagcaggtcagatgtaccaacagtaccagcaacaggccggctatggtgcacagcagccgcaggctccacctcagcagcctcaacagtatggtattcagtattcagcaagctatagtcagcagactggacctcaacaacctcagcagttccagggatatggccagcaaccaacttcccaggcaccagctcctgccttttctggtcagcctcaacaactgcctgctcagccgccacagcagtaccaggcgagcaattatcctgcacaaacttacactgcccaaacttctcagcctactaattatactgtggctcctgcctctcaacctggaatggctccaagccaacctggggcctatcaaccaagaccaggttttacttcacttcctggaagtaccatgacccctcctccaagtgggcctaatccttatgcgcgtaaccgtcctccctttggtcagggctatacccaacctggacctggttatcgataaggaggctcctctacaccaattaatgtagctgctagctattggcctcccaaaagactccagtactattttaatttgtattgaagaagttcagaaatttaaaagcagagcattttttatgatatcattgttggtgttaattgaaagtataatttgctggaacacaaagaccaaaatgaaagttttttcctccctgcttaaaaatgtagcagcttcttagttactttggaacactactcttacatgtataaagtgattgacttgactttctagcttcccttgtccggaggatattaaaatgctagggtgaggtttagccatcttacttggctttttactattaacatgatgtactaaagtagagccctttgagaatacaagatattatgtataaaatgtaacactgatgataggttaataaagatgattgaatcca

SEQ ID NO: 195223 - DNA, 723 bp, Homo sapiens
  Payload ID: 18550
  Gene Name: TRK-fused gene
  ENST ID: ENST00000463568
  CDS Start-End: 253-723
gagggggccgtgaccaccgcctccccgcgacgccccagtccagtggcctcgcgtccgcccattcagcggagacctgcggagaggcggcggccgcggcctccgcaagccggtatggccactggagacgggggttgcgggcgctctgtccgaggaggccgggagactaggaggcgctgggagggcctcgttcgaaccgcgcggcagctgggtctttctctagagttgtatatatagaacatcctggagtccaccatgaacggacagttggatctaagtgggaagctaatcatcaaagctcaacttggggaggatattcggcgaattcctattcataatgaagatattacttatgatgaattagtgctaatgatgcaacgagttttcagaggaaaacttctgagtaatgatgaagtaacaataaagtataaagatgaagatggagatcttataacaatttttgatagttctgacctttcctttgcaattcagtgcagtaggatactgaaactgacattatttgttaatggccagccaagaccccttgaatcaagtcaggtgaaatatctccgtcgagaactgatagaacttcgaaataaagtgaatcgtttattggatagcttggaaccacctggagaaccaggaccttccaccaatattcctgaaaatgatactgtggatggtagggaagaaaagtctgcttctgattcttctggaaaacagtct

SEQ ID NO: 195224 - DNA, 776 bp, Homo sapiens
  Payload ID: 18550
  Gene Name: TRK-fused gene
  ENST ID: ENST00000479672
  CDS Start-End: 392-776
tttttttcttgctcccgcctctgttcttcccccacctgccacgtacagagcccaagttctcgctaggcttgttgggtcagcgcgattggccggggcccgcgcgagcctgcgagcgaggtgcggcggtcgcgaagggcaaccgagggggccgtgaccaccgcctccccgcgacgccccagtccagtggcctcgcgtccgcccattcagcggagacctgcggagaggcggcggccgcggcctccgcaagccgatgactgcaagagcaaacgacagctttaggaaagaagcactggttcctggccacaagatgtttacagtcaataggaaacacaaaaagtgaatttgcagtctttctctagagttgtatatatagaacatcctggagtccaccatgaacggacagttggatctaagtgggaagctaatcatcaaagctcaacttggggaggatattcggcgaattcctattcataatgaagatattacttatgatgaattagtgctaatgatgcaacgagttttcagaggaaaacttctgagtaatgatgaagtaacaataaagtataaagatgaagatggagatcttataacaatttttgatagttctgacctttcctttgcaattcagtgcagtaggatactgaaactgacattatttgttaatggccagccaagaccccttgaatcaagtcaggtgaaatatctccgtcgagaactgatagaacttcgaaataaagtgaatcgtttattggatagcttggaaccacctggagaac

SEQ ID NO: 195225 - DNA, 1696 bp, Homo sapiens
  Payload ID: 18550
  Gene Name: TRK-fused gene
  Uniprot ID: Q92734
  ENST ID: ENST00000490574
  CDS Start-End: 98-1300
ggcagccgggacccagccagccctgcgcctcgcgccgtcgcgcatgcgtcctggtctttctctagagttgtatatatagaacatcctggagtccaccatgaacggacagttggatctaagtgggaagctaatcatcaaagctcaacttggggaggatattcggcgaattcctattcataatgaagatattacttatgatgaattagtgctaatgatgcaacgagttttcagaggaaaacttctgagtaatgatgaagtaacaataaagtataaagatgaagatggagatcttataacaatttttgatagttctgacctttcctttgcaattcagtgcagtaggatactgaaactgacattatttgttaatggccagccaagaccccttgaatcaagtcaggtgaaatatctccgtcgagaactgatagaacttcgaaataaagtgaatcgtttattggatagcttggaaccacctggagaaccaggaccttccaccaatattcctgaaaatgatactgtggatggtagggaagaaaagtctgcttctgattcttctggaaaacagtctactcaggttatggcagcaagtatgtctgcttttgatcctttaaaaaaccaagatgaaatcaataaaaatgttatgtcagcgtttggcttaacagatgatcaggtttcagggccacccagtgctcctgcagaagatcgttcaggaacacccgacagcattgcttcctcctcctcagcagctcacccaccaggcgttcagccacagcagccaccatatacaggagctcagactcaagcaggtcagattgaaggtcagatgtaccaacagtaccagcaacaggccggctatggtgcacagcagccgcaggctccacctcagcagcctcaacagtatggtattcagtattcagcaagctatagtcagcagactggacctcaacaacctcagcagttccagggatatggccagcaaccaacttcccaggcaccagctcctgccttttctggtcagcctcaacaactgcctgctcagccgccacagcagtaccaggcgagcaattatcctgcacaaacttacactgcccaaacttctcagcctactaattatactgtggctcctgcctctcaacctggaatggctccaagccaacctggggcctatcaaccaagaccaggttttacttcacttcctggaagtaccatgacccctcctccaagtgggcctaatccttatgcgcgtaaccgtcctccctttggtcagggctatacccaacctggacctggttatcgataaggaggctcctctacaccaattaatgtagctgctagctattggcctcccaaaagactccagtactattttaatttgtattgaagaagttcagaaatttaaaagcagagcattttttatgatatcattgttggtgttaattgaaagtataatttgctggaacacaaagaccaaaatgaaagttttttcctccctgcttaaaaatgtagcagcttcttagttactttggaacactactcttacatgtataaagtgattgacttgactttctagcttcccttgtccggaggatattaaaatgctagggtgaggtttagccatcttacttggctttttactattaacatgatgtactaaagtagagccctttgagaatacaagatattatgtataaaatgt

SEQ ID NO: 195226 - DNA, 913 bp, Homo sapiens
  Payload ID: 18550
  Gene Name: TRK-fused gene
  ENST ID: ENST00000487505
  CDS Start-End: 370-913
aacccctggctgcggtggccaggaggcgcgcctggggggctccgggaggggagtgcgccagctaatgccttggtgcagcctgcctccaagcgtttggattgagaggagaggggctttgggaggtttggggcggccggcgcccaatacccgaaggagctcggaagggtgtggagtggcgcctacgggaataagttgattggggtcatagaatcggagcctagttccttggctaagtcagcgcttaatcaagcgccggctggaggcccagcctggtttatagtgatgattctagctaactttaagagtttgctttgctggacactacatctttctctagagttgtatatatagaacatcctggagtccaccatgaacggacagttggatctaagtgggaagctaatcatcaaagctcaacttggggaggatattcggcgaattcctattcataatgaagatattacttatgatgaattagtgctaatgatgcaacgagttttcagaggaaaacttctgagtaatgatgaagtaacaataaagtataaagatgaagatggagatcttataacaatttttgatagttctgacctttcctttgcaattcagtgcagtaggatactgaaactgacattatttgttaatggccagccaagaccccttgaatcaagtcaggtgaaatatctccgtcgagaactgatagaacttcgaaataaagtgaatcgtttattggatagcttggaaccacctggagaaccaggaccttccaccaatattcctgaaaatgatactgtggatggtagggaagaaaagtctgcttctgattcttctggaaaacagtctactcaggttatggcagcaagtatgtctgcttttgatcctttaaaaaaccaagatgaaatcaataaaaatgtta

SEQ ID NO: 195227 - DNA, 2059 bp, Homo sapiens
  Payload ID: 18550
  Gene Name: TRK-fused gene
  ENST ID: ENST00000612059
  CDS Start-End: 435-1535
ttcctaaatcccgtcatccagtgagaaagcagggactcttcggcctaggcagccgggacccagccagccctgcgcctcgcgccgtcgcgcatgcgtcctgggtatgtccacgcgcaataaggaggggcgaaaggacatttttttttttcttgctcccgcctctgttcttcccccacctgccacgtacagagcccaagttctcgctaggcttgttgggtcagcgcgattggccggggcccgcgcgagcctgcgagcgaggtgcggcggtcgcgaagggcaaccgagggggccgtgaccaccgcctccccgcgacgccccagtccagtggcctcgcgtccgcccattcagcggagacctgcggagaggcggcggccgcggcctccgcaagccgtctttctctagagttgtatatatagaacatcctggagtccaccatgaacggacagttggatctaagtgggaagctaatcatcaaagctcaacttggggaggatattcggcgaattcctattcataatgaagatattacttatgatgaattagtgctaatgatgcaacgagttttcagaggaaaacttctgagtaatgatgaagtaacaataaagtataaagatgaagatggagatcttataacaatttttgatagttctgacctttcctttgcaattcagtgcagtaggatactgaaactgacattatttgttaatggccagccaagaccccttgaatcaagtcaggtgaaatatctccgtcgagaactgatagaacttcgaaataaagtgaatcgtttattggatagcttggaaccacctggagaaccaggaccttccaccaatattcctgaaaatgatactgtggatggtagggaagaaaagtctgcttctgattcttctggaaaacagtctactcaggttatggcagcaagtatgtctgcttttgatcctttaaaaaaccaagatgaaatcaataaaaatgttatgtcagcgtttggcttaacagatgatcaggtttcagggccacccagtgctcctgcagaagatcgttcaggaacacccgacagcattgcttcctcctcctcagcagctcacccaccaggcgttcagccacagcagccaccatatacaggagctcagactcaagcaggtcagatgtaccaacagtacagcaacaggccggctatggtgcacagcagccgcaggctccacctcagcagcctcaacagtatggtattcagtattcagcaagctatagtcagcagactggacctcaacaacctcagcagttccagggatatggccagcaaccaacttcccaggcaccagctcctgccttttctggtcagcctcaacaactgcctgctcagccgccacagcagtaccaggcgagcaattatcctgcacaaacttacactgcccaaacttctcagcctactaattatactgtggctcctgcctctcaacctggaatggctccaagccaacctggggcctatcaaccaagaccaggttttacttcacttcctggaagtaccatgacccctcctccaagtgggcctaatccttatgcgcgtaaccgtcctccctttggtcagggctatacccaacctggacctggttatcgataaggaggctcctctacaccaattaatgtagctgctagctattggcctcccaaaagactccagtactattttaatttgtattgaagaagttcagaaatttaaaagcagagcattttttatgatatcattgttggtgttaattgaaagtataatttgctggaacacaaagaccaaaatgaaagttttttcctccctgcttaaaaatgtagcagcttcttagttactttggaacactactcttacatgtataaagtgattgacttgactttctagcttcccttgtccggaggatattaaaatgctagggtgaggtttagccatcttacttggctttttactattaacatgatgtactaaagtagagccctttgagaatacaagatattatgtataaaatgtaacactgatgataggttaataaagatgattgaatccatt

SEQ ID NO: 195228 - DNA, 1244 bp, Homo sapiens
  Payload ID: 18550
  Gene Name: TRK-fused gene
  Uniprot ID: Q92734
  ENST ID: ENST00000615993
  CDS Start-End: 1-855
atgaacggacagttggatctaagtgggaagctaatcatcaaagctcaacttggggaggatattcggcgaattcctattcataatgaagatattacttatgatgaattagtgctaatgatgcaacgagttttcagaggaaaacttctgagtaatgatgaagtaacaataaagtataaagatgaagatggagatcttataacaatttttgatagttctgacctttcctttgcaattcagtgcagtaggatactgaaactgacattatttgttaatggccagccaagaccccttgaatcaagtcaggtgaaatatctccgtcgagaactgatagaacttcgaaataaagtgaatcgtttattggatagcttggaaccacctggagaaccaggaccttccaccaatattcctgaaaatgatactgtggatggtagggaagaaaagtctgcttctgattcttctggaaaacagtctactcaggttatggcagcaagtatgtctgcttttgatcctttaaaaaaccaagatgaaatcaataaaaatgttatgtcagcgtttggcttaacagatgatcaggtttcagggccacccagtgctcctgcagaagatcgttcaggaacacccgacagcattgcttcctcctcctcagcagctcacccaccaggcgttcagccacagcagccaccatatacaggagctcagactcaagcaggtcagattgaaggtcagatgtaccaacagtaccagcaacaggccggctatggtgcacagcagccgcaggctccacctcagcagcctcaacagtatggtattcagtattcaggattccagtcaatggagaggtttcattgcaagtagctgcagcaagctatagtcagcagactggacctcaacaacctcagcagttccagggatatggccagcaaccaacttcccaggcaccagctcctgccttttctggtcagcctcaacaactgcctgctcagccgccacagcagtaccaggcgagcaattatcctgcacaaacttacactgcccaaacttctcagcctactaattatactgtggctcctgcctctcaacctggaatggctccaagccaacctggggcctatcaaccaagaccaggttttacttcacttcctggaagtaccatgacccctcctccaagtgggcctaatccttatgcgcgtaaccgtcctccctttggtcagggctatacccaacctggacctggttatcgataa

SEQ ID NO: 195229 - DNA, 1289 bp, Homo sapiens
  Payload ID: 18550
  Gene Name: TRK-fused gene
  Uniprot ID: Q92734
  ENST ID: ENST00000620299
  CDS Start-End: 435-1289
ttcctaaatcccgtcatccagtgagaaagcagggactcttcggcctaggcagccgggacccagccagccctgcgcctcgcgccgtcgcgcatgcgtcctgggtatgtccacgcgcaataaggaggggcgaaaggacatttttttttttcttgctcccgcctctgttcttcccccacctgccacgtacagagcccaagttctcgctaggcttgttgggtcagcgcgattggccggggcccgcgcgagcctgcgagcgaggtgcggcggtcgcgaagggcaaccgagggggccgtgaccaccgcctccccgcgacgccccagtccagtggcctcgcgtccgcccattcagcggagacctgcggagaggcggcggccgcggcctccgcaagccgtctttctctagagttgtatatatagaacatcctggagtccaccatgaacggacagttggatctaagtgggaagctaatcatcaaagctcaacttggggaggatattcggcgaattcctattcataatgaagatattacttatgatgaattagtgctaatgatgcaacgagttttcagaggaaaacttctgagtaatgatgaagtaacaataaagtataaagatgaagatggagatcttataacaatttttgatagttctgacctttcctttgcaattcagtgcagtaggatactgaaactgacattatttgttaatggccagccaagaccccttgaatcaagtcaggtgaaatatctccgtcgagaactgatagaacttcgaaataaagtgaatcgtttattggatagcttggaaccacctggagaaccaggaccttccaccaatattcctgaaaatgatactgtggatggtagggaagaaaagtctgcttctgattcttctggaaaacagtctactcaggttatggcagcaagtatgtctgcttttgatcctttaaaaaaccaagatgaaatcaataaaaatgttatgtcagcgtttggcttaacagatgatcaggtttcagggccacccagtgctcctgcagaagatcgttcaggaacacccgacagcattgcttcctcctcctcagcagctcacccaccaggcgttcagccacagcagccaccatatacaggagctcagactcaagcaggtcagattgaaggtcagatgtaccaacagtaccagcaacaggccggctatggtgcacagcagccgcaggctccacctcagcagcctcaacagtatggtattcagtattcaggattccagtcaatggagaggtttcattgcaagtag

SEQ ID NO: 195230 - DNA, 1940 bp, Homo sapiens
  Payload ID: 18551
  Gene Name: tRNA 5-methylaminomethyl-2-thiouridylate methyltransferase
  Uniprot ID: O75648
  ENST ID: ENST00000290846
  CDS Start-End: 341-1606
ggctggggggcttagaattttatttttggtttacagcgcagaagaagagcagtgaggccggggcgcgggtggggagggcaaggcggcggctcaaaaaaaaagccagcccctcgcggcccgacagagtctcggcgccccgcgggtcggtggagcctcaggggtgagcgcaggccggagacaggggaacccgccgcgggacaggggaaggccggacggaacgcgggtaagctgccgcagcttccggccgggccactagcgcggaccctacggccggggcgggacttccggcaaggcgcggaagcggcggtagctgcagctggcgaagttgggcgactggcggatgcaggccttgcggcacgtcgtgtgcgccctgtccggcggcgtggacagcgccgtggccgcgctgctgctgaggcggagaggttaccaggtgacaggggtgtttatgaagaactgggactcactggatgaacatggggtctgtactgccgacaaagactgtgaagatgcttacagagtttgccagatcttagacatccctttccatcaagtgtcctacgtaaaggagtattggaatgatgtgttcagtgactttttgaatgagtatgaaaaaggaaggactcccaatcctgacatagtttgcaacaagcacatcaaatttagttgcttttttcattatgctgtggataatcttggggcagatgccattgccacaggtcactatgcaagaacttccctggaagatgaagaagtctttgagcagaagcacgttaagaagcccgaagggcttttcagaaatcggtttgaagttagaaatgcggtaaaactcctccaggcagctgacagctttaaagaccagaccttctttctcagccaggtttcccaggatgccctgaggagaaccatcttccctctggggggattaacgaaagagtttgtaaagaaaatcgctgctgagaatagacttcatcatgtgcttcagaagaaagagagcatgggcatgtgtttcatcgggaagaggaattttgaacatttccttcttcagtatctgcagcctcgacctggtcactttatttccatagaagacaataaggttctgggaacacataaaggttggttcctgtataccttgggccagagagcaaacataggtggcctgagagagccctggtacgtggtggagaaggacagcgtcaagggtgacgtgtttgtggccccccggacagaccacccagccctgtacagggacctgctgaggaccagccgcgtgcactggattgcggaggagcctcccgcagcactggtccgggacaagatgatggagtgccacttccgattccgccaccagatggcactagtgccctgtgtgctgaccctcaatcaagatggcaccgtgtgggtgacagctgtgcaggctgtgcgtgcccttgccacaggacagtttgctgtgttctacaagggggacgagtgcctgggcagcgggaagatcctgcggctggggccgtctgcctacacgctccagaagggccagcgcagagctgggatggccactgagagccccagtgacagcccagaagatggtccaggcctgagtcccttgctctgacagagatggatctgctagaaggaacctggagagcaggacccatggctgggcggctggtgagcagtccaggtgcccaagggccagcttgctgctgcccaaagcagaggaagccgggctggctgagggtccgaaaagcctgcaggggcccggcgagccccaggaagagcctcagctccaggctggggctctggctgctggagcatctgctggctggtggggtggcccgagttccccttcaccgcccccagggagggtttcccacctcagagtacaccgaggggacctgcagagggggctgtcgggacagcgtggaataaacattatttcaaggaca

SEQ ID NO: 195231 - DNA, 1381 bp, Homo sapiens
  Payload ID: 18551
  Gene Name: tRNA 5-methylaminomethyl-2-thiouridylate methyltransferase
  Uniprot ID: O75648
  ENST ID: ENST00000381019
  CDS Start-End: 21-1151
cgaagttgggcgactggcggatgcaggccttgcggcacgtcgtgtgcgccctgtccggcggcgtggacagcgccgtggccgcgctgctgctgaggcggagaggttaccaggtgacaggggtgtttatgaagaactgggactcactggatgaacatggggtctgtactgccgacaaagactgtgaagatgcttacagagtttgccagatcttagacatccctttccatcaagtgtcctacgtaaaggagtattggaatgatgtgttcagtgactttttgaatgagtatgaaaaaggaaggactcccaatcctgacatagtttgcaacaagcacatcaaatttagttgcttttttcattatgctgtggataatcttggggcagatgccattgccacaggtcactatgcaagaacttccctggaagatgaagaagtctttgagcagaagcacgttaagaagcccgaagggcttttcagaaatcggtttgaagttagaaatgcggtaaaactcctccaggcagctgacagctttaaagaccagaccttctttctcagccaggtttcccaggatgccctgaggagaaccatcttccctctggggggattaacgaaagagtttgtaaagaaaatcgctgctgagaatagacttcatcatgtgcttcagaagaaagagagcatgggcatgtgtttcatcgggaagaggaattttgaacatttccttcttcagtatctgcagcctcgacctggtcactttatttccatagaagacaataaggttctgggaacacataaaggttggttcctgtataccttgggccagagagcaaacataggtggcctgagagagccctggtacgtggtggagaaggacagcgtcaagggtgacgtgtttgtggccccccggacagaccacccagccctgtacagggacctgctgaggaccagccgcgtgcactggattgcggaggagcctcccgcagcactggtccgggacaagatgatggagtgccacttccgattccgccaccagatggcactagtttgctgtgttctacaagggggacgagtgcctgggcagcgggaagatcctgcggctggggccgtctgcctacacgctccagaagggccagcgcagagctgggatggccactgagagccccagtgacagcccagaagatggtccaggcctgagtcccttgctctgacagagatggatctgctagaaggaacctggagagcaggacccatggctgggcggctggtgagcagtccaggtgcccaagggccagcttgctgctgcccaaagcagaggaagccgggctggctgagggtccgaaaagcctgcaggggcccggcgagccccaggaagagcctcagctccag

SEQ ID NO: 195232 - DNA, 1830 bp, Homo sapiens
  Payload ID: 18551
  Gene Name: tRNA 5-methylaminomethyl-2-thiouridylate methyltransferase
  ENST ID: ENST00000381021
  CDS Start-End: 341-640
ggctggggggcttagaattttatttttggtttacagcgcagaagaagagcagtgaggccggggcgcgggtggggagggcaaggcggcggctcaaaaaaaaagccagcccctcgcggcccgacagagtctcggcgccccgcgggtcggtggagcctcaggggtgagcgcaggccggagacaggggaacccgccgcgggacaggggaaggccggacggaacgcgggtaagctgccgcagcttccggccgggccactagcgcggaccctacggccggggcgggacttccggcaaggcgcggaagcggcggtagctgcagctggcgaagttgggcgactggcggatgcaggccttgcggcacgtcgtgtgcgccctgtccggcggcgtggacagcgccgtggccgcgctgctgctgaggcggagaggttaccaggtgacaggggtgtttatgaagaactgggactcactggatgaacatggggtctgtactgccgacaaagactgtgaagatgcttacagagtttgccagatcttagacatccctttccatcaagtgtcctacgtaaaggagtattggaatgatgtgttcaggggcagatgccattgccacaggtcactatgcaagaacttccctggaagatgaagaagtctttgagcagaagcacgttaagaagcccgaagggcttttcagaaatcggtttgaagttagaaatgcggtaaaactcctccaggcagctgacagctttaaagaccagaccttctttctcagccaggtttcccaggatgccctgaggagaaccatcttccctctggggggattaacgaaagagtttgtaaagaaaatcgctgctgagaatagacttcatcatgtgcttcagaagaaagagagcatgggcatgtgtttcatcgggaagaggaattttgaacatttccttcttcagtatctgcagcctcgacctggtcactttatttccatagaagacaataaggttctgggaacacataaaggttggttcctgtataccttgggccagagagcaaacataggtggcctgagagagccctggtacgtggtggagaaggacagcgtcaagggtgacgtgtttgtggccccccggacagaccacccagccctgtacagggacctgctgaggaccagccgcgtgcactggattgcggaggagcctcccgcagcactggtccgggacaagatgatggagtgccacttccgattccgccaccagatggcactagtgccctgtgtgctgaccctcaatcaagatggcaccgtgtgggtgacagctgtgcaggctgtgcgtgcccttgccacaggacagtttgctgtgttctacaagggggacgagtgcctgggcagcgggaagatcctgcggctggggccgtctgcctacacgctccagaagggccagcgcagagctgggatggccactgagagccccagtgacagcccagaagatggtccaggcctgagtcccttgctctgacagagatggatctgctagaaggaacctggagagcaggacccatggctgggcggctggtgagcagtccaggtgcccaagggccagcttgctgctgcccaaagcagaggaagccgggctggctgagggtccgaaaagcctgcaggggcccggcgagccccaggaagagcctcagctccaggctggggctctggctgctggagcatctgctggctggtggggtggcccgagttccccttcaccgcccccagggagggtttcccacctcagagtacaccgaggggacctgcagagggggctgtcgggacagcgtggaataaacattatttcaagg

SEQ ID NO: 195233 - DNA, 1793 bp, Homo sapiens
  Payload ID: 18551
  Gene Name: tRNA 5-methylaminomethyl-2-thiouridylate methyltransferase
  ENST ID: ENST00000441818
  CDS Start-End: 365-664
gccgagaggaggcctccaatggctggctggggggcttagaattttatttttggtttacagcgcagaagaagagcagtgaggccggggcgcgggtggggagggcaaggcggcggctcaaaaaaaaagccagcccctcgcggcccgacagagtctcggcgccccgcgggtcggtggagcctcaggggtgagcgcaggccggagacaggggaacccgccgcgggacaggggaaggccggacggaacgcgggtaagctgccgcagcttccggccgggccactagcgcggaccctacggccggggcgggacttccggcaaggcgcggaagcggcggtagctgcagctggcgaagttgggcgactggcggatgcaggccttgcggcacgtcgtgtgcgccctgtccggcggcgtggacagcgccgtggccgcgctgctgctgaggcggagaggttaccaggtgacaggggtgtttatgaagaactgggactcactggatgaacatggggtctgtactgccgacaaagactgtgaagatgcttacagagtttgccagatcttagacatccctttccatcaagtgtcctacgtaaaggagtattggaatgatgtgttcaggggcagatgccattgccacaggtcactatgcaagaacttccctggaagatgaagaagtctttgagcagaagcacgttaagaagcccgaagggcttttcagaaatcggtttgaagttagaaatggtttcccaggatgccctgaggagaaccatcttccctctggggggattaacgaaagagtttgtaaagaaaatcgctgctgagaatagacttcatcatgtgcttcagaagaaagagagcatgggcatgtgtttcatcgggaagaggaattttgaacatttccttcttcagtatctgcagcctcgacctggtcactttatttccatagaagacaataaggttctgggaacacataaaggttggttcctgtataccttgggccagagagcaaacataggtggcctgagagagccctggtacgtggtggagaaggacagcgtcaagggtgacgtgtttgtggccccccggacagaccacccagccctgtacagggacctgctgaggaccagccgcgtgcactggattgcggaggagcctcccgcagcactggtccgggacaagatgatggagtgccacttccgattccgccaccagatggcactagtgccctgtgtgctgaccctcaatcaagatggcaccgtgtgggtgacagctgtgcaggctgtgcgtgcccttgccacaggacagtttgctgtgttctacaagggggacgagtgcctgggcagcgggaagatcctgcggctggggccgtctgcctacacgctccagaagggccagcgcagagctgggatggccactgagagccccagtgacagcccagaagatggtccaggcctgagtcccttgctctgacagagatggatctgctagaaggaacctggagagcaggacccatggctgggcggctggtgagcagtccaggtgcccaagggccagcttgctgctgcccaaagcagaggaagccgggctggctgagggtccgaaaagcctgcaggggcccggcgagccccaggaagagcctcagctccaggctggggctctggctgctggagcatctgctggctggtggggtggcccgagttccccttcaccgcccccagggagggtttcccacctcagagtacaccgaggggacctgcagagggggctgtcgggacagcgtggaataaacattatttcaa

SEQ ID NO: 195234 - DNA, 1775 bp, Homo sapiens
  Payload ID: 18551
  Gene Name: tRNA 5-methylaminomethyl-2-thiouridylate methyltransferase
  ENST ID: ENST00000453630
  CDS Start-End: 341-640
ggctggggggcttagaattttatttttggtttacagcgcagaagaagagcagtgaggccggggcgcgggtggggagggcaaggcggcggctcaaaaaaaaagccagcccctcgcggcccgacagagtctcggcgccccgcgggtcggtggagcctcaggggtgagcgcaggccggagacaggggaacccgccgcgggacaggggaaggccggacggaacgcgggtaagctgccgcagcttccggccgggccactagcgcggaccctacggccggggcgggacttccggcaaggcgcggaagcggcggtagctgcagctggcgaagttgggcgactggcggatgcaggccttgcggcacgtcgtgtgcgccctgtccggcggcgtggacagcgccgtggccgcgctgctgctgaggcggagaggttaccaggtgacaggggtgtttatgaagaactgggactcactggatgaacatggggtctgtactgccgacaaagactgtgaagatgcttacagagtttgccagatcttagacatccctttccatcaagtgtcctacgtaaaggagtattggaatgatgtgttcaggggcagatgccattgccacaggtcactatgcaagaacttccctggaagatgaagaagtctttgagcagaagcacgttaagaagcccgaagggcttttcagaaatcggtttgaagttagaaatgccaggtttcccaggatgccctgaggagaaccatcttccctctggggggattaacgaaagagtttgtaaagaaaatcgctgctgagaatagacttcatcatgtgcttcagaagaaagagagcatgggcatgtgtttcatcgggaagaggaattttgaacatttccttcttcagtatctgcagcctcgacctggtcactttatttccatagaagacaataaggttctgggaacacataaaggttggttcctgtataccttgggccagagagcaaacataggtggcctgagagagccctggtacgtggtggagaaggacagcgtcaagggtgacgtgtttgtggccccccggacagaccacccagccctgtacagggacctgctgaggaccagccgcgtgcactggattgcggaggagcctcccgcagcactggtccgggacaagatgatggagtgccacttccgattccgccaccagatggcactagtgccctgtgtgctgaccctcaatcaagatggcaccgtgtgggtgacagctgtgcaggctgtgcgtgcccttgccacaggacagtttgctgtgttctacaagggggacgagtgcctgggcagcgggaagatcctgcggctggggccgtctgcctacacgctccagaagggccagcgcagagctgggatggccactgagagccccagtgacagcccagaagatggtccaggcctgagtcccttgctctgacagagatggatctgctagaaggaacctggagagcaggacccatggctgggcggctggtgagcagtccaggtgcccaagggccagcttgctgctgcccaaagcagaggaagccgggctggctgagggtccgaaaagcctgcaggggcccggcgagccccaggaagagcctcagctccaggctggggctctggctgctggagcatctgctggctggtggggtggcccgagttccccttcaccgcccccagggagggtttcccacctcagagtacaccgaggggacctgcagagggggctgtcgggacagcgtggaataaacattatttcaagg

SEQ ID NO: 195235 - DNA, 1882 bp, Homo sapiens
  Payload ID: 18551
  Gene Name: tRNA 5-methylaminomethyl-2-thiouridylate methyltransferase
  Uniprot ID: O75648
  ENST ID: ENST00000457572
  CDS Start-End: 341-841
ggctggggggcttagaattttatttttggtttacagcgcagaagaagagcagtgaggccggggcgcgggtggggagggcaaggcggcggctcaaaaaaaaagccagcccctcgcggcccgacagagtctcggcgccccgcgggtcggtggagcctcaggggtgagcgcaggccggagacaggggaacccgccgcgggacaggggaaggccggacggaacgcgggtaagctgccgcagcttccggccgggccactagcgcggaccctacggccggggcgggacttccggcaaggcgcggaagcggcggtagctgcagctggcgaagttgggcgactggcggatgcaggccttgcggcacgtcgtgtgcgccctgtccggcggcgtggacagcgccgtggccgcgctgctgctgaggcggagaggttaccaggtgacaggggtgtttatgaagaactgggactcactggatgaacatggggtctgtactgccgacaaagactgtgaagatgcttacagagtttgccagatcttagacatccctttccatcaagtgtcctacgtaaaggagtattggaatgatgtgttcagtgactttttgaatgagtatgaaaaaggaaggactcccaatcctgacatagtttgcaacaagcacatcaaatttagttgcttttttcattatgctgtggataatcttggggcagatgccattgccacaggtcactatgcaagaacttccctggaagatgaagaagtctttgagcagaagcacgttaagaagcccgaagggcttttcagaaatcggtttgaagttagaaatgccaggtttcccaggatgccctgaggagaaccatcttccctctggggggattaacgaaagagtttgtaaagaaaatcgctgctgagaatagacttcatcatgtgcttcagaagaaagagagcatgggcatgtgtttcatcgggaagaggaattttgaacatttccttcttcagtatctgcagcctcgacctggtcactttatttccatagaagacaataaggttctgggaacacataaaggttggttcctgtataccttgggccagagagcaaacataggtggcctgagagagccctggtacgtggtggagaaggacagcgtcaagggtgacgtgtttgtggccccccggacagaccacccagccctgtacagggacctgctgaggaccagccgcgtgcactggattgcggaggagcctcccgcagcactggtccgggacaagatgatggagtgccacttccgattccgccaccagatggcactagtgccctgtgtgctgaccctcaatcaagatggcaccgtgtgggtgacagctgtgcaggctgtgcgtgcccttgccacaggacagtttgctgtgttctacaagggggacgagtgcctgggcagcgggaagatcctgcggctggggccgtctgcctacacgctccagaagggccagcgcagagctgggatggccactgagagccccagtgacagcccagaagatggtccaggcctgagtcccttgctctgacagagatggatctgctagaaggaacctggagagcaggacccatggctgggcggctggtgagcagtccaggtgcccaagggccagcttgctgctgcccaaagcagaggaagccgggctggctgagggtccgaaaagcctgcaggggcccggcgagccccaggaagagcctcagctccaggctggggctctggctgctggagcatctgctggctggtggggtggcccgagttccccttcaccgcccccagggagggtttcccacctcagagtacaccgaggggacctgcagagggggctgtcgggacagcgtggaataaacattatttcaagg

SEQ ID NO: 195236 - DNA, 1688 bp, Homo sapiens
  Payload ID: 18551
  Gene Name: tRNA 5-methylaminomethyl-2-thiouridylate methyltransferase
  ENST ID: ENST00000456595
  CDS Start-End: 341-640
ggctggggggcttagaattttatttttggtttacagcgcagaagaagagcagtgaggccggggcgcgggtggggagggcaaggcggcggctcaaaaaaaaagccagcccctcgcggcccgacagagtctcggcgccccgcgggtcggtggagcctcaggggtgagcgcaggccggagacaggggaacccgccgcgggacaggggaaggccggacggaacgcgggtaagctgccgcagcttccggccgggccactagcgcggaccctacggccggggcgggacttccggcaaggcgcggaagcggcggtagctgcagctggcgaagttgggcgactggcggatgcaggccttgcggcacgtcgtgtgcgccctgtccggcggcgtggacagcgccgtggccgcgctgctgctgaggcggagaggttaccaggtgacaggggtgtttatgaagaactgggactcactggatgaacatggggtctgtactgccgacaaagactgtgaagatgcttacagagtttgccagatcttagacatccctttccatcaagtgtcctacgtaaaggagtattggaatgatgtgttcaggggcagatgccattgccacaggtcactatgcaagaacttccctggaagatgaagaagtctttgagcagaagcacgttaagaagcccgaagggcttttcagaaatcggtttgaagttagaaatggtttcccaggatgccctgaggagaaccatcttccctctggggggattaacgaaagagtttgtaaagaaaatcgctgctgagaatagacttcatcatgtgcttcagaagaaagagagcatgggcatgtgtttcatcgggaagaggaattttgaacatttccttcttcagtatctgcagcctcgacctggtcactttatttccatagaagacaataaggttctgggaacacataaaggttggttcctgtataccttgggccagagagcaaacataggtggcctgagagagccctggtacgtggtggagaaggacagcgtcaagggtgacgtgtttgtggccccccggacagaccacccagccctgtacagggacctgctgaggaccagccgcgtgcactggattgcggaggagcctcccgcagcactggtccgggacaagatgatggagtgccacttccgattccgccaccagatggcactagtttgctgtgttctacaagggggacgagtgcctgggcagcgggaagatcctgcggctggggccgtctgcctacacgctccagaagggccagcgcagagctgggatggccactgagagccccagtgacagcccagaagatggtccaggcctgagtcccttgctctgacagagatggatctgctagaaggaacctggagagcaggacccatggctgggcggctggtgagcagtccaggtgcccaagggccagcttgctgctgcccaaagcagaggaagccgggctggctgagggtccgaaaagcctgcaggggcccggcgagccccaggaagagcctcagctccaggctggggctctggctgctggagcatctgctggctggtggggtggcccgagttccccttcaccgcccccagggagggtttcccacctcagagtacaccgaggggacctgcagagggggctgtcgggacagcgtggaataaacattatttcaagg

SEQ ID NO: 195237 - DNA, 682 bp, Homo sapiens
  Payload ID: 18552
  Gene Name: tRNA aspartic acid methyltransferase 1
  ENST ID: ENST00000313936
  CDS Start-End: 1-682
aaagctgtatacctgcacaagtggtggctgccattgatgtcaacactgtcgctaatgaagtatacaagtataattttcctcacacacagttacttgccaagacgattgaaggcattacactcgaagagtttgacagattatcttttgatatgattttaatgagccctccctgccagccattcacaagagacctcttgatacaaacaatagaaaattgtggctttcagtaccaagagtttctattatctccaacctctcttggcattccaaattcaaggctacgatattttcttattgcaaagcttcagtcagagccattaccctttcaagcccctggtcaggtactgatggagttccccaaaattgaatctgtacatccacaaaaatatgcaatggatgtagaaaataaaattcaagaaaagaacgttgaaccaaatattagctttgatggcagcatacagtgttctggaaaagatgccattctttttaagcttgaaactgcagaagaaattcacaggaaaaatcaacaagatagtgatctctctgtgaaaatgctaaaagattttcttgaagatgacactgacgtgaaccagtatcttttaccaccaaagtcattgctgcgatatgctcttctgttagacattgttcagcccacttgtagaaggtccgtgtgctttaccaa

SEQ ID NO: 195238 - DNA, 8230 bp, Homo sapiens
  Payload ID: 18552
  Gene Name: tRNA aspartic acid methyltransferase 1
  ENST ID: ENST00000354631
  CDS Start-End: 39-248
aggcctagctccggggctgcggcggctgaggcgcggggatggagcccctgcgggtgctggagctatacagcggcgtgggcggcatgcaccacgcgctgagagaaagctgtatacctgcacaagtggtggctgccattgatgtcaacactgtcgctaatgaagtatacaagtataattttcctcacacacagttacttgccaagacgattgaaaaaaggagcaacacagcacagttttcagctacttagcccattaggaattcttttgatgcatcttgtcaacagtcatttgaagttcattgcacacaactgcaaaacaaaataattgtggatatctgagaatgaggcccttttccatttgataatatattaacagatgtatatgaaagggatggtgactggtctgcatatcacatttgctaaataaagaacattattgacagggcattacactcgaagagtttgacagattatcttttgatatgattttaatgagccctccctgccagccattcacaaggattggccggcagggtgatatgactgattcaaggacgaatagcttcttacatattctagatattctcccaagattacaaaaattaccaaagtatattcttttggaaaatgttaaaggttttgaagtatcttctacaagagacctcttgatacaaacaatagaaaattgtggctttcagtaccaagagtttctattatctccaacctctcttggcattccaaattcaaggctacgatattttcttattgcaaagcttcagtcagagccattaccctttcaagcccctggtcaggtactgatggagttccccaaaattgaatctgtacatccacaaaaatatgcaatggatgtagaaaataaaattcaagaaaagaacgttgaaccaaatattagctttgatggcagcatacagtgttctggaaaagatgccattctttttaagcttgaaactgcagaagaaattcacaggaaaaatcaacaagatagtgatctctctgtgaaaatgctaaaagattttcttgaagatgacactgacgtgaaccagtatcttttaccaccaaagtcattgctgcgatatgctcttctgttagacattgttcagcccacttgtagaaggtccgtgtgctttaccaaaggatatggaagctacatagaagggacagggtctgtgttacagactgcagaggatgtgcaggttgagaatatctacaaatcccttaccaatttgtcacaagaagaacagataacaaagctgttaatacttaaactgcgatatttcactcctaaagaaatagcaaatctccttggatttcctccagagttcggatttcctgagaagataacagtgaaacagcgttatcgcctacttggaaatagtctcaacgtgcatgtagtagctaaactaatcaaaatcttatatgaataattttgaaataactctgaaagatggtcatatgatattccttcattttcagagagtaattctgaaattctgttttgaactaattctggtgaaatttaactaaattattttaatctgtccttattaagaaatttggattttattaaaaaaatccatgtgtttcatcaaatttatattactgtattttataaaatacgaactattgttatgctttatggagagtatattttcatatgaaactgataaatatatatgtggaatattctttttaaaaacaattttataaacaaatcaaggagcactagagctttagtgtctacatgagtatcttgtgaagtgtcataacaggcataacatatttttatgttaattaaagaagttttttatttctaattttaaaataatgattctaattctagcccattgaatgttttacttaatttccaatcctgtaaatatttctttatttcatctaaacaaatgcatatgatatgtaaaccaaattatcatcattcagtttatacagcagactgaagaatatgtcaggaaaaataatcctaaatgtttgattacctctccatgaagcggccacagaaactgttggtgcacattatctacattttcctcagcctctatctgaaggacaaaactcatttttccttcttcattttgtatgtactttcctttagttgactattatcaaagcttgtttttgtcttctcagcttctgagttgaatttgcctttgcacgctgaggaatgtagcatgacgttaagatttcagggaggaagctgccctctgatcccatgtcatatgacagtactcccctccccccagttgttctttattgtagcaacatacactctcaatgaacttttatgacttttaactttctctgtctctcttcctcagcagacctcttggaattagggtttctaatcaaactaagtcttgcatcataaattctatggtttgtgataaaagcaagtgacaaagagaagagagatgaaaagaaacaagtccagaaatcatattacaagattttaattcaaatttttcttcttaaaaatcagctatttagaggtggataaattggaagtttgtgcattgcttgtgggaacgtaaaatggttcagctgctgttggaaaacgctatggaggttcgtcacaaaattcaacatagaattaccctatgattcagcgattccacctctggctatagatccaaaagaattgaaagcagggacttgaacagatatttgtacaccagcgtttataacaccattatttacagtagccaaaaggtagaagcagcccaagtgtcatcccattcacccatgaatggatgcaggaattgtgttccgtgcatgcagtggaatagtaccagccttccgcaggaaggaaattctgacatatgcggtgacatggatgaaccttgagtacattatgcgaagtgaaataagccaccctgtggggatggagaatgggtagttagtgcataatggatacaaagtttctgattggggtgatgagaaagttctggaggtggatggggaggatggttgcacaacagtgtgagtgtacttaatgccactgcaactgtatatttaaaaatagttaaaatgataaattttacattatgtatattttactgcaattgaaaaaatcatactctattaccaatttttcagaactcatagataaatatgaatgtagggaagctgtaagccagcccatatacagaaactatcactatctacatttttcatatgtgttcagacagagcctattacaagtctcataaatttcagtaaacaatcacaaattattttggcacactttcatgtaggttctgttcactgctgaaatattctaaataaaatggtttagagttttactgtaactatgaataattatgctataattatagtatcccacattcggttgagcaacattatacaaaataagtgtcgagttactgtgcaccaactataaatacttgaaaggtctgtagagacatttgcttacaaactggtagacagaatgtagcttagtggaattcttaaattatgggaatgtattcacaggaagacggtgattcttgcccttaattcataattgaaaatatgcagtaacaagcataaaactcacatcttaatgaagatgtatctaccagtgtcattcaattagcagatgtatatgtatgcataattaatttggaaaatgttattttatggaatgtctgctatatgcttttggtaataatgctgtatataaaatttgcactggaaattctgtttcctgatatttggacttgtacatttattcagatgttggaaaacatagcttctcattttcaggagaactatgtgtaattcagtcttcaccataccttacagtaaaccgatttttcgttctccttttcccatcatccctgctcttttaaacggcttgccagataattgtaaggtatttattaccctgcttcatatttttagtatgtcttcaggatccaaaactaattctaagagatgaccaaatcaattaatgtaaacaaaatgagtcatagttggaaaatgatttcgaagaggtgggtagtcattgtaggaggggtcagagcctgacaatcctcagtggcaggcaagaaagaggaatgatggcatcaccttcacagaggaccctggccatggtgttctgtctgtgaaatcagaccttcaccatgggcactgccctatgtctggaaagatgagaaaatacctccaaccttcagccaacttattcttcctcaaaaaggagagccttctaaagaggcaaaaacagtagttgaaattgtgaacagtgagggtccacccagcacttttttagaaatttgagggtaaactgttgcttgaaattatccaacttttcaaagaggtaaagttatttagtagagaggcttttaagttgccctgaaaggctgtattgctaccatgtgggatgtaaaattggatggggttagagatgagtgcaggcaattcaacgcattggtaggggtggaagttctcagcagaaatcaccatctgggtttttgctcccatctcaacctagttgaggtctagagtgattaagctggagacttctgaggagagagaaatgaactaaagataaatacaactgatttaattttagccatagcagaacagaacaaagaagcaaccacatttcatctaatatcaagcacctactaaaggatgcattctgcaggccagctgcatctgcatccaaaccaaagtcactctggttgctcttttgctttgataacttaagagtttagaaacaagcggtttctaaaaaagccaagataacacaataaggaccaaattttaatcccacatagacaaagagattaaagtgggttttcctgaattgcttatgttatgaacaggttaccttgtcataatttggccttcggcttgggattctaactgttttaggccaccagttatgacactgacttactaatagctttggactttgaaactgtgtgagggtcatatagcctcagcagttttcttgtagcctgtgattgcattgagattatataatttttaaagacatggcctttggacctctgtctactagttaatctcttccatctaccattcaaatgtgctatatacaactatcatatcagcttcttagcaagcacttttctggacctctgtcacacccaccaagatgtctagttatgcctttcatttgagagtttccctttgctgttttttttgttttgttttgttttgttttgttttgtttttgagactgagtctcgctctgttgcctaggctggagtgcagtggcgtgatctcggctcactgcaatctccccctcctgggttaaagtgattttcctgcctcagcctccctagtagctgggattacaggcgcatgccaccacacctagctaatttttgtattagtagagatcgggtttcaccatgttggccaggctggtctcgaacacctgacctcaagttaatccacccaccttggcttccctaagtgctgggttttacaggcatgagccaccacgcccagcctccctttgcatgttttttaaaaaggcattaagcatcttgcacatgttctttagtttcagtttgcatgagtcaacctgtgtgcatcattttccctttcactatttcttgtctttgctggtgaaattttaaagcttcagtttaaaaaaaaaaagaaaaagtattttttgttgttgttgtttctagcttccgtttctctctttaggctgtctaggaacattttaaggtactcatgctcttcaaaatcttacacaatcaagatccaaactccatcaccattcatgtcttagcttgtgaatttatttctttttaaatatatttgttcaagaaatatgagcatgtacaatgagctgttttggctttgtattccccaagttctcatatacattggctttatatttaccatagattctgagtcttactttcagccacatccagcacttactgaagtctccctcaagtacaccacacttgactcctaaagcttccaaaatctcatttttcctataaatatgagaccggaaattttcacaaaaattacaagataggaactgagttctcccatagaactcttttctgaataagcctagggttttttcatttctttgcttgtacctagcatggcttcagtgtttacttcaaatatttgctctgtattttgtttgcattttgatttctatttttatcaggacagattgaaattataagagtgtacatagagaacatgtttgtttagctaaattagctctataatcagatgagatcacctagagggtcagaggatgagagtgaaagagagaaagagaaaaagaagagcagaggcttggagctgacttatctgaaggttccgtcctcaggtctctttctacccttcacttttcatgccatttttcttagagattctcaccctttcctacaacttcagccattttgccgatgacacccagatgactctaaatctgctgttttcctaagtcctattctagaatcttcatgctgggacatttttaacttggatatcttgctattcaagttgtatcggatttgcatcaaatttagcatgcttgcaacctaagcacactccattctatagtcagttccactcttgactttaatatttatggtacggttagtctccacatcttccaagttcaagcttcataaccaaagatcatcttcaccttccttctcactctgcattccattggtcagcttctgttaaaatggccttcctaaggcaggcctctgaacgatcatttatttttaggaaaacttataaaaagtcactgagatttaaaaacacccacacatatatttgcaatcatatttgtgtgcttggttaaacatgtcaacatttaacagatttgagccttctaaatttaatccagcatgaatgtcgtttttactaaaatatttgctattttactcacttagctggttccttacacaagtccagttaaatttcacatgtgaaaaaaatgactgaaaacactgaatggaatgtgatactccttgtgtagtagaaatgagttgactttcatatttaagagctgatcctatgaatgagtagacaataagctgaatagctgttacgatctgagttttaaaaatggaaaatgtttcatgttttagagaatgtaaacttccacaagggcagagattgttaatacgttgtccccccagtgacttaaaacagtactggcacatagtaagcactcaataaatagttgttgaatgagtgaatgtaggaaccatactggaatcaatattgaagctacatagaaagcaccacactgtggagttcaaacaatgtctttaagttgttctcttgaaaactatttaatttgtctgttactgccacttcttccatgcccagaggaacagccaaagttactcaagtctggaacacatgatttaaaaaataattctgggataggcttttggcttttggaaagtagcgcaaataaaactttttaaaatactgtattctgacttctggtcttgacaagagagtgtagatttatttctccctgctcctccctgaaaagtgtaattataaactctgggtaagtataattataaaataatgcaagaggaatcagaaggagaattctgaaaggtgggaccaggaagacacactgcggagggaccccaagactagaggaacaacatggttccaagacatctgacccctcacccaacagaggaaggttacccaggcttgatgtttcccgacctacaaccacacaatagaagacagcccagagaggctcgttcctacagaagagggaactgaagtctggtcggtaataccagatgagtctggctctaccagcacgggggtatatcaggaatcccactgacaaacatccagacctgagacttgtcttttgtgctgagagatgagcatccaggggcctctggcaaaaagcatctaacccaggaagattttttattaccctgagcctgagactcccttctcccagagataccatgggacctggcttgggagaaaatccttctttccctaaagtagcatcatgaaggaccattcgggaaccccagcagcaccagataaaccaagcagaccaaaataacactgcaaaggctttaaaaactaaattaccactggactcatagcccacaaaaactaagccagggcttgcatgctaaacacaaatggagtgactgcctactaaaaataaaagattaaaa

SEQ ID NO: 195239 - DNA, 3527 bp, Homo sapiens
  Payload ID: 18552
  Gene Name: tRNA aspartic acid methyltransferase 1
  Uniprot ID: O14717
  ENST ID: ENST00000377799
  CDS Start-End: 49-1224
acggaccggcaggcctagctccggggctgcggcggctgaggcgcggggatggagcccctgcgggtgctggagctatacagcggcgtgggcggcatgcaccacgcgctgagagaaagctgtatacctgcacaagtggtggctgccattgatgtcaacactgtcgctaatgaagtatacaagtataattttcctcacacacagttacttgccaagacgattgaaggcattacactcgaagagtttgacagattatcttttgatatgattttaatgagccctccctgccagccattcacaaggattggccggcagggtgatatgactgattcaaggacgaatagcttcttacatattctagatattctcccaagattacaaaaattaccaaagtatattcttttggaaaatgttaaaggttttgaagtatcttctacaagagacctcttgatacaaacaatagaaaattgtggctttcagtaccaagagtttctattatctccaacctctcttggcattccaaattcaaggctacgatattttcttattgcaaagcttcagtcagagccattaccctttcaagcccctggtcaggtactgatggagttccccaaaattgaatctgtacatccacaaaaatatgcaatggatgtagaaaataaaattcaagaaaagaacgttgaaccaaatattagctttgatggcagcatacagtgttctggaaaagatgccattctttttaagcttgaaactgcagaagaaattcacaggaaaaatcaacaagatagtgatctctctgtgaaaatgctaaaagattttcttgaagatgacactgacgtgaaccagtatcttttaccaccaaagtcattgctgcgatatgctcttctgttagacattgttcagcccacttgtagaaggtccgtgtgctttaccaaaggatatggaagctacatagaagggacagggtctgtgttacagactgcagaggatgtgcaggttgagaatatctacaaatcccttaccaatttgtcacaagaagaacagataacaaagctgttaatacttaaactgcgatatttcactcctaaagaaatagcaaatctccttggatttcctccagagttcggatttcctgagaagataacagtgaaacagcgttatcgcctacttggaaatagtctcaacgtgcatgtagtagctaaactaatcaaaatcttatatgaataattttgaaataactctgaaagatggtcatatgatattccttcattttcagagagtaattctgaaattctgttttgaactaattctggtgaaatttaactaaattattttaatctgtccttattaagaaatttggattttattaaaaaaatccatgtgtttcatcaaatttatattactgtattttataaaatacgaactattgttatgctttatggagagtatattttcatatgaaactgataaatatatatgtggaatattctttttaaaaacaattttataaacaaatcaaggagcactagagctttagtgtctacatgagtatcttgtgaagtgtcataacaggcataacatatttttatgttaattaaagaagttttttatttctaattttaaaataatgattctaattctagcccattgaatgttttacttaatttccaatcctgtaaatatttctttatttcatctaaacaaatgcatatgatatgtaaaccaaattatcatcattcagtttatacagcagactgaagaatatgtcaggaaaaataatcctaaatgtttgattacctctccatgaagcggccacagaaactgttggtgcacattatctacattttcctcagcctctatctgaaggacaaaactcatttttccttcttcattttgtatgtactttcctttagttgactattatcaaagcttgtttttgtcttctcagcttctgagttgaatttgcctttgcacgctgaggaatgtagcatgacgttaagatttcagggaggaagctgccctctgatcccatgtcatatgacagtactcccctccccccagttgttctttattgtagcaacatacactctcaatgaacttttatgacttttaactttctctgtctctcttcctcagcagacctcttggaattagggtttctaatcaaactaagtcttgcatcataaattctatggtttgtgataaaagcaagtgacaaagagaagagagatgaaaagaaacaagtccagaaatcatattacaagattttaattcaaatttttcttcttaaaaatcagctatttagaggtggataaattggaagtttgtgcattgcttgtgggaacgtaaaatggttcagctgctgttggaaaacgctatggaggttcgtcacaaaattcaacatagaattaccctatgattcagcgattccacctctggctatagatccaaaagaattgaaagcagggacttgaacagatatttgtacaccagcgtttataacaccattatttacagtagccaaaaggtagaagcagcccaagtgtcatcccattcacccatgaatggatgcaggaattgtgttccgtgcatgcagtggaatagtaccagccttccgcaggaaggaaattctgacatatgcggtgacatggatgaaccttgagtacattatgcgaagtgaaataagccaccctgtggggatggagaatgggtagttagtgcataatggatacaaagtttctgattggggtgatgagaaagttctggaggtggatggggaggatggttgcacaacagtgtgagtgtacttaatgccactgcaactgtatatttaaaaatagttaaaatgataaattttacattatgtatattttactgcaattgaaaaaatcatactctattaccaatttttcagaactcatagataaatatgaatgtagggaagctgtaagccagcccatatacagaaactatcactatctacatttttcatatgtgttcagacagagcctattacaagtctcataaatttcagtaaacaatcacaaattattttggcacactttcatgtaggttctgttcactgctgaaatattctaaataaaatggtttagagttttactgtaactatgaataattatgctataattatagtatcccacattcggttgagcaacattatacaaaataagtgtcgagttactgtgcaccaactataaatacttgaaaggtctgtagagacatttgcttacaaactggtagacagaatgtagcttagtggaattcttaaattatgggaatgtattcacaggaagacggtgattcttgcccttaattcataattgaaaatatgcagtaacaagcataaaactcacatcttaatgaagatgtatctaccagtgtcattcaattagcagatgtatatgtatgcataattaatttggaaaatgttattttatggaatgtctgctatatgcttttggtaataatgctgtatataaaatttgcactggaaattctgtttcctgata

SEQ ID NO: 195240 - DNA, 333 bp, Homo sapiens
  Payload ID: 18552
  Gene Name: tRNA aspartic acid methyltransferase 1
  ENST ID: ENST00000424636
  CDS Start-End: 1-162
gcgctgagagaaagctgtatacctgcacaagtggtggctgccattgatgtcaacactgtcgctaatgaagtatacaagtataattttcctcacacacagttacttgccaagacgattgaaattacaaaaattaccaaagtatattcttttggaaaatgttaaaggttttgaagtatcttctacaagagacctcttgatacaaacaatagaaaattgtggctttcagtaccaagagtttctattatctccaacctctcttggcattccaaattcaaggctacgatattttcttattgcaaagcttcagtcagagccattaccctttcaagcccc

SEQ ID NO: 195241 - DNA, 257 bp, Homo sapiens
  Payload ID: 18552
  Gene Name: tRNA aspartic acid methyltransferase 1
  ENST ID: ENST00000436968
  CDS Start-End: 1-257
aaagctgtatacctgcacaagtggtggctgccattgatgtcaacactgtcgctaatgaagtatacaagtataattttcctcacacacagttacttgccaagacgattgaaagacctcttgatacaaacaatagaaaattgtggctttcagtaccaagagtttctattatctccaacctctcttggcattccaaattcaaggctacgatattttcttattgcaaagcttcagtcagagccattaccctttcaagcccc

SEQ ID NO: 195242 - DNA, 1374 bp, Homo sapiens
  Payload ID: 18552
  Gene Name: tRNA aspartic acid methyltransferase 1
  Uniprot ID: O14717
  ENST ID: ENST00000495022
  CDS Start-End: 218-409
attcgggaagccttattgttttccgtcctttgttcccctctagacccttgccaatccccaggccgcgaggccctctgaagccctgagcctggagcggtaggagacgggggaactgaaacgccgcggaaccagaggctgagggagcggcgcgatggagggaggaggagcgacggaccggcaggcctagctccggggctgcggcggctgaggcgcggggatggagcccctgcgggtgctggagctatacagcggcgtgggcggcatgcaccacgcgctgagagaaagctgtatacctgcacaagtggtggctgccattgatgtcaacactgtcgctaatgaagtatacaagtataattttcctcacacacagttacttgccaagacgattgaagattggccggcagggtgatatgactgattcaaggacgaatagcttcttacatattctagatattctcccaagagacctcttgatacaaacaatagaaaattgtggctttcagtaccaagagtttctattatctccaacctctcttggcattccaaattcaaggctacgatattttcttattgcaaagcttcagtcagagccattaccctttcaagcccctggtcaggtactgatggagttccccaaaattgaatctgtacatccacaaaaatatgcaatggatgtagaaaataaaattcaagaaaagaacgttgaaccaaatattagctttgatggcagcatacagtgttctggaaaagatgccattctttttaagcttgaaactgcagaagaaattcacaggaaaaatcaacaagatagtgatctctctgtgaaaatgctaaaagattttcttgaagatgacactgacgtgaaccagtatcttttaccaccaaagtcattgctgcgatatgctcttctgttagacattgttcagcccacttgtagaaggtccgtgtgctttaccaaaggatatggaagctacatagaagggacagggtctgtgttacagactgcagaggatgtgcaggttgagaatatctacaaatcccttaccaatttgtcacaagaagaacagataacaaagctgttaatacttaaactgcgatatttcactcctaaagaaatagcaaatctccttggatttcctccagagttcggatttcctgagaagataacagtgaaacagcgttatcgcctacttggaaatagtctcaacgtgcatgtagtagctaaactaatcaaaatcttatatgaataattttgaaataactctgaaagatggtcatatgatattccttcattttcagagagtaattctgaaattctgttttgaactaattctggtgaaatttaactaaattattttaatctgtccttattaa

SEQ ID NO: 195243 - DNA, 1301 bp, Homo sapiens
  Payload ID: 18552
  Gene Name: tRNA aspartic acid methyltransferase 1
  ENST ID: ENST00000488990
  CDS Start-End: 24-788
gctgcggcggctgaggcgcggggatggagcccctgcgggtgctggagctatacagcggcgtgggcggcatgcaccacgcgctgagagaaagctgtatacctgcacaagtggtggctgccattgatgtcaacactgtcgctaatgaagtatacaagtataattttcctcacacacagttacttgccaagacgattgaagtactgatggagttccccaaaattgaatctgtacatccacaaaaatatgcaatggatgtagaaaataaaattcaagaaaagaacgttgaaccaaatattagctttgatggcagcatacagtgttctggaaaagatgccattctttttaagcttgaaactgcagaagaaattcacaggaaaaatcaacaagatagtgatctctctgtgaaaatgctaaaagattttcttgaagatgacactgacgtgaaccagtatcttttaccaccaaagtcattgctgcgatatgctcttctgttagacattgttcagcccacttgtagaaggtccgtgtgctttaccaaaggatatggaagctacatagaagggacagggtctgtgttacagactgcagaggatgtgcaggttgagaatatctacaaatcccttaccaatttgtcacaagaagaacagataacaaagctgttaatacttaaactgcgatatttcactcctaaagaaatagcaaatctccttggatttcctccagagttcggtatgtgggatacgtgcagaattcagctttcatgtattaaaactctcaaaaatctttagggacttgtgtgtctaggacttgcctaaacaaatgggctcaagaaacctctttcctttcctgatcatgccatttatggcatctttctgccctctttcccctcataactgcctcattcggttctctactgactcattctccccctctctaactccagtagtgggtcacagaggttggcatggctagaagggtcacattggcaactccttgcctctttccacagatggctgtgcatagcatcccctttccagcttattttcttttccagaggtcctctcctaatcaccccacactagagcttgtgaaagaatgctttcgattggctttttataaattaaaaggcagttgagggattattttcgaagggtgggggtgtattggtatttattctcctcagagatacacctgtgtcagctgtgtgcccctatccttccctacaaggggtaggtggagaaagaggaggtggagaggctgtctaggaaggagctttcataatggaatgaaagggggactca

SEQ ID NO: 195244 - DNA, 410 bp, Homo sapiens
  Payload ID: 18552
  Gene Name: tRNA aspartic acid methyltransferase 1
  ENST ID: ENST00000525762
  CDS Start-End: 1-410
gcgctgagagaaagctgtatacctgcacaagtggtggctgccattgatgtcaacactgtcgctaatgaagtatacaagtataattttcctcacacacagttacttgccaagacgattgaaggcattacactcgaagagtttgacagattatcttttgatatgattttaatgagccctccctgccagccattcacaagattacaaaaattaccaaagtatattcttttggaaaatgttaaaggttttgaagtatcttctacaagagacctcttgatacaaacaatagaaaattgtggctttcagtaccaagagtttctattatctccaacctctcttggcattccaaattcaaggctacgatattttcttattgcaaagcttcagtcagagccattaccctttcaagcccc

SEQ ID NO: 195245 - DNA, 2112 bp, Homo sapiens
  Payload ID: 18553
  Gene Name: tRNA isopentenyltransferase 1
  Uniprot ID: Q9H3H1
  ENST ID: ENST00000316891
  CDS Start-End: 16-1419
gcagactgccataagatggcgtccgtggcggctgcacgagcagttcccgtgggcagtgggctcaggggcctgcaacggaccctacctcttgtagtgattctcggggccacgggcaccggcaaatccacgctggcgttgcagctaggccagcggctcggcggtgagatcgtcagcgctgactccatgcaggtctatgaaggcctagacatcatcaccaacaaggtttctgcccaagagcagagaatctgccggcaccacatgatcagctttgtggatcctcttgtgaccaattacacagtggtggacttcagaaatagagcaactgctctgattgaagatatatttgcccgagacaaaattcctattgttgtgggaggaaccaattattacattgaatctctgctctggaaagttcttgtcaataccaagccccaggagatgggcactgagaaagtgattgaccgaaaagtggagcttgaaaaggaggatggtcttgtacttcacaaacgcctaagccaggtggacccagaaatggctgccaagctgcatccacatgacaaacgcaaagtggccaggagcttgcaagtttttgaagaaacaggaatctctcatagtgaatttctccatcgtcaacatacggaagaaggtggtggtccccttggaggtcctctgaagttctctaacccttgcatcctttggcttcatgctgaccaggcagttctagatgagcgcttggataagagggtggatgacatgcttgctgctgggctcttggaggaactaagagattttcacagacgctataatcagaagaatgtttcggaaaatagccaggactatcaacatggtatcttccaatcaattggcttcaaggaatttcacgagtacctgatcactgagggaaaatgcacactggagactagtaaccagcttctaaagaaaggtattgaggctctgaaacaagtaactaagagatatgcccggaaacaaaaccgatgggttaaaaaccgttttttgagcagacctggtcccattgtcccccctgtctatggcttagaggtatctgatgtctcgaagtgggaagagtctgttcttgaacctgctcttgaaatcgtgcaaagtttcatccagggccacaagcctacagccactccaataaagatgccatacaatgaagctgagaacaagagaagttatcacctgtgtgacctctgtgatcgaatcatcattggggatcgcgaatgggcagcgcacataaaatccaaatcccacttgaaccaactgaagaaaagaagaagattggactcagatgctgtcaacaccatagaaagtcagagtgtttccccagaccataacaaagaacctaaagagaagggatccccagggcagaatgatcaagagctgaaatgcagcgtttaagagacatgtccagtggcctttggaaaggtggtggggatccagttcaggagggaggggtatgtttgtctcccagtctgggcaaaggagtgctatgcggaattctctgcatagcagaaaagctcccaccattttcttttgatgtggttttaaagtctcacgttctctataatagaaacagcaggtcttgtcagctccttgtgtggctgatgtgtctggaaatgatgtagttcaggaaagcattttttttttctttgaaccttaaaggttctattattaaaagcagcacagattccacatttttatacatgaggatcttctttgtggtgaataccaggattgactgcatccctttaaagaagttttatgtccctgactctggctaaaattatctaatttccagatgcttttgtagatgactgaagtatttgtgagccacatattgggagttctagatttgagtgaatggcaggaaagggccatctccattgagatgattaagtgaaccaaactagttctcagaattctacagagaaggagggaatcagactgaggaagctgtgacataggacttgaagaccaaagactttgaaatttgcgagctgctcatgtgtgagttattatcactgctgtctttctattgagttacaaatctatatttttattgaagtttaaataaagaaaaaatttacaaga

SEQ ID NO: 195246 - DNA, 2034 bp, Homo sapiens
  Payload ID: 18553
  Gene Name: tRNA isopentenyltransferase 1
  Uniprot ID: Q9H3H1
  ENST ID: ENST00000372818
  CDS Start-End: 16-1341
gcagactgccataagatggcgtccgtggcggctgcacgagcagttcccgtgggcagtgggctcaggggcctgcaacggaccctacctcttgtagtgattctcggggccacgggcaccggcaaatccacgctggcgttgcagctaggccagcggctcggcggtgagatcgtcagcgctgactccatgcaggtctatgaaggcctagacatcatcaccaacaaggtttctgcccaagagcagagaatctgccggcaccacatgatcagctttgtggatcctcttgtgaccaattacacagtggtggacttcagaaatagagcaactgctctgattgaagatatatttgcccgagacaaaattcctattgttgtgggaggaaccaattattacattgaatctctgctctggaaagttcttgtcaataccaagccccaggagatgggcactgagaaagtgattgaccgaaaagtggagcttgaaaaggaggatggtcttgtacttcacaaacgcctaagccaggtggacccagaaatggctgccaagctgcatccacatgacaaacgcaaagtggccaggagcttgcaagtttttgaagaaacaggaatctctcatagtgaatttctccatcgtcaacatacggaagaaggtggtggtccccttggaggtcctctgaagttctctaacccttgcatcctttggcttcatgctgaccaggcagttctagatgagcgcttggataagagggtggatgacatgcttgctgctgggctcttggaggaactaagagattttcacagacgctataatcagaagaatgtttcggaaaatagccaggactatcaacatggtatcttccaatcaattggcttcaaggaatttcacgagtacctgatcactgagggaaaatgcacactggagactagtaaccagcttctaaagaaaggacctggtcccattgtcccccctgtctatggcttagaggtatctgatgtctcgaagtgggaagagtctgttcttgaacctgctcttgaaatcgtgcaaagtttcatccagggccacaagcctacagccactccaataaagatgccatacaatgaagctgagaacaagagaagttatcacctgtgtgacctctgtgatcgaatcatcattggggatcgcgaatgggcagcgcacataaaatccaaatcccacttgaaccaactgaagaaaagaagaagattggactcagatgctgtcaacaccatagaaagtcagagtgtttccccagaccataacaaagaacctaaagagaagggatccccagggcagaatgatcaagagctgaaatgcagcgtttaagagacatgtccagtggcctttggaaaggtggtggggatccagttcaggagggaggggtatgtttgtctcccagtctgggcaaaggagtgctatgcggaattctctgcatagcagaaaagctcccaccattttcttttgatgtggttttaaagtctcacgttctctataatagaaacagcaggtcttgtcagctccttgtgtggctgatgtgtctggaaatgatgtagttcaggaaagcattttttttttctttgaaccttaaaggttctattattaaaagcagcacagattccacatttttatacatgaggatcttctttgtggtgaataccaggattgactgcatccctttaaagaagttttatgtccctgactctggctaaaattatctaatttccagatgcttttgtagatgactgaagtatttgtgagccacatattgggagttctagatttgagtgaatggcaggaaagggccatctccattgagatgattaagtgaaccaaactagttctcagaattctacagagaaggagggaatcagactgaggaagctgtgacataggacttgaagaccaaagactttgaaatttgcgagctgctcatgtgtgagttattatcactgctgtctttctattgagttacaaatctatatttttattgaagtttaaataaagaaaaaatttacaaga

SEQ ID NO: 195247 - DNA, 1851 bp, Homo sapiens
  Payload ID: 18553
  Gene Name: tRNA isopentenyltransferase 1
  Uniprot ID: Q9H3H1
  ENST ID: ENST00000441669
  CDS Start-End: 1-1158
atggcgtccgtggcggctgcacgagcagttcccgtgggcagtgggctcaggggcctgcaacggaccctacctcttgtagtgattctcggggccacgggcaccggcaaatccacgctggcgttgcagctaggccagcggctcggcggtgagatcgtcagcgctgactccatgcagccccaggagatgggcactgagaaagtgattgaccgaaaagtggagcttgaaaaggaggatggtcttgtacttcacaaacgcctaagccaggtggacccagaaatggctgccaagctgcatccacatgacaaacgcaaagtggccaggagcttgcaagtttttgaagaaacaggaatctctcatagtgaatttctccatcgtcaacatacggaagaaggtggtggtccccttggaggtcctctgaagttctctaacccttgcatcctttggcttcatgctgaccaggcagatgagcgcttggataagagggtggatgacatgcttgctgctgggctcttggaggaactaagagattttcacagacgctataatcagaagaatgtttcggaaaatagccaggactatcaacatggtatcttccaatcaattggcttcaaggaatttcacgagtacctgatcactgagggaaaatgcacactggagactagtaaccagcttctaaagaaaggtattgaggctctgaaacaagtaactaagagatatgcccggaaacaaaaccgatgggttaaaaaccgttttttgagcagacctggtcccattgtcccccctgtctatggcttagaggtatctgatgtctcgaagtgggaagagtctgttcttgaacctgctcttgaaatcgtgcaaagtttcatccagggccacaagcctacagccactccaataaagatgccatacaatgaagctgagaacaagagaagttatcacctgtgtgacctctgtgatcgaatcatcattggggatcgcgaatgggcagcgcacataaaatccaaatcccacttgaaccaactgaagaaaagaagaagattggactcagatgctgtcaacaccatagaaagtcagagtgtttccccagaccataacaaagaacctaaagagaagggatccccagggcagaatgatcaagagctgaaatgcagcgtttaagagacatgtccagtggcctttggaaaggtggtggggatccagttcaggagggaggggtatgtttgtctcccagtctgggcaaaggagtgctatgcggaattctctgcatagcagaaaagctcccaccattttcttttgatgtggttttaaagtctcacgttctctataatagaaacagcaggtcttgtcagctccttgtgtggctgatgtgtctggaaatgatgtagttcaggaaagcattttttttttctttgaaccttaaaggttctattattaaaagcagcacagattccacatttttatacatgaggatcttctttgtggtgaataccaggattgactgcatccctttaaagaagttttatgtccctgactctggctaaaattatctaatttccagatgcttttgtagatgactgaagtatttgtgagccacatattgggagttctagatttgagtgaatggcaggaaagggccatctccattgagatgattaagtgaaccaaactagttctcagaattctacagagaaggagggaatcagactgaggaagctgtgacataggacttgaagaccaaagactttgaaatttgcgagctgctcatgtgtgagttattatcactgctgtctttctattgagttacaaatctatatttttattgaagtttaaataaagaaaaaatttacaaga

SEQ ID NO: 195248 - DNA, 2026 bp, Homo sapiens
  Payload ID: 18553
  Gene Name: tRNA isopentenyltransferase 1
  Uniprot ID: Q9H3H1
  ENST ID: ENST00000537440
  CDS Start-End: 813-1304
agactgccataagatggcgtccgtggcggctgcacgagcagttcccgtgggcagtgggctcaggggcctgcaacggaccctacctcttgtagtgattctcggggccacgggcaccggcaaatccacgctggcgttgcagctaggccagcggctcggcggtgagatcgtcagcgctgactccatgcaggtctatgaaggcctagacatcatcaccaacaaggtttctgcccaagagcagagaatctgccggcaccacatgatcagctttgtggatcctcttgtgaccaattacacagtggtggacttcagaaatagagcaactgctctgattgaagatatatttgcccgagacaaaattcctattgttgtgggaggaaccaattattacattgaatctctgctctggaaagttcttgtcaataccaagccccaggagatgggcactgagaaagtgattgaccgaaaagtggagcttgaaaaggaggatggtcttgtacttcacaaacgcctaagccaggtggacccagaaatggctgccaagctgcatccacatgacaaacgcaaagtggccaggagcttgcaagtttttgaagaaacaggaatctctcatagtgaatttctccatcgtcaacatacggaagaaggtggtggtccccttggaggtcctctgaagttctctaacccttgcatcctttggcttcatgctgaccaggcagttctagatgagcgcttggataagagggtggatgacatgcttgctgctgggctcttggaggaactaagagattttcacagacgctataatcagaagaatgtttcggaaaataggtattgaggctctgaaacaagtaactaagagatatgcccggaaacaaaaccgatgggttaaaaaccgttttttgagcagacctggtcccattgtcccccctgtctatggcttagaggtatctgatgtctcgaagtgggaagagtctgttcttgaacctgctcttgaaatcgtgcaaagtttcatccagggccacaagcctacagccactccaataaagatgccatacaatgaagctgagaacaagagaagttatcacctgtgtgacctctgtgatcgaatcatcattggggatcgcgaatgggcagcgcacataaaatccaaatcccacttgaaccaactgaagaaaagaagaagattggactcagatgctgtcaacaccatagaaagtcagagtgtttccccagaccataacaaagaacctaaagagaagggatccccagggcagaatgatcaagagctgaaatgcagcgtttaagagacatgtccagtggcctttggaaaggtggtggggatccagttcaggagggaggggtatgtttgtctcccagtctgggcaaaggagtgctatgcggaattctctgcatagcagaaaagctcccaccattttcttttgatgtggttttaaagtctcacgttctctataatagaaacagcaggtcttgtcagctccttgtgtggctgatgtgtctggaaatgatgtagttcaggaaagcattttttttttctttgaaccttaaaggttctattattaaaagcagcacagattccacatttttatacatgaggatcttctttgtggtgaataccaggattgactgcatccctttaaagaagttttatgtccctgactctggctaaaattatctaatttccagatgcttttgtagatgactgaagtatttgtgagccacatattgggagttctagatttgagtgaatggcaggaaagggccatctccattgagatgattaagtgaaccaaactagttctcagaattctacagagaaggagggaatcagactgaggaagctgtgacataggacttgaagaccaaagactttgaaatttgcgagctgctcatgtgtgagttattatcactgctgtctttctattgagttacaaatctatatttttattgaagtttaaataaagaaaaaatttacaagagcctctttgatccttaaaaagatatacaa

SEQ ID NO: 195249 - DNA, 545 bp, Homo sapiens
  Payload ID: 18553
  Gene Name: tRNA isopentenyltransferase 1
  ENST ID: ENST00000541099
  CDS Start-End: 258-515
caacggaccctacctcttgtagtgattctcggggccacgggcaccggcaaatccacgctggcgttgcagctaggccagcggctcggcggtgagatcgtcagcgctgactccatgcaggacctggtcccattgtcccccctgtctatggcttagaggtatctgatgtctcgaagtgggaagagtctgttcttgaacctgctcttgaaatcgtgcaaagtttcatccagggccacaagcctacagccactccaataaagatgccatacaatgaagctgagaacaagagaagttatcacctgtgtgacctctgtgatcgaatcatcattggggatcgcgaatgggcagcgcacataaaatccaaatcccacttgaaccaactgaagaaaagaagaagattggactcagatgctgtcaacaccatagaaagtcagagtgtttccccagaccataacaaagaacctaaagagaagggatccccagggcagaatgatcaagagctgaaatgcagcgtttaagagacatgtccagtggcctttggaaaggtg

SEQ ID NO: 195250 - DNA, 983 bp, Homo sapiens
  Payload ID: 18553
  Gene Name: tRNA isopentenyltransferase 1
  ENST ID: ENST00000492612
  CDS Start-End: 1-422
tggcggctgcacgagcagttcccgtgggcagtgggctcaggggcctgcaacggaccctacctcttgtagtgattctcggggccacgggcaccggcaaatccacgctggcgttgcagctaggccagcggctcggcggtgagatcgtcagcgctgactccatgcaggtctatgaaggcctagacatcatcaccaacaaggtttctgcccaagagcagagaatctgccggcaccacatgatcagctttgtggatcctcttgtgaccaattacacagtggtggacttcagaaatagagcaactgctctgattgaagatatatttgcccgagacaaaattcctattgttgtgggaggaaccaattattacattgaatctctgctctggaaagttcttgtcaataccaaggagcttgcaagtttttgaagaaacaggaatctctcatagtgaatttctccatcgtcaacatacggaagaaggtggtggtccccttggaggtcctctgaagttctctaacccttgcatcctttggcttcatgctgaccaggcagttctagatgagcgcttggataagagggtggatgacatgcttgctgctgggctcttggaggaactaagagattttcacagacgctataatcagaagaatgtttcggaaaatagccaggactatcaacatggtatcttccaatcaattggcttcaaggaatttcacgagtacctgatcactgagggaaaatgcacactggagactagtaaccagcttctaaagaaaggtattgaggctctgaaacaagtaactaagagatatgcccggaaacaaaaccgatgggttaaaaaccgttttttgagcagacctggtcccattgtcccccctgtctatggcttagaggtatctgatgtctcgaagtgggaagagtctgttcttgaacctgctcttgaaatcgtgcaaagtttcatccagggccacaagcctacagccactcc

SEQ ID NO: 195251 - DNA, 861 bp, Homo sapiens
  Payload ID: 18553
  Gene Name: tRNA isopentenyltransferase 1
  ENST ID: ENST00000489945
  CDS Start-End: 6-437
ataagatggcgtccgtggcggctgcacgagcagttcccgtgggcagtgggctcaggggcctgcaacggaccctacctcttgtagtgattctcggggccacgggcaccggcaaatccacgctggcgttgcagctaggccagcggctcggcggtgagatcgtcagcgctgactccatgcaggtctatgaaggcctagacatcatcaccaacaaggtttctgcccaagagcagagaatctgccggcaccacatgatcagctttgtggatcctcttgtgaccaattacacagtggtggacttcagaaatagagcaactgctctgattgaagatatatttgcccgagacaaaattcctattgttgtgggaggaaccaattattacattgaatctctgctctggaaagttcttgtcaataccaaggagcttgcaagtttttgaagaaacaggaatctctcatagtgaatttctccatcgtcaacatacggaagaaggtggtggtccccttggaggtcctctgaagttctctaacccttgcatcctttggcttcatgctgaccagttctagatgagcgcttggataagagggtggatgacatgcttgctgctgggctcttggaggaactaagagattttcacagacgctataatcagaagaatgtttcggaaaatagccaggactatcaacatggtatcttccaatcaattggcttcaaggaatttcacgagtacctgatcactgagggaaaatgcacactggagactagtaaccagcttctaaagaaaggtattgaggctctgaaacaagtaactaagagatatgcccggaaacaaaaccgatgggttaaaaaccgttttttgagca

SEQ ID NO: 195252 - DNA, 2000 bp, Homo sapiens
  Payload ID: 18553
  Gene Name: tRNA isopentenyltransferase 1
  ENST ID: ENST00000462797
  CDS Start-End: 14-1063
agactgccataagatggcgtccgtggcggctgcacgagcagttcccgtgggcagtgggctcaggggcctgcaacggaccctacctcttgtagtgattctcggggccacgggcaccggcaaatccacgctggcgttgcagctaggccagcggctcggcggtgagatcgtcagcgctgactccatgcaggtctatgaaggcctagacatcatcaccaacaaggtttctgcccaagagcagagaatctgccggcaccacatgatcagctttgtggatcctcttgtgaccaattacacagtggtggacttcagaaatagagcaactgctctgattgaagatatatttgcccgagacaaaattcctattgttgtgggaggaaccaattattacattgaatctctgctctggaaagttcttgtcaataccaagccccaggagatgggcactgagaaagtgattgaccgaaaagtggagcttgaaaaggaggatggtcttgtacttcacaaacgcctaagccaggtggacccagaaatggctgccaagctgcatccacatgacaaacgcaaagtggccaggagcttgcaagtttttgaagaaacaggaatctctcatagtgaatttctccatcgtcaacatacggaagaaggtggtggtccccttggaggtcctctgaagttctctaacccttgcatcctttggcttcatgctgaccaggcagttctagatgagcgcttggataagagggtggatgacatgcttgctgctgggctcttggaggaactaagagattttcacagacgctataatcagaagaatgtttcggaaaatagccaggactatcaacatggtatcttccaatcaattggcttcaaggaatttcacgagtacctgatcactgagggaaaatgcacactggagactagtaaccagcttctaaagaaaggtattgaggctctgaaacaagtaactaagagatatgcccggaaacaaaaccgatgggttaaaaaccgttttttgagcaggccacaagcctacagccactccaataaagatgccatacaatgaagctgagaacaagagaagttatcacctgtgtgacctctgtgatcgaatcatcattggggatcgcgaatgggcagcgcacataaaatccaaatcccacttgaaccaactgaagaaaagaagaagattggactcagatgctgtcaacaccatagaaagtcagagtgtttccccagaccataacaaagaacctaaagagaagggatccccagggcagaatgatcaagagctgaaatgcagcgtttaagagacatgtccagtggcctttggaaaggtggtggggatccagttcaggagggaggggtatgtttgtctcccagtctgggcaaaggagtgctatgcggaattctctgcatagcagaaaagctcccaccattttcttttgatgtggttttaaagtctcacgttctctataatagaaacagcaggtcttgtcagctccttgtgtggctgatgtgtctggaaatgatgtagttcaggaaagcattttttttttctttgaaccttaaaggttctattattaaaagcagcacagattccacatttttatacatgaggatcttctttgtggtgaataccaggattgactgcatccctttaaagaagttttatgtccctgactctggctaaaattatctaatttccagatgcttttgtagatgactgaagtatttgtgagccacatattgggagttctagatttgagtgaatggcaggaaagggccatctccattgagatgattaagtgaaccaaactagttctcagaattctacagagaaggagggaatcagactgaggaagctgtgacataggacttgaagaccaaagactttgaaatttgcgagctgctcatgtgtgagttattatcactgctgtctttctattgagttacaaatctatatttttattgaagtttaaataaagaaaaaatttacaaga

SEQ ID NO: 195253 - DNA, 850 bp, Homo sapiens
  Payload ID: 18553
  Gene Name: tRNA isopentenyltransferase 1
  ENST ID: ENST00000486825
  CDS Start-End: 1-245
ctgcacgagcagttcccgtgggcagtgggctcaggggcctgcaacggaccctacctcttgtagtgattctcggggccacgggcaccggcaaatccacgctggcgttgcagctaggccagcggctcggcggtgagatcgtcagcgctgactccatgcagttttggattcctcagaaacttgaatcagaccaggaccctgttggcctcttgatccctttggggctctgcttgtctatgaaggcctagacatcatcaccaacaaggtttctgcccaagagcagagaatctgccggcaccacatgatcagctttgtggatcctcttgtgaccaattacacagtggtggacttcagaaatagagcaactgctctgattgaagatatatttgcccgagacaaaattcctattgttgtgggaggaaccaattattacattgaatctctgctctggaaagttcttgtcaataccaaggagcttgcaagtttttgaagaaacaggaatctctcatagtgaatttctccatcgtcaacatacggaagaaggtggtggtccccttggaggtcctctgaagttctctaacccttgcatcctttggcttcatgctgaccagttctagatgagcgcttggataagagggtggatgacatgcttgctgctgggctcttggaggaactaagagattttcacagacgctataatcagaagaatgtttcggaaaatagccaggactatcaacatggtatcttccaatcaattggcttcaaggaatttcacgagtacctgatcactgagggaaaatgcacactggagactagtaaccagcttctaaagaaaggtattgaggctctgaaa

SEQ ID NO: 195254 - DNA, 1156 bp, Homo sapiens
  Payload ID: 18553
  Gene Name: tRNA isopentenyltransferase 1
  ENST ID: ENST00000495175
  CDS Start-End: 21-212
caagcgcagactgccataagatggcgtccgtggcggctgcacgagcagttcccgtgggcagtgggctcaggggcctgcaacggaccctacctcttgtagtgattctcggggccacgggcaccggcaaatccacgctggcgttgcagctaggccagcggctcggcggtgagatcgtcagcgctgactccatgcaggagcttgcaagtttttgaagaaacaggaatctctcatagtgaatttctccatcgtcaacatacggaagaaggtggtggtccccttggaggtcctctgaagttctctaacccttgcatcctttggcttcatgctgaccaggcagttctagatgagcgcttggataagagggtggatgacatgcttgctgctgggctcttggaggaactaagagattttcacagacgctataatcagaagaatgtttcggaaaatagccaggactatcaacatggtatcttccaatcaattggcttcaaggaatttcacgagtacctgatcactgagggaaaatgcacactggagactagtaaccagcttctaaagaaaggtattgaggctctgaaacaagtaactaagagatatgcccggaaacaaaaccgatgggttaaaaaccgttttttgagcagacctggtcccattgtcccccctgtctatggcttagaggtatctgatgtctcgaagtgggaagagtctgttcttgaacctgctcttgaaatcgtgcaaagtttcatccagggccacaagcctacagccactccaataaagatgccatacaatgaagctgagaacaagagaagttatcacctgtgtgacctctgtgatcgaatcatcattggggatcgcgaatgggcagcgcacataaaatccaaatcccacttgaaccaactgaagaaaagaagaagattggactcagatgctgtcaacaccatagaaagtcagagtgtttccccagaccataacaaagaacctaaagagaagggatccccagggcagaatgatcaagagctgaaatgcagcgtttaagagacatgtccagtggcctttggaaaggtggtggggatccagttcaggagggaggggtatgtttgtctcccagtctgggcaaaggagtgctatgcggaattctctgcatagcagaaaa

SEQ ID NO: 195255 - DNA, 773 bp, Homo sapiens
  Payload ID: 18553
  Gene Name: tRNA isopentenyltransferase 1
  ENST ID: ENST00000469476
  CDS Start-End: 1-513
atcatcaccaacaaggtttctgcccaagagcagagaatctgccggcaccacatgatcagctttgtggatcctcttgtgaccaattacacagtggtggacttcagaaatagagcaactgctctgattgaagatatatttgcccgagacaaaattcctattgttgtgggaggaaccaattattacattgaatctctgctctggaaagttcttgtcaataccaagccccaggagatgggcactgagaaagtgattgaccgaaaagtggagcttgaaaaggaggatggtcttgtacttcacaaacgcctaagccaggtggacccagaaatggctgccaagctgcatccacatgacaaacgcaaagtggccaggagcttgcaagtttttgaagaaacaggaatctctcatagtgaatttctccatcgtcaacatacggaagaaggtggtggtccccttggaggtcctctgaagttctctaacccttgcatcctttggcttcatgctgaccagttctagatgagcgcttggataagagggtggatgacatgcttgctgctgggctcttggaggaactaagagattttcacagacgctataatcagaagaatgtttcggaaaatagatgaaatggctcaactaggtccatctccaaagcccctgctagcttttaggagcaatggcttatctgctgataccctcctgttcccagccaggactatcaacatggtatcttccaatcaattggcttcaaggaatttcacgagtacctgatcact

SEQ ID NO: 195256 - DNA, 2179 bp, Homo sapiens
  Payload ID: 18554
  Gene Name: tRNA methyltransferase 1
  Uniprot ID: Q9NXH9
  ENST ID: ENST00000221504
  CDS Start-End: 259-2151
agcaggtgaggacgggctaggcagcgcggggagggattcggactcggggcgggcctgcacgagggcatcggctccacagggaccagtcatccccaaaacgaggggatatcagcttaccgaggccgcaggttttcctagtccctacctcatagatatgtaggacatccccgggcccggaatgcggctctctgaccctctctgtgccctcccccgccccccgaaccaggcttggcgggcggaggcgccagcggatgtctcatgcaaggatcgtctctgtggctaagcctcactttccgctccgcccgggtgctctctagagcccggtttttcgagtggcagtctccagggctgccgaatacagcagcgatggagaacggcaccgggccctacggagaagaacgtccacgtgaagtccaggagacgacagtcaccgagggggctgccaaaatcgcctttcccagtgccaacgaggtcttttataacccggtgcaggaattcaatcgggacctgacatgtgctgtgatcaccgagtttgctcgcattcagcttggggccaaaggaatccagatcaaggttccaggagagaaggacacgcaaaaagtggtcgtggacttgtcagagcaagaggaggaaaaggttgaactgaaagagagtgaaaacctggcctcaggagaccaacctcgcacagcggccgtgggggagatctgtgaggaaggcctgcatgtgctggaaggcctggcagcttcaggcctacgttccattcgatttgccctagaggtgcctgggctcagatctgtggttgcaaacgatgcctccacccgggctgtggatctcatacgccggaatgtccagctcaatgacgtggcccacctggtacagccgagccaagcagatgcccggatgctgatgtaccagcaccagagggtgtcggagaggtttgacgtcatcgatctggacccctatggcagcccagccaccttcctggatgcagctgtgcaggctgtgagtgaaggagggttgctgtgtgtgacctgcacagacatggcggtgttggcggggaacagcggggagacgtgctacagcaagtacggggccatggccctcaagagccgggcctgccacgagatggccctgagaatcgtcctgcacagcctggacctccgcgccaactgctaccagcgcttcgtggtgccgctgctcagcatcagcgctgacttctacgtgcgtgtttttgtccgtgtcttcaccggccaggccaaggtcaaggcctcagccagggccaagttctctgcagcctgtggtccccctgtgacccccgagtgtgaacactgtgggcaacgacaccagcttggtggccccatgtgggcagagcccatccatgacctggattttgtgggccgtgtcctggaggctgtgagcgctaaccccggccgcttccacacctcggagcggatccgaggggtcctgagcgtcatcactgaggagctcccggacgtgcctctgtactacaccctggaccagctgagcagcaccatccactgcaacacaccaagcctcctgcagttgcggtcggccctcctccacgctgacttccgggtctcactctcccacgcctgtaagaacgctgtgaagacggatgcccctgcctctgccctctgggacatcatgcgttgctgggagaaggaatgtccggtgaaacgggagcgactatcagagactagcccagcgttccgcattctcagtgtggagcccaggctgcaggccaacttcaccatccgggaagatgccaaccccagctcccgacagcgaggactcaagcgcttccaggctaacccggaggccaactggggtccccggcctcgtgcccggccagggggcaaggcggccgacgaagctatggaggagagacgcaggctgcttcagaacaagcggaaggagccgccggaagatgtggcccagcgggctgcccggctcaagacatttccttgcaagaggtttaaggagggcacctgtcaacgcggggaccagtgctgctactcccacagccccccgacacccagggtttctgctgatgctgcccctgactgtccagagacctccaaccagaccccccctggacctggggctgccgctgggccaggcatagactgaaccaataaagagatgtcacgtcaccttc

SEQ ID NO: 195257 - DNA, 2142 bp, Homo sapiens
  Payload ID: 18554
  Gene Name: tRNA methyltransferase 1
  Uniprot ID: Q9NXH9
  ENST ID: ENST00000357720
  CDS Start-End: 130-2109
gattcgcccacccactgtgccaacatggcggcgcccaggtcctaattcgggaaacgtgcaccttgactaattcggttttctgtggctacgagagcaggcttggcgggcggaggcgccagcggatgtctcatgcaaggatcgtctctgtggctaagcctcactttccgctccgcccgggtgctctctagagcccggtttttcgagtggcagtctccagggctgccgaatacagcagcgatggagaacggcaccgggccctacggagaagaacgtccacgtgaagtccaggagacgacagtcaccgagggggctgccaaaatcgcctttcccagtgccaacgaggtcttttataacccggtgcaggaattcaatcgggacctgacatgtgctgtgatcaccgagtttgctcgcattcagcttggggccaaaggaatccagatcaaggttccaggagagaaggacacgcaaaaagtggtcgtggacttgtcagagcaagaggaggaaaaggttgaactgaaagagagtgaaaacctggcctcaggagaccaacctcgcacagcggccgtgggggagatctgtgaggaaggcctgcatgtgctggaaggcctggcagcttcaggcctacgttccattcgatttgccctagaggtgcctgggctcagatctgtggttgcaaacgatgcctccacccgggctgtggatctcatacgccggaatgtccagctcaatgacgtggcccacctggtacagccgagccaagcagatgcccggatgctgatgtaccagcaccagagggtgtcggagaggtttgacgtcatcgatctggacccctatggcagcccagccaccttcctggatgcagctgtgcaggctgtgagtgaaggagggttgctgtgtgtgacctgcacagacatggcggtgttggcggggaacagcggggagacgtgctacagcaagtacggggccatggccctcaagagccgggcctgccacgagatggccctgagaatcgtcctgcacagcctggacctccgcgccaactgctaccagcgcttcgtggtgccgctgctcagcatcagcgctgacttctacgtgcgtgtttttgtccgtgtcttcaccggccaggccaaggtcaaggcctcagccagcaagcaggcgctggtgttccagtgtgtgggctgcggggccttccaccttcagcgtctcggcaaagcgtcaggagtccccagcggccgggccaagttctctgcagcctgtggtccccctgtgacccccgagtgtgaacactgtgggcaacgacaccagcttggtggccccatgtgggcagagcccatccatgacctggattttgtgggccgtgtcctggaggctgtgagcgctaaccccggccgcttccacacctcggagcggatccgaggggtcctgagcgtcatcactgaggagctcccggacgtgcctctgtactacaccctggaccagctgagcagcaccatccactgcaacacaccaagcctcctgcagttgcggtcggccctcctccacgctgacttccgggtctcactctcccacgcctgtaagaacgctgtgaagacggatgcccctgcctctgccctctgggacatcatgcgttgctgggagaaggaatgtccggtgaaacgggagcgactatcagagactagcccagcgttccgcattctcagtgtggagcccaggctgcaggccaacttcaccatccgggaagatgccaaccccagctcccgacagcgaggactcaagcgcttccaggctaacccggaggccaactggggtccccggcctcgtgcccggccagggggcaaggcggccgacgaagctatggaggagagacgcaggctgcttcagaacaagcggaaggagccgccggaagatgtggcccagcgggctgcccggctcaagacatttccttgcaagaggtttaaggagggcacctgtcaacgcggggaccagtgctgctactcccacagccccccgacacccagggtttctgctgatgctgcccctgactgtccagagacctccaaccagaccccccctggacctggggctgccgctgggccaggcatagactgaaccaataaagagatgtcacgtcaccttctcccg

SEQ ID NO: 195258 - DNA, 2263 bp, Homo sapiens
  Payload ID: 18554
  Gene Name: tRNA methyltransferase 1
  Uniprot ID: Q9NXH9
  ENST ID: ENST00000437766
  CDS Start-End: 251-2230
aggacgggctaggcagcgcggggagggattcggactcggggcgggcctgcacgagggcatcggctccacagggaccagtcatccccaaaacgaggggatatcagcttaccgaggccgcaggttttcctagtccctacctcatagatatgtaggacatccccgggcccggaatgcggctctctgaccctctctgtgccctcccccgccccccgaaccaggcttggcgggcggaggcgccagcggatgtctcatgcaaggatcgtctctgtggctaagcctcactttccgctccgcccgggtgctctctagagcccggtttttcgagtggcagtctccagggctgccgaatacagcagcgatggagaacggcaccgggccctacggagaagaacgtccacgtgaagtccaggagacgacagtcaccgagggggctgccaaaatcgcctttcccagtgccaacgaggtcttttataacccggtgcaggaattcaatcgggacctgacatgtgctgtgatcaccgagtttgctcgcattcagcttggggccaaaggaatccagatcaaggttccaggagagaaggacacgcaaaaagtggtcgtggacttgtcagagcaagaggaggaaaaggttgaactgaaagagagtgaaaacctggcctcaggagaccaacctcgcacagcggccgtgggggagatctgtgaggaaggcctgcatgtgctggaaggcctggcagcttcaggcctacgttccattcgatttgccctagaggtgcctgggctcagatctgtggttgcaaacgatgcctccacccgggctgtggatctcatacgccggaatgtccagctcaatgacgtggcccacctggtacagccgagccaagcagatgcccggatgctgatgtaccagcaccagagggtgtcggagaggtttgacgtcatcgatctggacccctatggcagcccagccaccttcctggatgcagctgtgcaggctgtgagtgaaggagggttgctgtgtgtgacctgcacagacatggcggtgttggcggggaacagcggggagacgtgctacagcaagtacggggccatggccctcaagagccgggcctgccacgagatggccctgagaatcgtcctgcacagcctggacctccgcgccaactgctaccagcgcttcgtggtgccgctgctcagcatcagcgctgacttctacgtgcgtgtttttgtccgtgtcttcaccggccaggccaaggtcaaggcctcagccagcaagcaggcgctggtgttccagtgtgtgggctgcggggccttccaccttcagcgtctcggcaaagcgtcaggagtccccagcggccgggccaagttctctgcagcctgtggtccccctgtgacccccgagtgtgaacactgtgggcaacgacaccagcttggtggccccatgtgggcagagcccatccatgacctggattttgtgggccgtgtcctggaggctgtgagcgctaaccccggccgcttccacacctcggagcggatccgaggggtcctgagcgtcatcactgaggagctcccggacgtgcctctgtactacaccctggaccagctgagcagcaccatccactgcaacacaccaagcctcctgcagttgcggtcggccctcctccacgctgacttccgggtctcactctcccacgcctgtaagaacgctgtgaagacggatgcccctgcctctgccctctgggacatcatgcgttgctgggagaaggaatgtccggtgaaacgggagcgactatcagagactagcccagcgttccgcattctcagtgtggagcccaggctgcaggccaacttcaccatccgggaagatgccaaccccagctcccgacagcgaggactcaagcgcttccaggctaacccggaggccaactggggtccccggcctcgtgcccggccagggggcaaggcggccgacgaagctatggaggagagacgcaggctgcttcagaacaagcggaaggagccgccggaagatgtggcccagcgggctgcccggctcaagacatttccttgcaagaggtttaaggagggcacctgtcaacgcggggaccagtgctgctactcccacagccccccgacacccagggtttctgctgatgctgcccctgactgtccagagacctccaaccagaccccccctggacctggggctgccgctgggccaggcatagactgaaccaataaagagatgtcacgtcaccttctcccg

SEQ ID NO: 195259 - DNA, 813 bp, Homo sapiens
  Payload ID: 18554
  Gene Name: tRNA methyltransferase 1
  ENST ID: ENST00000587487
  CDS Start-End: 240-813
cgggaaacgtgcaccttgactaattcggttttctgtggctacgagagcaggaaggcctgcatgtgctggaaggcctggcagcttcaggcctacgttccattcgatttgccctagaggtgcctgggctcagatctgtggttgcaaacgatgcctccacccgggctgtggatctcatacgccggaatgtccagctcaatgacgtggcccacctggtacagccgagccaagcagatgcccggatgctgatgtaccagcaccagagggtgtcggagaggtttgacgtcatcgatctggacccctatggcagcccagccaccttcctggatgcagctgtgcaggctgtgagtgaaggagggttgctgtgtgtgacctgcacagacatggcggtgttggcggggaacagcggggagacgtgctacagcaagtacggggccatggccctcaagagccgggcctgccacgagatggccctgagaatcgtcctgcacagcctggacctccgcgccaactgctaccagcgcttcgtggtgccgctgctcagcatcagcgctgacttctacgtgcgtgtttttgtccgtgtcttcaccggccaggccaaggtcaaggcctcagccagcaagcaggcgctggtgttccagtgtgtgggctgcggggccttccaccttcagcgtctcggcaaagcgtcaggagtccccagcggccgggccaagttctctgcagcctgtggtccccctgtgacccccgagtgtgaacactgtgggcaacgacaccagcttggtggccccatgtgggcagagcccatccatgacctgg

SEQ ID NO: 195260 - DNA, 648 bp, Homo sapiens
  Payload ID: 18554
  Gene Name: tRNA methyltransferase 1
  ENST ID: ENST00000587633
  CDS Start-End: 1-306
cgcattcagcttggggccaaaggaatccagatcaaggttccaggagagaaggacacgcaaaaagtggtcgtggacttgtcagagcaagaggaggaaaaggttgaactgaaagagagtgaaaacctggcctcaggagaccaacctcgcacagcggccgtgggggagatctgtgagaggtgcctgggctcagatctgtggttgcaaacgatgcctccacccgggctgtggatctcatacgccggaatgtccagctcaatgacgtggcccacctggtacagccgagccaagcagatgcccggatgctgatgtaccagcaccagagggtgtcggagaggtttgacgtcatcgatctggacccctatggcagcccagccaccttcctggatgcagctgtgcaggctgtgagtgaaggagggttgctgtgtgtgacctgcacagacatggcggtgttggcggggaacagcggggagacgtgctacagcaagtacggggccatggccctcaagagccgggcctgccacgagatggccctgagaatcgtcctgcacagcctggacctccgcgccaactgctaccagcgcttcgtggtgccgctgctcagcatcagcgctgacttctacgtgcgtgtttttgtccgtgtcttcaccg

SEQ ID NO: 195261 - DNA, 582 bp, Homo sapiens
  Payload ID: 18554
  Gene Name: tRNA methyltransferase 1
  ENST ID: ENST00000591717
  CDS Start-End: 130-447
gattcgcccacccactgtgccaacatggcggcgcccaggtcctaattcgggaaacgtgcaccttgactaattcggttttctgtggctacgagagcaggcttggcgggcggaggcgccagcggatgtctcatgcaaggatcgtctctgtggctaagcctcactttccgctccgcccgggtgctctctagagcccggtttttcgagtggcagtctccagggctgccgaatacagcagcgatggagaacggcaccgggccctacggagaagaacgtccacgtgaagtccaggagacgacagtcaccgagggggctgccaaaatcgcctttcccagtgccaacgaggtcttttataacccggtgcaggaattcaatcgggacctgacgaaggcctgcatgtgctggaaggcctggcagcttcaggcctacgttccattcgatttgccctagaggtgcctgggctcagatctgtggttgcaaacgatgcctccacccgggctgtggatctcatacgccggaatgtccagctcaatgacgtggcccacctggtacagccgagccaagcagatgcccggatgctgatgt

SEQ ID NO: 195262 - DNA, 2579 bp, Homo sapiens
  Payload ID: 18554
  Gene Name: tRNA methyltransferase 1
  Uniprot ID: Q9NXH9
  ENST ID: ENST00000592062
  CDS Start-End: 572-2551
aaaagaaagaaagaaagaaaaggaggcacagagaaatgaagaaagctggtcaagatcatcacacagcaaggaagtgatggtaagaaaagtgaagccgcgggagtaacctgcccagagcatgtgatgggactgagattcaaacccggtaaatccaactccagagcctgagtcattcctgcagggtgctctgaaataatgtgtatatagcacccagaacacagaagaggaccaataagtgttgggtttctccgcttaccgccccttttctgagccacaacttcctcatctgtgaaatgggactagggacgtgtcctctcccaggggatccactgtgattaacacccccggaacagcacgatcagcgcgcttcctttatggctttcattttgatcccggccgcccaccgtacgtttcctcattgactggccaaccactatcatgtgattcgcccacccactgtgccaacatggcggcgcccaggtcctaattcgggaaacgtgcaccttgactaattcggttttctgtggctacgagagcaggcttggcgggcggaggcgccagcggatgtctcatgcaaggatcgtctctgtggctaagcctcactttccgctccgcccgggtgctctctagagcccggtttttcgagtggcagtctccagggctgccgaatacagcagcgatggagaacggcaccgggccctacggagaagaacgtccacgtgaagtccaggagacgacagtcaccgagggggctgccaaaatcgcctttcccagtgccaacgaggtcttttataacccggtgcaggaattcaatcgggacctgacatgtgctgtgatcaccgagtttgctcgcattcagcttggggccaaaggaatccagatcaaggttccaggagagaaggacacgcaaaaagtggtcgtggacttgtcagagcaagaggaggaaaaggttgaactgaaagagagtgaaaacctggcctcaggagaccaacctcgcacagcggccgtgggggagatctgtgaggaaggcctgcatgtgctggaaggcctggcagcttcaggcctacgttccattcgatttgccctagaggtgcctgggctcagatctgtggttgcaaacgatgcctccacccgggctgtggatctcatacgccggaatgtccagctcaatgacgtggcccacctggtacagccgagccaagcagatgcccggatgctgatgtaccagcaccagagggtgtcggagaggtttgacgtcatcgatctggacccctatggcagcccagccaccttcctggatgcagctgtgcaggctgtgagtgaaggagggttgctgtgtgtgacctgcacagacatggcggtgttggcggggaacagcggggagacgtgctacagcaagtacggggccatggccctcaagagccgggcctgccacgagatggccctgagaatcgtcctgcacagcctggacctccgcgccaactgctaccagcgcttcgtggtgccgctgctcagcatcagcgctgacttctacgtgcgtgtttttgtccgtgtcttcaccggccaggccaaggtcaaggcctcagccagcaagcaggcgctggtgttccagtgtgtgggctgcggggccttccaccttcagcgtctcggcaaagcgtcaggagtccccagcggccgggccaagttctctgcagcctgtggtccccctgtgacccccgagtgtgaacactgtgggcaacgacaccagcttggtggccccatgtgggcagagcccatccatgacctggattttgtgggccgtgtcctggaggctgtgagcgctaaccccggccgcttccacacctcggagcggatccgaggggtcctgagcgtcatcactgaggagctcccggacgtgcctctgtactacaccctggaccagctgagcagcaccatccactgcaacacaccaagcctcctgcagttgcggtcggccctcctccacgctgacttccgggtctcactctcccacgcctgtaagaacgctgtgaagacggatgcccctgcctctgccctctgggacatcatgcgttgctgggagaaggaatgtccggtgaaacgggagcgactatcagagactagcccagcgttccgcattctcagtgtggagcccaggctgcaggccaacttcaccatccgggaagatgccaaccccagctcccgacagcgaggactcaagcgcttccaggctaacccggaggccaactggggtccccggcctcgtgcccggccagggggcaaggcggccgacgaagctatggaggagagacgcaggctgcttcagaacaagcggaaggagccgccggaagatgtggcccagcgggctgcccggctcaagacatttccttgcaagaggtttaaggagggcacctgtcaacgcggggaccagtgctgctactcccacagccccccgacacccagggtttctgctgatgctgcccctgactgtccagagacctccaaccagaccccccctggacctggggctgccgctgggccaggcatagactgaaccaataaagagatgtcacgtcaccttc

SEQ ID NO: 195263 - DNA, 985 bp, Homo sapiens
  Payload ID: 18554
  Gene Name: tRNA methyltransferase 1
  ENST ID: ENST00000592814
  CDS Start-End: 93-985
ggtcctaattcgggaaacgtgcaccttgactaattcggttttctgtggctacgagagcaggcttggcgggcggaggcgccagcggatgtctcatgcaaggatcgtctctgtggctaagcctcactttccgctccgcccgggtgctctctagagcccggtttttcgagtggcagtctccagggctgccgaatacagcagcgatggagaacggcaccgggccctacggagaagaacgtccacgtgaagtccaggagacgacagtcaccgagggggctgccaaaatcgcctttcccagtgccaacgaggtcttttataacccggtgcaggaattcaatcgggacctgacatgtgctgtgatcaccgagtttgctcgcattcagcttggggccaaaggaatccagatcaaggttccaggagagaaggacacgcaaaaagtggtcgtggacttgtcagagcaagaggaggaaaaggttgaactgaaagagagtgaaaacctggcctcaggagaccaacctcgcacagcggccgtgggggagatctgtgaggaaggcctgcatgtgctggaaggcctggcagcttcaggcctacgttccattcgatttgccctagaggtgcctgggctcagatctgtggttgcaaacgatgcctccacccgggctgtggatctcatacgccggaatgtccagctcaatgacgtggcccacctggtacagccgagccaagcagatgcccggatgctgatgtaccagcaccagagggtgtcggagaggtttgacgtcatcgatctggacccctatggcagcccagccaccttcctggatgcagctgtgcaggctgccctgagaatcgtcctgcacagcctggacctccgcgccaactgctaccagcgcttcgtggtgccgctgctcagcatcagcgctgacttctacgtgcgtgtttttgtccgtgtcttcaccggccaggccaaggtcaaggcctcagccag

SEQ ID NO: 195264 - DNA, 552 bp, Homo sapiens
  Payload ID: 18554
  Gene Name: tRNA methyltransferase 1
  ENST ID: ENST00000588229
  CDS Start-End: 117-552
actgtgccaacatggcggcgcccaggtcctaattcgggaaacgtgcaccttgactaattcggttttctgtggctacgagagcaggcttggcgggcggaggcgccagcggatgtctcatgcaaggatcgtctctgtggctaagcctcactttccgctccgcccgggtgctctctagagcccggtttttcgagtggcagtctccagggctgccgaatacagcagcgatggagaacggcaccgggccctacggagaagaacgtccacgtgaagtccaggagacgacagtcaccgagggggctgccaaaatcgcctttcccagtgccaacgaggtcttttataacccggtgcaggaattcaatcgggacctgacatgtgctgtgatcaccgagtttgctcgcattcagcttggggccaaaggaatccagagtgagtggaggtccaggcttctggtgggcgggggtcacacaagtttatctccctgcctgggctcttctgccgcccaaatccagaggggcttcagccacatagcaggccctgggttctgctccttca

SEQ ID NO: 195265 - DNA, 562 bp, Homo sapiens
  Payload ID: 18554
  Gene Name: tRNA methyltransferase 1
  ENST ID: ENST00000588746
  CDS Start-End: 117-374
actgtgccaacatggcggcgcccaggtcctaattcgggaaacgtgcaccttgactaattcggttttctgtggctacgagagcaggcttggcgggcggaggcgccagcggatgtctcatgcaaggatcgtctctgtggctaagcctcactttccgctccgcccgggtgctctctagagcccggtttttcgagtggcagtctccagggctgccgaatacagcagcgatggagaacggcaccgggccctacggagaagaacgtccacgtgaagtccaggagacgacagtcaccgagggggctgccaaaatcgcctttcccagtgccaacgaggtcttttataacccggtgcaggaattcaatcgggacctgacgtgagcaggggtcagacgttagcctggcatcggctagtggtcaaggttccaggagagaaggacacgcaaaaagtggtcgtggacttgtcagagcaagaggaggaaaaggttgaactgaaagagagtgaaaacctggcctcaggagaccaacctcgcacagcggccgtgggggagatctgtgaggaaggcctg

SEQ ID NO: 195266 - DNA, 543 bp, Homo sapiens
  Payload ID: 18554
  Gene Name: tRNA methyltransferase 1
  ENST ID: ENST00000586224
  CDS Start-End: 129-470
attcgcccacccactgtgccaacatggcggcgcccaggtcctaattcgggaaacgtgcaccttgactaattcggttttctgtggctacgagagcaggcttggcgggcggaggcgccagcggatgtctcatgcaaggatcgtctctgtggctaagcctcactttccgctccgcccgggtgctctctagagcccggtttttcgagtggcagtctccagggctgccgaatacagcagcgatggagaacggcaccgggccctacggagaagaacgtccacgtgaagtccaggagacgacagtcaccgagggggctgccaaaatcgcctttcccagtgccaacgagatgtgctgtgatcaccgagtttgctcgcattcagcttggggccaaaggaatccagatcaaggttccaggagagaaggacacgcaaaaagtggtcgtggacttgtcagagcaagaggaggaaaaggttgaactgaaagagagtgaaaacctggcctcaggagaccaacctcgcacagcggccgtgggggagatctgtgaggaa

SEQ ID NO: 195267 - DNA, 3694 bp, Homo sapiens
  Payload ID: 18555
  Gene Name: tRNA methyltransferase 10A
  Uniprot ID: Q8TBZ6
  ENST ID: ENST00000273962
  CDS Start-End: 314-1333
gtttgctggctgggagcctagaagggatagtgggcgaggctccgccccgtggtggggcgctttccgtcggcgtgtgttttggggttgccatcggcccgtagtatgtgaaaagtgagtttgcaaagaatcagtgggaaatctgtactctaaagggccggaaagcgtgttatggccctgccacttcgtggctagagaccgtgggctttacctctttaaagctgccttacctcatttttcctgcaaagggctgacgtcgctgaactctctgaaatgtagagagcccgaggggaagttgctgcagaggcaccaaataatgtcatctgaaatgttgccagcatttattgaaacttctaatgttgacaaaaagcaaggcataaatgaagatcaagaggagagccagaagccaagattaggtgaagggtgtgaaccaatatctaaacgacaaatgaaaaaactaataaaacagaaacaatgggaagagcaacgggaactccgcaaacaaaagcgaaaagaaaaacgcaagaggaaaaaattagagcgacaatgtcaaatggaaccaaactcagatggacatgacagaaaacgtgttcgaagagatgttgttcatagcacccttcgccttattattgactgtagttttgatcacttgatggtattaaaggacattaagaaacttcataagcagattcaacgatgttacgcagaaaaccgacgggcactgcatcctgtgcagttttacttgacaagccacggaggccagctgaaaaagaacatggatgaaaatgacaaaggatgggtcaactggaaggatatccatatcaaaccagagcactatagtgaactcataaagaaagaagacctgatttaccttacgtcagattcacctaatatactgaaggaattagatgaatcaaaggcctatgtgattggaggattagtagatcacaaccatcacaagggactcacatataaacaagcgtcagattatggaatcaatcatgcacagctcccacttggaaattttgtgaagatgaatagtcgaaaagttttggcagttaatcatgtgtttgaaattattctggaatacctggaaacaagagactggcaagaagcattttttactatcttgccccaacggaaaggagctgttcccacagacaaagcctgtgaaagtgcttctcatgacaatcagtctgtcaggatggaggaaggtggatcggacagtgattccagtgaggaggaatatagcagaaatgaactagattcaccacatgaagaaaagcaggataaggaaaatcacactgaatctacagtgaactctctgccacactaatgttacctggtttccttttagtttaaggaaaaattaggagaaagtgaggtgctatatagaatattgaaattggaagaacattttattttctcttatttctgttgtgatttttaaaaacttttttttggacctaaataataataaaaaaaaaagccctttaaactttgtaaggaaatattttttgattttgcgtaagaagatttaaatgtgtatgtgattttttttgtttttgtttttaaagcctcagtagtttctagataattttactgtattagtatattttcattttctttcattttatattctttagaatgtgccttctgacctttcagttttttaattttatagtcacatcaacatctttatgatctattgcctatatatctgtgagggcacatattcataaatatactgtcaatctatcagcatttgtgtatggtaggttaccctctatttgcagcttttatgtttaaattagttacttgaaagaatgtagtaattttaggaagaagtatcagtttgatagacttaataattcatttcttttggactatggagcgcatatctgttccttctttatgatgcctttttatggttctgaagtaattactgaagagttgagaatctctttaatgcattttcttaattcttacaatggtgataagttacttcaattataaaattgaattttgcagactaaattattttataaggctgttgctattgaaagatcaattttgtctttacctgcatttaaaatggaacagctcttagcagctgtggtttttttttccatattttttttaaatttgttggctcttaagatgaataaagtttataggtgcatctgcctcctcttctctaagaatatgcatactaatgtttgtttctataaatcaaatacacatgtgataatatgcatgtaaatacataactatcctcatcatgtatggctctcagttcttaattgatgataacatgattgaattgccatatatctgtattacttgtgtgaatggttgtgttgaacacgctaagaacaatttgaattttattaagtacaaaaatccttaacgtttgtatgggaacattggcaagaaagaatagtgtgaaagggaactgttttagtttcctatcagtaattgtacatgcagttaaatgtttaaggtaaaatgattggtctctgtcacagctaaaagatttcagtagccttcattgagtttgggtaaaataagttgctgttcttttgtcttctttttaatatataaaagttatatttaaaaagtatataacatactatatatgttacatactaacatatatatacacaacagaaagtttattggatttagtactgatatttactgtctatttttgttactttgttcttagtaatctattatagttacctattttaaggtaaggtctgtaggcaagatatgtaagtaaagacaagccctacaattttaaaataacaaagcttatgtcttaagttgtattttttcaaaggttcatgtttttctgagtaaatgtggtttattagcatgaaatattatgccttttacttaaattattttatgtaaaatagggcactgtttaattatgaaagggggaaaatcattccaaataagagtttaatttttattaattataaaaaactctgtattagtttcctagatgtgctagaacaaattaccacaaactgggtggctttaaacaacagaaatttattctcttaacagttccagagactaaatgtccagactcacaatgtcccagtgccatgcttcctccttaggccctaggaaagaatacttcctagcctcttcctggcttttggtggttgccagcaatccctgctgttccttagcctatagtggcttgactccaatctcagttttgttgtcaagtggtcttctaccctgtcttctatgtttgtatccgtgtccaaactctttttctagggagaccagcactggattagagttcaccatgatccaatatgacctcatcttgactacatccgcaaagaccctgtctccaaataaggtcacatttacagggtaccatgtgttaggatttgacatatcttttgggggacacaattctacccactacaggcccatatcttatctaggatgttggtggcaagaaggtgaagattactacctcttttgatataactagtttctgaggtatttaaaaatttggttttaaaaatattaagctttttgctcatttgcatgtatacttttctctcaacattgttttggtttatttaggttatttgttaaaacttcagtaaatactaaagttacttgtattagaacataataaaagtagagaattaaactacctaaa

SEQ ID NO: 195268 - DNA, 1638 bp, Homo sapiens
  Payload ID: 18555
  Gene Name: tRNA methyltransferase 10A
  Uniprot ID: Q8TBZ6
  ENST ID: ENST00000394876
  CDS Start-End: 144-1163
aactaccgcccctgcctctgggaattgaagtttctgtggaaggaagcgtgagccgtaaccaggccaacccagaaaggctttctttctgagatttcacttccctgtcaactcttcagctcgttgtttttcagaggcaccaaataatgtcatctgaaatgttgccagcatttattgaaacttctaatgttgacaaaaagcaaggcataaatgaagatcaagaggagagccagaagccaagattaggtgaagggtgtgaaccaatatctaaacgacaaatgaaaaaactaataaaacagaaacaatgggaagagcaacgggaactccgcaaacaaaagcgaaaagaaaaacgcaagaggaaaaaattagagcgacaatgtcaaatggaaccaaactcagatggacatgacagaaaacgtgttcgaagagatgttgttcatagcacccttcgccttattattgactgtagttttgatcacttgatggtattaaaggacattaagaaacttcataagcagattcaacgatgttacgcagaaaaccgacgggcactgcatcctgtgcagttttacttgacaagccacggaggccagctgaaaaagaacatggatgaaaatgacaaaggatgggtcaactggaaggatatccatatcaaaccagagcactatagtgaactcataaagaaagaagacctgatttaccttacgtcagattcacctaatatactgaaggaattagatgaatcaaaggcctatgtgattggaggattagtagatcacaaccatcacaagggactcacatataaacaagcgtcagattatggaatcaatcatgcacagctcccacttggaaattttgtgaagatgaatagtcgaaaagttttggcagttaatcatgtgtttgaaattattctggaatacctggaaacaagagactggcaagaagcattttttactatcttgccccaacggaaaggagctgttcccacagacaaagcctgtgaaagtgcttctcatgacaatcagtctgtcaggatggaggaaggtggatcggacagtgattccagtgaggaggaatatagcagaaatgaactagattcaccacatgaagaaaagcaggataaggaaaatcacactgaatctacagtgaactctctgccacactaatgttacctggtttccttttagtttaaggaaaaattaggagaaagtgaggtgctatatagaatattgaaattggaagaacattttattttctcttatttctgttgtgatttttaaaaacttttttttggacctaaataataataaaaaaaaaagccctttaaactttgtaaggaaatattttttgattttgcgtaagaagatttaaatgtgtatgtgattttttttgtttttgtttttaaagcctcagtagtttctagataattttactgtattagtatattttcattttctttcattttatattctttagaatgtgccttctgacctttcagttttttaattttatagtcacatcaacatctttatgatctattgcctatatatctgtgagggcacatattcataaatatactgtcaatctatcagcatttgtgtatggtaggttaccctctatttgcagcttttatgtttaaat

SEQ ID NO: 195269 - DNA, 3516 bp, Homo sapiens
  Payload ID: 18555
  Gene Name: tRNA methyltransferase 10A
  Uniprot ID: Q8TBZ6
  ENST ID: ENST00000394877
  CDS Start-End: 118-1137
ctctgggaattgaagtttctgtggaaggaagcgtgagccgtaaccaggccaacccagaaaggctttctttctgagatttcacttccctgtcaactcttcagctcgaggcaccaaataatgtcatctgaaatgttgccagcatttattgaaacttctaatgttgacaaaaagcaaggcataaatgaagatcaagaggagagccagaagccaagattaggtgaagggtgtgaaccaatatctaaacgacaaatgaaaaaactaataaaacagaaacaatgggaagagcaacgggaactccgcaaacaaaagcgaaaagaaaaacgcaagaggaaaaaattagagcgacaatgtcaaatggaaccaaactcagatggacatgacagaaaacgtgttcgaagagatgttgttcatagcacccttcgccttattattgactgtagttttgatcacttgatggtattaaaggacattaagaaacttcataagcagattcaacgatgttacgcagaaaaccgacgggcactgcatcctgtgcagttttacttgacaagccacggaggccagctgaaaaagaacatggatgaaaatgacaaaggatgggtcaactggaaggatatccatatcaaaccagagcactatagtgaactcataaagaaagaagacctgatttaccttacgtcagattcacctaatatactgaaggaattagatgaatcaaaggcctatgtgattggaggattagtagatcacaaccatcacaagggactcacatataaacaagcgtcagattatggaatcaatcatgcacagctcccacttggaaattttgtgaagatgaatagtcgaaaagttttggcagttaatcatgtgtttgaaattattctggaatacctggaaacaagagactggcaagaagcattttttactatcttgccccaacggaaaggagctgttcccacagacaaagcctgtgaaagtgcttctcatgacaatcagtctgtcaggatggaggaaggtggatcggacagtgattccagtgaggaggaatatagcagaaatgaactagattcaccacatgaagaaaagcaggataaggaaaatcacactgaatctacagtgaactctctgccacactaatgttacctggtttccttttagtttaaggaaaaattaggagaaagtgaggtgctatatagaatattgaaattggaagaacattttattttctcttatttctgttgtgatttttaaaaacttttttttggacctaaataataataaaaaaaaaagccctttaaactttgtaaggaaatattttttgattttgcgtaagaagatttaaatgtgtatgtgattttttttgtttttgtttttaaagcctcagtagtttctagataattttactgtattagtatattttcattttctttcattttatattctttagaatgtgccttctgacctttcagttttttaattttatagtcacatcaacatctttatgatctattgcctatatatctgtgagggcacatattcataaatatactgtcaatctatcagcatttgtgtatggtaggttaccctctatttgcagcttttatgtttaaattagttacttgaaagaatgtagtaattttaggaagaagtatcagtttgatagacttaataattcatttcttttggactatggagcgcatatctgttccttctttatgatgcctttttatggttctgaagtaattactgaagagttgagaatctctttaatgcattttcttaattcttacaatggtgataagttacttcaattataaaattgaattttgcagactaaattattttataaggctgttgctattgaaagatcaattttgtctttacctgcatttaaaatggaacagctcttagcagctgtggtttttttttccatattttttttaaatttgttggctcttaagatgaataaagtttataggtgcatctgcctcctcttctctaagaatatgcatactaatgtttgtttctataaatcaaatacacatgtgataatatgcatgtaaatacataactatcctcatcatgtatggctctcagttcttaattgatgataacatgattgaattgccatatatctgtattacttgtgtgaatggttgtgttgaacacgctaagaacaatttgaattttattaagtacaaaaatccttaacgtttgtatgggaacattggcaagaaagaatagtgtgaaagggaactgttttagtttcctatcagtaattgtacatgcagttaaatgtttaaggtaaaatgattggtctctgtcacagctaaaagatttcagtagccttcattgagtttgggtaaaataagttgctgttcttttgtcttctttttaatatataaaagttatatttaaaaagtatataacatactatatatgttacatactaacatatatatacacaacagaaagtttattggatttagtactgatatttactgtctatttttgttactttgttcttagtaatctattatagttacctattttaaggtaaggtctgtaggcaagatatgtaagtaaagacaagccctacaattttaaaataacaaagcttatgtcttaagttgtattttttcaaaggttcatgtttttctgagtaaatgtggtttattagcatgaaatattatgccttttacttaaattattttatgtaaaatagggcactgtttaattatgaaagggggaaaatcattccaaataagagtttaatttttattaattataaaaaactctgtattagtttcctagatgtgctagaacaaattaccacaaactgggtggctttaaacaacagaaatttattctcttaacagttccagagactaaatgtccagactcacaatgtcccagtgccatgcttcctccttaggccctaggaaagaatacttcctagcctcttcctggcttttggtggttgccagcaatccctgctgttccttagcctatagtggcttgactccaatctcagttttgttgtcaagtggtcttctaccctgtcttctatgtttgtatccgtgtccaaactctttttctagggagaccagcactggattagagttcaccatgatccaatatgacctcatcttgactacatccgcaaagaccctgtctccaaataaggtcacatttacagggtaccatgtgttaggatttgacatatcttttgggggacacaattctacccactacaggcccatatcttatctaggatgttggtggcaagaaggtgaagattactacctcttttgatataactagtttctgaggtatttaaaaatttggttttaaaaatattaagctttttgctcatttgcatgtatacttttctctcaacattgttttggtttatttaggttatttgttaaaacttcagtaaatactaaagttacttgtattagaacataataaaagtagagaattaaactacctaaataaatgcatcaaaaaata

SEQ ID NO: 195270 - DNA, 802 bp, Homo sapiens
  Payload ID: 18555
  Gene Name: tRNA methyltransferase 10A
  ENST ID: ENST00000455368
  CDS Start-End: 186-802
ccgcggcctacccagctgctccctggttcgccagagacagcttaatcccgtctctgaaatgcgtttgctggctgggagcctagaagggatagtgggcgaggctccgccccgtggtggggcgctttccgtcggcgtgtgttttggggttgccatcggcccgtagtatgtgaaaaaggcaccaaataatgtcatctgaaatgttgccagcatttattgaaacttctaatgttgacaaaaagcaaggcataaatgaagatcaagaggagagccagaagccaagattaggtgaagggtgtgaaccaatatctaaacgacaaatgaaaaaactaataaaacagaaacaatgggaagagcaacgggaactccgcaaacaaaagcgaaaagaaaaacgcaagaggaaaaaattagagcgacaatgtcaaatggaaccaaactcagatggacatgacagaaaacgtgttcgaagagatgttgttcatagcacccttcgccttattattgactgtagttttgatcacttgatggtattaaaggacattaagaaacttcataagcagattcaacgatgttacgcagaaaaccgacgggcactgcatcctgtgcagttttacttgacaagccacggaggccagctgaaaaagaacatggatgaaaatgacaaaggatgggtcaactggaaggatatccatatcaaaccagagcactatagtgaactcataaagaaagaagacctgatttaccttacgtcagattcacctaatatactgaaggaattagatgaatcaaaggcctatgtgattgg

SEQ ID NO: 195271 - DNA, 788 bp, Homo sapiens
  Payload ID: 18555
  Gene Name: tRNA methyltransferase 10A
  ENST ID: ENST00000514547
  CDS Start-End: 190-788
ctacccagctgctccctggttcgccagagacagcttaatcccgtctctgaaatgcgtttgctggctgggagcctagaagggatagtgggcgaggctccgccccgtggtggggcgctttccgtcggcgtgtgttttggggttgccatcggcccgtagtatgtgaaaattgtttttcagaggcaccaaataatgtcatctgaaatgttgccagcatttattgaaacttctaatgttgacaaaaagcaaggcataaatgaagatcaagaggagagccagaagccaagattaggtgaagggtgtgaaccaatatctaaacgacaaatgaaaaaactaataaaacagaaacaatgggaagagcaacgggaactccgcaaacaaaagcgaaaagaaaaacgcaagaggaaaaaattagagcgacaatgtcaaatggaaccaaactcagatggacatgacagaaaacgtgttcgaagagatgttgttcatagcacccttcgccttattattgactgtagttttgatcacttgatggtattaaaggacattaagaaacttcataagcagattcaacgatgttacgcagaaaaccgacgggcactgcatcctgtgcagttttacttgacaagccacggaggccagctgaaaaagaacatggatgaaaatgacaaaggatgggtcaactggaaggatatccatatcaaaccagagcactatagtgaactcataaagaaagaagacctgatttaccttacgtcagattcacctaatatactgaaggaattagatgaatc

SEQ ID NO: 195272 - DNA, 2281 bp, Homo sapiens
  Payload ID: 18556
  Gene Name: tRNA methyltransferase 10B
  Uniprot ID: Q6PF06
  ENST ID: ENST00000297994
  CDS Start-End: 66-1016
cgcgccgctgccgctgcgtgggggtgaggggatcagtctggtggaaaggacagaggactaagtccatggactggaaattggaagggagtactcagaaagtagagtcacctgtgctgcaggggcaagaaggcatcctagaggagacaggtgaagatggacttcctgaaggcttccagcttctgcagatcgatgcggaaggcgagtgccaggagggagagatcctggccacaggcagtacggcatggtgctcgaaaaatgtccagagaaaacagagacactgggaaaagatagttgcagcaaagaagagcaaaagaaagcaagaaaaagaacgaagaaaagccaatcgtgcagaaaatccaggcatttgcccccagcacagcaaacgtttcctgagagctctaaccaaagacaaacttttggaagccaaacactcaggaccaagactatgtatcgatttgagtatgacccactacatgtcaaagaaggaattaagtagactggctggacagattcgaaggttgtatggttcaaacaaaaaagctgacaggccattttggatctgcctcactggattcacaacagacagtcccctttatgaagagtgtgtgaggatgaatgatggattttctagttacctgttagacataacagaagaagactgctttagtttatttcccttggaaacccttgtgtacctgactcctgactcagaacacgctcttgaagatgttgatctaaacaaagtttacatcctcggtgggcttgtggatgaaagcattcagaagaaggtgacatttcaaaaggcccgggaatactctgtcaagaccgcacgcttgccaatccaggaatacatggtcagaaaccagaatgggaaaaactatcattcagagatactggccatcaatcaagtgtttgatatcctgtccacttacttagagactcacaactggcctgaagcattgaagaaaggagtttcttcaggaaaaggctatattcttcggaactcagtggaatgatgggcctaagattgcagctgcgtggccaggtgctcacgccgtaatgccaacactttggtagaccgaagtgggcagatcacctgaggtcaggagttcacgaccagcctggccaacatggtgaaacccttctctactgaaaatacaaaaattagccaggtgtggtggcgcatacctgtagtcccagctacttgggaggctgaggcaggagaatcacttgaactcgggaggcgaaggttgcagtgagccgagatttcaccagtgcactccagcctgggtgacagagcaagactccatctcaaaaaaaaaataaataaaaaaaaatgcagctgcaggagtgaggcgcttggaggtaccttgacccaaagagcagggcagagggtggcagtggcacataggcaagtgtctttgcatgacatcttctcagagcttcacaataatgtcagggaccacatttaatgctttttaatctcccatagtgcctggctcacaggaagtgctcagatatgttaagtaataaaaagttaatgtggtgggtgcagtggctcacgcctgtaatcccagcactttgggaggctgaggtgagtggattacaaggtcaggagttccagaccagcctggctaatatggtgaaacctcgtctctactaaaaatacaaaaattagctgggcatggtggtgcgtgcctgtagtctcagctactcaggaggctgaggcaggagaatcgcctgaacccgggcggcggaggttgtagtgagccaagatccagcctgggcgacagagccagactcttgtctcgaggggaaaaaaaaaaaaaattatgtaacaaggaattagcctcaaaaccacatggctttggacgtgctaattcaacttttgtacatctatttgtgagagacctcttgaaattgtttaaatggttacatcaagagtttaatattcactaaactggcatcataaaattgtatgactttctccagccttgtctgatcatgctcgttgttgcccagctcagtaataagctttgcaggatccagcctgttctgacctatccctactgagtccccatagcattttgttccctcctgtggctcttaccttgttctcccttgcagagtatgggcatggagggcttctcttcctaatccttcctaatggtaggatcctaacaggacaaatctgtgtacctatctttctatcctccctgagcctgtaccaactagattcttcatatgtatttgtaacagattaaattggaaagcaaacaca

SEQ ID NO: 195273 - DNA, 2027 bp, Homo sapiens
  Payload ID: 18556
  Gene Name: tRNA methyltransferase 10B
  Uniprot ID: Q6PF06
  ENST ID: ENST00000377753
  CDS Start-End: 80-769
ggggggatccgatgcgcgccgctgccgctgcgtgggggtgaggggatcagtctggtggaaaggacagaggactaagtccatggactggaaattggaagggagtactcagaaagtagagtcacctgtgctgcaggggcaagaaggcatcctagaggagacaggtgaagatggacttcctgaaggcttccagcttctgcagatcgatgcggaaggcgagtgccaggagggagagatcctggccacaggcagtacggcatggtgctcggaattaagtagactggctggacagattcgaaggttgtatggttcaaacaaaaaagctgacaggccattttggatctgcctcactggattcacaacagacagtcccctttatgaagagtgtgtgaggatgaatgatggattttctagttacctgttagacataacagaagaagactgctttagtttatttcccttggaaacccttgtgtacctgactcctgactcagaacacgctcttgaagatgttgatctaaacaaagtttacatcctcggtgggcttgtggatgaaagcattcagaagaaggtgacatttcaaaaggcccgggaatactctgtcaagaccgcacgcttgccaatccaggaatacatggtcagaaaccagaatgggaaaaactatcattcagagatactggccatcaatcaagagactcacaactggcctgaagcattgaagaaaggagtttcttcaggaaaaggctatattcttcggaactcagtggaatgatgggcctaagattgcagctgcgtggccaggtgctcacgccgtaatgccaacactttggtagaccgaagtgggcagatcacctgaggtcaggagttcacgaccagcctggccaacatggtgaaacccttctctactgaaaatacaaaaattagccaggtgtggtggcgcatacctgtagtcccagctacttgggaggctgaggcaggagaatcacttgaactcgggaggcgaaggttgcagtgagccgagatttcaccagtgcactccagcctgggtgacagagcaagactccatctcaaaaaaaaaataaataaaaaaaaatgcagctgcaggagtgaggcgcttggaggtaccttgacccaaagagcagggcagagggtggcagtggcacataggcaagtgtctttgcatgacatcttctcagagcttcacaataatgtcagggaccacatttaatgctttttaatctcccatagtgcctggctcacaggaagtgctcagatatgttaagtaataaaaagttaatgtggtgggtgcagtggctcacgcctgtaatcccagcactttgggaggctgaggtgagtggattacaaggtcaggagttccagaccagcctggctaatatggtgaaacctcgtctctactaaaaatacaaaaattagctgggcatggtggtgcgtgcctgtagtctcagctactcaggaggctgaggcaggagaatcgcctgaacccgggcggcggaggttgtagtgagccaagatccagcctgggcgacagagccagactcttgtctcgaggggaaaaaaaaaaaaaattatgtaacaaggaattagcctcaaaaccacatggctttggacgtgctaattcaacttttgtacatctatttgtgagagacctcttgaaattgtttaaatggttacatcaagagtttaatattcactaaactggcatcataaaattgtatgactttctccagccttgtctgatcatgctcgttgttgcccagctcagtaataagctttgcaggatccagcctgttctgacctatccctactgagtccccatagcattttgttccctcctgtggctcttaccttgttctcccttgcagagtatgggcatggagggcttctcttcctaatccttcctaatggtaggatcctaacaggacaaatctgtgtacctatctttctatcctccctgagcctgtaccaactagattcttcatatgtatttgtaacagattaaattggaaagc

SEQ ID NO: 195274 - DNA, 1881 bp, Homo sapiens
  Payload ID: 18556
  Gene Name: tRNA methyltransferase 10B
  Uniprot ID: Q6PF06
  ENST ID: ENST00000377754
  CDS Start-End: 242-907
cgcgccgctgccgctgcgtgggggtgaggggatcagtctggtggaaaggacagaggactaagtccatggactggaaattggaagggagtactcagaaagtagagtcacctgtgctgcaggggcaagaaggcatcctagaggagacaggtgaagatggacttcctgaaggcttccagcttctgcagatcgatgcggaaggcgagtgccaggagggagagatcctggccacaggcagtacggcatggtgctcggcatttgcccccagcacagcaaacgtttcctgagagctctaaccaaagacaaacttttggaagccaaacactcaggaccaagactatgtatcgatttgagtatgacccactacatgtcaaagaaggaattaagtagactggctggacagattcgaaggttgtatggttcaaacaaaaaagctgacaggccattttggatctgcctcactggattcacaacagacagtcccctttatgaagagtgtgtgaggatgaatgatggattttctagttacctgttagacataacagaagaagactgctttagtttatttcccttggaaacccttgtgtacctgactcctgactcagaacacgctcttgaagatgttgatctaaacaaagtttacatcctcggtgggcttgtggatgaaagcattcagaagaaggtgacatttcaaaaggcccgggaatactctgtcaagaccgcacgcttgccaatccaggaatacatggtcagaaaccagaatgggaaaaactatcattcagagatactggccatcaatcaagtgtttgatatcctgtccacttacttagagactcacaactggcctgaagcattgaagaaaggagtttcttcaggaaaaggctatattcttcggaactcagtggaatgatgggcctaagattgcagctgcgtggccaggtgctcacgccgtaatgccaacactttggtagaccgaagtgggcagatcacctgaggtcaggagttcacgaccagcctggccaacatggtgaaacccttctctactgaaaatacaaaaattagccaggtgtggtggcgcatacctgtagtcccagctacttgggaggctgaggcaggagaatcacttgaactcgggaggcgaaggttgcagtgagccgagatttcaccagtgcactccagcctgggtgacagagcaagactccatctcaaaaaaaaaataaataaaaaaaaatgcagctgcaggagtgaggcgcttggaggtaccttgacccaaagagcagggcagagggtggcagtggcacataggcaagtgtctttgcatgacatcttctcagagcttcacaataatgtcagggaccacatttaatgctttttaatctcccatagtgcctggctcacaggaagtgctcagatatgttaagtaataaaaagttaatgtggtgggtgcagtggctcacgcctgtaatcccagcactttgggaggctgaggtgagtggattacaaggtcaggagttccagaccagcctggctaatatggtgaaacctcgtctctactaaaaatacaaaaattagctgggcatggtggtgcgtgcctgtagtctcagctactcaggaggctgaggcaggagaatcgcctgaacccgggcggcggaggttgtagtgagccaagatccagcctgggcgacagagccagactcttgtctcgaggggaaaaaaaaaaaaaattatgtaacaaggaattagcctcaaaaccacatggctttggacgtgctaattcaacttttgtacatctatttgtgagagacctcttgaaattgtttaaatggttacatcaagagtttaatattcactaaactggcatcataaaattgtatgactttctcc

SEQ ID NO: 195275 - DNA, 1443 bp, Homo sapiens
  Payload ID: 18556
  Gene Name: tRNA methyltransferase 10B
  Uniprot ID: Q6PF06
  ENST ID: ENST00000488673
  CDS Start-End: 66-590
cgcgccgctgccgctgcgtgggggtgaggggatcagtctggtggaaaggacagaggactaagtccatggactggaaattggaagggagtactcagaaagtagagtcacctgtgctgcaggggcaagaaggcatcctagaggagacaggtgaagatggacttcctgaaggcttccagcttctgcagatcgatgcggaaggcgagtgccaggagggagagatcctggccacaggcagtacggcatggtgctcgaaaaatgtccagagaaaacagagacactgggaaaagatagttgcagcaaagaagagcaaaagaaagcaagaaaaagaacgaagaaaagccaatcgtgcagaaaatccaggcatttgcccccagcacagcaaacgtttcctgagagctctaaccaaagacaaacttttggaagccaaacactcaggaccaagactatgtatcgatttgagtatgacccactacatgtcaaagaaggtagaacatccactaagcctggaattcctgctcgccatgagggaggcccagaagggtacagctttccgaagaatatggtcaactccagcttctgggattccttagtaaactagaattaagtagactggctggacagattcgaaggttgtatggttcaaacaaaaaagctgacaggccattttggatctgcctcactggattcacaacagacagtcccctttatgaagagtgtgtgaggatgaatgatggattttctagttacctgttagacataacagaagaagactgctttagtttatttcccttggaaacccttgtgtacctgactcctgactcagaacacgctcttgaagatgttgatctaaacaaagtttacatcctcggtgggcttgtggatgaaagcattcagaagaaggtgacatttcaaaaggcccgggaatactctgtcaagaccgcacgcttgccaatccaggaatacatggtcagaaaccagaatgggaaaaactatcattcagagatactggccatcaatcaagtgtttgatatcctgtccacttacttagagactcacaactggcctgaagcattgaagaaaggagtttcttcaggaaaaggctatattcttcggaactcagtggaatgatgggcctaagattgcagctgcgtggccaggtgctcacgccgtaatgccaacactttggtagaccgaagtgggcagatcacctgaggtcaggagttcacgaccagcctggccaacatggtgaaacccttctctactgaaaatacaaaaattagccaggtgtggtggcgcatacctgtagtcccagctacttgggaggctgaggcaggagaatcacttgaactcgggaggcgaaggttgcagtgagccgagatttcaccagtgcactccagcctgggtgacagagcaagactccatctcaaaaaaaaaataaataaa

SEQ ID NO: 195276 - DNA, 777 bp, Homo sapiens
  Payload ID: 18556
  Gene Name: tRNA methyltransferase 10B
  ENST ID: ENST00000537016
  CDS Start-End: 66-491
cgcgccgctgccgctgcgtgggggtgaggggatcagtctggtggaaaggacagaggactaagtccatggactggaaattggaagggagtactcagaaagtagagtcacctgtgctgcaggggcaagaaggcatcctagaggagacaggtgaagatggacttcctgaaggcttccagcttctgcagatcgatgcggaaggcgagtgccaggagggagagatcctggccacaggcagtacggcatggtgctcgaaaaatgtccagagaaaacagagacactgggaaaagatagttgcagcaaagaagagcaaaagaaagcaagaaaaagaacgaagaaaagccaatcgtgcagaaaatccaggcatttgcccccagcacagcaaacgtttcctgagagctctaaccaaagacaaacttttggaagccaaacactcaggaccaagactatgtatcgatttgagtatgacccactacatgtcaaagaagacataacagaagaagactgctttagtttatttcccttggaaacccttgtgtacctgactcctgactcagaacacgctcttgaagatgttgatctaaacaaagtttacatcctcggtgggcttgtggatgaaagcattcagaagaaggtgacatttcaaaaggcccgggaatactctgtcaagaccgcacgcttgccaatccaggaatacatggtcagaaaccagaatgggaaaaactatcattcagagatactggccatcaatcaaggtacttcttacacggcccccatcca

SEQ ID NO: 195277 - DNA, 2108 bp, Homo sapiens
  Payload ID: 18556
  Gene Name: tRNA methyltransferase 10B
  Uniprot ID: Q6PF06
  ENST ID: ENST00000537911
  CDS Start-End: 80-850
ggggggatccgatgcgcgccgctgccgctgcgtgggggtgaggggatcagtctggtggaaaggacagaggactaagtccatggactggaaattggaagggagtactcagaaagtagagtcacctgtgctgcaggggcaagaaggcatcctagaggagacaggtgaagatggacttcctgaaggcttccagcttctgcagatcgatgcggaaggcgagtgccaggagggagagatcctggccacaggcagtacggcatggtgctcgaaaaatgtccagagaaaacagagacactgggaaaagatagttgcagcaaagaagagcaaaagaaagcaagaaaaagaacgaagaaaagccaatcgtgcagaaaatccaggcatttgcccccagcacagcaaacgtttcctgagagctctaaccaaagacaaacttttggaagccaaacactcaggaccaagactatgtatcgatttgagtatgacccactacatgtcaaagaagttagacataacagaagaagactgctttagtttatttcccttggaaacccttgtgtacctgactcctgactcagaacacgctcttgaagatgttgatctaaacaaagtttacatcctcggtgggcttgtggatgaaagcattcagaagaaggtgacatttcaaaaggcccgggaatactctgtcaagaccgcacgcttgccaatccaggaatacatggtcagaaaccagaatgggaaaaactatcattcagagatactggccatcaatcaagagactcacaactggcctgaagcattgaagaaaggagtttcttcaggaaaaggctatattcttcggaactcagtggaatgatgggcctaagattgcagctgcgtggccaggtgctcacgccgtaatgccaacactttggtagaccgaagtgggcagatcacctgaggtcaggagttcacgaccagcctggccaacatggtgaaacccttctctactgaaaatacaaaaattagccaggtgtggtggcgcatacctgtagtcccagctacttgggaggctgaggcaggagaatcacttgaactcgggaggcgaaggttgcagtgagccgagatttcaccagtgcactccagcctgggtgacagagcaagactccatctcaaaaaaaaaataaataaaaaaaaatgcagctgcaggagtgaggcgcttggaggtaccttgacccaaagagcagggcagagggtggcagtggcacataggcaagtgtctttgcatgacatcttctcagagcttcacaataatgtcagggaccacatttaatgctttttaatctcccatagtgcctggctcacaggaagtgctcagatatgttaagtaataaaaagttaatgtggtgggtgcagtggctcacgcctgtaatcccagcactttgggaggctgaggtgagtggattacaaggtcaggagttccagaccagcctggctaatatggtgaaacctcgtctctactaaaaatacaaaaattagctgggcatggtggtgcgtgcctgtagtctcagctactcaggaggctgaggcaggagaatcgcctgaacccgggcggcggaggttgtagtgagccaagatccagcctgggcgacagagccagactcttgtctcgaggggaaaaaaaaaaaaaattatgtaacaaggaattagcctcaaaaccacatggctttggacgtgctaattcaacttttgtacatctatttgtgagagacctcttgaaattgtttaaatggttacatcaagagtttaatattcactaaactggcatcataaaattgtatgactttctccagccttgtctgatcatgctcgttgttgcccagctcagtaataagctttgcaggatccagcctgttctgacctatccctactgagtccccatagcattttgttccctcctgtggctcttaccttgttctcccttgcagagtatgggcatggagggcttctcttcctaatccttcctaatggtaggatcctaacaggacaaatctgtgtacctatctttctatcctccctgagcctgtaccaactagattcttcatatgtatttgtaacagattaaattggaaagc

SEQ ID NO: 195278 - DNA, 576 bp, Homo sapiens
  Payload ID: 18556
  Gene Name: tRNA methyltransferase 10B
  ENST ID: ENST00000538370
  CDS Start-End: 66-284
cgcgccgctgccgctgcgtgggggtgaggggatcagtctggtggaaaggacagaggactaagtccatggactggaaattggaagggagtactcagaaagtagagtcacctgtgctgcaggggcaagaaggcatcctagaggagacaggtgaagatggacttcctgaaggcttccagcttctgcagatcgatgcggaaggcgagtgccaggagggagagatcctggccacaggcagtacggcatggtgctcggcatttgcccccagcacagcaaacgtttcctgagagctctaaccaaagacaaacttttggaagccaaacactcaggaccaagactatgtatcgatttgagtatgacccactacatgtcaaagaaggtagaacatccactaagcctggaattcctgctcgccatgagggaggcccagaagggtacagctttccgaagaatatggtcaactccagcttctgggattccttagtaaactagaattaagtagactggctggacagattcgaaggttgtatggttcaaacaaaaaagctgacaggccattttggatctgcctcactggat

SEQ ID NO: 195279 - DNA, 523 bp, Homo sapiens
  Payload ID: 18556
  Gene Name: tRNA methyltransferase 10B
  ENST ID: ENST00000540616
  CDS Start-End: 66-284
cgcgccgctgccgctgcgtgggggtgaggggatcagtctggtggaaaggacagaggactaagtccatggactggaaattggaagggagtactcagaaagtagagtcacctgtgctgcaggggcaagaaggcatcctagaggagacaggtgaagatggacttcctgaaggcttccagcttctgcagatcgatgcggaaggcgagtgccaggagggagagatcctggccacaggcagtacggcatggtgctcgttctcaaacaattttgttttctggataatataagaaaaatgtccagagaaaacagagacactgggaaaagatagttgcagcaaagaagagcaaaagaaagcaagaaaaagaacgaagaaaagccaatcgtgcagaaaatccaggcatttgcccccagcacagcaaacgtttcctgagagctctaaccaaagacaaacttttggaagccaaacactcaggaccaagactatgtatcgatttgagtatgacccactacatgtcaaagaaggtag

SEQ ID NO: 195280 - DNA, 1819 bp, Homo sapiens
  Payload ID: 18557
  Gene Name: tRNA methyltransferase 10C, mitochondrial RNase P subunit
  Uniprot ID: Q7L0Y3
  ENST ID: ENST00000309922
  CDS Start-End: 155-1366
cgctctggtcggctgtgtagactgttgggtaggctgcgtgctagcttcggcgcggatccctgggcgtccgtacgtcggagtccttcgtcctccagggtccctgttctttgcgccagcgggaaccactatctctgcactcctggggttttgttacatggctgctttcctcaaaatgagtgttagtgtcaatttcttcagacctttcaccaggtttttggtgccatttacccttcataggaagagaaataacttaacaattttgcagagatacatgtcttccaaaataccagctgttacttatcctaaaaatgagagtacacccccttctgaagagctagagttggataagtggaaaactaccatgaaatctagtgtgcaagaagaatgtgtttcaacaatctcaagcagtaaggatgaagatcctctagctgccaccagagagttcattgagatgtggagattgcttggcagagaagtaccagaacacatcactgaagaagagctcaaaacccttatggaatgtgtttctaacacagcaaaaaaaaaatatttaaaatatttatatacgaaggaaaaagtgaaaaaagctaggcaaataaaaaaggaaatgaaagcagcagcaagggaagaagcaaaaaatatcaagctgctagaaaccactgaggaagataaacagaaaaactttctatttttacgactttgggataggaatatggacatagcaatgggctggaagggtgcccaggccatgcagtttggacaacctttggtttttgacatggcttacgaaaattatatgaaacgaaaagaattgcagaatactgtttcccagcttttagaaagtgaaggatggaacagaagaaatgttgatcctttccatatttatttctgcaatctaaaaatagatggtgctttgcacagagagttagttaaacggtatcaagaaaaatgggacaaattgcttttaacatcaacagaaaagtctcatgtagatttatttccaaaggacagtattatctatttaactgcagattctcccaatgttatgactactttcaggcatgacaaagtttatgtaattgggtcttttgttgataagagtatgcagccaggcacatccctagccaaggcaaaacggctgaacctggcaactgaatgccttccattagataaatatttacaatgggaaattggtaacaaaaatctcaccttagatcaaatgatacgtattttgttatgtctgaaaaacaatggtaattggcaagaggctctgcaattcgttcccaagagaaaacatactggttttctggagatttctcagcattctcaagagtttatcaacagactaaagaaggcaaagacttaattcattttcaaaaggttctctgaatgtgcacagaacacgtggctcaaatgagaacatttgatggcttaaaaagtaaatgcgttagaaatacagttctgttaatgtatttcttcccaaacaattcatttttctcttctaaaggtagtctttcccaactgactgtagggttgtgtcttttcccaattaaatatctgcagaactttgggattatactttgtttactgtagaaagataataaaaagagttgtccaagattgttgaacagaataatctttatcccagttaaatagttgtaccattggtagacttttttatggaggttcctagagggtggtgccctggggtgggcttggaagctctgcaccccttcccccatagctttccccgtgcatctctttgtctgtatgttttgtaatatcttttacagtaaactggtaaatgtgtttccttcaa

SEQ ID NO: 195281 - DNA, 1017 bp, Homo sapiens
  Payload ID: 18557
  Gene Name: tRNA methyltransferase 10C, mitochondrial RNase P subunit
  ENST ID: ENST00000495642
  CDS Start-End: 82-1017
ggggtgggaggacgccggagacgttccaagatgcacttagtggagcatgtgcgttcggaaggcccacgggggttttgttacatggctgctttcctcaaaatgagtgttagtgtcaatttcttcagacctttcaccaggtttttggtgccatttacccttcataggaagagaaataacttaacaattttgcagagatacatgtcttccaaaataccagctgttacttatcctaaaaatgagagtacacccccttctgaagagctagagttggataagtggaaaactaccatgaaatctagtgtgcaagaagaatgtgtttcaacaatctcaagcagtaaggatgaagatcctctagctgccaccagagagttcattgagatgtggagattgcttggcagagaagtaccagaacacatcactgaagaagagctcaaaacccttatggaatgtgtttctaacacagcaaaaaaaaaatatttaaaatatttatatacgaaggaaaaagtgaaaaaagctaggcaaataaaaaaggaaatgaaagcagcagcaagggaagaagcaaaaaatatcaagctgctagaaaccactgaggaagataaacagaaaaactttctatttttacgactttgggataggaatatggacatagcaatgggctggaagggtgcccaggccatgcagtttggacaacctttggtttttgacatggcttacgaaaattatatgaaacgaaaagaattgcagaatactgtttcccagcttttagaaagtgaaggatggaacagaagaaatgttgatcctttccatatttatttctgcaatctaaaaatagatggtgctttgcacagagagttagttaaacggtatcaagaaaaatgggacaaattgcttttaacatcaacagaaaagtctcatgtagatttatttccaaaggacagtattatctatttaactgcagattctcccaatgttatgactactttcaggcatgacaaagtttatgtaattgggtctttt

SEQ ID NO: 195282 - DNA, 1949 bp, Homo sapiens
  Payload ID: 18558
  Gene Name: tRNA methyltransferase 11 homolog
  Uniprot ID: Q7Z4G4
  ENST ID: ENST00000334379
  CDS Start-End: 122-1513
cgcctgcctcgcagagcttccgcttccggcccttcaggctctgtctctgtggagactgggctttgggagggagaaagagggacctagcgcgggccgcgcaggcgcacggtgggcagctgcaatggcgctgtcgtgtacccttaacaggtatctgctcctcatggcgcaggagcatctggagttccgcctgccggaaataaagtctttgcttttgctttttggaggtcagtttgccagcagtcaagaaacttatggaaagtcaccattttggattcttagcattccctctgaagatattgcaagaaatttgatgaaacggacagtgtgtgccaagtctatatttgaactatggggtcatggacaatctcctgaggagctgtacagttctcttaaaaactaccctgtggagaagatggttccatttctacattcggactctacatataaaataaagattcacacttttaataagacattgacacaagaagagaaaatcaagcgaatagatgcacttgaatttctgccatttgaaggaaaagtgaatttaaagaaaccgcaacatgtattttctgttttggaggattatggtttagacccaaactgcatccctgagaatccacataatatttattttggtagatggattgcagatggacagagagagcttattgagtcatacagtgtcaaaaagagacactttattggaaatacaagtatggatgctggtttgtcattcattatggctaaccatggaaaagtgaaagaaaatgatattgtctttgatccatttgttggaacaggtggcctgctgatagcatgtgctcattttggtgcatatgtgtatgggacagacatagactacaacacagttcatggcttgggaaaggctactaggaaaaaccagaagtggagaggaccagatgaaaacattagggccaatcttcgtcaatatggtttagagaagtattaccttgatgtcctggtttcagatgcatctaaaccttcctggaggaagggcacatattttgatgcaatcattactgatcctccatatggtatcagagaatctacaagaagaacaggttcacagaaggagataccaaaggggatagaaaaatgggaaaaatgtccagaaagccatgttcctgtttccttgagttatcatctgagtgatatgtttcttgacctgttaaacttcgcagctgagaccctcgttttaggtggaagactagtctattggttaccggtgtatacgccagaatacactgaagagatggtgccttggcacccttgcctggaactcgttagcaactgcgagcagaagctttccagtcacacatcaaggcgcttgatcacaatggaaaaggtgaagaaatttgagaatcgggaccagtattcacatctgctaagtgatcattttctgccataccaaggtcataattccttccgtgagaaatattttagtggggtaacaaaaagaattgccaaggaagaaaaatccacccaggaatgaaaattaagattttgacaatgaagaaagaataagaatttgatttaaaaagacatctggatgtgaactttcatgtatgatccagaaaataggtacggttttaaaatattttatatagaaaagctacaaagtaaattgagcaatgcttttaaagttatctttgttttatagacttttttgttgtatgtattacagtctttataatcttatttaatgtatatttgtactttcaagtactgatggagatagactcaaaacagttatttttttacaattaatctacaaagggaattaatattgttgacttttaaaacatctgctggatatattatatgcaattaatagtagttaagaatttattcatttggtagatatgtttatttggtttttggttgtcatcgatttacattgccactaataaaccatattgagaatttct

SEQ ID NO: 195283 - DNA, 1889 bp, Homo sapiens
  Payload ID: 18558
  Gene Name: tRNA methyltransferase 11 homolog
  Uniprot ID: Q7Z4G4
  ENST ID: ENST00000368332
  CDS Start-End: 73-1449
tggagactgggctttgggagggagaaagagggacctagcgcgggccgcgcaggcgcacggtgggcagctgcaatggcgctgtcgtgtacccttaacaggtatctgctcctcatggcgcaggagcatctggagttccgcctgccggaaataaagtctttgcttttgctttttggaggtcagtttgccagcagtcaagaaacttatggaaagtcaccattttggattcttagcattccctctgaagatattgcaagaaatttgatgaaacggacagtgtgtgccaagtctatatttgaactatggggtcatggacaatctcctgaggagctgtacagttctcttaaaaactaccctgtggagaagatggttccatttctacattcggactctacatataaaataaagattcacacttttaataagacattgacacaagaagagaaaatcaagcgaatagatgcacttgaatttctgccatttgaaggaaaagtgaatttaaagaaaccgcaacatgtattttctgttttggaggattatggtttagacccaaactgcatccctgagaatccacataatatttattttggtagatggattgcagatggacagagagagcttattgagtcatacagtgtcaaaaagagacactttattggaaatacaagtatggatgctggtttgtcattcattatggctaaccatggaaaagtgaaagaaaatgatattgtctttgatccatttgttggaacaggtggcctgctgatagcatgtgctcattttggtgcatatgtgtatgggacagacatagactacaacacagttcatggcttgggaaaggctactaggaaaaaccagaagtggagaggaccagatgaaaacattagggccaatcttcgtcaatatggtttagagaagtattaccttgatgtcctggtttcagatgcatctaaaccttcctggaggaagggcacatattttgatgcaatcattactgatcctccatatggtatcagagaatctacaagaagaacaggttcacagaaggagataccaaaggggatagaaaaatgggaaaaatgtccagaaagccatgttcctgtttccttgagttatcatctgagtgatatgtttcttgacctgttaaacttcgcagctgagaccctcgttttaggtggaagactagtctattggttaccggtgtatacgccagaatacactgaagagatggtgccttggcacccttgcctggaactcgttagcaactgcgagcagaagctttccagtcacacatcaaggcgcttgatcacaatggaaaagaatcgggaccagtattcacatctgctaagtgatcattttctgccataccaaggtcataattccttccgtgagaaatattttagtggggtaacaaaaagaattgccaaggaagaaaaatccacccaggaatgaaaattaagattttgacaatgaagaaagaataagaatttgatttaaaaagacatctggatgtgaactttcatgtatgatccagaaaataggtacggttttaaaatattttatatagaaaagctacaaagtaaattgagcaatgcttttaaagttatctttgttttatagacttttttgttgtatgtattacagtctttataatcttatttaatgtatatttgtactttcaagtactgatggagatagactcaaaacagttatttttttacaattaatctacaaagggaattaatattgttgacttttaaaacatctgctggatatattatatgcaattaatagtagttaagaatttattcatttggtagatatgtttatttggtttttggttgtcatcgatttacattgccactaataaaccatattgagaatttctaaaa

SEQ ID NO: 195284 - DNA, 617 bp, Homo sapiens
  Payload ID: 18558
  Gene Name: tRNA methyltransferase 11 homolog
  ENST ID: ENST00000444121
  CDS Start-End: 339-617
ggcgctgtcgtgtacccttaacaggtatctgctcctcatggcgcaggagcatctggagttccgcctgccggtgagtccgtagcgccctccggaacttccgacggaagaggacgctggagtggagtggagtgggtggaggtgatctgcatagcccgaggaagctgggattcgggggtcttcgctggtctgcgcgggtcacgcgtccccagtcctcgggcggggaaataaagtctttgcttttgctttttggaggtcagtttgccagcagtcaagaaacttatggaaagtcaccattttggattcttagcattccctctgaagatattgcaagaaatttgatgaaacggacagtgtgtgccaagtctatatttgaactatggggtcatggacaatctcctgaggagctgtacagttctcttaaaaactaccctgtggagaagatggttccatttctacattcggactctacatataaaataaagattcacacttttaataagacattgacacaagaagagaaaatcaagcgaatagatgcacttgaatttctgccatttgaaggaaaagtgaatttaaagaaaccgcaacatgtattttctgttttggaggattatggt

SEQ ID NO: 195285 - DNA, 393 bp, Homo sapiens
  Payload ID: 18558
  Gene Name: tRNA methyltransferase 11 homolog
  ENST ID: ENST00000453993
  CDS Start-End: 1-393
tttgtcattcattatggctaaccatggaaaagtgaaagaaaatgatattgtctttgatccatttgttggaacaggtggcctgctgatagcatgtgctcattttggtgcatatgtgtatgggacagacatagactacaacacagttcatggcttgggaaaggctactaggaaaaaccagaagtggagaggaccagatgaaaacattagggccaatcttcgtcaatatggtttagagaagtattaccttgatgtcctggtttcagatgcatctaaaccttcctggaggaagggcacatattttgatgcaatcattactgatcctccatatggtatcagagaatctacaagaagaacaggttcacagaaggagataccaaaggggatagaaaaatg

SEQ ID NO: 195286 - DNA, 657 bp, Homo sapiens
  Payload ID: 18558
  Gene Name: tRNA methyltransferase 11 homolog
  ENST ID: ENST00000446681
  CDS Start-End: 256-657
ggcgctgtcgtgtacccttaacaggtatctgctcctcatggcgcaggagcatctggagttccgcctgccggtgagtccgtagcgccctccggaacttccgacggaagaggacgctggagtggagtggagtgggtggaggaaataaagtctttgcttttgctttttggaggtcagtttgccagcagtcaagaaacttatggaaagtcaccattttggattcttagcattccctctgaagatattgcaagaaatttgatgaaacggacagtgtgtgccaagtctatatttgaactatggggtcatggacaatctcctgaggagctgtacagttctcttaaaaactaccctgtggagaagatggttccatttctacattcggactctacatataaaataaagattcacacttttaataagacattgacacaagaagagaaaatcaagcgaatagatgcacttgaatttctgccatttgaaggaaaagtgaatttaaagaaaccgcaacatgtattttctgttttggaggattatggtttagacccaaactgcatccctgagaatccacataatatttattttggtagatggattgcagatggacagagagagcttattgagtcatacagtgtcaaaaagagacactttattggaaataca

SEQ ID NO: 195287 - DNA, 2093 bp, Homo sapiens
  Payload ID: 18558
  Gene Name: tRNA methyltransferase 11 homolog
  Uniprot ID: Q7Z4G4
  ENST ID: ENST00000479748
  CDS Start-End: 73-846
tggagactgggctttgggagggagaaagagggacctagcgcgggccgcgcaggcgcacggtgggcagctgcaatggcgctgtcgtgtacccttaacaggtatctgctcctcatggcgcaggagcatctggagttccgcctgccggaaataaagtctttgcttttgctttttggaggtcagtttgccagcagtcaagaaacttatggaaagtcaccattttggattcttagcattccctctgaagatattgcaagaaatttgatgaaacggacagtgtgtgccaagtctatatttgaactatggggtcatggacaatctcctgaggagctgtacagttctcttaaaaactaccctgtggagaagatggttccatttctacattcggactctacatataaaataaagattcacacttttaataagacattgacacaagaagagaaaatcaagcgaatagatgcacttgaatttctgccatttgaaggaaaagtgaatttaaagaaaccgcaacatgtattttctgttttggaggattatggtttagacccaaactgcatccctgagaatccacataatatttattttggtagatggattgcagatggacagagagagcttattgagtcatacagtgtcaaaaagagacactttattggaaatacaagtatggatgctggtttgtcattcattatggctaaccatggaaaagtgaaagaaaatgatattgtctttgatccatttgttggaacaggtggcctgctgatagcatgtgctcattttggtgcatatgtgtatgggacagacatagactacaacacagttcatggcttggcctgctcaacatgaaggtgatgaggatgaagacctttatgatgatccacttccacttcatgaatagtaaatctatttttactgaataaagtaattatggaaaatattttaaactctagaagcttcaataatgatgtgtgattggatggaattgaatcaaactgaaaaagtatttccttatagcttaatggaaaggctactaggaaaaaccagaagtggagaggaccagatgaaaacattagggccaatcttcgtcaatatggtttagagaagtattaccttgatgtcctggtttcagatgcatctaaaccttcctggaggaagggcacatattttgatgcaatcattactgatcctccatatggtatcagagaatctacaagaagaacaggttcacagaaggagataccaaaggggatagaaaaatgggaaaaatgtccagaaagccatgttcctgtttccttgagttatcatctgagtgatatgtttcttgacctgttaaacttcgcagctgagaccctcgttttaggtggaagactagtctattggttaccggtgtatacgccagaatacactgaagagatggtgccttggcacccttgcctggaactcgttagcaactgcgagcagaagctttccagtcacacatcaaggcgcttgatcacaatggaaaaggtgaagaaatttgagaatcgggaccagtattcacatctgctaagtgatcattttctgccataccaaggtcataattccttccgtgagaaatattttagtggggtaacaaaaagaattgccaaggaagaaaaatccacccaggaatgaaaattaagattttgacaatgaagaaagaataagaatttgatttaaaaagacatctggatgtgaactttcatgtatgatccagaaaataggtacggttttaaaatattttatatagaaaagctacaaagtaaattgagcaatgcttttaaagttatctttgttttatagacttttttgttgtatgtattacagtctttataatcttatttaatgtatatttgtactttcaagtactgatggagatagactcaaaacagttatttttttacaattaatctacaaagggaattaatattgttgacttttaaaacatctgctggatatattatatgcaattaatagtagttaagaatttattcatttggtagatatgtttatttggtttttggttgtcatcgatttacattgccactaataaaccatattgagaatttctaaaa

SEQ ID NO: 195288 - DNA, 258 bp, Homo sapiens
  Payload ID: 18558
  Gene Name: tRNA methyltransferase 11 homolog
  ENST ID: ENST00000473273
  CDS Start-End: 1-258
atggcgctgtcgtgtacccttaacaggtatctgctcctcatggcgcaggagcatctggagttccgcctgccgtttgccagcagtcaagaaacttatggaaagtcaccattttggattcttagcattccctctgaagatattgcaagaaatttgatgaaacggacagtgtgtgccaagtctatatttgaactatggggtcatggacaatctcctgaggagctgtacagttctcttaaaaactaccctgtggagaagatg

SEQ ID NO: 195289 - DNA, 729 bp, Homo sapiens
  Payload ID: 18558
  Gene Name: tRNA methyltransferase 11 homolog
  ENST ID: ENST00000466316
  CDS Start-End: 1-14
cagtgtacttgtaaattgggtcttctcaaaactcactctaaccaaatggataaggttctgttaaggaagcacaggaaagcttttctgttccccttgacaactagttcttctaggtggcctgctgatagcatgtgctcattttggtgcatatgtgtatgggacagacatagactacaacacagttcatggcttgggaaaggctactaggaaaaaccagaagtggagaggaccagatgaaaacattagggccaatcttcgtcaatatggtttagagaagtattaccttgatgtcctggtttcagatgcatctaaaccttcctggaggaagggcacatattttgatgcaatcattactgatcctccatatggtatcagagaatctacaagaagaacaggttcacagaaggagataccaaaggggatagaaaaatgaaagccatgttcctgtttccttgagttatcatctgagtgatatgtttcttgacctgttaaacttcgcagctgagaccctcgttttaggtggaagactagtctattggttaccggtgtatacgccagaatacactgaagagatggtgccttggcacccttgcctggaactcgttagcaactgcgagcagaagctttccagtcacacatcaaggcgcttgatcacaatggaaaaggtgaagaaatttgagaatcgggaccagtattcacatctgctaagtgatcattttctgccatacc

SEQ ID NO: 195290 - DNA, 1009 bp, Homo sapiens
  Payload ID: 18558
  Gene Name: tRNA methyltransferase 11 homolog
  ENST ID: ENST00000468097
  CDS Start-End: 26-718
cgcaggcgcacggtgggcagctgcaatggcgctgtcgtgtacccttaacaggtatctgctcctcatggcgcaggagcatctggagttccgcctgccggaaataaagtctttgcttttgctttttggaggtcagtttgccagcagtcaagaaacttatggaaagtcaccattttggattcttagcattccctctgaagatattgcaagaaatttgatgaaacggacagtgtgtgccaagtctatatttgaactatggggtcatggacaatctcctgaggagctgtacagttctcttaaaaactaccctgtggagaagatggttccatttctacattcggactctacatataaaataaagattcacacttttaataagacattgacacaagaagagaaaatcaagcgaatagatgcacttgaatttctgccatttgaaggaaaagtgaatttaaagaaaccgcaacatgtattttctgttttggaggattatggtttagacccaaactgcatccctgagaatccacataatatttattttggtagatggattgcagatggacagagagagcttattgagtcatacagtgtcaaaaagagacactttattggaaatacaagtatggatgctggtttgtcattcattatggctaaccatggaaaagtgaaagaaaatgatattgtctttgatccatttgttggaacagcagtgtacttgtaaattgggtcttctcaaaactcactctaaccaaatggataaggttctgttaaggaagcacaggaaagcttttctgttccccttgacaactagttcttctaggtggcctgctgatagcatgtgctcattttggtgcatatgtgtatgggacagacatagactacaacacagttcatggcttggcctgctcaacatgaaggtgatgaggatgaagacctttatgatgatccacttccacttcatgaatagtaaatctatttttactgaataaagaaaggctactaggaaaaacca

SEQ ID NO: 195291 - DNA, 758 bp, Homo sapiens
  Payload ID: 18558
  Gene Name: tRNA methyltransferase 11 homolog
  ENST ID: ENST00000461129
  CDS Start-End: 73-321
tggagactgggctttgggagggagaaagagggacctagcgcgggccgcgcaggcgcacggtgggcagctgcaatggcgctgtcgtgtacccttaacaggtatctgctcctcatggcgcaggagcatctggagttccgcctgccggaaataaagtctttgcttttgctttttggaggtcagtttgccagcagtcaagaaacttatggaaagtcaccattttggattcttagcattccctctgaagatattgcaagaaatttgatgaaacggacagtgtgtgccaagttccatttctacattcggactctacatataaaataaagattcacacttttaataagacattgacacaagaagagaaaatcaagcgaatagatgcacttgaatttctgccatttgaaggaaaagtgaatttaaagaaaccgcaacatgtattttctgttttggaggattatggtttagacccaaactgcatccctgagaatccacataatatttattttggtagatggattgcagatggacagagagagcttattgagtcatacagtgtcaaaaagagacactttattggaaatacaagtatggatgctggtttgtcattcattatggctaaccatggaaaagtgaaagaaaatgatattgtctttgatccatttgttggaacaggtggcctgctgatagcatgtgctcattttggtgcatatgtgtatgggacagacatagactacaacacagttcatggcttgggtgagtag

SEQ ID NO: 195292 - DNA, 561 bp, Homo sapiens
  Payload ID: 18559
  Gene Name: tRNA methyltransferase 11-2 homolog (S. cerevisiae)
  Uniprot ID: Q9UI30
  ENST ID: ENST00000308774
  CDS Start-End: 33-395
ggttccggcctggcgagagtttgtgcggcgacatgaaactgcttacccacaatctgctgagctcgcatgtgcggggggtggggtcccgtggcttccccctgcgcctccaggccaccgaggtccgtatctgccctgtggaattcaaccccaacttcgtggcgcgtatgatacctaaagtggagtggtcggcgttcctggaggcggccgataacgtgccgaaagggccggttgagggatatgaggagaatgaggagtttctgaggaccatgcaccacctgctgctggaggtggaagtgatagagggcaccctgcagtgcccggaatctggacgtatgttccccatcagccgcgggatccccaacatgctgctgagtgaagaggaaactgagagttgattgtgccaggcgccagtttttcttgttatgactgtgtatttttgttgatctataccctgtttccgaattctgccgtgtgtatccccaacccttgacccaatgacaccaaacacagtgtttttgagctcggtattatatatttttttctcattaaaggtttaaaacc

SEQ ID NO: 195293 - DNA, 1106 bp, Homo sapiens
  Payload ID: 18559
  Gene Name: tRNA methyltransferase 11-2 homolog (S. cerevisiae)
  Uniprot ID: Q9UI30
  ENST ID: ENST00000544844
  CDS Start-End: 559-936
ggccacccgcagaacagagcttccgggacccacgcctcgtttgcactgggtgctggacagccgacgcaactacaaatggggcggagctttcggcactggagcagctaatttgcatataggaatgaggtgcggctcggcttccatgggcctaatttacagatagggcggtatttctgccccttaaccgaaagtgggatacagaggacgacggtgttaggcgcctgtgtaggagtaaaatgtgtttattttgcattcaacgagagctcctgcattgcagctattttgcatatgatttgcatcttacgaagaatttgtggcaaaaaaaagctgggcgtgcgccgtaggaacctcctgctgagacgcttccggtagcggcgcgtgacccgacaggtctttcacctacctacctcagctcccacaaacacgagaagttccagcaagttcgccacttccggttctcctggctatccaatagcatcgagaggagcatccccggaagtgaggcagcggaggacgacctttttccggttccggcctggcgagagtttgtgcggcgacatgaaactgcttacccacaatctgctgagctcgcatgtgcggggggtggggtcccgtggcttccccctgcgcctccaggccaccgaggtccgtatctgccctgtggaattcaaccccaacttcgtggcgcgtatgatacctaaagtggagtggtcggcgttcctggaggcggccgataacttgcgtctgatccaggtgccgaaagggccggttgagggatatgaggagaatgaggagtttctgaggaccatgcaccacctgctgctggaggtggaagtgatagagggcaccctgcagtgcccggaatctggacgtatgttccccatcagccgcgggatccccaacatgctgctgagtgaagaggaaactgagagttgattgtgccaggcgccagtttttcttgttatgactgtgtatttttgttgatctataccctgtttccgaattctgccgtgtgtatccccaacccttgacccaatgacaccaaacacagtgtttttgagctcggtattatatatttttttctcattaaaggtttaaaaccaaaa

SEQ ID NO: 195294 - DNA, 659 bp, Homo sapiens
  Payload ID: 18559
  Gene Name: tRNA methyltransferase 11-2 homolog (S. cerevisiae)
  ENST ID: ENST00000539854
  CDS Start-End: 28-348
cggcctggcgagagtttgtgcggcgacatgaaactgcttacccacaatctgctgagctcgcatgtgcggggggtggggtcccgtggcttccccctgcgcctccaggccaccgaggtccgtatctgccctgtggaattcaaccccaacttcgtggcgcgtatgatacctaaagtggagtggtcggcgttcctggaggcggccgataacttgcgtctgatccaggtgccgaaagggccggttgagggatatgaggagaatgaggagtttctgaggaccatgcaccacctgctgctggaggtgagaagcggcccatcacttgcttcccgggccacctgcctcccgcactgaggctgccagtgctcagctctgtccctccctgcccgcaggtggaagtgatagagggcaccctgcagtgcccggaatctggacgtatgttccccatcagccgcgggatccccaacatgctgctgagtgaagaggaaactgagagttgattgtgccaggcgccagtttttcttgttatgactgtgtatttttgttgatctataccctgtttccgaattctgccgtgtgtatccccaacccttgacccaatgacaccaaacacagtgtttttgagctcggtattatatatttttttctcattaaaggtttaaaac

SEQ ID NO: 195295 - DNA, 823 bp, Homo sapiens
  Payload ID: 18559
  Gene Name: tRNA methyltransferase 11-2 homolog (S. cerevisiae)
  ENST ID: ENST00000535750
  CDS Start-End: 177-422
cggggggtggggtcccgtggcttccccctgcgcctccaggtacccgccggcggcagtcttcccttttcgggcgggatggtgggccggggtccagtgcttgcctaaactcctccgccctgcaggccaccgaggtccgtatctgccctgtggaattcaaccccaacttcgtggcgcgtatgatacctaaagtggagtggtcggcgttcctggaggcggccgataacttgcgtctgatccaggtgccgaaagggccggttgagggatatgaggagaatgaggagtttctgaggaccatgcaccacctgctgctggaggtggaagtgatagagggcaccctgcagtgcccggaatctggacgtatgttccccatcagccgcgggatccccaacatgctgctgagtgaagaggaaactgagagttgattgtgccaggcgccagtttttcttgttatgactgtgtatttttgttgatctataccctgtttccgaattctgccgtgtgtatccccaacccttgacccaatgacaccaaacacagtgtttttgagctcggtattatatatttttttctcattaaaggtttaaaaccaaaagcggtttctctttgcagcaaatatacattaaaatagagtctctgtacagccaagggctctgggccctggcttgccccatgtccctgcgcctccctggccaaacccaaaaataaatatagtgttattgctctgcagggcatagaggcagtgctctcctaccccctgaggaggctcgttgggagctgatggggaagccctggccaccccaggggtccaggggctggagtctgc

SEQ ID NO: 195296 - DNA, 704 bp, Homo sapiens
  Payload ID: 18559
  Gene Name: tRNA methyltransferase 11-2 homolog (S. cerevisiae)
  ENST ID: ENST00000535126
  CDS Start-End: 19-210
acaatctgctgagctcgcatgtgcggggggtggggtcccgtggcttccccctgcgcctccaggtacccgccggcggcagtcttcccttttcgggcgggatggtgggccggggtccagtgcttgcctaaactcctccgccctgcaggccaccgaggtccgtatctgccctgtggaattcaaccccaacttcgtggcgcgtatgatacctaaagtggagtggtcggcgttcctggaggcggccgataacttgcgtctgatccaggtgccgaaagggccggttgagggatatgaggagaatgaggagtttctgaggaccatgcaccacctgctgctggaggtgagaagcggcccatcacttgcttcccgggccacctgcctcccgcactgaggctgccagtgctcagctctgtccctccctgcccgcaggtggaagtgatagagggcaccctgcagtgcccggaatctggacgtatgttccccatcagccgcgggatccccaacatgctgctgagtgaagaggaaactgagagttgattgtgccaggcgccagtttttcttgttatgactgtgtatttttgttgatctataccctgtttccgaattctgccgtgtgtatccccaacccttgacccaatgacaccaaacacagtgtttttgagctcggtattatatatttttttctcattaaaggtttaaaaccaaaa

SEQ ID NO: 195297 - DNA, 2207 bp, Homo sapiens
  Payload ID: 18560
  Gene Name: tRNA methyltransferase 12 homolog (S. cerevisiae)
  Uniprot ID: Q53H54
  ENST ID: ENST00000328599
  CDS Start-End: 109-1455
atttccggcaccggcatggccgggtgagctgcaggctaccttatttaagaccgggaatttagtcagcctggtgagccgactctgaggagatggagtatcgctgaggtgatgagagagaatgtggttgttagcaacatggagagagaaagtgggaagcccgtggctgttgtcgcagttgtgactgagccttggtttacccagcgatacagagaatatctccagaggcagaaactctttgatacacagcaccgtgtggaaaagatgccggatggctcggtggcgctaccggtgctgggagagacgcttccagagcagcacctgcaggagctgaggaatcgtgttgccccaggcagtccctgtatgctcacgcagctcccggatcctgttccttcgaagagggcccagggttgttcacctgcccaaaaattgtgtcttgaggtgagtcgctgggtggagggtcggggagtcaagtggtcagccgagttggaggctgatttgccccgatcatggcaacggcatggtaatctcttgttgctgagtgaagactgtttccaagccaagcagtggaaaaatctgggaccggaactctgggagaccgttgccttggcacttggcgtccagcgtttggcaaaacgagggcgggtatcaccggatggtactcgaactccagcagtgacactgctgctgggtgaccatggctgggtagagcatgtggataatggtatccgttataagtttgacgtgacccagtgtatgttctcctttggaaacatcactgagaagcttcgagtggcatcgttgtcctgtgctggagaagtgctggtggatctctatgcagggattggttattttacattgcctttcctagttcatgctggtgctgccttcgtccatgcttgtgagtggaatccccatgctgtagttgctctgagaaataaccttgagatcaatggagtagcagatcggtgccaaatacactttggagataacagaaaactgaagctctcaaatattgcagatagggtgatcctggggctgattcccagctctgaagaaggctggcccattgcctgccaagtgttaaggcaggatgctggaggcattttgcatatccaccaaaatgtggaatctttcccagggaagaatcttcaggctcttggagtcagcaaagtagagaaagagcattggctgtatcctcagcaaattaccaccaaccaatggaaaaatggagctaccagggattctaggggaaaaatgctgtcaccagccaccaagccagagtggcaaaggtgggcagaatctgcagaaactcgaatcgccactcttcttcagcaggtgcatgggaaaccatggaagacacaaattctgcacatccaaccagtgaaatcctatgctccccatgtggatcacatagtcctggatctggaatgctgcccctgtccttcagttggctagaggaggtagatcctgggacacatgggatccacgtgcgagtggcccttaaatgtatcagttcagtccaggttgtcatcccttttgtcccctggtgatcagtttttttcatattttatagccctgaaagcaggctctagatcaattcaaattatttcatttgtctttcattgataacagaaaatgaaatacctgtttgggagaagcagcatggcccattgaaatgaggctcatctgtgcaattatgaattccaaattctgacctcagttctggaattgaagtttcagtatgttttggcctcgggtttcgttatttgcaaaatgagagtttctttgaactgtctcacgtgactattaagcaactatacacaggacatcggttattttagagtgaaagacacagtgctttttccaaattgctctggctaccatatagaaaattgactgaaggagggccaagatggaaacagagagaccagtgaggaggcttctgtggttgtccaggtctgaggtgatggtaacttggactcggatggtggtaatgggaggtagattgatatgataaataaaattgacagaccaagcaatggaatcagaattaagtccttaacatgaagctgctttgttattatgactgactaaattagagagagaagggaacaaaaattattttagtgtatttccattcccttactgtggcattcctaaatgattgtgaggggttgtcttataaatttggtttgttgtggtagaaa

SEQ ID NO: 195298 - DNA, 822 bp, Homo sapiens
  Payload ID: 18560
  Gene Name: tRNA methyltransferase 12 homolog (S. cerevisiae)
  ENST ID: ENST00000522518
  CDS Start-End: 12-464
tcgctgaggtgatgagagagaatgtggttgttagcaacatggagagagaaagtgggaagcccgtggctgttgtcgcagttgtgactgagccttggtttacccagcgatacagagaatatctccagaggcagaaactctttgatacacagcaccgtgtggaaaagatgccggatggctcggtggcgctaccggtgctgggagagacgcttccagagcagcacctgcaggagctgaggaatcgtgttgccccaggcagtccctgtatgctcacgcagctcccggatcctgttccttcgaagagggcccagggttgttcacctgcccaaaaattgtgtcttgagcaggtgcatgggaaaccatggaagacacaaattctgcacatccaaccagtgaaatcctatgctccccatgtggatcacatagtcctggatctggaatgctgcccctgtccttcagttggctagaggaggtagatcctgggacacatgggatccacgtgcgagtggcccttaaatgtatcagttcagtccagaaaatgaaatacctgtttgggagaagcagcatggcccattgaaatgaggctcatctgtgcaattatgaattccaaattctgacctcagttctggaattgaagtttcagtatgttttggcctcgggtttcgttatttgcaaaatgagagtttctttgaactgtctcacgtgactattaagcaactatacacaggacatcggttattttagagtgaaagacacagtgctttttccaaattgctctggctaccatatagaaaattgactgaaggagggccaagatggaaacag

SEQ ID NO: 195299 - DNA, 711 bp, Homo sapiens
  Payload ID: 18561
  Gene Name: tRNA methyltransferase 13 homolog (S. cerevisiae)
  ENST ID: ENST00000370139
  CDS Start-End: 48-440
agggtagatgcggttactatgtggaaaagaagaaacggttctgcaggatggtggtggccgcagggaaaagattttgtggtgaacacgctggagccgcggaggaagaagatgctcggaaaagaatcctgtgtcctttagatccaaaacacacagtatatgaagatcaactagcaaagcatttgaaaaaatgtaactcaagagagaaaccaaaacctgatttctatattcaagatattaatgcaggcttaagagatgaaacagaaatacctgaacaattagttccaatttcttctctatctgaagagcagttggaaaagttaattaagaaattgagaaaagcaagtgaagcattacacgatgcacttaatgaccctaaaaatggcgattctgcaaccaagcacctgaaacagcaggtatgtttaggctatagtaactactaaacatggcctttgttcatttgttaaaactgttttaaatgtaattattaataagattttattttgtttacctttgagggtaccaaatatttccatttcaaaaatatatagaaacatatacaaaaaattgagggcatggatgtgattctgagtaccgtatattaaatatttaaaggcaagagagaaaaattttaagtcaaatacaaattatcaatgtaagcatactgccttatgcagaaattaccttgctgttttcccatttgaaccaaatgtg

SEQ ID NO: 195300 - DNA, 3129 bp, Homo sapiens
  Payload ID: 18561
  Gene Name: tRNA methyltransferase 13 homolog (S. cerevisiae)
  Uniprot ID: Q9NUP7
  ENST ID: ENST00000370141
  CDS Start-End: 7-1452
agaattatggcgacctccgcgacgtcgccgcacgcgcctggttttccagctgagggtagatgcggttactatgtggaaaagaagaaacggttctgcaggatggtggtggccgcagggaaaagattttgtggtgaacacgctggagccgcggaggaagaagatgctcggaaaagaatcctgtgtcctttagatccaaaacacacagtatatgaagatcaactagcaaagcatttgaaaaaatgtaactcaagagagaaaccaaaacctgatttctatattcaagatattaatgcaggcttaagagatgaaacagaaatacctgaacaattagttccaatttcttctctatctgaagagcagttggaaaagttaattaagaaattgagaaaagcaagtgaaggcttgaattctacacttaaagatcatattatgtcccatccagcattacacgatgcacttaatgaccctaaaaatggcgattctgcaaccaagcacctgaaacagcaggcttctattttaggtaacattgaaaatttaaagttacttggtccaagaagatgctttgttgagtttggagcgggaaagggaaaattatctcattgggttgatattgccttaaaagatgctgaaaaagttcacttcatcctagtggaaaaggtgaccacaagattcaaggtggatggaaaacacagaaagaaaaattcagtgtttgaaagacttcaaattgatattcaacacttgtgtttgaacaagattcctgtgctaagagaagaaaaactacctgtggtaggaattggaaagcatctgtgtggtatggcaacagatcttgcattacgatgtttggttgaaacctatgctgccagttttgaggaaaggaatgaagaacctttagccaaacgcataaagaatgataaaacagaaaaagaaatttacactttggccaaggaaggaaatgaaaaaaatgtcccagagaagtggaaccctgtggctggcattgttattgcactctgttgtcaccacaggtgtgattggagacattatgtgggcaaagaatatttcagggctctaggccttggagcagtggaattccattatttccagcgaatgagtagttgggcaacttgtgggatgcggaaaacatctttggaaacctcaaatagtaccacaaagaggcaagataatcagaatgatgatagtgaagagcatgatgatggaggatacagaatcacagatgatggcgctgattgtttgcctgggcttcttagtgttgaagaaaagaagaaaatagggcatctttgtaaattgctgattgaccaaggtcgaatccagtatttgcagcagaagggattcagtcctgctttgcagtactatacagaccctctggtgtctttggaaaatgttttgttaactgctttaccaaatcattcttcatcaccagaaacaactgcttaatggaaaagaaatttgagcatcatctgtcttccaccaaaaaaaattttttaattatatttttatatcaaaaaaatatatactttaaatagcaaataatatgaactttaaaaaatgctgtggcctcattaaactttggtaatagcttttctttttacttcagaaatccaaacattagagaattcaccaaagtaatcctctttagaagggcatcttgaattatattatccatccgtatttatggagattggtaaagtagttgaaccgttgacttggtgatctgaaacatacataacatgtcaacacataattagcgtatttctgtttgtattaattttggaaatttatcttcctttgattttatttaatattttttatttcttaagttcaagaggtagtgattgattgtaacaagggccaatctgagaatttgacttatatgtggacatttttccctacagatctggaaagcacaattgtgattttctcaaatgcagacaattcagagatattcacaattaataaacacaattaattaatgaagtcaccttcaaatttccagagccatacatgtatatattgtcagaatctgtccatgacaaacacaaaactgaagagctgttttcaaagaaaaaagattatttcacttaattattttgttggataattgtctagttagaacttccaaaaagatacttacaaacataattcacaaatttgaaataatttctgaagttgattagctatctcatatcttttatcaggtcattttttatatatgtaggcacaaacaataagtatgttctcttctgtttgggaaaataatttggaataaaatagaaattagataatgaaaccaaaaaccttctcaaatttaggccttatttaactcatgactggtttctatgcacaagaaaatactaaaccaaatatatggtaggactgttattctcttctgcatcttatccctattttgtttctgcctttatttgtaaaaattgtcttaattgatggtacatttgccaagacaaaggttcagaattactaattttagatattatgatattctgaaataactatttttatcctgtagttctatgattatatgatttgtaaataagaagcctaaccaatttaaaattcctgactttagtctcatatatcttgtcagactgtctcggttcaaattccaaacctaccatcttcagttgtgcgaccttgggcatgctacctaatctctttgtgcctcaatttcctccttttaaaatggggatgatgatgataacaataatacctacctcacaaggttgttgtgagcatcaaatgagataacacaagtaaaatgcatagaacagttccaagcacagagtaattcaataaatattaactagtaatagtagtggtagtaactcgtgaatctttttaataacataataggctttgattttattatctctttaagttgttaacttttttcccttgttataagttttatgtcaagtaaggtagtttgtttaagttagttacccatgtccccaatcaagggaacctaaatgaagatatatcattaaataattaacctttttttattgtgtcaagcaatactaatttgtgtcataaaatttgttttgcatcattcaacaatttatgcccagaaataaacaatattctacaacaggc

SEQ ID NO: 195301 - DNA, 476 bp, Homo sapiens
  Payload ID: 18561
  Gene Name: tRNA methyltransferase 13 homolog (S. cerevisiae)
  ENST ID: ENST00000370143
  CDS Start-End: 20-349
ggaagcgagccctagaattatggcgacctccgcgacgtcgccgcacgcgcctggttttccagctgagggtagatgcggttactatgtggaaaagaagaaacggttctgcaggatggtggtggccgcagggaaaagattttgtggtgaacacgctggagccgcggaggaagaagatgctcggaaaagaatcctgtgtcctttagatccaaaacacacagtatatgaagatcaactagcaaagcatttgaaaaaatgtaactcaagagagaaaccaaaacctgatttctatattcaagatattaatgcaggcttaagagatgaaacagaaatacctgaacaattagcttgaattctacacttaaagatcatattatgtcccatccagcattacacgatgcacttaatgaccctaaaaatggcgattctgcaaccaagcacctgaaacagcaggtatgtttaggctatagtaactacta

SEQ ID NO: 195302 - DNA, 1582 bp, Homo sapiens
  Payload ID: 18561
  Gene Name: tRNA methyltransferase 13 homolog (S. cerevisiae)
  Uniprot ID: Q9NUP7
  ENST ID: ENST00000482437
  CDS Start-End: 5-532
aattatggcgacctccgcgacgtcgccgcacgcgcctggttttccagctgagggtagatgcggttactatgtggaaaagaagaaacggttctgcaggatggtggtggccgcagggaaaagattttgtggtgaacacgctggagccgcggaggaagaagatgctcggaaaagaatcctgtgtcctttagatccaaaacacacagtatatgaagatcaactagcaaagcatttgaaaaaatgtaactcaagagagaaaccaaaacctgatttctatattcaagatattaatgcaggcttaagagatgaaacagaaatacctgaacaattagttccaatttcttctctatctgaagagcagttggaaaagttaattaagaaattgagaaaagcaagtgaaggcttgaattctacacttaaagatcatattatgtcccatccagcattacacgatgcacttaatgaccctaaaaatggcgattctgcaaccaagcacctgaaacagcaggtatgtttaggctatagtaactactaaacatggcctttgttcatttgttaaaactgttttaaatgtaattattaataagattttattttgtttacctttgagggtaccaaatatttccatttcaaaaatatatagaaacatatacaaaaaattgagggcatggatgtgattctgagtaccgtatattaaatatttaaaggcaagagagaaaaattttaagtcaaatacaaattatcaatgtaagcatactgccttatgcagaaattaccttgctgttttcccatttgaaccaaatgtgtttactctagtttataaaataatcttgtgaagtttgcaggcttctattttaggtaacattgaaaatttaaagttacttggtccaagaagatgctttgttgagtttggagcgggaaagggaaaattatctcattgggttgatattgccttaaaagatgctgaaaaagttcacttcatcctagtggaaaaggtgaccacaagattcaaggtggatggaaaacacagaaagaaaaattcagtgtttgaaagacttcaaattgatattcaacacttgtgtttgaacaagattcctgtgctaagagaagaaaaactacctgtggtaggaattggaaagcatctgtgtggtatggcaacaggtacgtaaacatactgataatgtttacattaatgcattaagttttggcctaacctggccccaaccatttcagtggtctcttttgaatagatatcttatgtttacaactcaataatctttatagagcactggccctgtgctttattagatgcatagctttcctatttatctgctcatattggccattttgcaggatgaattaagagttttgtatgtaaatactgcatcacattagaccttaaagttctttgggttaaatttcaaccagaaaaggaaaataagaccatttatggaaactgtatgattccacctagaagctactgattttttagagtagttgcttagaaagaactcagaaacctcttctactaaaagactattgtgtttcaggattctggggaaaaagaaaaaaataaatgttagac

SEQ ID NO: 195303 - DNA, 4392 bp, Homo sapiens
  Payload ID: 18562
  Gene Name: tRNA methyltransferase 1-like
  Uniprot ID: Q7Z2T5
  ENST ID: ENST00000367506
  CDS Start-End: 270-2471
acgcttctgcgcagtttgtggtggcgtcgtaacgcctcggggaaagggaagcggacgggcatctggaatcgctgcctctggctttctgttttctactaacaggatttggtcactggttcttcatcttttgtctgttgcacgcatcccgccctccccacttgcttccccactccttggatccagccctgtgggcattcacgtcagttctctgaccccgccgtgagccccgctccgggtccccgggcgggcttggcacggaggcggtaactatggagaatatggcggaggaggagctgctgcccctggagaaggaggaggtggaggtggcccaggtccaggtcccgaccccggcccgggactcggctggggtcccagctccggccccggattcggctctggactcggctccgactccggcctcggctccagccccagcccctgccctggcccaggctccggccctgtccccgtccctagcctctgcccctgaggaggctaaaagcaagagacacatctcaattcaaaggcagcttgctgatctagagaatttagcttttgtaactgatggaaattttgactctgccagctcattgaactcagataatcttgatgcaggcaacagacaggcttgtccattgtgccctaaggaaaaattcagagcttgtaatagccataagcttcgtcgtcacctccagaatttacactggaaagtctcagttgaatttgaaggttacaggatgtgcatctgtcacttaccttgtcgaccagtgaaaccaaacattattggagaacagataaccagtaaaatgggagcccattatcattgtatcatttgttcagcaacaatcaccagaagaactgatatgctaggacatgttaggcgccacatgaataaaggagagactaaatctagttatattgcagcttccactgctaaaccacctaaggaaattttgaaagaggcagacacggatgtacaagtttgtcccaactattctatacctcagaaaacagattcctattttaaccccaaaatgaaactaaatcggcagctaatattctgtacattggctgctttggctgaggaacgaaaacctttggaatgtctagatgcttttggagccactgggataatgggattacagtgggcaaaacatcttggaaatgcagtcaaagttacaatcaatgacttgaatgaaaattctgtgacactgattcaggaaaactgccatttaaacaaattgaaagtggtggtggacagtaaggaaaaggaaaagagtgatgatattcttgaagaaggagagaaaaatcttggtaatattaaggtgaccaaaatggatgccaatgtactgatgcatttgagatcttttgatttcatacatctagacccttttggaacatcagtgaattatctagattctgcattcagaaatataagaaaccttggcatagtgtcagtgacttctacagatatcagttctttatatgccaaggcacagcatgttgcccggcgtcactacggatgtaacattgtccgaactgaatattacaaggaactagcagccagaattgttgtagctgcagtggcaagagctgcagcccgatgcaacaaaggcatagaagtactgtttgcagtggctctggaacattttgtgttggtagttgtgagagttttgaggggacctacttcagcagatgaaacagccaagaagattcaatacctgatccattgtcagtggtgtgaagagagaatttttcagaaggatggtaatatggtagaagaaaacccatatagacagctgccttgtaactgtcatggaagcatgcctggaaagacagcaatagaacttggacctctgtggtcaagttcccttttcaatactggattcctcaaaagaatgctatttgaatctcttcaccatggtttggatgacattcagaccctaataaagacattaatctttgaatcagagtgtacgcctcaaagtcagttttcaattcatgcatcttcaaatgtcaacaagcaagaagaaaatggtgtatttattaaaactacagatgacaccacaacagataattacattgcacaaggaaagagaaaaagtaatgaaatgatcacaaatttaggcaagaagcaaaagactgatgtcagtactgaacatcctcccttttattacaacattcacagacacagcattaaaggaatgaatatgccaaagttaaaaaagtttttgtgctatttatctcaagcaggctttcgagtaagccgaactcattttgacccaatgggtgtacgcacagatgcacctctgatgcagtttaaatctatccttttaaagtacagcacccccacctacactggaggacagtcagaaagccatgtccagtcagcatctgaagatacagtaactgaaagagttgaaatgtcagtgaatgacaaagcagaagcaagtggctgcagaagatggtaaacgtagagaagaattggttctcaggtgtctgtatagatggcctaatagttctctataccaactgtagttctttttctgttctttcaattcagtagagtaaaaataaaaaacagtgtcattttcattcagaaactgagcagtttctaacttagctggtttgggagctttgctttccaagtttttttttgttttaaggcaaacttaaaattttaatggaaacatttcatatgaagccaagtctcactgagatcaccctactgcttaataattcagaaaattttcacatgcaaagtgtttggaattttatgtatgttatgaaagccatcttttacaattcttaatcacatctctgcctaaactgattcatgatgtttatgttttcctgtttgtagtgtacaaaatgaagctgaaggctcacatgttaaaatgaccctgaatagaataggaagaacaatgttcttacaggtcataatgtatttcacaattaaaaaactaaaatatgtacccatttttaagaaatcatacttctctccacattgatcttttcatttcttactagcttttaagaaattaaatacttgcctgagatagaaatactttatttttgtaactttaaggtctaaatgactaaacttcaaagtaagattttgtcagaataaattgagaccattaatctaatataatacttgttcatgagcactgaaatcctgaagaggagagatttggttataaattaaaaaggttgggtgatcttaagtgcctcagttaatgcacgtacagtattcatttggttggttgtactacctctcagaagtaaaatttgtcaccttatggaatgagagtttttgggtttgggggttgtttttttgttgttgcttggtttggtatttttggttttgtgtgtatttgtataaattttctgtataattagcccaggctgatgtaactataaaaattagttgaaaaaaaaaatattgtttccttaatggaattctcacttcatttgaatataagattttggatgaaaggatttggtataaagtttgggtttttgtctcaaggatttgatccatatttatccctaaatatttcttaagggatgtaactttttataaccattaagtggggggaagggggtggagggggtggtaataattataactgaaaggtttaaatatactacctaagaaaaaagtacttctgtgacatatacaaaaaaatctagtggataggcattagatgaatagagaatattaattttgcagaaatgaaggaaaatctcttcgtgctagtacagcgtattcccaagagagtttattttcctttctccaattaatgtggtcataaatttcggtaaaatcaagaaataggtgaagtgcaagctagtttctataatgaccattaaaaaaattctgctgtgtaattcttgccagttaaaattataacttgcaaatgagcagaataaatgaggtttttttcaattaaaaattactataaatccaggaggcaaactattttagcactcagattatctgatttaatacatattattgaatatcagtctcaaattttgctaaatgcttatcagcatgaaatatgttgatcagtgatgagttgggcttaatgcaaagatcctaatttaataaagaaacctgtaaattactgttacctaaaatatatgtgtatattaatttcacatataaaggtagatttttcaaagaaaaatttggtaggcggtagtttagaactctgatcaggtactacatcaaccaaaagaggaaatactttaaaaattccttttagcaacctgagcaatcttattctcgtaacaatagtagtaatttgggacattgcaaatgtttatcatgttgtaaagtagcatcagttgtatcctttcattaaaacttgataaacaaaagaa

SEQ ID NO: 195304 - DNA, 735 bp, Homo sapiens
  Payload ID: 18562
  Gene Name: tRNA methyltransferase 1-like
  ENST ID: ENST00000458395
  CDS Start-End: 1-639
acatcagtgaattatctagattctgcattcagaaatataagaaaccttggcatagtgtcagtgacttctacagatatcagttctttatatgccaaggcacagcatgttgcccggcgtcactacggatgtaacattgtccgaactgaatattacaaggaactagcagccagaattgttgtagctgcagtggcaagagctgcagcccgatgcaacaaaggcatagaagtactgtttgcagtggctctggaacattttgtgttggtagttgtgagagttttgaggggacctacttcagcagatgaaacagccaagaagattcaatacctgatccattgtcagtggtgtgaagagagaatttttcagaaggatggtaatatggtagaagaaaacccatatagacagctgccttgtaactgtcatggaagcatgcctggaaagacagcaatagaacttggacctctgtggtcaagttcccttttcaatactggattcctcaaaagaatgctatttgaatctcttcaccatggtttggatgacattcagaccctaataaagacattaatctttgaatcagagtgtacgcctcaaagtcagttttcaattcatgcatcttcaaatgtcaacaagcaaggtgactaactgaacgctagcttactagctttaaactgcttaccaaaaatactgtatctttttcaattgtatttgatgttataataaaaccaatataattataaa

SEQ ID NO: 195305 - DNA, 2964 bp, Homo sapiens
  Payload ID: 18563
  Gene Name: tRNA methyltransferase 2 homolog A
  Uniprot ID: Q8IZ69
  ENST ID: ENST00000252136
  CDS Start-End: 390-2267
ctagagctggctaaagtggttgggggttggatccggcgcgtgacgatgacgttgccagaagccaggatcatagagacgctcggcctccgccgcacgcgctggcggactaagagtggctggcgaagcgagcggccggcgcgggcccctggcgggcgggcggtacagccccaagcctgagacccggacctgagcatcgcaggttcgagtcccgccccgcctggggcgaagccgggggtggcggcgacctcgcggcgttgcaccggctctgtgagcacctcccctctgagcacttcccttgtgacaggccacttcccttgtgacaggcccaggacgaggtggccaggcggcccccatggcgtccctggtctaggcggagaaccgcctgggcgatgagtgagaacctcgacaacgagggcccgaagcccatggagagctgtggccaggagagcagcagtgccctgagctgccctaccgtctcggtgccccctgcagccccggcagccctggaggaggtggagaaagagggcgctggggcggctacagggccggggcctcagcccgggctctacagctacatcagggatgacttgtttacctctgagatctttaaactggagctgcagaacgtgcctcgccacgccagcttcagcgacgtccggcgcttcctgggccgctttggtctgcagccccacaaaaccaaactctttgggcaaccaccctgcgcctttgtgacattccgcagcgctgcagagagggacaaggccctgcgcgttttgcatggtgccctctggaaaggccgcccactcagtgtgcgcctggcccggcccaaggccgaccccatggccaggaggaggcgacaggagggtgagagtgagccaccagtaacacgagtggccgacgtggtgacccctctatggacagtgccctatgctgagcagcttgagcggaagcagctggagtgcgagcaggtgctgcagaaacttgccaaggaaatcgggagcaccaaccgtgccttgctgccctggctgctcgagcagaggcacaagcacaacaaggcctgctgcccgctggagggggtcaggccatcaccccagcagactgagtatcgtaataagtgtgagtttctggttggcgtcggggtggatggggaggataacaccgtgggctgtcggctcggcaagtacaagggcgggacgtgtgctgtggcagccccgtttgacaccgtgcacatccccgaagccaccaagcaggtggtgaaggccttccaggagttcatccggtccactccatactcggcatacgacccagagacgtacacaggccactggaagcagctgactgtgcgcaccagccgccgccaccaggccatggccattgcctacttccacccccagaagctgagccctgaggagctggcagagctgaagacctccctagcgcagcacttcacagcagggccaggcagggccagtggagtgacctgcctctacttcgtggaggagggacagcgaaagactcctagccaggagggcctgcccctggagcatgtggctggggaccggtgcatccacgaggacctgctagggctgaccttccggatctctccacacgccttcttccaggtgaacacacccgcagccgaggtgctctacacagtcatccaggactgggcccaattggatgcggggagcatggtgctggacgtgtgctgtggcaccggcaccattggcctggccctggcccggaaggtaaagagggtcattggggtcgagctatgcccagaggctgtggaggacgcccgggtgaacgcccaggacaatgagttgagtaatgtggagttccactgcgggagggccgaggacctggtgcccaccctggtgagcagactggcctcccagcacctcgtggccatcctggacccaccccgtgctggcttgcattccaaggtgatcctggccatccggagagctaagaacctcaggcggctgctgtacgtctcatgcaacccccgggcagccatgggcaactttgtggacctctgcagagccccatctaaccgggtgaagggcattcccttccggccggtcaaggctgtggcagtggacctgttcccgcagaccccgcactgtgagatgctcatcctgtttgagagggtggagcaccccaatggcacaggggtcttggggccccacagccctccagctcaacccacaccaggacccccagataacaccctacaagaaactgggaccttcccctcatcctaggcccaggacccattatggggacaggagctgaagggctcccagggccccaggggcggggaaggcatggcttgctggccaggatattcagaggtaggcagccaaagggcacagaaccctgtgccccaccaggattggcctgctgctaggggccaggggccctgaccaggaagacaggtgggttcctgtagcctgttgcccatccccagggcctttgtggactagccaaggctgtgagggccagaataaacaactgctcaacaaagggtgtttctgtgatgagagccaggggtctgaacacagggcctgggtgccagggaaagggccaaactaggcctaggcagctctgcaagcctctctgcatggctgggggagtcagggcagagcttactttaaaaaagaatgttcgatttgatacttaaacttgaggagaggcagagagaggtctgggaactgcaccagctgggggcatggggtggagaacactgggcagagttggcccctctgtggccagcctggccctcagcccagcagagagggcatcaaccaaggaaggggccatgctggggtgctgctcagctgttacaaaggcagggtccagcctgcagggaggccccaggaggggatctggccagtcaagggtccacagggtgccagcctctcaccctcagaataaagacatcagccattcccttctgga

SEQ ID NO: 195306 - DNA, 2498 bp, Homo sapiens
  Payload ID: 18563
  Gene Name: tRNA methyltransferase 2 homolog A
  Uniprot ID: Q8IZ69
  ENST ID: ENST00000404751
  CDS Start-End: 340-2028
gttgccagaagccaggatcatagagacgctcggcctccgccgcacgcgctggcggactaagagtggctggcgaagcgagcggccggcgcgggcccctggcgggcgggcggtacagccccaagcctgagacccggacctgagcatcgcaggttcgagtcccgccccgcctggggcgaagccgggggtggcggcgacctcgcggcgttgcaccggctctgtgagcacctcccctctgagcacttcccttgtgacaggccacttcccttgtgacaggcccaggacgaggtggccaggcggcccccatggcgtccctggtctaggcggagaaccgcctgggcgatgagtgagaacctcgacaacgagggcccgaagcccatggagagctgtggccaggagagcagcagtgccctgagctgccctaccgtctcggtgccccctgcagccccggcagccctggaggaggtggagaaagagggcgctggggcggctacagggccggggcctcagcccgggctctacagctacatcagggatgacttgtttacctctgagatctttaaactggagctgcagaacgtgcctcgccacgccagcttcagcgacgtccggcgcttcctgggccgctttggtctgcagccccacaaaaccaaactctttgggcaaccaccctgcgcctttgtgacattccgcagcgctgcagagagggacaaggccctgcgcgttttgcatggtgccctctggaaaggccgcccactcagtgtgcgcctggcccggcccaaggccgaccccatggccaggaggaggcgacaggagggtgagagtgagccaccagtaacacgagtggccgacgtggtgacccctctatggacagtgccctatgctgagcagcttgagcggaagcagctggagtgcgagcaggtgctgcagaaacttgccaaggaaatcgggagcaccaaccgtgccttgctgccctggctgctcgagcagaggcacaagcacaacaaggcctgctgcccgctggagggggtcaggccatcaccccagcagactgagtatcgtaataagtgtgagtttctggttggcgtcggggtggatggggaggataacaccgtgggctgtcggctcggcaagtacaagggcgggacgtgtgctgtggcagccccgtttgacaccgtgcacatccccgaagccaccaagcaggtggtgaaggccttccaggagttcatccggtccactccatactcggcatacgacccagagacgtacacaggccactggaagcagctgactgtgcgcaccagccgccgccaccaggccatggccattgcctacttccacccccagaagctgagccctgaggagctggcagagctgaagacctccctagcgcagcacttcacagcagggccaggcagggccagtggagtgacctgcctctacttcgtggaggagggacagcgaaagactcctagccaggagggcctgcccctggagcatgtggctggggaccggtgcatccacgaggacctgctagggctgaccttccggatctctccacacgccttcttccaggtgaacacacccgcagccgaggtgctctacacagtcatccaggactgggcccaattggatgcggggagcatggtgctggacgtgtgctgtggcaccggcaccattggcctggccctggcccggaaggtaaagagggtcattggggtcgagctatgcccagaggctgtggaggacgcccgggtgaacgcccaggacaatgagttgagtaatgtggagttccactgcgggagggccgaggacctggtgcccaccctggtgagcagactggcctcccagcacctcgtggccatcctggacccaccccgtgctggcttgcattccaaggtgatcctggccatccggagagctaagaacctcaggcggctgctgtacgtctcatgcaacccccgggcagccatgggcaactttgtggacgccccccttttccccccacagcctctgcagagccccatctaaccgggtgaagggcattcccttccggccggtcaaggctgtggcagtggacctgttcccgcagaccccgcactgtgagatgctcatcctgtttgagagggtggagcaccccaatggcacaggggtcttggggccccacagccctccagctcaacccacaccaggacccccagataacaccctacaagaaactgggaccttcccctcatcctaggcccaggacccattatggggacaggagctgaagggctcccagggccccaggggcggggaaggcatggcttgctggccaggatattcagaggtaggcagccaaagggcacagaaccctgtgccccaccaggattggcctgctgctaggggccaggggccctgaccaggaagacaggtgggttcctgtagcctgttgcccatccccagggcctttgtggactagccaaggctgtgagggccagaataaacaactgctcaac

SEQ ID NO: 195307 - DNA, 2928 bp, Homo sapiens
  Payload ID: 18563
  Gene Name: tRNA methyltransferase 2 homolog A
  Uniprot ID: Q8IZ69
  ENST ID: ENST00000403707
  CDS Start-End: 363-2240
aaaacgcccgcggcgcatgcccggcccgcccgtcagccagaggagcgcgcactcccggcgacacccgcgcgcacttccgtcccggccacgcgcgcctctagagctggctaaagtggttgggggttggatccggcgcgtgacgatgacgttgccagaagccaggatcatagagacgctcggcctccgccgcacgcgctggcggactaagagtggctggcgaagcgagcggccggcgcgggcccctggcgggcgggcggtacagccccaagcctgagacccggacctgagcatcgcaggcccaggacgaggtggccaggcggcccccatggcgtccctggtctaggcggagaaccgcctgggcgatgagtgagaacctcgacaacgagggcccgaagcccatggagagctgtggccaggagagcagcagtgccctgagctgccctaccgtctcggtgccccctgcagccccggcagccctggaggaggtggagaaagagggcgctggggcggctacagggccggggcctcagcccgggctctacagctacatcagggatgacttgtttacctctgagatctttaaactggagctgcagaacgtgcctcgccacgccagcttcagcgacgtccggcgcttcctgggccgctttggtctgcagccccacaaaaccaaactctttgggcaaccaccctgcgcctttgtgacattccgcagcgctgcagagagggacaaggccctgcgcgttttgcatggtgccctctggaaaggccgcccactcagtgtgcgcctggcccggcccaaggccgaccccatggccaggaggaggcgacaggagggtgagagtgagccaccagtaacacgagtggccgacgtggtgacccctctatggacagtgccctatgctgagcagcttgagcggaagcagctggagtgcgagcaggtgctgcagaaacttgccaaggaaatcgggagcaccaaccgtgccttgctgccctggctgctcgagcagaggcacaagcacaacaaggcctgctgcccgctggagggggtcaggccatcaccccagcagactgagtatcgtaataagtgtgagtttctggttggcgtcggggtggatggggaggataacaccgtgggctgtcggctcggcaagtacaagggcgggacgtgtgctgtggcagccccgtttgacaccgtgcacatccccgaagccaccaagcaggtggtgaaggccttccaggagttcatccggtccactccatactcggcatacgacccagagacgtacacaggccactggaagcagctgactgtgcgcaccagccgccgccaccaggccatggccattgcctacttccacccccagaagctgagccctgaggagctggcagagctgaagacctccctagcgcagcacttcacagcagggccaggcagggccagtggagtgacctgcctctacttcgtggaggagggacagcgaaagactcctagccaggagggcctgcccctggagcatgtggctggggaccggtgcatccacgaggacctgctagggctgaccttccggatctctccacacgccttcttccaggtgaacacacccgcagccgaggtgctctacacagtcatccaggactgggcccaattggatgcggggagcatggtgctggacgtgtgctgtggcaccggcaccattggcctggccctggcccggaaggtaaagagggtcattggggtcgagctatgcccagaggctgtggaggacgcccgggtgaacgcccaggacaatgagttgagtaatgtggagttccactgcgggagggccgaggacctggtgcccaccctggtgagcagactggcctcccagcacctcgtggccatcctggacccaccccgtgctggcttgcattccaaggtgatcctggccatccggagagctaagaacctcaggcggctgctgtacgtctcatgcaacccccgggcagccatgggcaactttgtggacctctgcagagccccatctaaccgggtgaagggcattcccttccggccggtcaaggctgtggcagtggacctgttcccgcagaccccgcactgtgagatgctcatcctgtttgagagggtggagcaccccaatggcacaggggtcttggggccccacagccctccagctcaacccacaccaggacccccagataacaccctacaagaaactgggaccttcccctcatcctaggcccaggacccattatggggacaggagctgaagggctcccagggccccaggggcggggaaggcatggcttgctggccaggatattcagaggtaggcagccaaagggcacagaaccctgtgccccaccaggattggcctgctgctaggggccaggggccctgaccaggaagacaggtgggttcctgtagcctgttgcccatccccagggcctttgtggactagccaaggctgtgagggccagaataaacaactgctcaacaaagggtgtttctgtgatgagagccaggggtctgaacacagggcctgggtgccagggaaagggccaaactaggcctaggcagctctgcaagcctctctgcatggctgggggagtcagggcagagcttactttaaaaaagaatgttcgatttgatacttaaacttgaggagaggcagagagaggtctgggaactgcaccagctgggggcatggggtggagaacactgggcagagttggcccctctgtggccagcctggccctcagcccagcagagagggcatcaaccaaggaaggggccatgctggggtgctgctcagctgttacaaaggcagggtccagcctgcagggaggccccaggaggggatctggccagtcaagggtccacagggtgccagcctctcaccctcagaataaagacatcagccattc

SEQ ID NO: 195308 - DNA, 426 bp, Homo sapiens
  Payload ID: 18563
  Gene Name: tRNA methyltransferase 2 homolog A
  ENST ID: ENST00000444256
  CDS Start-End: 1-426
gtgaacacacccgcagccgaggtgctctacacagtcatccaggactgggcccaattggatgcggggagcatggtgctggacgtgtgctgtggcaccggcaccattggcctggccctggcccggaaggtaaagagggtcattggggtcgagctatgcccagaggctgtggaggacgcccgggtgaacgcccaggacaatgcctctgcagagccccatctaaccgggtgaagggcattcccttccggccggtcaaggctgtggcagtggacctgttcccgcagaccccgcactgtgagatgctcatcctgtttgagagggtggagcaccccaatggcacaggggtcttggggccccacagccctccagctcaacccacaccaggacccccagataacaccctacaagaaactgggaccttcccctcat

SEQ ID NO: 195309 - DNA, 582 bp, Homo sapiens
  Payload ID: 18563
  Gene Name: tRNA methyltransferase 2 homolog A
  ENST ID: ENST00000445045
  CDS Start-End: 224-582
agaagccaggatcatagagacgctcggcctccgccgcacgcgctggcggactaagagtggctggcgaagcgagcggccggcgcgggcccctggcgggcgggcggtacagccccaagcctgagacccggacctgagcatcgcaggttcgagtcccgccccgcctggggcgaagccgggggtggcggcgacctcgcggcgttgcaccggctctggcccgaagcccatggagagctgtggccaggagagcagcagtgccctgagctgccctaccgtctcggtgccccctgcagccccggcagccctggaggaggtggagaaagagggcgctggggcggctacagggccggggcctcagcccgggctctacagctacatcagggatgacttgtttacctctgagatctttaaactggagctgcagaacgtgcctcgccacgccagcttcagcgacgtccggcgcttcctgggccgctttggtctgcagccccacaaaaccaaactctttgggcaaccaccctgcgcctttgtgacattccgcagcgctgcagagagggacaaggccctgcgcgttttgcatggtgc

SEQ ID NO: 195310 - DNA, 2473 bp, Homo sapiens
  Payload ID: 18563
  Gene Name: tRNA methyltransferase 2 homolog A
  ENST ID: ENST00000439169
  CDS Start-End: 317-2248
agacgctcggcctccgccgcacgcgctggcggactaagagtggctggcgaagcgagcggccggcgcgggcccctggcgggcgggcggtacagccccaagcctgagacccggacctgagcatcgcaggttcgagtcccgccccgcctggggcgaagccgggggtggcggcgacctcgcggcgttgcaccggctctgtgagcacctcccctctgagcacttcccttgtgacaggccacttcccttgtgacaggcccaggacgaggtggccaggcggcccccatggcgtccctggtctaggcggagaaccgcctgggcgatgagtgagaacctcgacaacgagggcccgaagcccatggagagctgtggccaggagagcagcagtgccctgagctgccctaccgtctcggtgccccctgcagccccggcagccctggaggaggtggagaaagagggcgctggggcggctacagggccggggcctcagcccgggctctacagctacatcagggatgacttgtttacctctgagatctttaaactggagctgcagaacgtgcctcgccacgccagcttcagcgacgtccggcgcttcctgggccgctttggtctgcagccccacaaaaccaaactctttgggcaaccaccctgcgcctttgtgacattccgcagcgctgcagagagggacaaggccctgcgcgttttgcatggtgccctctggaaaggccgcccactcagtgtgcgcctggcccggcccaaggccgaccccatggccaggaggaggcgacaggagggtgagagtgagccaccagtaacacgagtggccgacgtggtgacccctctatggacagtgccctatgctgagcagcttgagcggaagcagctggagtgcgagcaggtgctgcagaaacttgccaaggaaatcgggagcaccaaccgtgccttgctgccctggctgctcgagcagaggcacaagcacaacaaggcctgctgcccgctggagggggtcaggccatcaccccagcagactgagtatcgtaataagtgtgagtttctggttggcgtcggggtggatggggaggataacaccgtgggctgtcggctcggcaagtacaagggcgggacgtgtgctgtggcagccccgtttgacaccgtgcacatccccgaagccaccaagcaggtggtgaaggccttccaggagttcatccggtccactccatactcggcatacgacccagagacgtacacaggccactggaagcagctgactgtgcgcaccagccgccgccaccaggccatggccattgcctacttccacccccagaagctgagccctgaggagctggcagagctgaagacctccctagcgcagcacttcacagcagggccaggcagggccagtggagtgacctgcctctacttcgtggaggagggacagcgaaagactcctagccaggagggcctgcccctggagcatgtggctggggaccggtgcatccacgaggacctgctagggctgaccttccggatctctccacacgccttcttccaggtgaacacacccgcagccgaggtgctctacacagtcatccaggactgggcccaattggatgcggggagcatggtgctggacgtgtgctgtggcaccggcaccattggcctggccctggcccggggccccatgtactcccctccctgggtggggcgacaccacgctttcctgtttcagaaggtaaagagggtcattggggtcgagctatgcccagaggctgtggaggacgcccgggtgaacgcccaggacaatgagttgagtaatgtggagttccactgcgggagggccgaggacctggtgcccaccctggtgagcagactggcctcccagcacctcgtggccatcctggacccaccccgtgctggcttgcattccaaggtgatcctggccatccggagagctaagaacctcaggcggctgctgtacgtctcatgcaacccccgggcagccatgggcaactttgtggacctctgcagagccccatctaaccgggtgaagggcattcccttccggccggtcaaggctgtggcagtggacctgttcccgcagaccccgcactgtgagatgctcatcctgtttgagagggtggagcaccccaatggcacaggggtcttggggccccacagccctccagctcaacccacaccaggacccccagataacaccctacaagaaactgggaccttcccctcatcctaggcccaggacccattatggggacaggagctgaagggctcccagggccccaggggcggggaaggcatggcttgctggccaggatattcagaggtaggcagccaaagggcacagaaccctgtgccccaccaggattggcctgctgctaggggccaggggccctgaccaggaagacaggtgggttcctgtagcctgttgcccatccccagggcctttgtggactagcca

SEQ ID NO: 195311 - DNA, 739 bp, Homo sapiens
  Payload ID: 18563
  Gene Name: tRNA methyltransferase 2 homolog A
  ENST ID: ENST00000444845
  CDS Start-End: 1-477
aaggtaaagagggtcattggggtcgagctatgcccagaggctgtggaggacgcccgggtgaacgcccaggacaatgagttgagtaatgtggagttccactgcgggagggccgaggacctggtgcccaccctggtgagcagactggcctcccagcacctcgtggccatcctggacccaccccgtgctggcttgcattccaaggtgatcctggccatccggagagctaagaacctcaggcggctgctcctctgcagagccccatctaaccgggtgaagggcattcccttccggccggtcaaggctgtggcagtggacctgttcccgcagaccccgcactgtgagatgctcatcctgtttgagagggtggagcaccccaatggcacaggggtcttggggccccacagccctccagctcaacccacaccaggacccccagataacaccctacaagaaactgggaccttcccctcatcctaggcccaggacccattatggggacaggagctgaagggctcccagggccccaggggcggggaaggcatggcttgctggccaggatattcagaggtaggcagccaaagggcacagaaccctgtgccccaccaggattggcctgctgctaggggccaggggccctgaccaggaagacaggtgggttcctgtagcctgttgcccatccccagggcctttgtggactagccaaggctgtgagggccagaataaacaactgctcaacaaa

SEQ ID NO: 195312 - DNA, 2921 bp, Homo sapiens
  Payload ID: 18564
  Gene Name: tRNA methyltransferase 2 homolog B
  Uniprot ID: Q96GJ1
  ENST ID: ENST00000372935
  CDS Start-End: 368-1882
gctatgagtgcttttaaggaaggtctccatagaaggttcccccagcaaagtagggaggggtactccccgagaggagtcgaggtgccggagcctgctgcctcgccgacgctgggaggagccccgtgtcccgccgcgcttgccaagggttggctgcgcgtgcggcgggagtagaggcgccttgcgcaccaggaagtgactgtttccccgccgcagcaaaccaggccatccgctggccttttagtttgccgcctcagaaaactccctactatgccaaactgtccgcggggcggggaatggaggaggcaggcggggctggagacgggacccgacggtgactgcgcaaggtggatttcagtgtgttctttggatggcaggccttaagagaagagtcccactgcacagcctcagatacttcatctccatggtgggtctcttctccaaaccaggactgcttccctggtatgccagaaatccaccaggatggtcacagctctttctgggcacagtatgtaagggagatttcacccgtgtgatagccacgaaatgtcagaaaggacaaaaaagtcagaagaaaccaagccatcttggaccactagatggttcctggcaggaaaggctggctgatgttgtgacaccactctggaggttgagctatgaagaacagctcaaggtgaaatttgcagctcagaagaaaattttacaaagactagagtcttacatccaaatgctcaatggagtcagtgtgacaacggctgtacccaaatctgagaggctctcttgtcttctccatcctattataccctctcctgtcatcaatggttaccgaaataagtccaccttctctgtgaaccgaggtccagatggcaatccaaagactgtggggttctacctgggaacttggagagatgggaacgttgtctgtgtgcagtctaatcatctgaaaaacatccctgagaaacacagtcaagtggcgcagtactatgaagtattccttcgacagtctccattggagccctgccttgtatttcatgaaggtggatactggcgtgagctcacagtccgcaccaatagccaagggcacacaatggctatcatcactttccatccccagaaattaagtcaggaggagctccatgttcagaaggagattgtaaaggaatttttcatcagaggtcctggagcagcctgtggcttgacctcactttacttccaggaaagtaccatgacccgttgcagccatcagcagtctccctatcagcttctgtttggggaaccctacatctttgaagaacttctgagcttgaagatccgcatctctccagatgcctttttccagattaacacagctggtgcagagatgctgtatcggactgtgggggagctgactggagtgaactctgacaccatccttcttgacatctgctgtggaactggtgtgattggcctctctctggctcagcatacatctcgggtccttgggattgaattgttggagcaggcagtggaggatgcaagatggactgcagccttcaatggcatcaccaactctgaatttcatactggtcaagcagagaagattttgccagggctgctaaagtcaaaggaagatggacagtcaattgttgctgtggtgaacccagcccgtgccggactgcattacaaggtgattcaagccattcgaaacttcagggccatccacacgctagtttttgtttcctgcaagctccatggtgaatccactaggaatgtcattgagctgtgctgtcctccagaccctgctaagaagctcttaggcgagccctttgtcctgcagcaagctgtacctgtggatttgttccctcacaccccacattgtgagctggtgctcctctttactcgataagcagcctcctagaagacagcaggctatttgttaaggctgaagtttcagaaactttcaggtttggcatattgctacattgcagaccctgggagcattacagtggaaaccaatctttggtttgtgaataggaagaatctattaggcctctggtctgaggcagattttttttttgagatagagtctcactcttgcccaggctggagtgtcgtggcgtgatctcagctcactgcaacctccgcctcccgggttcaagtgattctcgtgcctcagcttccccagtagctaggattaaaggtgcgtgccaccatgcccggctaatttttgtatttttggtagagacagggtttcaccatgttggccaggctggtctcaaactcctgacctcaagtgatccacccgcctcggcctctcaaagtgctgggattataggcgtgagccaccacaccccgccgcggctgacttaaccttagatttcagattccctttcaatcatgcccgtttgcttgggtttgaccactccccactcctggatctggactgtttcttcctgttgctgtcagccttggttctagtttatagtcttgtctcctccgtttctgcttatggtgtggacaaatgaccttttttaagcagctggtaataattttacattgactggagcctgtgcatttgctcagagatgctacaatttttagatatttctaagacttctggattcttgaggtagttaaggattaaaaccagaaacagtcgaggttttttaaaagcagggtaagccatgaagtgaatacagggtgactgagtgatcatcagatgagattaattcttttgggttttcttggttttaaggcatctcgaatgccccttgaaaatgtagttttccctggtggtgggcacctgtaatcccagctactcgggaggctgaggcaggataattgcttgaacctgggaggtggaggttgcagtgagctgaaattgtgccactgcactccagcctgggtgacagagtgagacaccatctcaaaaaaaaaaaaaaaaa

SEQ ID NO: 195313 - DNA, 3327 bp, Homo sapiens
  Payload ID: 18564
  Gene Name: tRNA methyltransferase 2 homolog B
  Uniprot ID: Q96GJ1
  ENST ID: ENST00000372936
  CDS Start-End: 774-2288
ggcgggtgtcagggctatgagtgcttttaaggaaggtctccatagaaggttcccccagcaaagtagggaggggtactccccgagaggagtcgaggtgccggagcctgctgcctcgccgacgctgggaggagccccgtgtcccgccgcgcttgccaagggttggctgcgcgtgcggcgggagtagaggcgccttgcgcaccaggaagtgactgtttccccgccgcagcaaaccaggccatccgctggccttttagtttgccgcctcagaaaactccctactatgccaaactgtccgcggggcggggaatggaggaggcaggcggggctggagacgggacccgacggtgactgcgcaaggtcgtgtacggcccagcgtgggcctgtgccctaactcctcccactcccttactttctgtccttcccgggccctgcagaccggccaagtttagtggtagcctttcctagtgtctcctctttgttaacccttcctacagacacagtgggcagaacttgcctaaagaagaagggaatggaagggctagtggagtcttgttggggagacaaggacctgactgcctgtgggctgcattcgggacacgacacagcagtcaacccatttgcttgtttggtttagcaaggaatagtgtctggagccggtccagctgaaggaagggtgagcagagagtgcaagcaggacccttgtcggtgggtgaacattttgctccaaaagggatccttggccctgcgcaggtggatttcagtgtgttctttggatggcaggccttaagagaagagtcccactgcacagcctcagatacttcatctccatggtgggtctcttctccaaaccaggactgcttccctggtatgccagaaatccaccaggatggtcacagctctttctgggcacagtatgtaagggagatttcacccgtgtgatagccacgaaatgtcagaaaggacaaaaaagtcagaagaaaccaagccatcttggaccactagatggttcctggcaggaaaggctggctgatgttgtgacaccactctggaggttgagctatgaagaacagctcaaggtgaaatttgcagctcagaagaaaattttacaaagactagagtcttacatccaaatgctcaatggagtcagtgtgacaacggctgtacccaaatctgagaggctctcttgtcttctccatcctattataccctctcctgtcatcaatggttaccgaaataagtccaccttctctgtgaaccgaggtccagatggcaatccaaagactgtggggttctacctgggaacttggagagatgggaacgttgtctgtgtgcagtctaatcatctgaaaaacatccctgagaaacacagtcaagtggcgcagtactatgaagtattccttcgacagtctccattggagccctgccttgtatttcatgaaggtggatactggcgtgagctcacagtccgcaccaatagccaagggcacacaatggctatcatcactttccatccccagaaattaagtcaggaggagctccatgttcagaaggagattgtaaaggaatttttcatcagaggtcctggagcagcctgtggcttgacctcactttacttccaggaaagtaccatgacccgttgcagccatcagcagtctccctatcagcttctgtttggggaaccctacatctttgaagaacttctgagcttgaagatccgcatctctccagatgcctttttccagattaacacagctggtgcagagatgctgtatcggactgtgggggagctgactggagtgaactctgacaccatccttcttgacatctgctgtggaactggtgtgattggcctctctctggctcagcatacatctcgggtccttgggattgaattgttggagcaggcagtggaggatgcaagatggactgcagccttcaatggcatcaccaactctgaatttcatactggtcaagcagagaagattttgccagggctgctaaagtcaaaggaagatggacagtcaattgttgctgtggtgaacccagcccgtgccggactgcattacaaggtgattcaagccattcgaaacttcagggccatccacacgctagtttttgtttcctgcaagctccatggtgaatccactaggaatgtcattgagctgtgctgtcctccagaccctgctaagaagctcttaggcgagccctttgtcctgcagcaagctgtacctgtggatttgttccctcacaccccacattgtgagctggtgctcctctttactcgataagcagcctcctagaagacagcaggctatttgttaaggctgaagtttcagaaactttcaggtttggcatattgctacattgcagaccctgggagcattacagtggaaaccaatctttggtttgtgaataggaagaatctattaggcctctggtctgaggcagattttttttttgagatagagtctcactcttgcccaggctggagtgtcgtggcgtgatctcagctcactgcaacctccgcctcccgggttcaagtgattctcgtgcctcagcttccccagtagctaggattaaaggtgcgtgccaccatgcccggctaatttttgtatttttggtagagacagggtttcaccatgttggccaggctggtctcaaactcctgacctcaagtgatccacccgcctcggcctctcaaagtgctgggattataggcgtgagccaccacaccccgccgcggctgacttaaccttagatttcagattccctttcaatcatgcccgtttgcttgggtttgaccactccccactcctggatctggactgtttcttcctgttgctgtcagccttggttctagtttatagtcttgtctcctccgtttctgcttatggtgtggacaaatgaccttttttaagcagctggtaataattttacattgactggagcctgtgcatttgctcagagatgctacaatttttagatatttctaagacttctggattcttgaggtagttaaggattaaaaccagaaacagtcgaggttttttaaaagcagggtaagccatgaagtgaatacagggtgactgagtgatcatcagatgagattaattcttttgggttttcttggttttaaggcatctcgaatgccccttgaaaatgtagttttccctggtggtgggcacctgtaatcccagctactcgggaggctgaggcaggataattgcttgaacctgggaggtggaggttgcagtgagctgaaattgtgccactgcactccagcctgggtgacagagtgagacaccatctcaaaaaaaaaaaaaaaaa

SEQ ID NO: 195314 - DNA, 3078 bp, Homo sapiens
  Payload ID: 18564
  Gene Name: tRNA methyltransferase 2 homolog B
  Uniprot ID: Q96GJ1
  ENST ID: ENST00000372939
  CDS Start-End: 468-1847
aggaaggtctccatagaaggttcccccagcaaagtagggaggggtactccccgagaggagtcgaggtgccggagcctgctgcctcgccgacgctgggaggagccccgtgtcccgccgcgcttgccaagggttggctgcgcgtgcggcgggagtagaggcgccttgcgcaccaggaagtgactgtttccccgccgcagcaaaccaggccatccgctggccttttagtttgccgcctcagaaaactccctactatgccaaactgtccgcggggcggggaatggaggaggcaggcggggctggagacgggacccgacggtgactgcgcaagcaaggaatagtgtctggagccggtccagctgaaggaagggtgagcagagagtgcaagcaggacccttgtcggtgggtgaacattttgctccaaaagggatccttggccctgcgcaggtggatttcagtgtgttctttggatggcaggccttaagagaagagtcccactgcacagcctcagatacttcatctccatggtgggtctcttctccaaaccaggactgcttccctggtatgccagaaatccaccaggatggtcacagctctttctgggcacagtatgtaagggagatttcacccgtgtgatagccacgaaatgtcagaaaggacaaaaaagtcagaagaaaccaagccatcttggaccactagatggttcctggcaggaaaggctggctgatgttgtgacaccactctggaggttgagctatgaagaacagctcaagcctgtcatcaatggttaccgaaataagtccaccttctctgtgaaccgaggtccagatggcaatccaaagactgtggggttctacctgggaacttggagagatgggaacgttgtctgtgtgcagtctaatcatctgaaaaacatccctgagaaacacagtcaagtggcgcagtactatgaagtattccttcgacagtctccattggagccctgccttgtatttcatgaaggtggatactggcgtgagctcacagtccgcaccaatagccaagggcacacaatggctatcatcactttccatccccagaaattaagtcaggaggagctccatgttcagaaggagattgtaaaggaatttttcatcagaggtcctggagcagcctgtggcttgacctcactttacttccaggaaagtaccatgacccgttgcagccatcagcagtctccctatcagcttctgtttggggaaccctacatctttgaagaacttctgagcttgaagatccgcatctctccagatgcctttttccagattaacacagctggtgcagagatgctgtatcggactgtgggggagctgactggagtgaactctgacaccatccttcttgacatctgctgtggaactggtgtgattggcctctctctggctcagcatacatctcgggtccttgggattgaattgttggagcaggcagtggaggatgcaagatggactgcagccttcaatggcatcaccaactctgaatttcatactggtcaagcagagaagattttgccagggctgctaaagtcaaaggaagatggacagtcaattgttgctgtggtgaacccagcccgtgccggactgcattacaaggtgattcaagccattcgaaacttcagggccatccacacgctagtttttgtttcctgcaagctccatggtgaatccactaggaatgtcattgagctgtgctgtcctccagaccctgctaagaagctcttaggcgagccctttgtcctgcagcaagctgtacctgtggatttgttccctcacaccccacattgtgagctggtgctcctctttactcgataagcagcctcctagaagacagcaggctatttgttaaggctgaagtttcagaaactttcaggtttggcatattgctacattgcagaccctgggagcattacagtggaaaccaatctttggtttgtgaataggaagaatctattaggcctctggtctgaggcagattttttttttgagatagagtctcactcttgcccaggctggagtgtcgtggcgtgatctcagctcactgcaacctccgcctcccgggttcaagtgattctcgtgcctcagcttccccagtagctaggattaaaggtgcgtgccaccatgcccggctaatttttgtatttttggtagagacagggtttcaccatgttggccaggctggtctcaaactcctgacctcaagtgatccacccgcctcggcctctcaaagtgctgggattataggcgtgagccaccacaccccgccgcggctgacttaaccttagatttcagattccctttcaatcatgcccgtttgcttgggtttgaccactccccactcctggatctggactgtttcttcctgttgctgtcagccttggttctagtttatagtcttgtctcctccgtttctgcttatggtgtggacaaatgaccttttttaagcagctggtaataattttacattgactggagcctgtgcatttgctcagagatgctacaatttttagatatttctaagacttctggattcttgaggtagttaaggattaaaaccagaaacagtcgaggttttttaaaagcagggtaagccatgaagtgaatacagggtgactgagtgatcatcagatgagattaattcttttgggttttcttggttttaaggcatctcgaatgccccttgaaaatgtagttttccctggtggtgggcacctgtaatcccagctactcgggaggctgaggcaggataattgcttgaacctgggaggtggaggttgcagtgagctgaaattgtgccactgcactccagcctgggtgacagagtgagacaccatctcaaaaaaaaaaaaaaaaagaaaatgtagttatccctaggagcaatagcaccaattaactctcacccgtggaggaagaattggttattggagagaccctaagggaaaggagattttcagagagactgaatacctataattgtgctgtgtagtgtggaggcaaaaagctccaaaatctagtataacataataaactggatattgaaaactga

SEQ ID NO: 195315 - DNA, 3106 bp, Homo sapiens
  Payload ID: 18564
  Gene Name: tRNA methyltransferase 2 homolog B
  Uniprot ID: Q96GJ1
  ENST ID: ENST00000545398
  CDS Start-End: 357-1871
aggggaggagaggagaacttagagaaggaaggcggcgggtgtcagggctatgagtgcttttaaggaaggtctccatagaaggttcccccagcaaagtagggaggggtactccccgagaggagtcgaggtgccggagcctgctgcctcgccgacgctgggaggagccccgtgtcccgccgcgcttgccaagggttggctgcgcgtgcggcgggagtagaggcgccttgcgcaccaggaagtgactgtttccccgccgcagcaaaccaggccatccgctggccttttagtttgccgcctcaggtttgtaagaggatttattggttacgaaggaaggtggatttcagtgtgttctttggatggcaggccttaagagaagagtcccactgcacagcctcagatacttcatctccatggtgggtctcttctccaaaccaggactgcttccctggtatgccagaaatccaccaggatggtcacagctctttctgggcacagtatgtaagggagatttcacccgtgtgatagccacgaaatgtcagaaaggacaaaaaagtcagaagaaaccaagccatcttggaccactagatggttcctggcaggaaaggctggctgatgttgtgacaccactctggaggttgagctatgaagaacagctcaaggtgaaatttgcagctcagaagaaaattttacaaagactagagtcttacatccaaatgctcaatggagtcagtgtgacaacggctgtacccaaatctgagaggctctcttgtcttctccatcctattataccctctcctgtcatcaatggttaccgaaataagtccaccttctctgtgaaccgaggtccagatggcaatccaaagactgtggggttctacctgggaacttggagagatgggaacgttgtctgtgtgcagtctaatcatctgaaaaacatccctgagaaacacagtcaagtggcgcagtactatgaagtattccttcgacagtctccattggagccctgccttgtatttcatgaaggtggatactggcgtgagctcacagtccgcaccaatagccaagggcacacaatggctatcatcactttccatccccagaaattaagtcaggaggagctccatgttcagaaggagattgtaaaggaatttttcatcagaggtcctggagcagcctgtggcttgacctcactttacttccaggaaagtaccatgacccgttgcagccatcagcagtctccctatcagcttctgtttggggaaccctacatctttgaagaacttctgagcttgaagatccgcatctctccagatgcctttttccagattaacacagctggtgcagagatgctgtatcggactgtgggggagctgactggagtgaactctgacaccatccttcttgacatctgctgtggaactggtgtgattggcctctctctggctcagcatacatctcgggtccttgggattgaattgttggagcaggcagtggaggatgcaagatggactgcagccttcaatggcatcaccaactctgaatttcatactggtcaagcagagaagattttgccagggctgctaaagtcaaaggaagatggacagtcaattgttgctgtggtgaacccagcccgtgccggactgcattacaaggtgattcaagccattcgaaacttcagggccatccacacgctagtttttgtttcctgcaagctccatggtgaatccactaggaatgtcattgagctgtgctgtcctccagaccctgctaagaagctcttaggcgagccctttgtcctgcagcaagctgtacctgtggatttgttccctcacaccccacattgtgagctggtgctcctctttactcgataagcagcctcctagaagacagcaggctatttgttaaggctgaagtttcagaaactttcaggtttggcatattgctacattgcagaccctgggagcattacagtggaaaccaatctttggtttgtgaataggaagaatctattaggcctctggtctgaggcagattttttttttgagatagagtctcactcttgcccaggctggagtgtcgtggcgtgatctcagctcactgcaacctccgcctcccgggttcaagtgattctcgtgcctcagcttccccagtagctaggattaaaggtgcgtgccaccatgcccggctaatttttgtatttttggtagagacagggtttcaccatgttggccaggctggtctcaaactcctgacctcaagtgatccacccgcctcggcctctcaaagtgctgggattataggcgtgagccaccacaccccgccgcggctgacttaaccttagatttcagattccctttcaatcatgcccgtttgcttgggtttgaccactccccactcctggatctggactgtttcttcctgttgctgtcagccttggttctagtttatagtcttgtctcctccgtttctgcttatggtgtggacaaatgaccttttttaagcagctggtaataattttacattgactggagcctgtgcatttgctcagagatgctacaatttttagatatttctaagacttctggattcttgaggtagttaaggattaaaaccagaaacagtcgaggttttttaaaagcagggtaagccatgaagtgaatacagggtgactgagtgatcatcagatgagattaattcttttgggttttcttggttttaaggcatctcgaatgccccttgaaaatgtagttttccctggtggtgggcacctgtaatcccagctactcgggaggctgaggcaggataattgcttgaacctgggaggtggaggttgcagtgagctgaaattgtgccactgcactccagcctgggtgacagagtgagacaccatctcaaaaaaaaaaaaaaaaagaaaatgtagttatccctaggagcaatagcaccaattaactctcacccgtggaggaagaattggttattggagagaccctaagggaaaggagattttcagagagactgaatacctataattgtgctgtgtagtgtggaggcaaaaagctccaaaatctagtataacataataaactggatattgaaaactgactgt

SEQ ID NO: 195316 - DNA, 2799 bp, Homo sapiens
  Payload ID: 18565
  Gene Name: tRNA methyltransferase 44 homolog (S. cerevisiae)
  Uniprot ID: Q8IYL2
  ENST ID: ENST00000389737
  CDS Start-End: 1-2274
atggctgaggtgggccgtaccgggatcagctacccaggcgcgcttctcccacagggcttctgggctgcggtcgaagtgtggctggagaggccgcaggtggcaaacaaacggctttgcggcgcccgcctggaggcccgctggagcgccgccctgccctgcgcggaggcccgcggccccgggactagcgcaggctcggagcagaaggagcggggtccgggacccggccagggttcccccggagggggcccgggtcccaggtcgctatcaggacccgagcagggcacggcatgttgcgaacttgaggaggcccagggccagtgccagcaagaggaggcacagagggaagccgcctcagtgcccctgagggactccgggcaccccggccatgctgaaggaagggagggcgacttccccgccgcagatctggattcgctttgggaggatttctcccaaagtctcgcccgtggcaattcggagttgctggccttcctcaccagctccggggcgggatcgcagccagaggcgcagcgtgagctcgacgtggttctcagaaccgtcatcccgaaaactagcccacattgcccccttacaactcccaggagggaaatagtcgtgcaagatgtcctcaatggaaccataacgtttttgcctttggaagaagatgatgaggggaacctaaaggttaagatgagcaatgtgtatcaaattcagctcagtcatagcaaagaagaatggttcatatctgttttaattttctgtccagaaagatggcattcagatggaatcgtgtatcccaaacccacgtggcttggagaagagttgctggccaagttggccaagtggtctgtagagaacaagaagagtgactttaaaagcaccctttccctcatctccattatgaagtatagcaaggcttaccaggaacttaaagagaagtataaggaaatggttaaggtgtggcctgaagtcactgatcctgagaagttcgtgtatgaagatgtggctatcgcagcatacctgctgattctatgggaagaagaaagggctgagaggagactaactgccaggcagtcctttgtggacctgggatgtggaaatggcctcctggtccacatcctgagcagtgaggggcatccaggcagagggattgatgtccgaagaagaaaaatctgggacatgtatggaccacaaactcagttagaggaagatgcaatcacacccaatgataagacccttttccctgatgttgattggttaatcggtaaccattctgatgaactcacaccatggatacctgtcattgcagccaggtcttcctacaattgccgcttctttgtcctcccctgctgcttctttgacttcattggaagatactcccggaggcagagtaagaagactcagtaccgggaataccttgacttcattaaagaagtgggcttcacctgtgggtttcacgtggacgaagactgcctcaggattccttcaaccaaaagagtctgtctcgttggaaaatccagaacatacccttcctccagagaagcttccgtggatgaaaagaggactcagtacattaagagcaggcggggctgccctgtaagcccacctggctgggagctttccccttctccacgctgggttgctgctggcagtgctggtcactgtgacggtcagcaagctctggacgccagggtcgggtgtgtaaccagggcctgggccgctgagcatggagcagggccccaggctgaaggaccctggctacctggatttcatcccagagaaaaggctgagcgtgtgaggaactgtgccgccctgccacgagattttattgaccaagtggttttgcaagtagcgaatttactgttaggtggaaagcaattaaacacaagaagttctcgaaatgggagtttgaagacctggaatgggggagagagcctatctctggcagaagtagccaacgagctggacacggagaccctgcggaggctgaagcgggagtgtgggggcctgcagacgctgctccggaacagccaccaggtgttccaagttgtgaatgggagagttcacatccgcgactggcgagaggagacactgtggaagacaaagcaaccggaagcgaaacagagactgctctctgaagcctgcaaaacccgcctctgctggttcttcatgcatcaccctgatggctgcgctctgtccacggactgctgcccgtttgcccatgggcctgcggagctgcggccaccccggaccaccccgaggaagaagatttcatgagctgcatccttgccagccgaggcctggttggggaggccaaaccaaggagagcttccccagcagtcgtcagtgctgtggtctctgctctggctgtgtttcagcccacctcctcccagctttctccacatcctcacagtgatgaaccgtatttcataaacatcacacgccagagaagccacagttactcggaagcccccagctgactgcctggcttgtttcagatgcagccgcttgaaacgtgcgcagcatcttcatatcataaagattgtgcacggatccttacaatgtctcctgggggagagcggctgaggctgccttgcacaggcccttcccagggcgctgtccgacgcctgccccaccatgtccacatctgtgaagaggatggggctcctcgagaagtaagaccgtatctgccagcgtttctcaccacactggagagcagctgctctggagcagggatccaccagattggtatttttaaaaaaggtgtcaggcttgctatgttgaggttgtttttagagttac

SEQ ID NO: 195317 - DNA, 1666 bp, Homo sapiens
  Payload ID: 18565
  Gene Name: tRNA methyltransferase 44 homolog (S. cerevisiae)
  Uniprot ID: Q8IYL2
  ENST ID: ENST00000513449
  CDS Start-End: 250-1485
gattcggagacgagaccaagctgttgctgaggacgacagccctgctctggtcactccggaggctgaccagtctacacacggctgaagcttgaagaaacaacaagcccggctctagtcacgcactggcagctgaatagtctacgcatggccgaagcttgaggacttgtcaagcaaatgtcctcaatggaaccataacgtttttgcctttggaagaagatgatgaggggaacctaaaggttaagatgagcaatgtgtatcaaattcagctcagtcatagcaaagaagaatgaaagatggcattcagatggaatcgtgtatcccaaacccacgtggcttggagaagagttgctggccaagttggccaagtggtctgtagagaacaagaagagtgactttaaaagcaccctttccctcatctccattatgaagtatagcaaggcttaccaggaacttaaagagaagtataaggaaatggttaaggtgtggcctgaagtcactgatcctgagaagttcgtgtatgaagatgtggctatcgcagcatacctgctgattctatgggaagaagaaagggctgagaggagactaactgccaggcagtcctttgtggacctgggatgtggaaatggcctcctggtccacatcctgagcagtgaggggcatccaggcagagggattgatgtccgaagaagaaaaatctgggacatgtatggaccacaaactcagttagaggaagatgcaatcacacccaatgataagacccttttccctgatgttgattggttaatcggtaaccattctgatgaactcacaccatggatacctgtcattgcagccaggtcttcctacaattgccgcttctttgtcctcccctgctgcttctttgacttcattggaagatactcccggaggcagagtaagaagactcagtaccgggaataccttgacttcattaaagaagtgggcttcacctgtgggtttcacgtggacgaagactgcctcaggattccttcaaccaaaagagtctgtctcgttggaaaatccagaacatacccttcctccagagaagcttccgtggatgaaaagaggactcagtacattaagagcaggcggggctgccctgtaagcccacctggctgggagctttccccttctccacgctgggttgctgctggcagtgctggtcactgtgacggtcagcaagctctggacgccagggtcgggtgtgtaaccagggcctgggccgctgagcatggagcagggccccaggctgaaggaccctggctacctggatttcatcccagagaaaaggctgagcgtgtgaggaactgtgccgccctgccacgagattttattgaccaagtggttttgcaagtagcgaatttactgttaggtggaaagcaattaaacacaagaagttctcgaaatgggagtttgaagacctggaatgggggaggtaagctgtccaccatcttagggaggggctagcacgctcccaggcttgagggcaggaattcacgtcttcagaaccgacatgaaatggtgtggccctgtgactacacactttgaaaaagccattgatggtgggtgcataggctctcttcaagcaaattctttaaaattttccaaatagctcttataaacataaaggactttgttatttccaggg

SEQ ID NO: 195318 - DNA, 660 bp, Homo sapiens
  Payload ID: 18565
  Gene Name: tRNA methyltransferase 44 homolog (S. cerevisiae)
  ENST ID: ENST00000504134
  CDS Start-End: 1-660
ggagcgccgccctgccctgcgcggaggcccgcggccccgggactagcgcaggctcggagcagaaggagcggggtccgggacccggccagggttcccccggagggggcccgggtcccaggtcgctatcaggacccgagcagggcacggcatgttgcgaacttgaggaggcccagggccagtgccagcaagaggaggcacagagggaagccgcctcagtgcccctgagggactccgggcaccccggccatgctgaaggaagggagggcgacttccccgccgcagatctggattcgctttgggaggatttctcccaaagtctcgcccgtggcaattcggagttgctggccttcctcaccagctccggggcgggatcgcagccagaggcgcagcgtgagctcgacgtggttctcagaaccgtcatcccgaaaactagcccacattgcccccttacaactcccaggagggaaatagtcgtgcaagaaagatggcattcagatggaatcgtgtatcccaaacccacgtggcttggagaagagttgctggccaagttggccaagtggtctgtagagaacaagaagagtgactttaaaagcaccctttccctcatctccattatgaagtatagcaaggcttaccaggaacttaaagagaagtataagg

SEQ ID NO: 195319 - DNA, 5573 bp, Homo sapiens
  Payload ID: 18566
  Gene Name: tRNA methyltransferase 5
  Uniprot ID: Q32P41
  ENST ID: ENST00000261249
  CDS Start-End: 386-1915
ttcggcctccgcttcttcaggctgctggacagagacataccagccccgctcagcgttgaagctcccccaggacgcctccatgctgctctccagctgactaccagttccatctacgagcctctacccctgccctgcgctccagtcgtcggtcgcgccagaggcggagctttgagcccggcccttccggcattccgtacttcaccagggcctggaaggagaggagcgagtcgacttgatctgatgacgcgcgccctcttcgcggcgaacagtgatgatgtcatagaagacccgcccatccacccgcgacccacatccgatcggtaccggagcgggaggtgaggggtcggctcgcggatccagctgcagagcgacgtggggaattggaatggtgctttggatcttatggaggccatttggattctcaggaagatttctgaaactggaaagccatagcataactgaatcaaaatcgttgattccagtagcttggacatccctgacacagatgcttttggaagcacctggtattttcttattgggtcaaagaaaaagattctcaaccatgccagaaacagaaacacatgagagagagactgaattgttttcaccaccttctgatgtccgaggcatgacaaaacttgatagaacagcttttaaaaagacagtcaacattccagtgcttaaagtgaggaaagaaatagtcagtaaattgatgcgatccctaaaaagggcagcattgcagcgcccaggcataagacgtgtgattgaagatccggaagataaagaaagtagactaatcatgttggatccctataaaatatttactcatgattcctttgagaaagcagaactcagtgttttagagcagcttaatgtcagtccacagatctctaaatacaatttggaactaacatatgaacactttaagtcagaagaaatcttgagagctgtgcttcctgaaggtcaagatgtaacttcagggtttagcaggattggacatattgcacacctaaaccttcgagatcatcagctgcctttcaaacatttaattggccaggttatgattgacaaaaatccaggaatcacctcagcagtaaataaaataaataatattgacaatatgtaccgaaatttccaaatggaagtgctatctggagagcagaacatgatgacaaaggttcgagaaaacaactacacctatgaatttgatttttcaaaagtctattggaatcctcgtctgtctacagaacacagccgtatcacagaacttctcaaacctggggatgtcctatttgatgtttttgctggggttgggccctttgccattccagtagcaaagaaaaactgcactgtatttgccaatgatctcaatcctgaatctcataaatggctgttgtacaactgtaaattaaataaagtggaccaaaaggtgaaagtcttcaacttggatgggaaagacttcctccaaggaccagtcaaagaagagttaatgcagctgctgggtctgtcaaaagaaagaaaaccctctgtgcacgttgtcatgaacttgccagcaaaagctatagagtttcttagtgctttcaagtggcttttagatgggcagccatgcagcagtgagttccttcccatagtgcattgttatagcttttccaaagatgctaaccctgctgaggatgttcggcaaagggctggagctgtgttaggcatttctctggaggcatgcagttcagttcacctggtaagaaatgtggccccaaacaaggaaatgctgtgcatcacgtttcagattcctgcctctgtcctctacaagaaccagaccagaaatccagagaatcatgaagatccacctcttaaaaggcagaggacggctgaagccttttcagacgaaaaaacacaaattgtttcaaacacttaattggaaatgttttctccatctccctaccagacttacatgtagtgaaatagaatttgtattatttaataaaattttagggtttggtttttactattgaacccttgtactttgccttattttacaaattgaggattaccaattaaactttaactgaactaaggctaccaaatacattccctgttatctaaattataacatacaattattttataacaaaatatatctaatttttattggataaatatgaataaatattttctctcagggaaaataatttttgaaagtagggtgattgagtactaactaggaaggtattaacaccactttgtagttgtcctttacgtaactactcctttactgccaattaactatcaccataaaagtaataaaaaatgaaattatttagaacggggcaggcaaactacatcctgcaggccaaatctgtcccaccacctgttttcatatggcctgtggcctaataatgttcttacgttttccattggttgaaaaataatcaaaagaacattttgtgacgtgaaaattttatgacatctattatgtatcagttttaaaaattagaattgtatgaaattaagagtttcagagttcataaagtttgattggaacataccatgctcatttgtttacatatcatctgcagctgttttttgtttttaatatggaacgcttcacgaatttgcatgtcatccttgcgcagggaccattctgatcttctctgtaccattccagttttttagtatatgtgctgctgaagtgaggactgcagctgctttcttgaacaatagcagagttgagtggttgcaacacacactgaatgtgactgtcatcacttcacactgctgtttgacacatcacaaatcactgatgtggttgtaacgacagcattttgagtgccatgtatatcacatgaacccacattttattttttattaccagagcatatctattatagcaaaacaagaaaagtggactttgttgttatttttaaagtacagtagggtgtgaattattttgatgttgaattagacgacaaagcatctatatagctaagctaaaagaataaccattgacattaccagacaaaccactcatcacagtattcccaactcacaggcaagcaactgttagaaaaattagaaaatttaaaatggaaataacaaagcagaatttcttcacaaaatgaaaatgaggctgcaacaacagtaagtctctaagtcaatcatttgttagccaagcaaagccatttattgatggtgtgaattaattatgtttggatgcagcagctgaatatatccagagaaaataaacttaagattactggcctttggcaagaacagttgcttaaagagttaaggacattgaaagcgacataaatagtcactttaaaaaggaaatgattctggatggttctttgactctatttttatttttacttagagacagggtcttgctctgttgcccaggctggagtgtagagacacagttacacctcaatgtaaccttgaactcctaggcttgagatcttcccatctcggcttcccaatgtgtgaaggttacaggtgtgagcccttatatgtggccctcgtgaatggtttagcactatccccttggtggtgtccttaagataatgagttatgagatcttgttgtttcaaagtatgtggcactcgccccccacactctcttgctcctgccttcgccatgtgaagtgccttctcctattttgccttctaccatgagtaaaagcttcctgaggcttccccagaagcagatgccagtgctatgcttcctatagcctggagaactgtgagccaattatacctcttttcttataaattacccagtatcaagtatttctttatagcaatgcaagaatggcctaaaacacaaggcaaaacaactttgatatggtacagtcattttgacaatcgatatttgaatcacaatatttgatgacaatatccttacacatttgtcatactatcaaagagaaagaaacaagatttccattcccacaaattttagtgagtatattttctgagttcagcatttttagggacctaggtgcaagtgcaaaggaaatttccctgtttcaaaatctatttaactgcaattgaggtgattcaacctaattttcagtaagaagtgattaaaataatgacatgctaaaaggcaaatttcaagggaagaaatgtaaaagaattttacaaatgctttccaagtgatgaatatgctcagttaatttcatatgctcctggattgatagcagtatttggcaatacctatctgtatgagaagacatttttaaagatgaaatgtgtaaaatcttattaccattagtattaatggttaatgatggttaatgataaccattaataggcaatcatttacaactgattttgatcacagggaacacttacttagaaccctgattagaggcaatgttattctcaccaaaaaaggcattacaaaaaattgggctatattttgaattttgtcaattaaaaaagcgtgggagcagtgtgaaggagaagaggcaagaacgacccctggaccgaccaaagcccgcgcgctgctgcgtcccacacccggtgcccacatcccgccgccgccgccgccgccatgcccaagagaaagactgaaggggatgctaaaggagataaagccaaggtgaaggatgaatcacagagaagatctgcgaggttgtctgctaaacctgctcctccaaagccagagcccaagcctaaaaaggcccctgcaaagaagggagagaaggtacccaaagggaaaaagagaaaagctgatgctggcaaggagcgggaaggtgctggagatcccaagtgaagtgtgtgcattttttataactgtacttctggtgactgtacagtttgaaatattctttatcaagttttataaaaatgcagaattttgttttactttttttaagctatgttgttagcacacagaacacttcattgttgtttttgggggaaggggtatgtgtcactaatagaatatctctgaagctggattgatacggggaaaacatctttcccttctagttttgagagacttcctcttggctcccaggaggagggatttcctgactttgacacacatggccaccttggcacaaaagccttgtggtatggaaaaacaaattcgtttttatgtcttcttttccctttccatctttcagcatagacttaatccccttaagcccagacatctgttgggacctgacccccggtcattggttaccagtgtgtctggcaatctggactttccagtgatgccactgagatggcacctgtcaaaagagcagtggttccatttctagattatggatcttcggataaattctgccattttcatttcacttcctgaaagtcagggttggcttgtgaaaagttgttaaacaacatgctaaatgtgaaatgttaaccctctaaactttccctgttcagagcatcagatgaggacttcattgggttttatagcggctgatttttggtagtccattgaagaagagagtttgaaagttgtatactgttaatgactgtctgcccatgtcctgcctgaaataccatgattgtttatggaaagtatctttaataaagctggatacagtttgaaag

SEQ ID NO: 195320 - DNA, 572 bp, Homo sapiens
  Payload ID: 18566
  Gene Name: tRNA methyltransferase 5
  ENST ID: ENST00000555420
  CDS Start-End: 117-572
ccacatccgatcggtaccggagcgggaggtgaggggtcggctcgcggatccagctgcagagcgacgtggggaattggaatggtgctttggtgaggtggcggccgcgttaggggctaatggtccaggggaggtaccagcccgcccagggctgctctctgccatgtgctgcctgggcacagaaacatcgcgaggtcacccacccgcctaggatcttatggaggccatttggattctcaggaagatttctgaaactggaaagccatagcataactgaatcaaaatcgttgattccagtagcttggacatccctgacacagatgcttttggaagcacctggtattttcttattgggtcaaagaaaaagattctcaaccatgccagaaacagaaacacatgagagagagactgaattgttttcaccaccttctgatgtccgaggcatgacaaaacttgatagaacagcttttaaaaagacagtcaacattccagtgcttaaagtgaggaaagaaatagtcagtaaattgatgcgatccctaaaaagggcagcattgcagcgcccaggcataagacgt

SEQ ID NO: 195321 - DNA, 560 bp, Homo sapiens
  Payload ID: 18566
  Gene Name: tRNA methyltransferase 5
  ENST ID: ENST00000553903
  CDS Start-End: 53-560
attccgtacttcaccagggcctggaaggagaggagcgagtcgacttgatctgatgacgcgcgccctcttcgcggcgaacagtgatgatgtcatagaagacccgcccatccacccgcgacccacatccgatcggtaccggagcgggaggatcttatggaggccatttggattctcaggaagatttctgaaactggaaagccatagcataactgaatcaaaatcgttgattccagtagcttggacatccctgacacagatgcttttggaagcacctggtattttcttattgggtcaaagaaaaagattctcaaccatgccagaaacagaaacacatgagagagagactgaattgttttcaccaccttctgatgtccgaggcatgacaaaacttgatagaacagcttttaaaaagacagtcaacattccagtgcttaaagtgaggaaagaaatagtcagtaaattgatgcgatccctaaaaagggcagcattgcagcgcccaggcataagacgtgtgattgaagatccggaagataaagaaagtagactaatcatgttggatc

SEQ ID NO: 195322 - DNA, 2327 bp, Homo sapiens
  Payload ID: 18567
  Gene Name: tRNA methyltransferase 6
  Uniprot ID: Q9UJA5
  ENST ID: ENST00000203001
  CDS Start-End: 132-1625
cgtgcaacacgtgggggcggtgccggtcggagggctcctagtgcgccaggttgtgggaagtgaggctggcggtggcgacaaccgaggaggaggggcgggacgccgtggagcacggcgaccggctgagcgtcatggagggctcaggggagcagccgggcccacaaccacagcatcccggagaccaccgcatccgcgacggcgacttcgtggtgctgaaacgtgaagatgtgtttaaagcagtacaagtccagcggagaaaaaaagtaactttcgaaaaacagtggttctacctggataacgtcattggccatagttatggaactgcatttgaagtgaccagtggaggaagtctacagcccaagaagaagagggaagagcctactgcagagactaaagaagcgggcactgataatcgaaatatagttgatgatgggaaatctcagaaacttactcaagatgacataaaagctttgaaggacaagggcattaaaggagaggaaatagttcagcagttaattgaaaatagtacaacattccgagacaagacagaatttgcccaagataaatatattaaaaagaagaaaaaaaaatatgaagccatcattactgttgtgaagccatccacccgtattctttcaattatgtattatgcaagagaacctggaaaaattaaccacatgagatacgatacactagcccagatgttgacgttgggaaatatccgtgctggcaacaaaatgattgtgatggaaacgtgtgcaggcttggtgctgggtgcaatgatggaacgaatgggaggttttggctccattattcagctataccctggaggaggacctgttcgggcagcaacagcatgttttggatttcccaaatcttttctcagtggtctttatgaattccctctcaacaaagtggacagtcttctacatggaacattttctgccaagatgttatcttcagagccaaaagacagtgctttggttgaagaaagtaatggcacactggaggaaaaacaggcttctgaacaagagaatgaagacagcatggcagaggccccagagagcaaccacccagaagaccaggaaacaatggaaacaatttctcaagatccagaacataaggggcctaaagagagaggaagcaaaaaagattatattcaggaaaaacagaggagacaagaagagcagaggaaaagacatttagaggctgccgctctgctgagtgaaagaaacgcagatggtttaattgtagctagtcgtttccaccccactcccctgctgctgtctttgctggactttgtggccccttcaaggccgtttgtggtctactgtcagtacaaagagcctctgttggaatgctacacaaaactgcgggagaggggaggggtcatcaacctcaggctgtctgaaacctggctcagaaattatcaggttttgccagatcgaagtcatcctaaactgctgatgagtggaggtgggggttatcttctctccggcttcaccgttgccatggacaaccttaaagcagacaccagcctcaaatctaatgcaagcactttagaatcacacgagactgaggagcctgcagctaaaaaacgaaaatgcccagagtctgactcttaacccttttgagaattgctctgaattttgttctcaggcattatacagttagtaattaaactttaaatgccattactacttgttttttcatatcccaagaataagaacatgtctatgtacccgtttctaggaaggaggagtatatgccttttgtctatttctgacacagatgcatttggtctgtcaaaactgcaaccatggggtatgtagtatgaccaactgcatttaacaaaactcctctaagtacttctaaatattctgtgcaaatatcttgagaacttcaacatcctaaaaatgtgtttctacaagactttatattttaagctaagtggaataatacaacgtaactaaaacatggcgggtaccgaaaggagggcaattcatggaagaaatttcctctgttcattccgttctcttcaacctaagcaatatggatgtgtgagtgtgtgatttattatggtaccaaaaatgtccaccttctttcctgcagcggaataagcttttttgaaatgctgaggttttattttaatagttgacaacctgggaaagttctgagtatttattttactgctcttttttgtgcatagaaaggtttagtagggtacttttttgcattaatttgccaatactcttattctttgttctaaataaagtgactagaatttttgtgtactattcaattaaaggaaacaaatgtcttttccc

SEQ ID NO: 195323 - DNA, 2239 bp, Homo sapiens
  Payload ID: 18567
  Gene Name: tRNA methyltransferase 6
  Uniprot ID: Q9UJA5
  ENST ID: ENST00000453074
  CDS Start-End: 554-1537
ctgggccggaaagcggaagcggcgtgcaacacgtgggggcggtgccggtcggagggctcctagtgcgccaggttgtgggaagtgaggctggcggtggcgacaaccgaggaggaggggcgggacgccgtggagcacggcgaccggctgagcgtcatggagggctcaggggagcagccgggcccacaaccacagcatcccggagaccaccgcatccgcgacggcgacttcgtggtgctgaaacgtgaagatgtgtttaaagcagtacaagtccagcggagaaaaaaagtaactttcgaaaaacagtggttctacctggataacgtcattggccatagttatggaactgcatttgaagtgaccagtggaggaagtctacagcccaagaagaagagggaagagcctactgcaggaaatagttcagcagttaattgaaaatagtacaacattccgagacaagacagaatttgcccaagataaatatattaaaaagaagaaaaaaaaatatgaagccatcattactgttgtgaagccatccacccgtattctttcaattatgtattatgcaagagaacctggaaaaattaaccacatgagatacgatacactagcccagatgttgacgttgggaaatatccgtgctggcaacaaaatgattgtgatggaaacgtgtgcaggcttggtgctgggtgcaatgatggaacgaatgggaggttttggctccattattcagctataccctggaggaggacctgttcgggcagcaacagcatgttttggatttcccaaatcttttctcagtggtctttatgaattccctctcaacaaagtggacagtcttctacatggaacattttctgccaagatgttatcttcagagccaaaagacagtgctttggttgaagaaagtaatggcacactggaggaaaaacaggcttctgaacaagagaatgaagacagcatggcagaggccccagagagcaaccacccagaagaccaggaaacaatggaaacaatttctcaagatccagaacataaggggcctaaagagagaggaagcaaaaaagattatattcaggaaaaacagaggagacaagaagagcagaggaaaagacatttagaggctgccgctctgctgagtgaaagaaacgcagatggtttaattgtagctagtcgtttccaccccactcccctgctgctgtctttgctggactttgtggccccttcaaggccgtttgtggtctactgtcagtacaaagagcctctgttggaatgctacacaaaactgcgggagaggggaggggtcatcaacctcaggctgtctgaaacctggctcagaaattatcaggttttgccagatcgaagtcatcctaaactgctgatgagtggaggtgggggttatcttctctccggcttcaccgttgccatggacaaccttaaagcagacaccagcctcaaatctaatgcaagcactttagaatcacacgagactgaggagcctgcagctaaaaaacgaaaatgcccagagtctgactcttaacccttttgagaattgctctgaattttgttctcaggcattatacagttagtaattaaactttaaatgccattactacttgttttttcatatcccaagaataagaacatgtctatgtacccgtttctaggaaggaggagtatatgccttttgtctatttctgacacagatgcatttggtctgtcaaaactgcaaccatggggtatgtagtatgaccaactgcatttaacaaaactcctctaagtacttctaaatattctgtgcaaatatcttgagaacttcaacatcctaaaaatgtgtttctacaagactttatattttaagctaagtggaataatacaacgtaactaaaacatggcgggtaccgaaaggagggcaattcatggaagaaatttcctctgttcattccgttctcttcaacctaagcaatatggatgtgtgagtgtgtgatttattatggtaccaaaaatgtccaccttctttcctgcagcggaataagcttttttgaaatgctgaggttttattttaatagttgacaacctgggaaagttctgagtatttattttactgctcttttttgtgcatagaaaggtttagtagggtacttttttgcattaatttgccaatactcttattctttgttctaaataaagtgactagaatttttgtgtactattcaattaaaggaaacaaatgtcttttccc

SEQ ID NO: 195324 - DNA, 2827 bp, Homo sapiens
  Payload ID: 18568
  Gene Name: tRNA methyltransferase 61A
  ENST ID: ENST00000299202
  CDS Start-End: 1-575
ggcacgtgtggagccccggcagcaggagcgtcgcaggcaccggcagtggctctgtgtcccacgccatcatccgcaccattgcacccacgggtcacctgcacacggtggagttccaccagcagcgggcagagaaggcccgggaggagttccaggagcaccgtgtgggccgctgggtgactgtgcgcacccaggacgtgtgccgcagtggctttggcgtgagccacgtggccgacgccgtcttcctggacatcccatcaccctgggaggccgtgggccacgcctgggacgccctcaaggtcgaaggcgggcgcttctgctccttctcaccgtgcatcgagcaggtgcaacgcacatgccaggcgctggcagcgcgcggcttctcagagctgagcaccctggaggtgctgccacaggtctacaacgtgcgcactgtcagcctgccaccgcccgacctgggcacaggcacagatggccctgccggctccgacaccagccccttccgcagcggcacgcccatgaaggaggccgtgggccacaccggctacctgaccttcgccaccaagaccccaggctagggggccgcctcccagggcaccagggagctgggagcactgaagggctgggcagggaggccagaggcaccttatatggtcagcgatgcctgccagacacagacggtggggtggggcttgggggcctcctgggtggccagagtgggacagcaggaagggcggctgtgatggaggagcagtgctggggctgggcctcagccattcctgtccagccctgtggcccatcccagctgctgtttgttgccaatatgaagtatccactgccacaggctcccctgggtgttgaagccaaagggtgcaggtgggggagtctgaccccctcccaggtgggcctaagcaggaagggggtggaggagggaggggggcattgaccctgagaccacgctgcgtctgacccctgggcccccacggccctggctgccccacggggcctgagaccatctcgtgcttctccagtccccgggccgaggctccagccttggccagaagctggggtgagctgacccagaatccctgccctgctctccccagcgctaggagaccaggccagcccaggaaccagggaggtgaccctgctctctggcctcctggctgatgtcacagcactgagctcagcccaggccttcgtccactcatgtccaagaggcggggcatcccccacccagccagagcccctgacatgggctgcactcgctgaggccaggcagcgctgcggagaggagcggcagagtgggttgtctgccgcaggcaaccaggcaagtgtgtcggggctggggtgtgaatgccagcctgtgagtcccggaactatgtgggtacccctacccctcacagaagccaagggcatggaggaggtccctccacagtgacaacggtgtggggtaggggaggtgcattcaggacaccacccagggacagtgcctatgtgatcacctcttaaaggctaagcttaggggcatttcccaaagtggggacagagggcaggacgcccaggctgggggctctcctcgcccgccctggtgtctgacagcctcaaggaaggagcagtgcctgtgtcagccatggggcccttggagctgccgctggtgcctagggggcctgggtttctgcccaggcagccagtggctgttgggagcctctgtttcccctgtgctgggggccttgagtgctatgctagcaggggcctggccccaagtgtgagtgatgagcaataaacgtaccgtccccctctgttctgagtgatccctagcagccaaggccacccccagctgctgtctaggccagccctacctgcgctctgcccctggtccctgctcctccctgtcctggtttggcatgataggcgctccagtctccaggacaaaggggcaaatgtgtggccacccccatctggctgcagaaaaggccactccttcctggggttggggtggtccaggagtgctgggccttcttccacagtcctgggctggaattcagtgtggctgcctgggttacttgtatgcgcccctgaaggaagggtccactccaggccgcctggtccctgcgaagtgtcacactgtgggtcaccgggggctgtggctaatgtggtccgggaggcctgtgtccctgagagttgctcagccctgctccgagggcttgtcctctccttccaggacccagcttcccttctaaccttgttactcacctggggcacagaggaggggcccccagtcaggttcaacatggaagtgggtgaccctaatgccaggagctttggggtcaggctgtccctggggtgtcatgaactgggtgacgcacacccctgagatctcagttcccccaagcctgccctgcccctcctggccacagcaaaggcctgcatggtgtctgatgggtggacaccgggaggtgtttctttgaggcgcagctccatggtttataggacacataggcctcaggcaccgtagggtccaggttgtgcccattttccagccggggctggttgccctggtggcagccctgggtgagtcaccagggtccgcacatggagagcgggaggtcccagcccacccttagttgtcacatgggacagagttgctgtgtcaatcccctcggccctgctgctctgccctgcacacaggcccccatgatgaccttgagcctccaggcatccacccccaccgtatggccctctagacccagctgggcctcaccccactccctcagcttggatcctcacgtggcctggagccagcattaaactcctgtatgtccttcaa

SEQ ID NO: 195325 - DNA, 3229 bp, Homo sapiens
  Payload ID: 18568
  Gene Name: tRNA methyltransferase 61A
  Uniprot ID: Q96FX7
  ENST ID: ENST00000389749
  CDS Start-End: 108-977
ggagccggaagtgttgtggccgccgccgccgcgcgtcgcggaggcacgtgtggagccccggcagcaggagcgtcgcaggtccttggcccttgccagacattagcaccatgagcttcgtggcatacgaggagctgatcaaggagggtgacacggccatcctgtcactgggccatggtgcaatggtggcggtgcgtgtgcagcgtggggcacagacccagacccggcatggtgtcctgcggcactcagttgaccttatcggccgccccttcggctccaaggtgacgtgcggccgaggtggctgggtgtatgtgctgcaccccacgcccgagctctggacgctgaacctgccgcaccgcacgcagatcctctactccacagacatcgccctcatcaccatgatgttggagcttcggcccggctctgtggtctgtgagtctggcaccggcagtggctctgtgtcccacgccatcatccgcaccattgcacccacgggtcacctgcacacggtggagttccaccagcagcgggcagagaaggcccgggaggagttccaggagcaccgtgtgggccgctgggtgactgtgcgcacccaggacgtgtgccgcagtggctttggcgtgagccacgtggccgacgccgtcttcctggacatcccatcaccctgggaggccgtgggccacgcctgggacgccctcaaggtcgaaggcgggcgcttctgctccttctcaccgtgcatcgagcaggtgcaacgcacatgccaggcgctggcagcgcgcggcttctcagagctgagcaccctggaggtgctgccacaggtctacaacgtgcgcactgtcagcctgccaccgcccgacctgggcacaggcacagatggccctgccggctccgacaccagccccttccgcagcggcacgcccatgaaggaggccgtgggccacaccggctacctgaccttcgccaccaagaccccaggctagggggccgcctcccagggcaccagggagctgggagcactgaagggctgggcagggaggccagaggcaccttatatggtcagcgatgcctgccagacacagacggtggggtggggcttgggggcctcctgggtggccagagtgggacagcaggaagggcggctgtgatggaggagcagtgctggggctgggcctcagccattcctgtccagccctgtggcccatcccagctgctgtttgttgccaatatgaagtatccactgccacaggctcccctgggtgttgaagccaaagggtgcaggtgggggagtctgaccccctcccaggtgggcctaagcaggaagggggtggaggagggaggggggcattgaccctgagaccacgctgcgtctgacccctgggcccccacggccctggctgccccacggggcctgagaccatctcgtgcttctccagtccccgggccgaggctccagccttggccagaagctggggtgagctgacccagaatccctgccctgctctccccagcgctaggagaccaggccagcccaggaaccagggaggtgaccctgctctctggcctcctggctgatgtcacagcactgagctcagcccaggccttcgtccactcatgtccaagaggcggggcatcccccacccagccagagcccctgacatgggctgcactcgctgaggccaggcagcgctgcggagaggagcggcagagtgggttgtctgccgcaggcaaccaggcaagtgtgtcggggctggggtgtgaatgccagcctgtgagtcccggaactatgtgggtacccctacccctcacagaagccaagggcatggaggaggtccctccacagtgacaacggtgtggggtaggggaggtgcattcaggacaccacccagggacagtgcctatgtgatcacctcttaaaggctaagcttaggggcatttcccaaagtggggacagagggcaggacgcccaggctgggggctctcctcgcccgccctggtgtctgacagcctcaaggaaggagcagtgcctgtgtcagccatggggcccttggagctgccgctggtgcctagggggcctgggtttctgcccaggcagccagtggctgttgggagcctctgtttcccctgtgctgggggccttgagtgctatgctagcaggggcctggccccaagtgtgagtgatgagcaataaacgtaccgtccccctctgttctgagtgatccctagcagccaaggccacccccagctgctgtctaggccagccctacctgcgctctgcccctggtccctgctcctccctgtcctggtttggcatgataggcgctccagtctccaggacaaaggggcaaatgtgtggccacccccatctggctgcagaaaaggccactccttcctggggttggggtggtccaggagtgctgggccttcttccacagtcctgggctggaattcagtgtggctgcctgggttacttgtatgcgcccctgaaggaagggtccactccaggccgcctggtccctgcgaagtgtcacactgtgggtcaccgggggctgtggctaatgtggtccgggaggcctgtgtccctgagagttgctcagccctgctccgagggcttgtcctctccttccaggacccagcttcccttctaaccttgttactcacctggggcacagaggaggggcccccagtcaggttcaacatggaagtgggtgaccctaatgccaggagctttggggtcaggctgtccctggggtgtcatgaactgggtgacgcacacccctgagatctcagttcccccaagcctgccctgcccctcctggccacagcaaaggcctgcatggtgtctgatgggtggacaccgggaggtgtttctttgaggcgcagctccatggtttataggacacataggcctcaggcaccgtagggtccaggttgtgcccattttccagccggggctggttgccctggtggcagccctgggtgagtcaccagggtccgcacatggagagcgggaggtcccagcccacccttagttgtcacatgggacagagttgctgtgtcaatcccctcggccctgctgctctgccctgcacacaggcccccatgatgaccttgagcctccaggcatccacccccaccgtatggccctctagacccagctgggcctcaccccactccctcagcttggatcctcacgtggcctggagccagcattaaactcctgtatgtccttcaa

SEQ ID NO: 195326 - DNA, 1836 bp, Homo sapiens
  Payload ID: 18569
  Gene Name: tRNA methyltransferase 61B
  Uniprot ID: Q9BVS5
  ENST ID: ENST00000306108
  CDS Start-End: 25-1458
gcgacggcgccttcgcgaaacactatgctaatggcatggtgccgcggtcctgtcttgctgtgcctgcggcaggggctcggaaccaattcattcctgcacggcctggggcaggagcccttcgagggagctcggtcactgtgttgcaggtcctcgcctagagacctgcgagatggagaaagagagcacgaggcggcacaaaggaaagccccaggagcagagtcttgcccatctctccctctgagcatctcggacattgggactggatgtctttcgtcactggaaaacctcagactgccgacgctgcgggaagagtcatcccctcgagagctcgaggactcgagcggagaccagggccggtgcggtcccacacaccagggatccgaggatccttcgatgctctcgcaggcccagtccgctaccgaggtcgaagagcgtcacgtctccccttcttgttcaacttccagagagagaccctttcaggctggggaactgattttagctgagactggggagggagaaacaaaatttaagaaattatttaggttgaacaacttcggactcttaaatagtaactggggggcagtcccgttcggcaagatcgtggggaagttccccggccagatactgaggagttccttcggtaagcagtacatgctgaggaggccagccttggaagactatgtagtattgatgaaaagagggactgccataacattcccaaaggatattaatatgattctctcaatgatggatatcaacccaggtgatactgttttggaagctggctcaggctctggtggaatgagcttatttttatccaaagcagttggatcacaaggacgagtcataagttttgaggtacgaaaagaccaccatgatctggctaagaagaattacaaacactggcgtgattcatggaaattaagtcatgtagaagagtggccagacaatgtggattttattcataaggacatttcaggagcaaccgaagacataaaatctttaacatttgacgcagtagctttggatatgttaaatcctcatgttactttgcctgttttttacccacatcttaagcatggtggtgtatgtgctgtatatgtagtaaacatcacacaggttattgaacttttagatggaattcgcacctgtgaacttgctctttcatgtgaaaagataagcgaggtcattgtcagagattggttggtttgccttgcaaaacagaaaaatggaattttagctcaaaaagtagaatctaaaatcaacacagatgtacaactagattctcaagagaaaattggagttaaaggtgagctgtttcaagaggatgaccatgaagaatcgcattctgattttccatatggatcatttccctatgttgctagaccagtacactggcaacctggtcatacagcttttcttgtcaagttgaggaaggtcaaaccacaacttaactgagtactccagatgacagtaactgacttgaagatggaaaaatatcaaaatagaactttatattgaaaatcactgcttccatagattggcatttttagctattactatgacttatataacttatacatataattttgaaaataacaactaaaagatgtataacatagcaaaactgcttaaacatcccattttgacacttgtcttgcagttagtttgacattttgtagttaatgattccaaattggtttagttgggccatctcattcttcacttcctgtaaaccactccatagatttgtctttcttcaagaaattagttttctttcctttatttgattgatggtcattgactactgaaataaaatatgcattttaagataaa

SEQ ID NO: 195327 - DNA, 1584 bp, Homo sapiens
  Payload ID: 18569
  Gene Name: tRNA methyltransferase 61B
  ENST ID: ENST00000439947
  CDS Start-End: 19-1119
gcgccttcgcgaaacactatgctaatggcatggtgccgcggtcctgtcttgctgtgcctgcggcaggggctcggaaccaattcattcctgcacggcctggggcaggagcccttcgagggagctcggtcactgtgttgcaggtcctcgcctagagacctgcgagatggagaaagagagcacgaggcggcacaaaggaaagccccaggagcagagtcttgcccatctctccctctgagcatctcggacattgggactggatgtctttcgtcactggaaaacctcagactgccgacgctgcgggaagagtcatcccctcgagagctcgaggactcgagcggagaccagggccggtgcggtcccacacaccagggatccgaggatccttcgatgctctcgcaggcccagtccgctaccgaggtcgaagagcgtcacgtctccccttcttgttcaacttccagagagagaccctttcaggctggggaactgattttagctgagactggggagggagaaacaaaatttaagaaattatttaggttgaacaacttcggactcttaaatagtaactggggggcagtcccgttcggcaagatcgtggggaagttccccggccagatactgaggagttccttcggtaagcagtacatgctgaggaggccagccttggaagactatgtagtattgatgaaaagagggactgccataacattcccaaaggatattaatatgattctctcaatgatggatatcaacccaggtgatactgttttggaagctggctcaggctctggtggaatgagcttatttttatccaaagcagttggatcacaaggacgagtcataagttttgaggtacgaaaagaccaccatgatctggctaagaagaattacaaacactggcgtgattcatggaaattaagtcatgtagaagagtggccagacaatgtggattttattcataaggacatttcaggagcaaccgaagacataaaatctttaacatttgacgcagtagctttggatatgttaaatcctcatgttactttgcctgttttttacccacatcttaagcatggtggtgtatgtgctgtatatgtagtaaaaagaatcgcattctgattttccatatggatcatttccctatgttgctagaccagtacactggcaacctggtcatacagcttttcttgtcaagttgaggaaggtcaaaccacaacttaactgagtactccagatgacagtaactgacttgaagatggaaaaatatcaaaatagaactttatattgaaaatcactgcttccatagattggcatttttagctattactatgacttatataacttatacatataattttgaaaataacaactaaaagatgtataacatagcaaaactgcttaaacatcccattttgacacttgtcttgcagttagtttgacattttgtagttaatgattccaaattggtttagttgggccatctcattcttcacttcctgtaaaccactccatagatttgtctttcttcaagaaattagttttctttcctttatttgattgatggtcattgactactgaaataaa

SEQ ID NO: 195328 - DNA, 685 bp, Homo sapiens
  Payload ID: 18569
  Gene Name: tRNA methyltransferase 61B
  ENST ID: ENST00000419999
  CDS Start-End: 1-307
tgaacttttagatggaattcgcacctgtgaacttgctctttcatgtgaaaagataagcgaggtcattgtcagagattggttggtttgccttgcaaaacagaaaaatggaattttagctcaaaaagtagaatctaaaatcaacacagatgtacaactagattctcaagagaaaattggagttaaagaagaatcgcattctgattttccatatggatcatttccctatgttgctagaccagtacactggcaacctggtcatacagcttttcttgtcaagttgaggaaggtcaaaccacaacttaactgagtactccagatgacagtaactgacttgaagatggaaaaatatcaaaatagaactttatattgaaaatcactgcttccatagattggcatttttagctattactatgacttatataacttatacatataattttgaaaataacaactaaaagatgtataacatagcaaaactgcttaaacatcccattttgacacttgtcttgcagttagtttgacattttgtagttaatgattccaaattggtttagttgggccatctcattcttcacttcctgtaaaccactccatagatttgtctttcttcaagaaattagttttctttcctttatttgattgatggtcattgactactgaaataaaatatgcattttaagataaa

SEQ ID NO: 195329 - DNA, 843 bp, Homo sapiens
  Payload ID: 18570
  Gene Name: tRNA methyltransferase O
  ENST ID: ENST00000375117
  CDS Start-End: 1-480
cgcggcttggaggagtcggggcctcggcctacagcgaccccgtgcggctgcgttaagccggctctggagacagggaatcttttaactgagccagtcggctacttggaatcttgtttctcggccaagaatggtactccaagacagccatccatttgtagctattctcgagcctgtttgaggattagaaagaggatctttaataatcctgaacattccttgatgggcctagaacagttttctcatgtttggattttgtttgtttttcacaaaaatggtcatttgagctgtaaggcaaaagtgcagcctcctaggctgaatggtgcaaagactggagttttttccacaaggagccctcatcgtcccaatgcaataggactgaccctggccaagctggaaaaggtagaagccttggggaaatggacagatatcatggctgcagtgctgatgtcaactgtgctgtgtggcaggagtctgggatgaatcacactacaaggacaaacattggtcaggtggagctatatacctttctggaattgacatgatacatggcacacccgtactagacatcaagccctacatagctgagtatgactcaccgcaaaatgtgatggagcctttagcagactttaatttacagaataaccaacatacaccaaacactgtgtcccagtctgacagcaagactgacagctgtgaccagcgacagctctcagggtgtgatgagccacaaccccaccatagcactaagaggaaacctaaatgtcctgaagacagaacttcagaagaaaactacctgacacacagtgacacagccagaattcagcaagcatttcctatgcacag

SEQ ID NO: 195330 - DNA, 2971 bp, Homo sapiens
  Payload ID: 18570
  Gene Name: tRNA methyltransferase O
  ENST ID: ENST00000375118
  CDS Start-End: 1885-2772
attttatcaatttgtaatggctaacaaacttggatagcaagtactagaagattttatgattattcagggacatattttctagcactgaatatgtgccagacattgtcctaggtgctagagctatagtgataaacaaatcagatgaaagtagaaatccatgccctaaagaacttaatgtttcaattgggaaggtcaagtcagataggttaaaaggcaaacacagtagcactgtagacattactatataagctttatggcaactagtgtttgtgcagtgctttacagttagtaaacagtgttcacgtaccttatctcacagtggctttgtgggtttgacaaagtagcaatcctcatctcataggtgaggaaactagggctctttaagattagataatctgtctaatagcatccagccaggtggtcatctgactctaaatcctttgaagtcttacttatgctacagtgcctttctttttcctacagatattgttaggcataattcatcatctagcaagtccagaatcatctttccagagttccagctcattcataataacatgtttcagaaatcagggtcctgtattagttacgtttttcttaaatggagacggaatcaaatgtgactgcatgtagtttttctgttctcatttggcctattttccaagagtaaggttagtagatggctatttgtagcagtaactggacagcatctgtccagtgggacagctggagacttgtctttagtatttggtaatgctgacttatgtgctgcttaatcttttgagtcttgatggatgtattagatttctattgttgtgtaacaaattaccacagaatcatcagtttaaacaacacacatgtattatgtgtttgaaacattattatgtatctgtgggtcagaaggatgggcacagcttaactaggtcatctgcttaggtctcactagactgcaattaaattgtcagctgatatgagttcttatctggaggcttgaccatggaagaatctgcttaagctcactcagactgttggccacattgatttccttgccatcgtagtaggactgggggccccagattcttgctggttgttggctggaggctgccctcagtgtctaaaggctgtttgcagttccttgctatgtgggcttcctagcacgcctgcctacttcagcaagccttcaaggagagtctctcgagtgagtcttccagccagcagcagtgctaatgaaaagcatagtcactggagggacatcatacctcttttgccatattctgttggttagaagccagtcacactcaaggggaaggattatataagggcatgaacttcaggaggtgcgggtcacagggccacttttggatctgtttgccacagtaagaaccttcattggtcccacagagatatactgaggactactatatccctggaacagaagcaccagtgatacaaagatgagttggtcccagcctgtgttaaggggcctgcctgcgtctagggatgaagactctaagcaggtcactaccctaccgtggggaaagcgctctagcagaggtttgtgcacaggcttctctatggggactgtaggaaagaatgcttttgtctggaggagccagaaaggctttgtaaaaggtgtgcttttgagggcctcaaagagcaagtaggagtttgataggtagagaagaggatgggctaccaggtagcaagaagggtgtgtgttggtactaggtctgtgtgagagaattatgagtaagtgcagtgaggcgtaagcagacagtgttagaggattctggggcgtgactgtattctccaagtgtttgcactgttcttcatttttcacgtttttatgtcataggtggagctatatacctttctggaattgacatgatacatggcacacccgtactagacatcaagccctacatagctgagtatgactcaccgcaaaatgtgatggagcctttagcagactttaatttacagaataaccaacatacaccaaacactgtgtcccagtctgacagcaagactgacagctgtgaccagcgacagctctcagggtgtgatgagccacaaccccaccatagcactaagaggaaacctaaatgtcctgaagacagaacttcagaagaaaactacctgacacacagtgacacagccagaattcagcaagcatttcctatgcacagggagatagcagtggattttggtttggaatcaagacgtgatcagagttccagcgtggcagaagaacaaattggcccatattgcccagagaagagcttttcagagaaaggtacagacaagaagctagaaagagtggaaggagcagcagtcttgcaaggaagcagggcagagacacagcccatggcccctcactgccctgctggaagggctgatggagctccccgcagcgtggttcctgcctgggtgacagaggctcctgtggccactttagaagtgcggtttactcctcatgccgagatggaccttgggcagctcagttcacaagatgttggtcaggcgtcatttaaatattttcagtcagcagaggaagcaaagcgtgccattgaggctgtgctgtcagcggatcctcggtctgtgtaccgccggaagctttgccaggaccgccttttctactttactgtagacatagcgcatgtcacttgctggtttggtgatggctttgcagaggtgctgaggatcaagccggcttctgagcctgttcatatgactggccctgtggggtccttggtgtctctagggtcttaaggagcctccctcatgtctttaaggtagcatcattgatctttggatgtggcttttggattttctgaacaagctaatgttgtgtcgagaagcaacactttgtgatctcatggctttgattgatttgggctgttcaaaatgtttatttgaaaaacgtatacattaataaacttaacaaagagatataaaatacagagaaatc

SEQ ID NO: 195331 - DNA, 1647 bp, Homo sapiens
  Payload ID: 18570
  Gene Name: tRNA methyltransferase O
  Uniprot ID: Q9BU70
  ENST ID: ENST00000375119
  CDS Start-End: 78-1403
actgcgcatgcgtcaggcatggagagcggaagcggaaggttgaatgcgtcgggtgggcacctcagcaaccagtagccatgcgcggcttggaggagtcggggcctcggcctacagcgaccccgtgcggctgcgttaagccggctctggagacagggaatcttttaactgagccagtcggctacttggaatcttgtttctcggccaagaatggtactccaagacagccatccatttgtagctattctcgagcctgtttgaggattagaaagaggatctttaataatcctgaacattccttgatgggcctagaacagttttctcatgtttggattttgtttgtttttcacaaaaatggtcatttgagctgtaaggcaaaagtgcagcctcctaggctgaatggtgcaaagactggagttttttccacaaggagccctcatcgtcccaatgcaataggactgaccctggccaagctggaaaaggtagaaggtggagctatatacctttctggaattgacatgatacatggcacacccgtactagacatcaagccctacatagctgagtatgactcaccgcaaaatgtgatggagcctttagcagactttaatttacagaataaccaacatacaccaaacactgtgtcccagtctgacagcaagactgacagctgtgaccagcgacagctctcagggtgtgatgagccacaaccccaccatagcactaagaggaaacctaaatgtcctgaagacagaacttcagaagaaaactacctgacacacagtgacacagccagaattcagcaagcatttcctatgcacagggagatagcagtggattttggtttggaatcaagacgtgatcagagttccagcgtggcagaagaacaaattggcccatattgcccagagaagagcttttcagagaaaggtacagacaagaagctagaaagagtggaaggagcagcagtcttgcaaggaagcagggcagagacacagcccatggcccctcactgccctgctggaagggctgatggagctccccgcagcgtggttcctgcctgggtgacagaggctcctgtggccactttagaagtgcggtttactcctcatgccgagatggaccttgggcagctcagttcacaagatgttggtcaggcgtcatttaaatattttcagtcagcagaggaagcaaagcgtgccattgaggctgtgctgtcagcggatcctcggtctgtgtaccgccggaagctttgccaggaccgccttttctactttactgtagacatagcgcatgtcacttgctggtttggtgatggctttgcagaggtgctgaggatcaagccggcttctgagcctgttcatatgactggccctgtggggtccttggtgtctctagggtcttaaggagcctccctcatgtctttaaggtagcatcattgatctttggatgtggcttttggattttctgaacaagctaatgttgtgtcgagaagcaacactttgtgatctcatggctttgattgatttgggctgttcaaaatgtttatttgaaaaacgtatacattaataaacttaacaaagagatataaaatacagagaaatcaccaaatgctttttgatctgttgatattaaagaatcaaaaggtga

SEQ ID NO: 195332 - DNA, 552 bp, Homo sapiens
  Payload ID: 18570
  Gene Name: tRNA methyltransferase O
  ENST ID: ENST00000455506
  CDS Start-End: 1-519
ggcttggaggagtcggggcctcggcctacagcgaccccgtgcggctgcgttaagccggctctggagacagggaatcttttaactgagccagtcggctacttggaatcttgtttctcggccaagaatggtactccaagacagccatccatttgtagctattctcgagcctgtttgaggattagaaagaggatctttaataatcctgaacattccttgatgggcctagaacagttttctcatgtttggattttgtttgtttttcacaaaaatggtcatttgagctgtaaggcaaaagtgcagcctcctaggctgaatggtgcaaagactggagttttttccacaaggagccctcatcgtcccaatgcaataggactgaccctggccaagctggaaaaggtagaaggtaacccatttcatttctacttttacctttttcctcacccaaaaaagccttataaaataaacagcattcaccactggctgtttattcagacgagtaccaatgatgttaactcctgagaaccaccagacattgaagaaaatacaatgatt

SEQ ID NO: 195333 - DNA, 3635 bp, Homo sapiens
  Payload ID: 18570
  Gene Name: tRNA methyltransferase O
  ENST ID: ENST00000611338
  CDS Start-End: 2439-2996
gggcacctcagcaaccagtagccatgcgcggcttggaggagtcggggcctcggcctacagcgaccccgtgcggctgcgttaagccggctctggagacagggaatcttttaactgagccagtcggctacttggaatcttgtttctcggccaagaatggtactccaagacagccatccatttgtagctattctcgagcctgtttgaggattagaaagaggatctttaataatcctgaacattccttgatgggcctagaacagttttctcatgtttggaaggtctagtcatgccaaatggaaaaagaaaggaaggtctggtaaaggattttgtttgtttttcacaaaaatggtcatttgagctgtaaggcaaaagtgcagcctcctaggctgaatggtgcaaagactggagttttttccacaaggagccctcatcgtcccaatgcaataggactgaccctggccaagctggaaaaggtagaagccttggggaaatggacagatatcatggctgcagtgctgatgtcaactgtgctgtgtggcaggagtctgggatgaatcacactacaaggacaaacattggtcaggttgtagaagttttaaactagttttaactgtgtgttcgtatataacctagttacgcatttatggaaagcattccattctgacctaacagatgcatttgttatagaggcagcagatgaaatggcaggtaaactaggagtcaagagaccattccaggcttcagcctgctggttgtgaagtgggcaaaggagaaggacctgcttcctctgtgattccacagaatattttgagaatcttgtaagagagaagttctaaaactactttttcaggctattggacactaaatagatgagagcagttattttgcttgttctttcccagaacttgaactctcccactggattgtactcaactgggccttaggtagttttctcagaaaaattcagtagctgatccaccttgaattttatcaatttgtaatggctaacaaacttggatagcaagtactagaagattttatgattattcagggacatattttctagcactgaatatgtgccagacattgtcctaggtgctagagctatagtgataaacaaatcagatgaaagtagaaatccatgccctaaagaacttaatgtttcaattgggaaggtcaagtcagataggttaaaaggcaaacacagtagcactgtagacattactatataagctttatggcaactagtgtttgtgcagtgctttacagttagtaaacagtgttcacgtaccttatctcacagtggctttgtgggtttgacaaagtagcaatcctcatctcataggtgaggaaactagggctctttaagattagataatctgtctaatagcatccagccaggtggtcatctgactctaaatcctttgaagtcttacttatgctacagtgcctttctttttcctacagatattgttaggcataattcatcatctagcaagtccagaatcatctttccagagttccagctcattcataataacatgtttcagaaatcagggtcctgtattagttacgtttttcttaaatggagacggaatcaaatgtgactgcatgtagtttttctgttctcatttggcctattttccaagagtaaggttagtagatggctatttgtagcagtaactggacagcatctgtccagtgggacagctggagacttgtctttagtatttggtaatgctgacttatgtgctgcttaatcttttgagtcttgatggatgtattagatttctattgttgtgtaacaaattaccacagaatcatcagtttaaacaacacacatgtattatgtgtttgaaacattattatgtatctgtgggtcagaaggatgggcacagcttaactaggtcatctgcttaggtctcactagactgcaattaaattgtcagctgatatgagttcttatctggaggcttgaccatggaagaatctgcttaagctcactcagactgttggccacattgatttccttgccatcgtagtaggactgggggccccagattcttgctggttgttggctggaggctgccctcagtgtctaaaggctgtttgcagttccttgctatgtgggcttcctagcacgcctgcctacttcagcaagccttcaaggagagtctctcgagtgagtcttccagccagcagcagtgctaatgaaaagcatagtcactggagggacatcatacctcttttgccatattctgttggttagaagccagtcacactcaaggggaaggattatataagggcatgaacttcaggaggtgcgggtcacagggccacttttggatctgtttgccacagtaagaaccttcattggtcccacagagatatactgaggactactatatccctggaacagaagcaccagtgatacaaagatgagttggtcccagcctgtgttaaggggcctgcctgcgtctagggatgaagactctaagcaggtcactaccctaccgtggggaaagcgctctagcagaggtggagctatatacctttctggaattgacatgatacatggcacacccgtactagacatcaagccctacatagctgagtatgactcaccgcaaaatgtgatggagcctttagcagactttaatttacagaataaccaacatacaccaaacactgtgtcccagtctgacagcaagactgacagctgtgaccagcgacagctctcagggtgtgatgagccacaaccccaccatagcactaagaggaaacctaaatgtcctgaagacagaacttcagaagaaaactacctgacacacagtgacacagccagaattcagcaagcatttcctatgcacagggagatagcagtggattttggtttggaatcaagacgtgatcagagttccagcgtggcagaagaacaaattggcccatattgcccagagaagagcttttcagagaaaggtacagacagaagctagaaagagtggaaggagcagcagtcttgcaaggaagcagggcagagacacagcccatggcccctcactgccctgctggaagggctgatggagctccccgcagcgtggttcctgcctgggtgacagaggctcctgtggccactttagaagtgcggtttactcctcatgccgagatggaccttgggcagctcagttcacaagatgttggtcaggcgtcatttaaatattttcagtcagcagaggaagcaaagcgtgccattgaggctgtgctgtcagcggatcctcggtctgtgtaccgccggaagctttgccaggaccgccttttctactttactgtagacatagcgcatgtcacttgctggtttggtgatggctttgcagaggtgctgaggatcaagccggcttctgagcctgttcatatgactggccctgtggggtccttggtgtctctagggtcttaaggagcctccctcatgtctttaaggtagcatcattgatctttggatgtggcttttggattttctgaacaagctaatgttgtgtcgagaagcaacactttgtgatctcatggctttgattgatttgggctgttcaaaatgtttatttgaaaaacgtatacattaataaacttaacaaagagat

SEQ ID NO: 195334 - DNA, 2276 bp, Homo sapiens
  Payload ID: 18571
  Gene Name: tRNA nucleotidyl transferase, CCA-adding, 1
  Uniprot ID: Q96Q11
  ENST ID: ENST00000251607
  CDS Start-End: 103-1407
gttggtgacgtcaccgcgttcaccagcccggaagtgcgcgtggcggcggtggcggctgcggcaacagcggggccgatgtgtagttggtgactgcctctccagatgctgaggtgcctgtatcattggcacaggccagtgctgaaccgtaggtggagtaggctgtgccttccgaagcagtatctattcacaatgaagttgcagtctcccgaattccagtcacttttcacagaaggactgaagagtctgacagaattatttgtcaaagagaatcacgaattaagaatagcaggaggagcagtgagggatttattaaatggagtaaagcctcaggatatagattttgccaccactgctacccctactcaaatgaaggagatgtttcagtcggctgggattcggatgataaacaacagaggagaaaagcacggaacaattactgccaggcttcatgaagaaaattttgagattactacactacggattgatgtcaccactgatggaagacatgctgaggtagaatttacaactgactggcagaaagatgcggaacgcagagatctcactataaattctatgtttttaggttttgatggcactttatttgactactttaatggttatgaagatttaaaaaataagaaagttagatttgttggacatgctaaacagagaatacaagaggattatcttagaattttaagatacttcaggttttatgggagaattgtagacaaacctggtgaccatgatcctgagactttggaagcaattgcagaaaatgcaaaaggcttggctggaatatcaggagaaaggatttgggtggaactgaaaaaaattcttgttggtaaccatgtaaatcatttgattcaccttatctatgatcttgatgtggctccttatataggtttacctgctaatgcaagtttagaagaatttgacaaagtcagtaaaaatgttgatggtttttcaccaaagccagtgactcttttggcctcattattcaaagtacaagatgatgtcacaaaattggatttgaggttgaagatcgcaaaagaggagaaaaaccttggcttatttatagttaaaaataggaaagatttaattaaagcaacagatagttcagacccattgaaaccctatcaagacttcattatagattctagggaacctgatgcaactactcgtgtatgtgaactactgaagtaccaaggagagcactgtctcctaaaggaaatgcagcagtggtccattcctccatttcctgtaagtggccatgacatcagaaaagtgggcatttcttcaggaaaagaaattggggctctattacaacagttgcgagaacagtggaaaaaaagtggttaccaaatggaaaaagatgaacttctgagttacataaagaagacctaaaactgatggctactaaaaagcagagcatttctggtaagactaaattttctcccctccctcttaatgaggttttagagactacaccagaataaaagacagtttaggggacctctgtagaacaacaagggtcttattttgtgaattatatatttcaagaactaaacagagatccacctttctggatctgatttatatcactgaaatgtacagttcttttggaatagtttcacctgagaaaacatagttggctattatctatcttaacctgttcaggcttttaaaaaaaactgtttttgcatagggtagtactaagatcttaaaaagtggtaactgtcttgaagaaaaaacgtttattgtttgtttgcaattgaaataacagggttaccttaacaatgactgtctatgatgtgtcagttcttatctgaattccaaaataaacctgtgcttaaaaaagaaataattgaccaagtaagtttgcataaaatgtgaatactaaatgtgtccccagttgctggcattcatatgtacaggatttgttctagcaagctatgcttcagtatgtggttgatatttttctgtcacaatgatttctttatgcatgcagagcctggggaagtcatgggattaacttgagggtcactattgagcctattaattaattattgttttaataaaacaaacattggtattggaagataaatatgtttatgtggtatctgacaatgtgtattaggtgtcatatacaatggtaatatgcctgtctttaaagtgttattttattaattaaaaggatatggctattattatatattctctaaagatttgagtcctaaatgctttcatcaggtaaataaaatgtataatacaaa

SEQ ID NO: 195335 - DNA, 2180 bp, Homo sapiens
  Payload ID: 18571
  Gene Name: tRNA nucleotidyl transferase, CCA-adding, 1
  Uniprot ID: Q96Q11
  ENST ID: ENST00000280591
  CDS Start-End: 67-1311
cgcgtggcggcggtggcggctgcggcaacagcggggccgatgtgtagttggtgactgcctctccagatgctgaggtgcctgtatcattggcacaggccagtgctgaaccgtaggtggagtaggctgtgccttccgaagcagtatctattcacaatgaagttgcagtctcccgaattccagtcacttttcacagaaggactgaagagtctgacagaattatttgtcaaagagaatcacgaattaagaatagcaggaggagcagtgagggatttattaaatggagtaaagcctcaggatatagattttgccaccactgctacccctactcaaatgaaggagatgtttcagtcggctgggattcggatgataaacaacagaggagaaaagcacggaacaattactgccaggcttcatgaagaaaattttgagattactacactacggattgatgtcaccactgatggaagacatgctgaggtagaatttacaactgactggcagaaagatgcggaacgcagagatctcactataaattctatgtttttaggttttgatggcactttatttgactactttaatggttatgaagatttaaaaaataagaaagttagatttgttggacatgctaaacagagaatacaagaggattatcttagaattttaagatacttcaggttttatgggagaattgtagacaaacctggtgaccatgatcctgagactttggaagcaattgcagaaaatgcaaaaggcttggctggaatatcaggagaaaggatttgggtggaactgaaaaaaattcttgttggtttacctgctaatgcaagtttagaagaatttgacaaagtcagtaaaaatgttgatggtttttcaccaaagccagtgactcttttggcctcattattcaaagtacaagatgatgtcacaaaattggatttgaggttgaagatcgcaaaagaggagaaaaaccttggcttatttatagttaaaaataggaaagatttaattaaagcaacagatagttcagacccattgaaaccctatcaagacttcattatagattctagggaacctgatgcaactactcgtgtatgtgaactactgaagtaccaaggagagcactgtctcctaaaggaaatgcagcagtggtccattcctccatttcctgtaagtggccatgacatcagaaaagtgggcatttcttcaggaaaagaaattggggctctattacaacagttgcgagaacagtggaaaaaaagtggttaccaaatggaaaaagatgaacttctgagttacataaagaagacctaaaactgatggctactaaaaagcagagcatttctggtaagactaaattttctcccctccctcttaatgaggttttagagactacaccagaataaaagacagtttaggggacctctgtagaacaacaagggtcttattttgtgaattatatatttcaagaactaaacagagatccacctttctggatctgatttatatcactgaaatgtacagttcttttggaatagtttcacctgagaaaacatagttggctattatctatcttaacctgttcaggcttttaaaaaaaactgtttttgcatagggtagtactaagatcttaaaaagtggtaactgtcttgaagaaaaaacgtttattgtttgtttgcaattgaaataacagggttaccttaacaatgactgtctatgatgtgtcagttcttatctgaattccaaaataaacctgtgcttaaaaaagaaataattgaccaagtaagtttgcataaaatgtgaatactaaatgtgtccccagttgctggcattcatatgtacaggatttgttctagcaagctatgcttcagtatgtggttgatatttttctgtcacaatgatttctttatgcatgcagagcctggggaagtcatgggattaacttgagggtcactattgagcctattaattaattattgttttaataaaacaaacattggtattggaagataaatatgtttatgtggtatctgacaatgtgtattaggtgtcatatacaatggtaatatgcctgtctttaaagtgttattttattaattaaaaggatatggctattattatatattctctaaagatttgagtcctaaatgctttcatcaggtaaataaaatgtataatacaaa

SEQ ID NO: 195336 - DNA, 976 bp, Homo sapiens
  Payload ID: 18571
  Gene Name: tRNA nucleotidyl transferase, CCA-adding, 1
  Uniprot ID: Q96Q11
  ENST ID: ENST00000339437
  CDS Start-End: 68-241
gcgcgtggcggcggtggcggctgcggcaacagcggggccgatgtgtagttggtgactgcctctccagatgctgaggtgcctgtatcattggcacaggccagtgctgaaccgtaggtggagtaggctgtgccttccgaagcagtatctattcacaatgaagttgcagtctcccgaattccagtcacttttcacagaaggactgaagagtctgacaggtataaatgctttccatgagaactgaaggaagaaggaaataggagttgcctccattgtgcacgttgcaaaacctgtctggaaggagcataggaaatggctttagctaagtgccagtagcttcttgctgttgccacagtttcattagtgttgattctcaatgttgtctgctgatgttgctaaagcagccacacagtagcattacaaagcctgtgggaattttaatagcaccttcataaatatatttagtagtatatgtagaaatatgacctatacagcactggctatctattagattcacctggggagcttttaaagcacacatgctcgggttctacctgcagcctactgaattagaatctctgggtgggatgaccatctatatttttaataaaagctccacaagttaattctgatgcacagaagatagacgaaccattactttaacatgactcaccttgtattagcttattctcaaagctactttcccattcttgaaattggatgatggctttttaggtacgtgccagagataaatggcccagaatatgttgattcttttagattgttttaggcagactttaagtagagggcttaaatgcatgtttggttttgccgatgcttcactatcttttttaattggagagagtgaaaattgctaaaaattgctgtccaatagaaatttatgagcccatatgtaatataaacttttttactaaccacattaaaaagatagaaatggtgaaataaattttaataatta

SEQ ID NO: 195337 - DNA, 374 bp, Homo sapiens
  Payload ID: 18571
  Gene Name: tRNA nucleotidyl transferase, CCA-adding, 1
  ENST ID: ENST00000397779
  CDS Start-End: 2-199
gatgctgaggtgcctgtatcattggcacaggccagtgctgaaccgtaggtggagtaggctgtgccttccgaagcagtatctattcacaatgaagttgcagtctcccgaattccagtcacttttcacagaaggactgaagagtctgacagataaggtcttgctctgtcacccaggctggagtgcagtggcacgatcatagctcaccgcagccttgaactcctgggctcaagccatcctcccacctcagcctcccaagtagctgggactacagaattatttgtcaaagagaatcacgaattaagaatagcaggaggagcagtgagggatttattaaatggagtaaagcctcaggatatagattttgccaccactgc

SEQ ID NO: 195338 - DNA, 1935 bp, Homo sapiens
  Payload ID: 18571
  Gene Name: tRNA nucleotidyl transferase, CCA-adding, 1
  Uniprot ID: Q96Q11
  ENST ID: ENST00000402675
  CDS Start-End: 1027-1200
agagttggtggcgtgagttgctgccccttccttcctgctgtgggccagaggcgccaccgcgcccggtcctcgaggaagacgggagcgggacgtggcgagaggcctcctcagcagtgggcaaaatagccccgacgcggaggtcgtgtccccgccacgtttccggcgaccgcaggcgcggattccttggcttccctcagcactttcccctccgcgcggacggccccgagacgctttttcactgggccttgtcgccagcacccggcgtggggggtgagacgcgccttttcagggctggggttccccagagcgttttcctaagtcgaggcggaggtgcgaggaaactgagtgggtctttccgccccacgtggcctgccgggaagcgcggctcctccacccgcttccgtggaatggaatggtttttctctgcaggtttacaccggggtcactcgagagctgctgcggcctccttatgggcaggacccccgtatggggagaacgaggatgtgatatgtagaagggaaggccgcggtgtgccagaaatcagaggagattgcaagatggcaggaaaagaatcaggaaaatgggggcagcaaaactaaattcatgggaaaatacaatgtctaggagctatcccagggtcgtgaatcctcgagtgcaggtggggaagtagggtgatacccacctgtgaccatgacaagttttggagaccagaaactcggttagagtttctagaaccccgcatccctctcatactgcctgaagccctgctctggggagagtgtcatcacagtaccatgtggcatgcgagtgtcgtggtaatgctccccgaccaaaccaccaaaccgagggttgggctgcttattctcgctgcccaataatgagatgcagataaactaggaaagaaaggagtttatttctgtaaccaggtacggggcgaaggcgtggaaaatatcccagaccgactcagaattacagagctttccagagcttatataccttatgtgtagttggtgactgcctctccagatgctgaggtgcctgtatcattggcacaggccagtgctgaaccgtaggtggagtaggctgtgccttccgaagcagtatctattcacaatgaagttgcagtctcccgaattccagtcacttttcacagaaggactgaagagtctgacaggtataaatgctttccatgagaactgaaggaagaaggaaataggagttgcctccattgtgcacgttgcaaaacctgtctggaaggagcataggaaatggctttagctaagtgccagtagcttcttgctgttgccacagtttcattagtgttgattctcaatgttgtctgctgatgttgctaaagcagccacacagtagcattacaaagcctgtgggaattttaatagcaccttcataaatatatttagtagtatatgtagaaatatgacctatacagcactggctatctattagattcacctggggagcttttaaagcacacatgctcgggttctacctgcagcctactgaattagaatctctgggtgggatgaccatctatatttttaataaaagctccacaagttaattctgatgcacagaagatagacgaaccattactttaacatgactcaccttgtattagcttattctcaaagctactttcccattcttgaaattggatgatggctttttaggtacgtgccagagataaatggcccagaatatgttgattcttttagattgttttaggcagactttaagtagagggcttaaatgcatgtttggttttgccgatgcttcactatcttttttaattggagagagtgaaaattgctaaaaattgctgtccaatagaaatttatgagcccatatgtaatataaacttttttactaaccacattaaaaagatagaaatggtgaaataaattttaataatta

SEQ ID NO: 195339 - DNA, 483 bp, Homo sapiens
  Payload ID: 18571
  Gene Name: tRNA nucleotidyl transferase, CCA-adding, 1
  ENST ID: ENST00000413000
  CDS Start-End: 298-483
agagttggtggcgtgagttgctgccccttccttcctgctgtgggccagaggcgccaccgcgcccggtcctcgaggaagacgggagcgggacgtggcgagaggcctcctcagcagtgggcaaaatagccccgacgcggaggtcgtgtccccgccacgtttccggcgaccgcaggcgcggattccttggcttccctcagcactttcccctccgcgcggacggccccgagacgctttttcactgggccttgtcgccagcacccggcgtgggggatgtgtagttggtgactgcctctccagatgctgaggtgcctgtatcattggcacaggccagtgctgaaccgtaggtggagtaggctgtgccttccgaagcagtatctattcacaatgaagttgcagtctcccgaattccagtcacttttcacagaaggactgaagagtctgacagaattatttgtcaaagagaatcacgaattaagaatagca

SEQ ID NO: 195340 - DNA, 854 bp, Homo sapiens
  Payload ID: 18571
  Gene Name: tRNA nucleotidyl transferase, CCA-adding, 1
  Uniprot ID: Q96Q11
  ENST ID: ENST00000420393
  CDS Start-End: 411-584
cagcggggccggtaagcgggcgcgcgccgctcagaggggcagagttggtggcgtgagttgctgccccttccttcctgctgtgggccagaggcgccaccgcgcccggtcctcgaggaagacgggagcgggacgtggcgagaggcctcctcagcagtgggcaaaatagccccgacgcggaggtcgtgtccccgccacgtttccggcgaccgcaggcgcggattccttggcttccctcagcactttcccctccgcgcggacggccccgagacgctttttcactgggccttgtcgccagcacccggcgtggggggtacggggcgaaggcgtggaaaatatcccagaccgactcagaattacagagctttccagagcttatataccttatgtgtagttggtgactgcctctccagatgctgaggtgcctgtatcattggcacaggccagtgctgaaccgtaggtggagtaggctgtgccttccgaagcagtatctattcacaatgaagttgcagtctcccgaattccagtcacttttcacagaaggactgaagagtctgacaggtataaatgctttccatgagaactgaaggaagaaggaaataggagttgcctccattgtgcacgttgcaaaacctgtctggaaggagcataggaaatggctttagctaagtgccagtagcttcttgctgttgccacagtttcattagtgttgattctcaatgttgtctgctgatgttgctaaagcagccacacagtagcattacaaagcctgtgggaattttaatagcaccttcataaatatatttagtagtatatgtagaaatatgacctatacagcactggctatctattagatt

SEQ ID NO: 195341 - DNA, 1871 bp, Homo sapiens
  Payload ID: 18571
  Gene Name: tRNA nucleotidyl transferase, CCA-adding, 1
  Uniprot ID: Q96Q11
  ENST ID: ENST00000434583
  CDS Start-End: 54-1358
tggcggctgcggcaacagcggggccgatgtgtagttggtgactgcctctccagatgctgaggtgcctgtatcattggcacaggccagtgctgaaccgtaggtggagtaggctgtgccttccgaagcagtatctattcacaatgaagttgcagtctcccgaattccagtcacttttcacagaaggactgaagagtctgacagaattatttgtcaaagagaatcacgaattaagaatagcaggaggagcagtgagggatttattaaatggagtaaagcctcaggatatagattttgccaccactgctacccctactcaaatgaaggagatgtttcagtcggctgggattcggatgataaacaacagaggagaaaagcacggaacaattactgccaggcttcatgaagaaaattttgagattactacactacggattgatgtcaccactgatggaagacatgctgaggtagaatttacaactgactggcagaaagatgcggaacgcagagatctcactataaattctatgtttttaggttttgatggcactttatttgactactttaatggttatgaagatttaaaaaataagaaagttagatttgttggacatgctaaacagagaatacaagaggattatcttagaattttaagatacttcaggttttatgggagaattgtagacaaacctggtgaccatgatcctgagactttggaagcaattgcagaaaatgcaaaaggcttggctggaatatcaggagaaaggatttgggtggaactgaaaaaaattcttgttggtaaccatgtaaatcatttgattcaccttatctatgatcttgatgtggctccttatataggtttacctgctaatgcaagtttagaagaatttgacaaagtcagtaaaaatgttgatggtttttcaccaaagccagtgactcttttggcctcattattcaaagtacaagatgatgtcacaaaattggatttgaggttgaagatcgcaaaagaggagaaaaaccttggcttatttatagttaaaaataggaaagatttaattaaagcaacagatagttcagacccattgaaaccctatcaagacttcattatagattctagggaacctgatgcaactactcgtgtatgtgaactactgaagtaccaaggagagcactgtctcctaaaggaaatgcagcagtggtccattcctccatttcctgtaagtggccatgacatcagaaaagtgggcatttcttcaggaaaagaaattggggctctattacaacagttgcgagaacagtggaaaaaaagtggttaccaaatggaaaaagatgaacttctgagttacataaagaagacctaaaactgatggctactaaaaagcagagcatttctgccagtcataacatctttgtactctatgagcaaatagtaattttggaccttgataaaacaattttgtagagtgtaatatttctaagaggaaatgtcacaggggctatgatgcaagaaagcctcagaaatgactgcatacaggaaataatctcatcatttccaaagatgtcttcatgtcccatcaatgacatgctaccagacatatcagattccacaggataatggcaccaagctacccaagtagatgtttctggtattctagactgccgttcatgcttgtttcctaaagtatacttaaaagtttcaaatacagtttcacttagaaactgcaaccctccaagtaatgttatgtttacttaggtattaatgttatgtttacttaggtatgtatcagaggcaataatttccaaagcagatcttagaatataaccaatttgttagataactttatctctatcacatctgtttacaagcaaagtat

SEQ ID NO: 195342 - DNA, 962 bp, Homo sapiens
  Payload ID: 18572
  Gene Name: tRNA phosphotransferase 1
  Uniprot ID: Q86TN4
  ENST ID: ENST00000317459
  CDS Start-End: 170-931
gcggtcgaggatcctggaggtttgtccccgccgccccgacgcttccgcccggtccgtcggcacgtcggccctgcctcccggaccaccctgcggggcgcaccagcgatctggggtgcggggctcggcctccctgcgctcctggctgaccgtgtgaccttgggtcttaaccatgaacttctctggaggagggaggcaggaagcagcagggtccaggggtagaagggctcccagaccccgagaacaggaccgagacgtgcagctgtccaaggctctgtcctatgccctgcgccatggggccttgaagctggggcttcccatgggagctgatggcttcgtgcccctgggcaccctcctgcagttgccccagttccgcggcttctctgctgaagatgtgcagcgcgtggtggacaccaataggaagcagcggttcgccctgcagctgggggatcccagcactggccttctcatccgggccaaccagggccattccctgcaggtacctaagttggagctgatgcccctggagacaccgcaggccctgcccccgatgctagtccatggtacattctggaagcactggccatccatcctactcaaaggcctgtcctgccagggaaggacgcacattcacctggccccaggactgcctggagaccccggtatcatcagtggcatgcggtcccattgtgaaatagctgtgttcatcgatggacccctggctctggcagatggaatacccttcttccgctctgccaatggggtgattctgactccagggaatactgatggcttcctccttcccaagtacttcaaggaggccctgcagctacgccctacccgaaagcccctttccttggctggtgatgaagagacagagtgtcagagtagccccaagcacagctccagagaaaggaggaggatccaacaataaaatattaatttataaaaaagaaattttaaaa

SEQ ID NO: 195343 - DNA, 1058 bp, Homo sapiens
  Payload ID: 18572
  Gene Name: tRNA phosphotransferase 1
  Uniprot ID: Q86TN4
  ENST ID: ENST00000394546
  CDS Start-End: 215-982
agtgcccgccccctttccacgcggcttttcattggcgggtccgccgcggtcgaggatcctggaggtttgtccccgccgccccgacgcttccgcccggtccgtcggcacgtcggccctgcctcccggaccaccctgcggggcgcaccagcgatctggggtgcggggctcggcctccctgcgctcctggctgaccgtgtgaccttgggtcttaaccatgaacttctctggaggagggaggcaggaagcagcagggtccaggggtagaagggctcccagaccccgagaacaggaccgagacgtgcagctgtccaaggctctgtcctatgccctgcgccatggggccttgaagctggggcttcccatgggagctgatggcttcgtgcccctgggcaccctcctgcagttgccccagttccgcggcttctctgctgaagatgtgcagcgcgtggtggacaccaataggaagcagcggttcgccctgcagctgggggatcccagcactggccttctcatccgggccaaccagggccattccctgcaggtcggggtacctaagttggagctgatgcccctggagacaccgcaggccctgcccccgatgctagtccatggtacattctggaagcactggccatccatcctactcaaaggcctgtcctgccagggaaggacgcacattcacctggccccaggactgcctggagaccccggtatcatcagtggcatgcggtcccattgtgaaatagctgtgttcatcgatggacccctggctctggcagatggaatacccttcttccgctctgccaatggggtgattctgactccagggaatactgatggcttcctccttcccaagtacttcaaggaggccctgcagctacgccctacccgaaagcccctttccttggctggtgatgaagagacagagtgtcagagtagccccaagcacagctccagagaaaggaggaggatccaacaataaaatattaatttataaaaaagaaattttaaaaagtaacaagaaagaactcgtttgaaaccatgtttcatcatcctgt

SEQ ID NO: 195344 - DNA, 865 bp, Homo sapiens
  Payload ID: 18572
  Gene Name: tRNA phosphotransferase 1
  Uniprot ID: Q86TN4
  ENST ID: ENST00000394547
  CDS Start-End: 174-788
gcacgtcggccctgcctcccggaccaccctgcggggcgcaccagcgatctggggtgcggggctcggcctccctgcgctcctggctgaccgtgtgaccttgggaccgagacgtgcagctgtccaaggctctgtcctatgccctgcgccatggggccttgaagctggggcttcccatgggagctgatggcttcgtgcccctgggcaccctcctgcagttgccccagttccgcggcttctctgctgaagatgtgcagcgcgtggtggacaccaataggaagcagcggttcgccctgcagctgggggatcccagcactggccttctcatccgggccaaccagggccattccctgcaggtacctaagttggagctgatgcccctggagacaccgcaggccctgcccccgatgctagtccatggtacattctggaagcactggccatccatcctactcaaaggcctgtcctgccagggaaggacgcacattcacctggccccaggactgcctggagaccccggtatcatcagtggcatgcggtcccattgtgaaatagctgtgttcatcgatggacccctggctctggcagatggaatacccttcttccgctctgccaatggggtgattctgactccagggaatactgatggcttcctccttcccaagtacttcaaggaggccctgcagctacgccctacccgaaagcccctttccttggctggtgatgaagagacagagtgtcagagtagccccaagcacagctccagagaaaggaggaggatccaacaataaaatattaatttataaaaaagaaattttaaaaagtaacaagaaagaactcgtttgaaaccatgtttcatcatcctgta

SEQ ID NO: 195345 - DNA, 684 bp, Homo sapiens
  Payload ID: 18572
  Gene Name: tRNA phosphotransferase 1
  ENST ID: ENST00000546089
  CDS Start-End: 158-661
ggtcttaaccatgaacttctctggaggagggaggcaggaagcagcagggtccaggggtagaagggctcccagaccccgagaacaggaccgagacgtgcagctgtccaaggctctgtcctatgccctgcgccatggggccttgaagctggggcttcccatgggagctgatggcttcgtgcccctgggcaccctcctgcagttgccccagttccgcggcttctctgctgaagatgtgcagcgcgtggtggacaccaataggaagcagcggttcgccctgcagctgggggatcccagcactggccttctcatccgggccaaccagggccattccctgcaggtacctaagttggagctgatgcccctggagacaccgcaggccctgcccccgatgctagtccatggtacattctggaagcactggccatccatcctactcaaaggcctgtcctgccagggaaggacgcacattcacctggccccaggactgcctggagaccccggtatcatcagtggcatgcggtcccattgtgaaatagctgtgttcatcgatggacccctggctctggcaggaaagcccctttccttggctggtgatgaagagacagagtgtcagagtagccccaagcacagctccagagaaaggaggaggatccaacaataaaatattaatttataaaaaagaaa

SEQ ID NO: 195346 - DNA, 941 bp, Homo sapiens
  Payload ID: 18572
  Gene Name: tRNA phosphotransferase 1
  Uniprot ID: Q86TN4
  ENST ID: ENST00000541278
  CDS Start-End: 215-865
agtgcccgccccctttccacgcggcttttcattggcgggtccgccgcggtcgaggatcctggaggtttgtccccgccgccccgacgcttccgcccggtccgtcggcacgtcggccctgcctcccggaccaccctgcggggcgcaccagcgatctggggtgcggggctcggcctccctgcgctcctggctgaccgtgtgaccttgggtcttaaccatgaacttctctggaggagggaggcaggaagcagcagggtccaggggtagaagggctcccagaccccgagaacaggaccgagacgtgcagctgtccaaggctctgtcctatgccctgcgccatggggccttgaagctggggcttcccatgggagctgatggcttcgtgcccctgggcaccctcctgcagttgccccagttccgcggcttctctgctgaagatgtgcagcgcgtggtggacaccaataggaagcagcggttcgccctgcagctgggggatcccagcactggccttctcatccgggccaaccagggccattccctgcaggtacctaagttggagctgatgcccctggagacaccgcaggccctgcccccgatgctagtccatggtacattctggaagcactggccatccatcctactcaaaggcctgtcctgccagggaaggacgcacattcacctggccccaggactgcctggagaccccggtatcatcagtggcatgcggtcccattgtgaaatagctgtgttcatcgatggacccctggctctggcaggaaagcccctttccttggctggtgatgaagagacagagtgtcagagtagccccaagcacagctccagagaaaggaggaggatccaacaataaaatattaatttataaaaaagaaattttaaaaagtaacaagaaagaactcgtttgaaaccatgtttcatcatcctgt

SEQ ID NO: 195347 - DNA, 382 bp, Homo sapiens
  Payload ID: 18572
  Gene Name: tRNA phosphotransferase 1
  ENST ID: ENST00000546133
  CDS Start-End: 1-336
atgctagtccatggtacattctggaagcactggccatccatcctactcaaaggcctgtcctgccagggaaggacgcacattcacctggccccaggactgcctggagaccccggtatcatcagtggcatgcggtcccattgtgaaatagctgtgttcatcgatggacccctggctctggcagggaatactgatggcttcctccttcccaagtacttcaaggaggccctgcagctacgccctacccgaaagcccctttccttggctggtgatgaagagacagagtgtcagagtagccccaagcacagctccagagaaaggaggaggatccaacaataaaatattaatttataaaaaagaaattttaaaaagtaacaagaaagaa

SEQ ID NO: 195348 - DNA, 681 bp, Homo sapiens
  Payload ID: 18572
  Gene Name: tRNA phosphotransferase 1
  ENST ID: ENST00000545812
  CDS Start-End: 109-681
acgtcggccctgcctcccggaccaccctgcggggcgcaccagcgatctggggtgcggggctcggcctccctgcgctcctggctgaccgtgtgaccttgggtcttaaccatgaacttctctggaggagggaggcaggaagcagcagggtccaggggtagaagggctcccagaccccgagaacaggaccgagacgtgcagctgtccaaggctctgtcctatgccctgcgccatggggccttgaagctggggcttcccatgggagctgatggcttcgtgcccctgggcaccctcctgcagttgccccagttccgcggcttctctgctgaagatgtgcagcgcgtggtggacaccaataggaagcagcggttcgccctgcagctgggggatcccagcactggccttctcatccgggccaaccagggccattccctgcaggtcggggtacctaagttggagctgatgcccctggagacaccgcaggccctgcccccgatgctagtccatggtacattctggaagcactggccatccatcctactcaaaggcctgtcctgccagggaaggacgcacattcacctggccccaggactgcctggagaccccggtatcatcagtggcatgcggtcccattgtgaaatagctgtgttcatcgatggacccctggctctggcagatggaata

SEQ ID NO: 195349 - DNA, 527 bp, Homo sapiens
  Payload ID: 18572
  Gene Name: tRNA phosphotransferase 1
  ENST ID: ENST00000544286
  CDS Start-End: 1-346
gccatccatcctactcaaaggcctgtcctgccagggaaggacgcacattcacctggccccaggactgcctggagaccccggtatcatcagtggcatgcggtcccattgtgaaatagctgtgttcatcgatggacccctggctctggcagatggaatacccttcttccgctctgccaatggggtgattctgactccagggaatactgatggcttcctccttcccaagtacttcaaggaggccctgcagctacgccctacccgtgagaaccaccaccccagcccctattccttgttcctgaaagctgtgcccttctgccctcacctctctcctagcttccaaccctagactgacttaggtgtccctttctctaaccaactcttgtctttatcaggaaagcccctttccttggctggtgatgaagagacagagtgtcagagtagccccaagcacagctccagagaaaggaggaggatccaacaataaaatattaatttataaaaaagaaattttaaaaagtaacaagaaa

SEQ ID NO: 195350 - DNA, 1799 bp, Homo sapiens
  Payload ID: 18573
  Gene Name: tRNA selenocysteine 1 associated protein 1
  Uniprot ID: Q9NX07
  ENST ID: ENST00000373830
  CDS Start-End: 27-890
gcaaagccccaccccggtgcgcgggtatggcggccagcctgtggatgggcgacctggaaccctacatggatgagaacttcatctccagagcctttgccaccatgggggagaccgtaatgagcgtcaaaattatccgaaaccgcctcactgggatcccagctggctactgctttgtagaatttgcagatttggccacagctgagaagtgtttgcataaaattaatgggaaaccccttccaggagccacacctgcgaaacgttttaaactgaactatgccacttacgggaaacaaccagataacagccctgagtattccctctttgtgggggacctgaccccggacgtggatgatggcatgctgtatgaattcttcgtcaaagtctacccctcctgtcggggaggcaaggtggttttggaccagacaggcgtgtctaagggttatggttttgtgaaattcacagatgaactggaacagaagcgagccctgacggagtgccagggagcagtgggactggggtctaagcctgtgcggctgagcgtggcaatccctaaagcgagccgtgtaaagccagtggaatatagtcagatgtacagttatagctacaaccagtattatcagcagtaccagaactactatgctcagtggggctatgaccagaacacaggcagctacagctacagttacccccagtatggctatacccagagcaccatgcagacatatgaagaagttggagatgatgcattggaagaccccatgccacagctggatgtgactgaggccaacaaggagttcatggaacagagtgaggagctgtatgacgctctgatggactgtcactggcagcccctggacacagtgtcttcagagatccctgccatgatgtagccaggccaaaggacaagccaggttgcatgatgtgagggagatgagagactcctttttaaaaattgtgaaacctttttggaaatatgatttgtaagattttaataatgactgtttttggagatcatgaatgtttctacaacactgctgcattcatttgaccatttgagtttgaagaccaagggaacaacttttaaacaaggttcaaattggtttccttcacaggaatcctttgtccaggtagttatccacataggacagtttgggattatccaaaactgggatgagcagcttgggataattcacacactaaagcctgagttcaaggtttctcagttgacaggtaggtatgtaaatcagggttctctggagtatttgtaggacctgccatatttgagtcctaacttggtgcaagtctggcagctaggtagaaaaggcactctagcaggtgtggtaggagcacgccccagaaggtagaatgtggtggggtgtgatggaacaggccagttggcctaagaattagtacttgctctaataatgggtttcatctattttcatgagttgcagcatctgcatatacaaggcctggatcactttaggatcaatattttgacacgggagaaggcagctcagaaaggattaaggaagatagctcaaagccaaagcagaccctccgtgtgaactttatactgctcacttccgtgtttcccaagtaaatggggaaactgtccaaccttgtcatgtgttgggacttactgcttgaggcaaagcattcatcctacatcataaaaaatctccaaagatctctttaagggctgggcatggtggctcactttgggagatggattgcttgagctcgggaagagaccagttcggtctctacaaaaaaatacaaacacaaatatactttta

SEQ ID NO: 195351 - DNA, 3107 bp, Homo sapiens
  Payload ID: 18574
  Gene Name: tRNA-histidine guanylyltransferase 1-like
  Uniprot ID: Q9NWX6
  ENST ID: ENST00000231198
  CDS Start-End: 245-1141
aagaccagcagataaaaaataatttttaaaaacctcgtgagactgatttgccgcaggacgggaggaggaagaagcaagcgtggaaggtgctaacggaggaacctaaacctccatcctctttgcctgggaggttaagaactacagggagaggcgagagagactatgactgccctacggctagagtagccgcgaagagaacacttccggggcggggctatctggccctttcctttccgcgtgtagaatgtggggcgcctgtaaagttaaggttcacgattccttggccaccatttccatcactctgagacggtacctgagattgggggcgaccatggcaaaaagcaagttcgagtacgtgagggacttcgaggctgacgacacctgcctggcacactgctgggtggtagtgcggctggacggccggaatttccatcggtttgctgagaagcacaactttgcaaaacccaatgacagccgtgctctccagctgatgaccaaatgtgcgcagactgtgatggaagaactagaggatattgtgatcgcgtatggacagagtgatgagtacagctttgtgttcaagcggaaaaccaattggtttaaaagaagagccagtaagttcatgactcacgtggcctcccagtttgcctccagctatgtgttttattggcgggattactttgaggaccagccccttctgtatcccccaggctttgacggaagagtcgtggtgtatcccagcaaccagactttaaaggactacctcagctggcgacaagcagattgtcacatcaataatctttataatacagttttctgggcacttatacaacaatctggactaacaccagtacaagcccaagggagattacagggaactcttgcagcagacaagaatgagattttgttttctgaattcaacatcaactataataatgagctgccgatgtataggaaagggactgtgttgatatggcagaaggtggatgaagtgatgacaaaagaaattaagctgccaacagaaatggaaggaaaaaagatggcagtgacccggaccaggacaaagccagtgcccttgcactgcgatatcatcggggatgctttctggaaggaacatccagagattctagatgaagacagctgacccttttgcgcttcagttctggtgtgcttaaccatgcaagccctcccacctcccagggctccttgccttaggtggctgtagcatccctaccacccaggacactggtgcgaatgacacaactcaagttgggaggggaacagggaaggaagggatggatgggggtggtgtatcttactctgtttaagcagaacaccttgtttgcggtgttggaacatggttcctttggcagaagtgctttttttttaatcgcagtactatttttataaagcaagaactattccatgccttggagaatgaatcatttttagattgtgacataaatcttgtaaaaacctgtcagttattttcatctatgagagaagaggagcccaaactctcgcccacctgttcttaaccagaaaacccactgactttgaaaatctcacctctgccacccatctacttgcattcgtctttggcagacctcaagataaatatgggttaatgcctgcatgatgcctctgaattcaggaattgcagggaaaactcggggctttgtgccagtctctaagttggcaactttggctgaacaaatgagtagtggcttcagtgtccttgcgtacacattctgtggattgatttaatggagttgtcagcatgatcatcatcttctagccaggggcatagttgccaaggccatttacctctttctaagaagaaacagaattatgtgtatatatgagagaaagaaacaagaatgcgtgaatgaggatgaagaaacatttaccccatgtactcaagacatttcagttttaaaagtcactttcctattagacttcttgaaaaacattctcacatagcctctatgtaatcagacaaatgacatttgatttcaagagcagaggggtaaacatcctctgctaatcgacaggtagcaggtgtcagaggaggcataatattaatagcgccaccttctgttgggtcagtggagatgggtgaggaacagcacagagcagcagggatcatcacatgcagccaaacttggcctctgaagggggaaggtagtgggaataggtggtgagagaactcacatttttctcttgtcctggttttatatttcggagggaaaggattatttggccccattaagaattaagaggctgggtgcggtggctcacgtctgtaatcccagcaccttgggaggcccaggcaggcagatcacctgaggtcgggagttcgagaccagcgtgaccaacgtggagaaacccccgtctctactaaaaatacaaaaaattagctgggcatggtggtgcatgcctgtgattccagctacttgggaggttgaggcaggagaatcatttgaactcaggaggcggaagttgcggtgagccaagattgtgccattgcactccagcctgggcaacgagcgaaactacatctcaaaaaaaaaaaaaaaagacatggctgggcatggtggctcacacctgtaatcccagcactttggggggctgaggcaggtagatcacttcaggccaggagtccaagaccagcacgtccaacatggcaaaacccagtctgtactaaaaatagaaaaattagctgggcgtggtggcgtgtgcctgcaataccagctactcagaaggctgaagcaggataattgcttgaacctggtaggtggaggttgcagtgagctgaaatcatgccactgcactccagcctgggtgacagagcaaaactgccttaaaaaaaaaaattaagagacagcccgtgtcccagtccctcgtcttgcactgcagaatttacatctaagaagaaaatgtatttttgaaagggtgatggctggcctcatccctcactaattgacaacccatctgtcgatgccattttttcccttcctgttctcactccacagaaagaggagatacggttcttgtttggtaattgctaaaatctctttgaggaaagaaataaagatgtcaactccttt

SEQ ID NO: 195352 - DNA, 919 bp, Homo sapiens
  Payload ID: 18574
  Gene Name: tRNA-histidine guanylyltransferase 1-like
  ENST ID: ENST00000521655
  CDS Start-End: 22-396
cctttcctttccgcgtgtagaatgtggggcgcctgtaaagttaaggttcacgattccttggccaccatttccatcactctgagacggtacctgagattgggggcgaccatggcaaaaagcaagttcgagtacgtgagggacttcgaggctgacgacacctgcctggcacactgctgggtggtagtgcggctggacggccggaatttccatcggtttgctgagaagcacaactttgcaaaacccaatgacagccgtgctctccagctgatgaccaaatgtgcgcagactgtgatggaagaactagaggatattgtgatcgcgtatggacagagtgatgagtacagctttgtgttcaagcggaaaaccaattggtttaaaagaagagccaggctttgacggaagagtcgtggtgtatcccagcaaccagactttaaaggactacctcagctggcgacaagcagattgtcacatcaataatctttataatacagttttctgggcacttatacaacaatctggactaacaccagtacaagcccaagggagattacagggaactcttgcagcagacaagaatgagattttgttttctgaattcaacatcaactataataatgagctgccgatgtataggaaagggactgtgttgatatggcagaaggtggatgaagtgatgacaaaagaaattaagctgccaacagaaatggaaggaaaaaagatggcagtgacccggaccaggacaaagccagtgcccttgcactgcgatatcatcggggatgctttctggaaggaacatccagagattctagatgaagacagctgacccttttgcgcttcagttctggtgtgcttaaccatgcaagccctcccacctcccagggctccttgccttaggtggctgtagcatccctaccaccca

SEQ ID NO: 195353 - DNA, 576 bp, Homo sapiens
  Payload ID: 18574
  Gene Name: tRNA-histidine guanylyltransferase 1-like
  ENST ID: ENST00000523575
  CDS Start-End: 1-103
tgagattttgttttctgaattcaacatcaactataataatgagctgccgatgtataggaaagggactgtgttgatatggcagaagtaccaaggagtaccttgagagctagtcattccactggcaactccagctctttgagttgttcaaaacatttattctttggtacagacttggatacttcttaatgcaggtggaaggtggatgaagtgatgacaaaagaaattaagctgccaacagaaatggaaggaaaaaagatggcagtgacccggaccaggacaaagccagtgcccttgcactgcgatatcatcggggatgctttctggaaggaacatccagagattctagatgaagacagctgacccttttgcgcttcagttctggtgtgcttaaccatgcaagccctcccacctcccagggctccttgccttaggtggctgtagcatccctaccacccaggacactggtgcgaatgacacaactcaagttgggaggggaacagggaaggaagggatggatgggggtggtgtatcttactctgtttaagcagaacaccttgtttgcggtgttggaacatg

SEQ ID NO: 195354 - DNA, 3348 bp, Homo sapiens
  Payload ID: 18575
  Gene Name: tRNA-yW synthesizing protein 1 homolog (S. cerevisiae)
  Uniprot ID: Q9NV66
  ENST ID: ENST00000359626
  CDS Start-End: 165-2363
gaaccaatcaggaccggcctggcagtgtcatggctgcccacaggtctgcaggcactcggtacgccgctaacgcggcgaggtagctcggtgcgtctcgcggtaccagtgcgaatcatcgggctatccaggtccgagatcctagtctcctgtcggctctgaggaggatggatccttctgcggatacatgggacctcttctcacctttaatatcattatggataaacaggttttacatttatttgggctttgctgttagcattagcctttggatttgtgtccagattgtcatcaagacgcagggcaagaacttacaggaaaaatctgttccaaaagcagctcaggatttgatgacaaatggttatgtctcccttcaagagaaagacatctttgtgtctggagtgaagattttttatggttctcagactggaacagcgaagggattcgcaacagttcttgctgaagcagttacatccctggatctgcctgtggccattattaatctaaaagaatatgatccagatgatcatctgatagaagaggtgactagtaaaaatgtctgtgtcttcctggttgcgacatacactgacggcctaccaactgaaagtgcagagtggttctgcaaatggttagaggaagcatccattgattttcgatttggcaaaacttacctgaagggtatgagatatgcggtatttggcctgggaaattctgcctatgctagccacttcaacaaggttggcaaaaatgttgacaagtggctctggatgcttggcgcgcatcgtgtgatgagtcgaggggagggcgactgcgacgtggttaaaagcaagcacggcagcattgaggccgacttcagagcatggaagaccaagttcatctcccagctgcaggcacttcagaaaggggagagaaagaagtcctgtggcggccactgcaagaaaggcaaatgtgaatctcaccaacatggctcagaggagagggaggaaggatctcatgagcaggatgaattgcatcatagagacaccgaggaggaagaaccctttgagagctccagtgaagaagagtttggtggtgaggaccatcagagcctaaattccattgttgatgttgaagatttgggcaaaattatggatcatgtgaagaaagaaaagagagaaaaggaacagcaggaagagaagtctggtttgttcaggaacatggggaggaatgaagatggtgaaagaagagctatgataactcctgctctccgagaagcccttactaaacaaggttatcagttgattgggagccactcgggggtgaagctttgcaggtggacaaagtccatgctccgagggagaggaggttgttacaaacacacattctatggaattgagagccatcgctgcatggaaaccaccccgagcttggcgtgtgctaataaatgtgtcttctgttggcggcaccacaccaaccccgtgggcactgagtggcggtggaagatggaccagcctgaaatgatcttgaaggaagccattgaaaaccatcagaacatgattaagcagtttaaaggagtaccgggcgtcaaagcagaacgctttgaagaaggaatgacggtaaagcactgtgcattgtccctcgtgggagaaccaataatgtacccagagatcaacaggtttttgaagctactccaccagtgtaaaatttccagcttcctggtcacaaacgcacaatttcctgcggaaatcaggaacctcgagccggttactcagctgtatgtcagtgtggatgccagtaccaaagacagcctgaagaaaatcgaccgcccactcttcaaggatttctggcagagattccttgacagtttaaaagccttggcagtcaagcaacaacgaactgtctacagactgacgctcgtgaaagcatggaacgtggacgagctccaggcctacgcgcagctcgtgtccctggggaatcctgacttcatcgaagtgaagggcgttacctactgcggagaaagttcagcaagcagtcttaccatggcccacgtgccctggcatgaggaagtggtacagtttgtccacgagttggtggatctgatccccgaatatgaaattgcatgtgaacacgaacactctaattgcctcctgatagcacacagaaagtttaaaattggtggtgaatggtggacatggatcgattataaccgcttccaggagctcatccaggaatatgaagatagtggtggatcaaaaacgttcagcgcaaaggattatatggccagaactcctcactgggcattatttggtgccagtgaaagaggctttgatcccaaggacacaagacatcagagaaagaacaaatcaaaggctatttctggatgttgagattatctgatttcaaggtactgaaggacaaaaacttggatggcctcaaaaggttcttgaacaccactgtgattctccaaggacgaattacgtaaattatactttcatacaaaggagacgataaggcagtaaacatggagacacgggggacagcgtccacactcagagggcctgggccacagccccgatgtttcttttcagaactcagcccctttcctgattttacttctaagaggaaaattattttggggaggaactacacagtcgtgattagaatttatctgatggttttgtattataacttgtaagacctgccagaatgctagtcccgagagtgtcagacaaggaagaagtccctgggcctcttccccttacccggcccttagatttcatggagcagccacttagcattgaattgcactaccctgagctaaacgtgtctgtgctttctaagataagagcttgatccctttcttctatcttaagacagcacctcctgaaaagaatcgaagttgtcacaactctcaattattttttaaatactgcatagattgagttttggtttattaccaacccttcccagaattgcgttggatctaaaactactagatctcatcccattcccatgtaaattaccacagaccgcagtaccggggctggagcggagtgaagctgtctgctgtaagaggagtggccatgtgagggcatggagtcattagtctcacaaacacactttggactgaagaggatcatttctttttgttcgtgaggtcactgtccaggcctctcatatcatgaccagacggcgggtctccatcttctttcactcctgtggccctggctgctttacacaatctgttctataaggttcaggtgttttcaagttggaaagatcataaatactcaaaattgttttcaagttagcaagttcttttaacagtcttttatgcaaaaattgaattaataaaataatcttttgtaaaga

SEQ ID NO: 195355 - DNA, 3255 bp, Homo sapiens
  Payload ID: 18575
  Gene Name: tRNA-yW synthesizing protein 1 homolog (S. cerevisiae)
  Uniprot ID: Q9NV66
  ENST ID: ENST00000361660
  CDS Start-End: 127-1281
cacaggtctgcaggcactcggtacgccgctaacgcggcgaggtagctcggtgcgtctcgcggtaccagtgcgaatcatcgggctatccaggtccgagatcctagtctcctgtcggctctgaggaggatggatccttctgcggatacatgggacctcttctcacctttaatatcattatggataaacaggttttacatttatttgggctttgctgttagcattagcctttggatttgtgtccagattgtcatcaagacgcagggcaagaacttacaggaaaaatctgttccaaaagcagctcaggatttgatgacaaatggttatgtctcccttcaagagaaagacatctttgtgtctggagtgaagattttttatggttctcagactggaacagcgaagggattcgcaacagttcttgctgaagcagttacatccctggatctgcctgtggccattattaatctaaaagaatatgatccagatgatcatctgatagaagaggtgactagtaaaaatgtctgtgtcttcctggttgcgacatacactgacggcctaccaactgaaagtgcagagtggttctgcaaatggttagaggaagcatccattgattttcgatttggcaaaacttacctgaagggtatgagatatgcggtatttggcctgggaaattctgcctatgctagccacttcaacaaggttggcaaaaatgttgacaagtggctctggatgcttggcgcgcatcgtgtgatgagtcgaggggagggcgactgcgacgtggttaaaagcaagcacggcagcattgaggccgacttcagagcatggaagaccaagttcatctcccagctgcaggcacttcagaaaggggagagaaagaagtcctgtggcggccactgcaagaaaggcaaatgtgaatctcaccaacatggctcagaggagagggaggaaggatctcatgagcaggatgaattgcatcatagagacaccgaggaggaagaaccctttgagagctccagtgaagaagagtttggtggtgaggaccatcagagcctaaattccattgttgatgttgaagatttgggcaaaattatggatcatgtgaagaaagaaaagagagaaaaggaacagcaggaagagaagtctggtttgttcaggaacatggggaggaatgaagatggtgaaagaagagctatgataactcctgctctccgagaagcccttactaaacaagtccatgctccgagggagaggaggttgttacaaacacacattctatggaattgagagccatcgctgcatggaaaccaccccgagcttggcgtgtgctaataaatgtgtcttctgttggcggcaccacaccaaccccgtgggcactgagtggcggtggaagatggaccagcctgaaatgatcttgaaggaagccattgaaaaccatcagaacatgattaagcagtttaaaggagtaccgggcgtcaaagcagaacgctttgaagaaggaatgacggtaaagcactgtgcattgtccctcgtgggagaaccaataatgtacccagagatcaacaggtttttgaagctactccaccagtgtaaaatttccagcttcctggtcacaaacgcacaatttcctgcggaaatcaggaacctcgagccggttactcagctgtatgtcagtgtggatgccagtaccaaagacagcctgaagaaaatcgaccgcccactcttcaaggatttctggcagagattccttgacagtttaaaagccttggcagtcaagcaacaacgaactgtctacagactgacgctcgtgaaagcatggaacgtggacgagctccaggcctacgcgcagctcgtgtccctggggaatcctgacttcatcgaagtgaagggcgttacctactgcggagaaagttcagcaagcagtcttaccatggcccacgtgccctggcatgaggaagtggtacagtttgtccacgagttggtggatctgatccccgaatatgaaattgcatgtgaacacgaacactctaattgcctcctgatagcacacagaaagtttaaaattggtggtgaatggtggacatggatcgattataaccgcttccaggagctcatccaggaatatgaagatagtggtggatcaaaaacgttcagcgcaaaggattatatggccagaactcctcactgggcattatttggtgccagtgaaagaggctttgatcccaaggacacaagacatcagagaaagaacaaatcaaaggctatttctggatgttgagattatctgatttcaaggtactgaaggacaaaaacttggatggcctcaaaaggttcttgaacaccactgtgattctccaaggacgaattacgtaaattatactttcatacaaaggagacgataaggcagtaaacatggagacacgggggacagcgtccacactcagagggcctgggccacagccccgatgtttcttttcagaactcagcccctttcctgattttacttctaagaggaaaattattttggggaggaactacacagtcgtgattagaatttatctgatggttttgtattataacttgtaagacctgccagaatgctagtcccgagagtgtcagacaaggaagaagtccctgggcctcttccccttacccggcccttagatttcatggagcagccacttagcattgaattgcactaccctgagctaaacgtgtctgtgctttctaagataagagcttgatccctttcttctatcttaagacagcacctcctgaaaagaatcgaagttgtcacaactctcaattattttttaaatactgcatagattgagttttggtttattaccaacccttcccagaattgcgttggatctaaaactactagatctcatcccattcccatgtaaattaccacagaccgcagtaccggggctggagcggagtgaagctgtctgctgtaagaggagtggccatgtgagggcatggagtcattagtctcacaaacacactttggactgaagaggatcatttctttttgttcgtgaggtcactgtccaggcctctcatatcatgaccagacggcgggtctccatcttctttcactcctgtggccctggctgctttacacaatctgttctataaggttcaggtgttttcaagttggaaagatcataaatactcaaaattgttttcaagttagcaagttcttttaacagtcttttatgcaaaaattgaattaataaaataatcttttgtaaa

SEQ ID NO: 195356 - DNA, 563 bp, Homo sapiens
  Payload ID: 18575
  Gene Name: tRNA-yW synthesizing protein 1 homolog (S. cerevisiae)
  ENST ID: ENST00000442959
  CDS Start-End: 160-563
aatcaggaccggcctggcagtgtcatggctgcccacaggtctgcaggcactcggtacgccgctaacgcggcgaggtagctcggtgcgtctcgcggtaccagtgcgaatcatcgggctatccaggtccgagatcctagtctcctgtcggctctgaggaggatggatccttctgcggatacatgggacctcttctcacctttaatatcattatggataaacaggttttacatttatttgggctttgctgttagcattagcctttggatttgtgtccagattgtcatcaagacgcagggcaagaacttacaggaaaaatctgttccaaaagcagctcaggatttgatgacaaatggttatgtctcccttcaagagaaagacatctttgtgtctggagtgaagattttttatggttctcagactggaacagcgaagggattcgcaacagttcttgctgaagcagttacatccctggatctgcctgtggccattattaatctaaaagaatatgatccagatgatcatctgatagaagaggttggcaaaaatgttgacaagtggctctg

SEQ ID NO: 195357 - DNA, 3156 bp, Homo sapiens
  Payload ID: 18575
  Gene Name: tRNA-yW synthesizing protein 1 homolog (S. cerevisiae)
  ENST ID: ENST00000615572
  CDS Start-End: 160-2166
aatcaggaccggcctggcagtgtcatggctgcccacaggtctgcaggcactcggtacgccgctaacgcggcgaggtagctcggtgcgtctcgcggtaccagtgcgaatcatcgggctatccaggtccgagatcctagtctcctgtcggctctgaggaggatggatccttctgcggatacatgggacctcttctcacctttaatatcattatggataaacaggttttacatttatttgggctttgctgttagcattagcctttggatttgtgtccagattgtcatcaagacgcagggattcgcaacagttcttgctgaagcagttacatccctggatctgcctgtggccattattaatctaaaagaatatgatccagatgatcatctgatagaagaggtgactagtaaaaatgtctgtgtcttcctggttgcgacatacactgacggcctaccaactgaaagtgcagagtggttctgcaaatggttagaggaagcatccattgattttcgatttggcaaaacttacctgaagggtatgagatatgcggtatttggcctgggaaattctgcctatgctagccacttcaacaaggttggcaaaaatgttgacaagtggctctggatgcttggcgcgcatcgtgtgatgagtcgaggggagggcgactgcgacgtggttaaaagcaagcacggcagcattgaggccgacttcagagcatggaagaccaagttcatctcccagctgcaggcacttcagaaaggggagagaaagaagtcctgtggcggccactgcaagaaaggcaaatgtgaatctcaccaacatggctcagaggagagggaggaaggatctcatgagcaggatgaattgcatcatagagacaccgaggaggaagaaccctttgagagctccagtgaagaagagtttggtggtgaggaccatcagagcctaaattccattgttgatgttgaagatttgggcaaaattatggatcatgtgaagaaagaaaagagagaaaaggaacagcaggaagagaagtctggtttgttcaggaacatggggaggaatgaagatggtgaaagaagagctatgataactcctgctctccgagaagcccttactaaacaagtccatgctccgagggagaggaggttgttacaaacacacattctatggaatgagagccatcgctgcatggaaaccaccccgagcttggcgtgtgctaataaatgtgtcttctgttggcggcaccacaccaaccccgtgggcactgagtggcggtggaagatggaccagcctgaaatgatcttgaaggaagccattgaaaaccatcagaacatgattaagcagtttaaaggagtaccgggcgtcaaagcagaacgctttgaagaaggaatgacggtaaagcactgtgcattgtccctcgtgggagaaccaataatgtacccagagatcaacaggtttttgaagctactccaccagtgtaaaatttccagcttcctggtcacaaacgcacaatttcctgcggaaatcaggaacctcgagccggttactcagctgtatgtcagtgtggatgccagtaccaaagacagcctgaagaaaatcgaccgcccactcttcaaggatttctggcagagattccttgacagtttaaaagccttggcagtcaagcaacaacgaactgtctacagactgacgctcgtgaaagcatggaacgtggacgagctccaggcctacgcgcagctcgtgtccctggggaatcctgacttcatcgaagtgaagggcgttacctactgcggagaaagttcagcaagcagtcttaccatggcccacgtgccctggcatgaggaagtggtacagtttgtccacgagttggtggatctgatccccgaatatgaaattgcatgtgaacacgaacactctaattgcctcctgatagcacacagaaagtttaaaattggtggtgaatggtggacatggatcgattataaccgcttccaggagctcatccaggaatatgaagatagtggtggatcaaaaacgttcagcgcaaaggattatatggccagaactcctcactgggcattatttggtgccagtgaaagaggctttgatcccaaggacacaagacatcagagaaagaacaaatcaaaggctatttctggatgttgagattatctgatttcaaggtactgaaggacaaaaacttggatggcctcaaaaggttcttgaacaccactgtgattctccaaggacgaattacgtaaattatactttcatacaaaggagacgataaggcagtaaacatggagacacgggggacagcgtccacactcagagggcctgggccacagccccgatgtttcttttcagaactcagcccctttcctgattttacttctaagaggaaaattattttggggaggaactacacagtcgtgattagaatttatctgatggttttgtattataacttgtaagacctgccagaatgctagtcccgagagtgtcagacaaggaagaagtccctgggcctcttccccttacccggcccttagatttcatggagcagccacttagcattgaattgcactaccctgagctaaacgtgtctgtgctttctaagataagagcttgatccctttcttctatcttaagacagcacctcctgaaaagaatcgaagttgtcacaactctcaattattttttaaatactgcatagattgagttttggtttattaccaacccttcccagaattgcgttggatctaaaactactagatctcatcccattcccatgtaaattaccacagaccgcagtaccggggctggagcggagtgaagctgtctgctgtaagaggagtggccatgtgagggcatggagtcattagtctcacaaacacactttggactgaagaggatcatttctttttgttcgtgaggtcactgtccaggcctctcatatcatgaccagacggcgggtctccatcttctttcactcctgtggccctggctgctttacacaatctgttctataaggttcaggtgttttcaagttggaaagatcataaatactcaaaattgttttcaagttagcaagttcttttaacagtcttttatgcaaaaattgaattaataaaataatcttttgtaaagacttgc

SEQ ID NO: 195358 - DNA, 1543 bp, Homo sapiens
  Payload ID: 18576
  Gene Name: tRNA-yW synthesizing protein 1 homolog B (S. cerevisiae)
  ENST ID: ENST00000612372
  CDS Start-End: 100-1515
gctaacgccgcgaggtagctcggtgcgtctcgcagtaccagtgcgaacctttgggctctccaggtccgagatcctagtctcctgtcggctctgaggaggatggatccttctgcggatacatgggacctctcctcacctttaatatcattatggataaacaggttttacatttatctgggctttgctgttagcattagcctttggatttgtgtccagattgtcatcgagatgcagggatttgcaacagttcttgctgaagcagttacgtccctggatctgcctgtggccattattaatctaaaagaatatgatccagatgatcatctgatagaagaggaggaagaacccttcgagagctccagtgaagaagagtttggtggtgaggaccatcagagcctaaattccattgttgatgttgaagatttgggcaaaattatggatcacgtgaagaaagaaaagagagaaaaggaacagcaggaagagaagtctggtttgttcaggaacatggggaggaatgaagatggtgaaagaagagctatgataactcctgctctccgagaagcccttactaaacaagtcgatgctccgagggagaggagcttgttacaaacacacattctatggaatgagagccatcgctgcatggaaaccaccccgagcttggcgtgtgctaataaatgtgtcttctgttggtggcaccacaacaaccctgtgggcactgaatggttgtggaagatggaccagcctgaaatgatcttgaaggaagccattgaaaaccatcagaacatgattaagcagtttaaaggagtaccgggcgtcaaagcagaacgctttgaagaaggaatgacggtaaagcactgtgcattgtccctcgtgggagaaccaataatgtacccagagatcaacaggtttttgaagctactccaccagtgtaaaatctccagcttcctggtcacaaatgcacaatttcctgcggaaatcaggaacctcgagccagttactcagctgtatgtcagtgtggatgccagtaccaaagacagcctgaagaaaatcgaccgcccactcttcaaggatttctggcagcaattccttgacagtttaaaagccttggcagtcaagcaacaacgaactgtctacagactgatgctcgtgaaagcatggaacgtggacgagctccaggcctacgcgcagctcgtgtccctggggaatcctgacttcatcgaagtgaagggcgttacctactgcagagaaagttcagcaagcagtcttaccatggcccatgtgccctggcatgaggaagtggtacagtttgtccgcgagctggtggatctgatccccgaatatgaaattgcatgtgaacacgaacactctaattgcctcctgatagcacacagaaagacagttttaggagggacaccaggccatggagtcacagaaatccagtgggaagagtggatcaagaaaagactaatcagccaggcacggtggctcatatctgttatcccagcacattgagaggctgaggcaggcagatcacttgagg

SEQ ID NO: 195359 - DNA, 3113 bp, Homo sapiens
  Payload ID: 18576
  Gene Name: tRNA-yW synthesizing protein 1 homolog B (S. cerevisiae)
  ENST ID: ENST00000620995
  CDS Start-End: 124-2130
agttctgcagccactcggtacggcgctaacgccgcgaggtagctcggtgcgtctcgcagtaccagtgcgaacctttgggctctccaggtccgagatcctagtctcctgtcggctctgaggaggatggatccttctgcggatacatgggacctctcctcacctttaatatcattatggataaacaggttttacatttatctgggctttgctgttagcattagcctttggatttgtgtccagattgtcatcgagatgcagggatttgcaacagttcttgctgaagcagttacgtccctggatctgcctgtggccattattaatctaaaagaatatgatccagatgatcatctgatagaagaggtgactagtaaaaatgtctgtgtcttcctggttgcgacatacactgacggcctaccaaccgaaagtgcagagtggttctgcaaatggttagaggaagcatccattgattttcgatttggcaaaacttacctgaagggtatgagagatgcggtatttggcctgggaaattctgcctatgctagccacttcaacaaggttggcaaaaatgttgacaagtggctctggatgcttggcgtgcatcgtgtgatgagtcgaggggagggcgactgcgacgtggttaaaagcaagcacggcagcattgaggccaacttcagagcatggaagaccaagttcatctcccagctgcaggcacttcagaaaggggagagaaagaagtcctgtggcggccactgcaagaaaggcaaatgtgaatctcaccaacatggctcagaggagagggaggaaggatctcaagagcaggacgaattgcatcacagagacaccaaggaggaagaacccttcgagagctccagtgaagaagagtttggtggtgaggaccatcagagcctaaattccattgttgatgttgaagatttgggcaaaattatggatcacgtgaagaaagaaaagagagaaaaggaacagcaggaagagaagtctggtttgttcaggaacatggggaggaatgaagatggtgaaagaagagctatgataactcctgctctccgagaagcccttactaaacaagtcgatgctccgagggagaggagcttgttacaaacacacattctatggaatgagagccatcgctgcatggaaaccaccccgagcttggcgtgtgctaataaatgtgtcttctgttggtggcaccacaacaaccctgtgggcactgaatggttgtggaagatggaccagcctgaaatgatcttgaaggaagccattgaaaaccatcagaacatgattaagcagtttaaaggagtaccgggcgtcaaagcagaacgctttgaagaaggaatgacggtaaagcactgtgcattgtccctcgtgggagaaccaataatgtacccagagatcaacaggtttttgaagctactccaccagtgtaaaatctccagcttcctggtcacaaatgcacaatttcctgcggaaatcaggaacctcgagccagttactcagctgtatgtcagtgtggatgccagtaccaaagacagcctgaagaaaatcgaccgcccactcttcaaggatttctggcagcaattccttgacagtttaaaagccttggcagtcaagcaacaacgaactgtctacagactgatgctcgtgaaagcatggaacgtggacgagctccaggcctacgcgcagctcgtgtccctggggaatcctgacttcatcgaagtgaagggcgttacctactgcagagaaagttcagcaagcagtcttaccatggcccatgtgccctggcatgaggaagtggtacagtttgtccgcgagctggtggatctgatccccgaatatgaaattgcatgtgaacacgaacactctaattgcctcctgatagcacacagaaagtttaaaattggtggtgaatggtggacatggatcgattataaccgcttccaggagctcatccaggaatatgaagatagtggtggatcaaaaacgttcagcgcaaaggattatatggccagaactcctcactgggcattatttggtgccaatgaaagaagctttgatcccaaggacacaagacatcagagaaagaacaaatcaaaggctatttctggatgttgagattatctgatttcaaggtactgaaggacaaaaacttggatggcctcaaaaggttcttgaacaccactctgattctccaaggacgaattacgtaaattatactttcatacaaaggagacgataaggcagtaaacatggagacacgggggacagcgtccacactcagagggcctgggccacagccccgatgtttcttttcagaactcagcccctttcctgattttacttctaagaggaaaattattttggggaggaactacacagtcgtgattagaatttaactgatggttttgtattataacttctaagacctgccagaatgctagtcctgagagtgtcagacaaggaagaaatccctgggcctcttcccctcacctggcccttggatttcatggagcagccacttagcattgaattgcactaccctgagctaaacgtgtctgtgctttctaagataagagcttgatccctttcttctgtcttaagacagcacctcctgaaaagaatcgaagttgtcacaactctcaattattttttaaatactgcatagattgagttttggtttattactaacccttcccaaaattgcatcggatctaaaactactagatctcatcccattcccatgtaaattaccacagaccgcagtaccggggctggagcggagtgaagctgtctgctgtaagaggagtggccatgtgagggcatggagtcattagtctcacaaacacactttggactgaagaggatcatttctttttgttcgtgaggtcactgtccgggcctctcatatcacgaccagacggcgggtctccatcttctttgactcctgtggccctcgctgctttacacaatctgttctataaggttcaggtgttttcaagttggaaagatcataaatactcaaaattgttttcaagttagcaaattcttttaacagtcttttatgcaaaaattgaattaataaaataatattttgtaaa

SEQ ID NO: 195360 - DNA, 1086 bp, Homo sapiens
  Payload ID: 18576
  Gene Name: tRNA-yW synthesizing protein 1 homolog B (S. cerevisiae)
  ENST ID: ENST00000610600
  CDS Start-End: 112-1086
actcggtacggcgctaacgccgcgaggtagctcggtgcgtctcgcagtaccagtgcgaacctttgggctctccaggtccgagatcctagtctcctgtcggctctgaggaggatggatccttctgcggatacatgggacctctcctcacctttaatatcattatggataaacaggttttacatttatctgggctttgctgttagcattagcctttggatttgtgtccagattgtcatcgagatgcagggatttgcaacagttcttgctgaagcagttacgtccctggatctgcctgtggccattattaatctaaaagaatatgatccagatgatcatctgatagaagaggttggcaaaaatgttgacaagtggctctggatgcttggcgtgcatcgtgtgatgagtcgaggggagggcgactgcgacgtggttaaaagcaagcacggcagcattgaggccaacttcagagcatggaagaccaagttcatctcccagctgcaggcacttcagaaaggggagagaaagaagtcctgtggcggccactgcaagaaaggcaaatgtgaatctcaccaacatggctcagaggagagggaggaaggatctcaagagcaggacgaattgcatcacagagacaccaaggaggaagaacccttcgagagctccagtgaagaagagtttggtggtgaggaccatcagagcctaaattccattgttgatgttgaagatttgggcaaaattatggatcacgtgaagaaagaaaagagagaaaaggaacagcaggaagagaagtctggtttgttcaggaacatggggaggaatgaagatggtgaaagaagagctatgataactcctgctctccgagaagcccttactaaacaagtcgatgctccgagggagaggagcttgttacaaacacacattctatggaatgagagccatcgctgcatggaaaccaccccgagcttggcgtgtgctaataaatgtgtcttctgttggtggcaccacaacaaccctgtgggcactgaatggttgtggaagatggaccagcctgaaatgatcttgaaggaagccattgaaaaccatcag

SEQ ID NO: 195361 - DNA, 3430 bp, Homo sapiens
  Payload ID: 18577
  Gene Name: tRNA-yW synthesizing protein 3 homolog (S. cerevisiae)
  Uniprot ID: Q6IPR3
  ENST ID: ENST00000370867
  CDS Start-End: 90-869
tcggccaccgctcgcttcaatatggctgcccccagggagagacgaggctaccatgaaggagccgagcgcagaccctgagtccgtcacccatggatcgcagcgcggagttcaggaaatggaaggcgcaatgtttgagcaaagcggacctcagccggaagggcagtgttgacgaggatgtggtagagcttgtgcagtttctgaacatgcgagatcagtttttcaccaccagctcctgcgctggccgcatcctactccttgaccggggtataaatggttttgaggttcagaaacaaaactgttgctggctactggttacacacaaactttgtgtaaaagatgatgtgattgtagctctgaagaaagcaaatggtgatgccactttgaaatttgaaccatttgttcttcatgtgcagtgtcgacaattgcaggatgcacagattctgcattccatggcaatagattctggtttcaggaactctggcataacggtgggaaagagaggaaaaactatgttggctgtccggagtacacatggcttagaagttccattaagccataagggaaaactgatggtgacagaggaatatattgacttcctgttaaatgtggcaaatcaaaaaatggaggaaaacaagaaaagaattgagaggttttacaactgcctacagcatgctttggaaagggaaacgatgactaacttacatcccaagatcaaagagaaaaataactcatcatatattcataagaaaaaaagaaacccagaaaaaacacgtgcccagtgtattactaaagaaagtgatgaagaacttgaaaatgatgatgatgatgatctaggaatcaatgttaccatcttccctgaagattactaagctttggttctgatgtgtcttggccgtaatgtttctagtaggttttataaagctgctcttcataagagtattttagtttgttgagtgtatcagccattcataagccagtaatgacaagtgcagagcttcaaactataactttgttgcccagaggatgtgcagttgtcatctaagctctcagcagtacccggcttatcctacgacttcacctgaaatgctatagttatccctacttttttaccagtttctcccagaagcacctgcttaataaatcaaagatgtttgaatggtgtcttattctgaaataacctgacctaagacaggtatttagattattttggatacattttgaaaagggatagcataaatattttaagtaaaaagacctttattttaaataatagtggatattttaatgctggaaattagcattatagttgatatgccagaaattatatctttggttgtgatttaaacttatgctataaactaaattaatgatgtaaatacatagttttaaacattcttttagggacatgtaacttttaagtatcacttcaataatacgtattattataggaacaaagatttgggaataattgattacaggtgaggaagtactggaattccagttcaaggagataccatttcatttaggactaaaaggacaagatacaagttcacatgatgggaaaaatcagaaaacctctcgcagacaaagggtatataatggatatgaggcatcaaaaagcatggtatagtcagtgatggggaatagtccagaaaggctgaaacacagcatgtgatgcgagtcaaggtagttgatgcccaactgtgaagggccgttctaatctagcatggaggtagacagtgtttccttaatatggctgcatatcagaattacctaggtcaggacgaggcatggagatgctactttaataggccctgccgcagatcttccaaaccagaatcttaatcctggagtctaggaatctttatttttcacacaactcatccaagtggttctgataaaatcagtccagcacttttagaacccactgataacagacttattcctggagacagcatttgaggaggaattgaagatttttctaatgaaaagaaaaagggtcacatgaacagatgttgcagtgtacctgtgccagggatttcatgtgtacactttataggagaataagcaagagcttaggtaagttatagtccttaccattgggtctaaggcagtttccaggaaagcatggcaactcgttcagctatgtaagttgaactctgtaccacttgggagggaacattcccctagatgacaatgtcagtggcactcgaagttgtgcagtgcacattcttatctaccaacatatacagcagtccttctgggaaggaaatttgggcaggaaagggaactcacagtgtcggaatgcctggagcatttcttctagtctggtggacagaatatgaaagtatctgcctggcagtgcagtaaatgaaaagagaagataaatgaataaaaaaaaaagttataaataacagtaggaaagagagagtgcaggtggaacgagcctatcctgtggtgaaatgacaacacattctgcagttttaaaatctaagaggctcattgacttttcttcattcatttaaattgatctccaagaaaactatgtattttaaagattccataaactgaatatatgaatgagaattaagaagagaggggctgcttcctaatctgtttatataaggtatagtatagtataatctgtttatataaggttagtagagaggagacaccaggtgctggccataaacctaagaagacattgaatcccattcactccttaacattccttaatatacattcatgagctacataacattttaatcatcaatgatggaccatataccatatacgatatggtggccccataagattataatggacctgaaaaattcctattgctagtgatgtggtcattgtaaagctgtagcacaacacattacccacgtttgtggtgacagtcatataaaagtatggtacatataattatgtacagtgcatacataatacttgataatatgttactggtttgtgtctttgctatgctttttatcattattttagggtatactacttaaaatgttaactgtaaaacagcttctgacaggtccttcaggaagtactccagaagaaggcattgttatcatagaaggtgacagcttcatgtgtgttattgcccctgaagaccttccagtggtacaagatgtggaggaggaagacagtgatactgaggattctgaccctgtgtaggcttaggctaatgtgtgtgtttatatcttagtttttcacaaaaaggtttttccaatgttaaaaaaaatatataaaaaagcttatagaataaggatataaagaaatattttgtacagctgtacaataagctaagcattattaccaaagagtcaaaaagttttaagaaattaaagtttataaaccaaatgttcattgtgagccaaggttaatttattgaagaaataaaacatttttaatg

SEQ ID NO: 195362 - DNA, 3335 bp, Homo sapiens
  Payload ID: 18577
  Gene Name: tRNA-yW synthesizing protein 3 homolog (S. cerevisiae)
  Uniprot ID: Q6IPR3
  ENST ID: ENST00000457880
  CDS Start-End: 94-774
cttttcggccaccgctcgcttcaatatggctgcccccagggagagacgaggctaccatgaaggagccgagcgcagaccctgagtccgtcacccatggatcgcagcgcggagttcaggaaatggaaggcgcaatgtttgagcaaagcggacctcagccggaagggcagtgttgacgaggatgtggtagagcttgtgcagtttctgaacatgcgagatcagtttttcaccaccagctcctgcgctggccgcatcctactccttgaccggggtataaatggttttgaggttcagaaacaaaactgttgctggctactggttacacacaaactttgtgtaaaagatgatgtgcattccatggcaatagattctggtttcaggaactctggcataacggtgggaaagagaggaaaaactatgttggctgtccggagtacacatggcttagaagttccattaagccataagggaaaactgatggtgacagaggaatatattgacttcctgttaaatgtggcaaatcaaaaaatggaggaaaacaagaaaagaattgagaggttttacaactgcctacagcatgctttggaaagggaaacgatgactaacttacatcccaagatcaaagagaaaaataactcatcatatattcataagaaaaaaagaaacccagaaaaaacacgtgcccagtgtattactaaagaaagtgatgaagaacttgaaaatgatgatgatgatgatctaggaatcaatgttaccatcttccctgaagattactaagctttggttctgatgtgtcttggccgtaatgtttctagtaggttttataaagctgctcttcataagagtattttagtttgttgagtgtatcagccattcataagccagtaatgacaagtgcagagcttcaaactataactttgttgcccagaggatgtgcagttgtcatctaagctctcagcagtacccggcttatcctacgacttcacctgaaatgctatagttatccctacttttttaccagtttctcccagaagcacctgcttaataaatcaaagatgtttgaatggtgtcttattctgaaataacctgacctaagacaggtatttagattattttggatacattttgaaaagggatagcataaatattttaagtaaaaagacctttattttaaataatagtggatattttaatgctggaaattagcattatagttgatatgccagaaattatatctttggttgtgatttaaacttatgctataaactaaattaatgatgtaaatacatagttttaaacattcttttagggacatgtaacttttaagtatcacttcaataatacgtattattataggaacaaagatttgggaataattgattacaggtgaggaagtactggaattccagttcaaggagataccatttcatttaggactaaaaggacaagatacaagttcacatgatgggaaaaatcagaaaacctctcgcagacaaagggtatataatggatatgaggcatcaaaaagcatggtatagtcagtgatggggaatagtccagaaaggctgaaacacagcatgtgatgcgagtcaaggtagttgatgcccaactgtgaagggccgttctaatctagcatggaggtagacagtgtttccttaatatggctgcatatcagaattacctaggtcaggacgaggcatggagatgctactttaataggccctgccgcagatcttccaaaccagaatcttaatcctggagtctaggaatctttatttttcacacaactcatccaagtggttctgataaaatcagtccagcacttttagaacccactgataacagacttattcctggagacagcatttgaggaggaattgaagatttttctaatgaaaagaaaaagggtcacatgaacagatgttgcagtgtacctgtgccagggatttcatgtgtacactttataggagaataagcaagagcttaggtaagttatagtccttaccattgggtctaaggcagtttccaggaaagcatggcaactcgttcagctatgtaagttgaactctgtaccacttgggagggaacattcccctagatgacaatgtcagtggcactcgaagttgtgcagtgcacattcttatctaccaacatatacagcagtccttctgggaaggaaatttgggcaggaaagggaactcacagtgtcggaatgcctggagcatttcttctagtctggtggacagaatatgaaagtatctgcctggcagtgcagtaaatgaaaagagaagataaatgaataaaaaaaaaagttataaataacagtaggaaagagagagtgcaggtggaacgagcctatcctgtggtgaaatgacaacacattctgcagttttaaaatctaagaggctcattgacttttcttcattcatttaaattgatctccaagaaaactatgtattttaaagattccataaactgaatatatgaatgagaattaagaagagaggggctgcttcctaatctgtttatataaggtatagtatagtataatctgtttatataaggttagtagagaggagacaccaggtgctggccataaacctaagaagacattgaatcccattcactccttaacattccttaatatacattcatgagctacataacattttaatcatcaatgatggaccatataccatatacgatatggtggccccataagattataatggacctgaaaaattcctattgctagtgatgtggtcattgtaaagctgtagcacaacacattacccacgtttgtggtgacagtcatataaaagtatggtacatataattatgtacagtgcatacataatacttgataatatgttactggtttgtgtctttgctatgctttttatcattattttagggtatactacttaaaatgttaactgtaaaacagcttctgacaggtccttcaggaagtactccagaagaaggcattgttatcatagaaggtgacagcttcatgtgtgttattgcccctgaagaccttccagtggtacaagatgtggaggaggaagacagtgatactgaggattctgaccctgtgtaggcttaggctaatgtgtgtgtttatatcttagtttttcacaaaaaggtttttccaatgttaaaaaaaatatataaaaaagcttatagaataaggatataaagaaatattttgtacagctgtacaataagctaagcattattaccaaagagtcaaaaagttttaagaaattaaagtttataaaccaaatgttcattgtgagccaaggttaatttattgaagaaataaaacatttttaatg

SEQ ID NO: 195363 - DNA, 708 bp, Homo sapiens
  Payload ID: 18577
  Gene Name: tRNA-yW synthesizing protein 3 homolog (S. cerevisiae)
  ENST ID: ENST00000483990
  CDS Start-End: 540-708
atttttttttcatttttaaatactgtgctagccaaatagctagagtacaactcaggtgctgctagtattatcccttatactaatccctttttttcttgcaaaatcatgaccatatttcagaagatgtttatcaagtagttttacctttcacataattttctacctcaagttatttgggctcattcttattctgggttaacattacccaaaaacataccgaattgtttttattaatacttaaaatcctgacttgggattattaatttaagaaagcctacaatatactatgcattatgcttattatttttgtaaaatattatatgaaacttaaattatgttattttttattttagggtataaatggttttgaggttcagaaacaaaactgttgctggctactggttacacacaaactttgtgtaaaagatgatgtgattgtagctctgaagaaagcaaatggtgatgccactttgaaatttgaaccatttgttcttcatgtgcagtgtcgacaattgcaggatgcacagattctgcattccatggcaatagattctggtttcaggaactctggcataacggtgggaaagagaggaaaaactatgttggctgtccggagtacacatggcttagaagttccattaagccataagggaaaactgatggtgacagaggaatatattgacttcctgttaaatgtggcaaatcaaa

SEQ ID NO: 195364 - DNA, 1130 bp, Homo sapiens
  Payload ID: 18577
  Gene Name: tRNA-yW synthesizing protein 3 homolog (S. cerevisiae)
  ENST ID: ENST00000479111
  CDS Start-End: 424-843
ggatcgcagcgcggagttcaggaaatggaaggcgcaatgtttgagcaaagcggacctcagccggaagggcagtgttgacgaggatgtggtagagcttgtgcagtttctgaacatgcgagatcagtttttcaccaccagctcctgcgctggccgcatcctactccttgaccgggttcagttaccccagtcaacagcagtctgaaaatattaaatgaaaattccagaaataaacaattaggtataaatggttttgaggttcagaaacaaaactgttgctggctactggttacacacaaactttgtgtaaaagatgatgtgattgtagctctgaagaaagcaaatggtgatgccactttgaaatttgaaccatttgttcttcatgtgcagtgtcgacaattgcaggatgcacagattctgcattccatggcaatagattctggtttcaggaactctggcataacggtgggaaagagaggaaaaactatgttggctgtccggagtacacatggcttagaagttccattaagccataagggaaaactgatggtgacagaggaatatattgacttcctgttaaatgtggcaaatcaaaaaatggaggaaaacaagaaaagaattgagaggttttacaactgcctacagcatgctttggaaagggaaacgatgactaacttacatcccaagatcaaagagaaaaataactcatcatatattcataagaaaaaaagaaacccagaaaaaacacgtgcccagtgtattactaaagaaagtgatgaagaacttgaaaatgatgatgatgatgatctaggaatcaatgttaccatcttccctgaagattactaagctttggttctgatgtgtcttggccgtaatgtttctagtaggttttataaagctgctcttcataagagtattttagtttgttgagtgtatcagccattcataagccagtaatgacaagtgcagagcttcaaactataactttgttgcccagaggatgtgcagttgtcatctaagctctcagcagtacccggcttatcctacgacttcacctgaaatgctatagttatccctacttttttaccagtttctcccagaagcacctgcttaataaatcaaagatgtttgaa

SEQ ID NO: 195365 - DNA, 4306 bp, Homo sapiens
  Payload ID: 18578
  Gene Name: tRNA-yW synthesizing protein 5
  Uniprot ID: A2RUC4
  ENST ID: ENST00000354611
  CDS Start-End: 267-1214
gcctcagcggtgtcggagaaagagactggagagcaaagtggacctgttgctgcagcctctggtgagtcggccccgtccccgctctccagcacgcagcccaggccgaggcccttcggcaacccgccccgcgctcggacccagccactctggagtctgccggcctcgcggaccttttctctgtcgctcgtgtttccgggcggatggcgctgaggaacgctttagagccgaagttccgaagacctggaagagggcaggcgtgagcaaccatggccgggcagcacctcccggtaccccggctggagggcgtttctcgggagcagttcatgcagcacctctacccacagagaaaacctcttgtgttggaagggattgatttggggccatgtacaagcaaatggacagtggattacctaagccaagttggagggaagaaagaagtaaagattcatgttgctgcagttgcacagatggacttcattagtaagaactttgtatatagaactttaccttttgaccagttggtccagagggcagctgaagagaaacataaagaattctttgtttcagaggatgagaaatactacttacggtcacttggagaagaccctagaaaggatgttgcagatatcagaaagcagtttcctttgttgaaaggagatattaagtttccagaattcttcaaagaggaacagttcttttccagtgtttttcgaattagttcaccaggattacaactatggactcattatgatgtaatggataatttgttaatacaagtgacaggaaaaaagcgtgttgtactcttcagtcctcgagatgcccagtatttatatttaaaaggtactaaatcagaagtactgaatatagataacccagacttggctaaatatccacttttttccaaggctagaagatatgaatgttcccttgaagctggtgatgtattattcattcctgctttatggttccataatgtaatttctgaagagtttggagtgggagtgaatatcttttggaagcaccttccatctgaatgctatgataaaacagatacctatggaaacaaagatcctacagcagcatcaagagctgcacaaattctggacagagccttgaaaacactggccgagttaccagaggaatatagggacttctatgcacgacgaatggtcctacacattcaagacaaagcctacagcaagaactctgagtaaataatgaagtgaatgcaatgcacattaacactttagtaaggtataacgatataaattaaagattttgttaaaataggaaagatacatcagatttacagattatgtaagtacgaaggggtgtttgtgtggattctacttgatacagattgttataattaaagaatgctgtgctgggaccactctttaacattcagatgctgaccactaaaagtccaacttaaaatgacttaaaaacagtaagaaaatatattgattcacaatacatgaaatctattgacagaatgtgctgcagtgtttctgatccaatgattcagtaatgtcatcaagaaccttgggaacccgcctccacaccccacccccttttcaaccacaacattggcatcatcctaaggctggctaccctcgtggtcatgggatgattgccagtagcagttggagccttgtgcatcttcatttacatgcagcggaagagtcaggctggattctaggggccctgtcctagtatgagaaagctttcccagaattcactttccatatccttaggtctcattgctctaaagtaacttagacctgtccatccctgagccagtcactggcaaagggtctagaataacctttagggcagtcaggtccactggagctgagagtagaagtggaggccacatgagggatatatggggacagaaaggatagtttttttaaaatcatggttctgataggaaaaacatgagcaacgcacaatatctattacatttgcctagaagcagaattttttgaggaactttaaaaaatgtacagatacctaggtcccaactttgtagactgattcaagagtgtttgggatttggtataggaacttaatagacctcacagggtgttctgatgcataatcagagctgagatcaactggagttgatgatagtgacttggattattagttttgtgattagtgcaaaacaaatgtttaatctgatcttgacttttcttgccacccagtatgtcagggtggtttttggtttttgaatgttacaaaataaataatttatacctatgtctaaaccttagcctagttaaagatttcccaactattttttccacctatcccttttttaaaagaaaaattacttaaagaatgaataaatgagatcctaaaagtgttgtcatcgaagacagtgagccattgtgtgtggatctctgcttttgttttgtacctagtaattatattgcagtgtcattgaagaccacataatcttcactgaacataaatgtgttcatctaaagcaatctcttagtacatcaatttggtgcattttaattagagaaaatcattttctctattgaagagaatccatccactcatgtcctataaattatagtaaataaggaaaagcatatataacattctgaatttcctaggtgtctttggaaacaggtaagttactcaggtgaataaaggtgaaaaaagtcttgtcagaaaaggaatgattatattagccaaatttaattaccaggttttgatcttcattaagcaaagcaaagaacttctttactgattccttgtccttcagtaaggaaaaagacaaaactctccttagtttacacattatttatggtcagtttttaataaatcttgttttttttcttaaccagcaagagaattgatacaaagtataaatccagagtcatgtagaaaacttggaagtattaataaaacagattacagtttgtgcactgaatagtcatcttaattgattgtttaatggagaagcaaactggatgaccttagacaaaataacatttatctatgaagcttattttcctcatctttaaaacagaactacaaaaatgcagagagttcaagggcaggcacatagttgataactggtgctagttcttctatttaattatattccatctttgttgagagatttgaggtagctcctgttgcagtattaatttataatattttaaaagttagagaactttcctttgggatgttttaaaattatttccctggtcataattaatattagggtctgtttatttcaaatacaaaatattttaatcttttcttcctactgggttaagaccaaatgagatgtttgtttttaatgtataaaatcttatacagtgtatgttagctgcaacttctcaggaattctgaatcttagaacttttttattgaaagagatcttagaagccatctaaccaacccagattgcttaatgattgtctgggttcacatagctatgggtgatagaaaccgggattcgttgtgaccagtaattctccattctccctaatgtgcagcacatctccagtacttctgaatagattacacagcttttctttggctagtttgggggcttgacctgatgcaaaaaggaatttttttcctctgccaacaaaatttctcactgcactgcttgctacacagacaagattcaaaataaaagtaatggtgggtcaggtgccatggctcatgcctgtaatcccagcactttgggaggccgaggtgggcagatcacgaggtcagatcaagaccattctggccaacatggtaaaaccccgtctctactaaaaatagaaaaattaaatgttacatgaaaaacatatttgaaactgtactgccatttgtgtaaaacaaggtatgtggtgtgtgaacatcttatttgcatatgcatataattatctctaaggatgcacgagaaaccagtgataattatgcctccaagaagaggttcaactaggtgggctgcttagaatctagttttgtattatttggacttttgttcacattatcctttcaaaatacattttaaaaatactatatgcaccgaggtgggtggatcatctgaactcaggagttcgagaccagcctgggcaacatggcgaaaccttgtctctaccaaaaatacagagaattagctggctgtggtggtgtgcgcctgtagtcccagctactcaggaggctaagataggaggatcacttgagcctgggaggtgcaggttgcagtgagctggaattgtgcaactgcactccagcctgggtgacagagtgagaccctgtctcaaaaaaaaaaaaaaaaaaa

SEQ ID NO: 195366 - DNA, 2042 bp, Homo sapiens
  Payload ID: 18578
  Gene Name: tRNA-yW synthesizing protein 5
  ENST ID: ENST00000441832
  CDS Start-End: 34-399
cgaagacctggaagagggcaggcgtgagcaaccatggccgggcagcacctcccggtaccccggctggagggcgtttctcgggagcagttcatgcagcacctctacccacagagaaaacctcttgtgttggaagggattgatttggggccatgtacaagcaaatggacagtggattacctaagccaagttggagggaagaaagaagtaaagattcatgttgctgcagttgcacagatggacttcattaaactttaccttttgaccagttggtccagagggcagctgaagagaaacataaagaattctttgtttcagaggatgagaaatactacttacggtcacttggagaagaccctagaaaggatgttgcagatatcagaaagcagtttcctttgttgaaaggagatattaagtttccagaattcttcaaagaggaacagttcttttccagtgtttttcgaattagttcaccaggattacaactatggactcattatgatgtactaaatcagaagtactgaatatagataacccagacttggctaaatatccacttttttccaaggctagaagatatgaatgttcccttgaagctggtgatgtattattcattcctgctttatggttccataatgtaatttctgaagagtttggagtgggagtgaatatcttttggaagcaccttccatctgaatgctatgataaaacagatacctatggaaacaaagatcctacagcagcatcaagagctgcacaaattctggacagagccttgaaaacactggccgagttaccagaggaatatagggacttctatgcacgacgaatggtcctacacattcaagacaaagcctacagcaagaactctgagtaaataatgaagtgaatgcaatgcacattaacactttagtaaggtataacgatataaattaaagattttgttaaaataggaaagatacatcagatttacagattatgtaagtacgaaggggtgtttgtgtggattctacttgatacagattgttataattaaagaatgctgtgctgggaccactctttaacattcagatgctgaccactaaaagtccaacttaaaatgacttaaaaacagtaagaaaatatattgattcacaatacatgaaatctattgacagaatgtgctgcagtgtttctgatccaatgattcagtaatgtcatcaagaaccttgggaacccgcctccacaccccacccccttttcaaccacaacattggcatcatcctaaggctggctaccctcgtggtcatgggatgattgccagtagcagttggagccttgtgcatcttcatttacatgcagcggaagagtcaggctggattctaggggccctgtcctagtatgagaaagctttcccagaattcactttccatatccttaggtctcattgctctaaagtaacttagacctgtccatccctgagccagtcactggcaaagggtctagaataacctttagggcagtcaggtccactggagctgagagtagaagtggaggccacatgagggatatatggggacagaaaggatagtttttttaaaatcatggttctgataggaaaaacatgagcaacgcacaatatctattacatttgcctagaagcagaattttttgaggaactttaaaaaatgtacagatacctaggtcccaactttgtagactgattcaagagtgtttgggatttggtataggaacttaatagacctcacagggtgttctgatgcataatcagagctgagatcaactggagttgatgatagtgacttggattattagttttgtgattagtgcaaaacaaatgtttaatctgatcttgacttttcttgccacccagtatgtcagggtggtttttggtttttgaatgttacaaaataaataatttatacctatgtctaaaccttagcctagttaaagatttcccaactattttttccacctatcccttttttaaaagaaaaattacttaaagaatgaataaatgagatcctaaaagtgttgtcatcgaa

SEQ ID NO: 195367 - DNA, 4287 bp, Homo sapiens
  Payload ID: 18578
  Gene Name: tRNA-yW synthesizing protein 5
  ENST ID: ENST00000483328
  CDS Start-End: 267-632
gcctcagcggtgtcggagaaagagactggagagcaaagtggacctgttgctgcagcctctggtgagtcggccccgtccccgctctccagcacgcagcccaggccgaggcccttcggcaacccgccccgcgctcggacccagccactctggagtctgccggcctcgcggaccttttctctgtcgctcgtgtttccgggcggatggcgctgaggaacgctttagagccgaagttccgaagacctggaagagggcaggcgtgagcaaccatggccgggcagcacctcccggtaccccggctggagggcgtttctcgggagcagttcatgcagcacctctacccacagagaaaacctcttgtgttggaagggattgatttggggccatgtacaagcaaatggacagtggattacctaagccaagttggagggaagaaagaagtaaagattcatgttgctgcagttgcacagatggacttcattaaactttaccttttgaccagttggtccagagggcagctgaagagaaacataaagaattctttgtttcagaggatgagaaatactacttacggtcacttggagaagaccctagaaaggatgttgcagatatcagaaagcagtttcctttgttgaaaggagatattaagtttccagaattcttcaaagaggaacagttcttttccagtgtttttcgaattagttcaccaggattacaactatggactcattatgatgtaatggataatttgttaatacaagtgacaggaaaaaagcgtgttgtactcttcagtcctcgagatgcccagtatttatatttaaaaggtactaaatcagaagtactgaatatagataacccagacttggctaaatatccacttttttccaaggctagaagatatgaatgttcccttgaagctggtgatgtattattcattcctgctttatggttccataatgtaatttctgaagagtttggagtgggagtgaatatcttttggaagcaccttccatctgaatgctatgataaaacagatacctatggaaacaaagatcctacagcagcatcaagagctgcacaaattctggacagagccttgaaaacactggccgagttaccagaggaatatagggacttctatgcacgacgaatggtcctacacattcaagacaaagcctacagcaagaactctgagtaaataatgaagtgaatgcaatgcacattaacactttagtaaggtataacgatataaattaaagattttgttaaaataggaaagatacatcagatttacagattatgtaagtacgaaggggtgtttgtgtggattctacttgatacagattgttataattaaagaatgctgtgctgggaccactctttaacattcagatgctgaccactaaaagtccaacttaaaatgacttaaaaacagtaagaaaatatattgattcacaatacatgaaatctattgacagaatgtgctgcagtgtttctgatccaatgattcagtaatgtcatcaagaaccttgggaacccgcctccacaccccacccccttttcaaccacaacattggcatcatcctaaggctggctaccctcgtggtcatgggatgattgccagtagcagttggagccttgtgcatcttcatttacatgcagcggaagagtcaggctggattctaggggccctgtcctagtatgagaaagctttcccagaattcactttccatatccttaggtctcattgctctaaagtaacttagacctgtccatccctgagccagtcactggcaaagggtctagaataacctttagggcagtcaggtccactggagctgagagtagaagtggaggccacatgagggatatatggggacagaaaggatagtttttttaaaatcatggttctgataggaaaaacatgagcaacgcacaatatctattacatttgcctagaagcagaattttttgaggaactttaaaaaatgtacagatacctaggtcccaactttgtagactgattcaagagtgtttgggatttggtataggaacttaatagacctcacagggtgttctgatgcataatcagagctgagatcaactggagttgatgatagtgacttggattattagttttgtgattagtgcaaaacaaatgtttaatctgatcttgacttttcttgccacccagtatgtcagggtggtttttggtttttgaatgttacaaaataaataatttatacctatgtctaaaccttagcctagttaaagatttcccaactattttttccacctatcccttttttaaaagaaaaattacttaaagaatgaataaatgagatcctaaaagtgttgtcatcgaagacagtgagccattgtgtgtggatctctgcttttgttttgtacctagtaattatattgcagtgtcattgaagaccacataatcttcactgaacataaatgtgttcatctaaagcaatctcttagtacatcaatttggtgcattttaattagagaaaatcattttctctattgaagagaatccatccactcatgtcctataaattatagtaaataaggaaaagcatatataacattctgaatttcctaggtgtctttggaaacaggtaagttactcaggtgaataaaggtgaaaaaagtcttgtcagaaaaggaatgattatattagccaaatttaattaccaggttttgatcttcattaagcaaagcaaagaacttctttactgattccttgtccttcagtaaggaaaaagacaaaactctccttagtttacacattatttatggtcagtttttaataaatcttgttttttttcttaaccagcaagagaattgatacaaagtataaatccagagtcatgtagaaaacttggaagtattaataaaacagattacagtttgtgcactgaatagtcatcttaattgattgtttaatggagaagcaaactggatgaccttagacaaaataacatttatctatgaagcttattttcctcatctttaaaacagaactacaaaaatgcagagagttcaagggcaggcacatagttgataactggtgctagttcttctatttaattatattccatctttgttgagagatttgaggtagctcctgttgcagtattaatttataatattttaaaagttagagaactttcctttgggatgttttaaaattatttccctggtcataattaatattagggtctgtttatttcaaatacaaaatattttaatcttttcttcctactgggttaagaccaaatgagatgtttgtttttaatgtataaaatcttatacagtgtatgttagctgcaacttctcaggaattctgaatcttagaacttttttattgaaagagatcttagaagccatctaaccaacccagattgcttaatgattgtctgggttcacatagctatgggtgatagaaaccgggattcgttgtgaccagtaattctccattctccctaatgtgcagcacatctccagtacttctgaatagattacacagcttttctttggctagtttgggggcttgacctgatgcaaaaaggaatttttttcctctgccaacaaaatttctcactgcactgcttgctacacagacaagattcaaaataaaagtaatggtgggtcaggtgccatggctcatgcctgtaatcccagcactttgggaggccgaggtgggcagatcacgaggtcagatcaagaccattctggccaacatggtaaaaccccgtctctactaaaaatagaaaaattaaatgttacatgaaaaacatatttgaaactgtactgccatttgtgtaaaacaaggtatgtggtgtgtgaacatcttatttgcatatgcatataattatctctaaggatgcacgagaaaccagtgataattatgcctccaagaagaggttcaactaggtgggctgcttagaatctagttttgtattatttggacttttgttcacattatcctttcaaaatacattttaaaaatactatatgcaccgaggtgggtggatcatctgaactcaggagttcgagaccagcctgggcaacatggcgaaaccttgtctctaccaaaaatacagagaattagctggctgtggtggtgtgcgcctgtagtcccagctactcaggaggctaagataggaggatcacttgagcctgggaggtgcaggttgcagtgagctggaattgtgcaactgcactccagcctgggtgacagagtgagaccctgtctcaaaaaaaaaaaaaaaaaaa

SEQ ID NO: 195368 - DNA, 4647 bp, Homo sapiens
  Payload ID: 18579
  Gene Name: trophinin
  Uniprot ID: Q12816
  ENST ID: ENST00000173898
  CDS Start-End: 113-4408
gggggataggctcagacacaaggagaggcttggagagagcagacgccttctggattcaagaagacgaggcccattcccctcaggctcacctgttactcggcctcccagaaagatggataggagaaatgactacggatatagggtgcctctatttcagggccctctgcctcccccggggagcctggggcttcccttccctccagatatacagactgagaccacagaagaggacagtgtcctgctgatgcataccctgttggcggcaaccaaggactccctggccatggacccaccagttgtcaaccggcctaagaaaagcaagaccaagaaggcccctataaagactattactaaggctgcacctgctgcccctccagtcccagctgccaatgagattgccaccaacaagcccaaaataacttggcaggctttaaacctgccagtcattacccagatcagccaggctttacctaccactgaggtaaccaatactcaggcttcttcagtcactgctcagcctaagaaagccaacaagatgaagagagttactgccaaggcagcccaaggctcccaatccccaactggccatgagggtggcactatacagctgaagtcacccttgcaggtcctaaagctaccagtcatctcacagaatattcacgctccaattgccaatgagtcagccagttcccaagccttgataacctctatcaagcctaagaaagcttccaaggctaagaaggctgcaaataaggccatagctagtgccaccgaggtctcgctggctgcaactgccacccatacagctaccacccaaggccaaattaccaatgagacagccagtatccacaccacagcagcctccatccgaaccaagaaagcctccaaagccaggaagacaattgctaaggtcataaatactgacactgagcatatagaggctctaaatgtcactgacgcagctaccaggcagattgaggcctcagtagtggctatcaggcccaaaaaatccaagggcaagaaggctgccagcaggggcccaaattctgtctctgagatctctgaggccccacttgccactcagatagtcacaaaccaagccctggcagccaccctgcgggtcaagagagggtctagggctcggaaggctgccactaaggctcgggcaactgaaagccagactccaaatgctgaccaaggggcccaggccaagatagcctctgctcagaccaacgtaagtgcccttgagactcaggttgctgctgctgtccaggccctggcagatgactatctggctcagttgagcctggagcccacaaccaggacccggggcaaaagaaaccgaaagtccaagcatctgaatggggatgagagaagtggcagtaattacaggcggatcccatggggccggaggcctgcaccaccgcgagatgtggccattttacaagaaagggctaataagttggtgaaatacctgttggttaaggaccagacaaagatccccatcaaacgctcagacatgctgagggatgtcatccaagaatatgatgaatatttcccagaaatcattgaacgagcaagctacactctggagaagatgtttcgagtcaatctgaaagaaattgataagcaaagtagcttgtatattctcatcagcactcaggaatcctctgcaggcatactgggaacgaccaaggacacacccaagctgggtctcctcatggtgattctgagtgtcatttttatgaatggcaacaaggccagtgaggctgtcatctgggaggtgctgcgcaagttggggctgcgccctggggtgaggcattcactctttggggaagtgaggaagctcatcacagacgagtttgtgaagcagaagtacctggagtacaagagggtccctaacagcagaccacctgaatatgagttcttctggggcttgcgctcctaccacgagactagcaagatgaaagtcctcaagtttgcatgcagggtgcagaagaaagaccccaaggactgggctgtgcagtaccgcgaggcagtggagatggaagtccaagctgcagctgtggctgtggctgaggctgaagccagggctgaggcaagagcccaaatggggattggagaggaagctgtggctgggccctggaattgggatgacatggatatcgactgcctaacaagggaagagttaggcgatgatgctcaggcctggagcagattttcatttgaaattgaggccagagcccaagaaaatgcagatgccagcaccaacgtcaacttcagcagaggagctagtaccagggctggcttcagcgatggtgctagtattagcttcaatggtgcacccagctccagtggtggcttcagtggtggacctggcattacctttggtgttgcacccagcaccagtgccagcttcagcaatacagccagcattagctttggtggtacactgagcactagctccagcttcagcagcgcagccagcattagctttggttgtgcacacagcaccagcactagtttcagcagtgaagccagcattagctttggtggcatgccttgtaccagtgccagctttagtggtggagtcagctctagttttagtggcccactcagcaccagtgccactttcagtggtggagccagctctggctttggaggcacactcagcaccacggctggctttagtggtgtactcagcactagcaccagctttggcagtgcacccacaacgagcacagtcttcagtagtgcgcttagcaccagcactggctttggaggcatactcagcaccagtgtctgttttggtggctctcccagctccagtggtagctttggtggtacactcagtaccagtatctgcttcggtggctctccctgcaccagcactggctttggaggcacacttagcaccagtgtctcctttggtggctcttccagcaccagtgccaattttggtggtacactaagtaccagcatctgctttgatggctctcccagcactggtgctggctttggtggtgctctcaacaccagtgccagctttggcagtgtgctcaacaccagtactggttttggtggtgctatgagcaccagtgctgactttggcggtacactaagcaccagtgtctgctttggtggctctcctggcaccagtgtcagctttggcagtgcactcaacaccaatgctggttatggtggtgctgtcagcaccaacactgactttggtggtacactaagcaccagcgtctgttttggtggctctcccagcaccagtgctggctttggtggtgcactcaacaccaatgccagctttggctgtgccgtcagcaccagtgccagcttcagtggtgctgtcagcaccagtgcttgcttcagtggtgcaccaatcaccaaccctggctttggcggtgcatttagcaccagtgctggcttcggtggggcacttagtaccgctgctgacttcggtggtactcccagcaacagcattggctttggtgctgctcccagcaccagtgtcagctttggtggtgctcatggcaccagcctctgttttggtggagctcccagcaccagcctctgctttggcagtgcatctaatactaacctatgctttggtggccctcctagcaccagtgcctgctttagtggtgctaccagccctagtttttgtgatggacccagcaccagtaccggtttcagctttggcaatgggttaagcaccaatgctggatttggtggtggactgaacaccagtgctggctttggtggtggcctaggcaccagtgctggcttcagtggtggcctaagcacaagttctggctttgatggtgggctaggtaccagcgctggcttcggtggaggaccaggcaccagcactggttttggtggtggactgggcaccagtgctggcttcagtggcggactgggcaccagtgctggctttggtggtggactggtcactagtgatggctttggtggtggactgggcaccaatgctagtttcggcagcacacttggcaccagtgctggctttagtggtggcctcagcaccagcgatggctttggcagtaggcctaatgccagcttcgacagaggactgagtaccatcattggctttggcagtggttccaacaccagcactggctttactggcgaacccagcaccagcacgggcttcagtagtggacccagttctattgttggcttcagcggtggaccaagcactggtgttggcttctgcagtggaccaagcaccagtggcttcagcggtggaccgagcacaggagctggcttcggcggtggaccaaacactggtgctggctttggtggtggaccgagcaccagtgctggctttggcagtggagccgccagtcttggtgcctgtggcttctcgtatggctagtgaggtttcagatttattccccatgtttacagataccgctaataaattgcagtagtccttcccatggagccaaagtacatccttggaatctttgtccacacagcagtcaaggcagttatggccaatcagctgagggtgtcatgtgatggaaaaatctgtttgctgttcctgctttattgtttgctttctgtgtgctgtcatattttggtatcagagttacattaaatttgcaaaatgaa

SEQ ID NO: 195369 - DNA, 2326 bp, Homo sapiens
  Payload ID: 18579
  Gene Name: trophinin
  Uniprot ID: Q12816
  ENST ID: ENST00000319167
  CDS Start-End: 113-2233
gggggataggctcagacacaaggagaggcttggagagagcagacgccttctggattcaagaagacgaggcccattcccctcaggctcacctgttactcggcctcccagaaagatggataggagaaatgactacggatatagggtgcctctatttcagggccctctgcctcccccggggagcctggggcttcccttccctccagatatacagactgagaccacagaagaggacagtgtcctgctgatgcataccctgttggcggcaaccaaggactccctggccatggacccaccagttgtcaaccggcctaagaaaagcaagaccaagaaggcccctataaagactattactaaggctgcacctgctgcccctccagtcccagctgccaatgagattgccaccaacaagcccaaaataacttggcaggctttaaacctgccagtcattacccagatcagccaggctttacctaccactgaggtaaccaatactcaggcttcttcagtcactgctcagcctaagaaagccaacaagatgaagagagttactgccaaggcagcccaaggctcccaatccccaactggccatgagggtggcactatacagctgaagtcacccttgcaggtcctaaagctaccagtcatctcacagaatattcacgctccaattgccaatgagtcagccagttcccaagccttgataacctctatcaagcctaagaaagcttccaaggctaagaaggctgcaaataaggccatagctagtgccaccgaggtctcgctggctgcaactgccacccatacagctaccacccaaggccaaattaccaatgagacagccagtatccacaccacagcagcctccatccgaaccaagaaagcctccaaagccaggaagacaattgctaaggtcataaatactgacactgagcatatagaggctctaaatgtcactgacgcagctaccaggcagattgaggcctcagtagtggctatcaggcccaaaaaatccaagggcaagaaggctgccagcaggggcccaaattctgtctctgagatctctgaggccccacttgccactcagatagtcacaaaccaagccctggcagccaccctgcgggtcaagagagggtctagggctcggaaggctgccactaaggctcgggcaactgaaagccagactccaaatgctgaccaaggggcccaggccaagatagcctctgctcagaccaacgtaagtgcccttgagactcaggttgctgctgctgtccaggccctggcagatgactatctggctcagttgagcctggagcccacaaccaggacccggggcaaaagaaaccgaaagtccaagcatctgaatggggatgagagaagtggcagtaattacaggcggatcccatggggccggaggcctgcaccaccgcgagatgtggccattttacaagaaagggctaataagttggtgaaatacctgttggttaaggaccagacaaagatccccatcaaacgctcagacatgctgagggatgtcatccaagaatatgatgaatatttcccagaaatcattgaacgagcaagctacactctggagaagatgtttcgagtcaatctgaaagaaattgataagcaaagtagcttgtatattctcatcagcactcaggaatcctctgcaggcatactgggaacgaccaaggacacacccaagctgggtctcctcatggtgattctgagtgtcatttttatgaatggcaacaaggccagtgaggctgtcatctgggaggtgctgcgcaagttggggctgcgccctggggtgaggcattcactctttggggaagtgaggaagctcatcacagacgagtttgtgaagcagaagtacctggagtacaagagggtccctaacagcagaccacctgaatatgagttcttctggggcttgcgctcctaccacgagactagcaagatgaaagtcctcaagtttgcatgcagggtgcagaagaaagaccccaaggactgggctgtgcagtaccgcgaggcagtggagatggaagtccaagctgcagctgtggctgtggctgaggctgaagccagggctgagatttattccccatgtttacagataccgctaataaattgcagtagtccttcccatggagccaaagtacatccttggaatctttgtccacacagcagtcaaggcagttatggccaatcagctgagggtgtcatgtgatggaaaaatctgtttgctgttcctgctttattgtttgctttctgtgtgctgtcatattttggtatcagagttacattaaatttgcaaaatgaa

SEQ ID NO: 195370 - DNA, 2306 bp, Homo sapiens
  Payload ID: 18579
  Gene Name: trophinin
  Uniprot ID: Q12816
  ENST ID: ENST00000375022
  CDS Start-End: 93-2213
ataggctcagacacaaggagaggcttggagagagcagacgccttctggattcaagaagacgaggctcacctgttactcggcctcccagaaagatggataggagaaatgactacggatatagggtgcctctatttcagggccctctgcctcccccggggagcctggggcttcccttccctccagatatacagactgagaccacagaagaggacagtgtcctgctgatgcataccctgttggcggcaaccaaggactccctggccatggacccaccagttgtcaaccggcctaagaaaagcaagaccaagaaggcccctataaagactattactaaggctgcacctgctgcccctccagtcccagctgccaatgagattgccaccaacaagcccaaaataacttggcaggctttaaacctgccagtcattacccagatcagccaggctttacctaccactgaggtaaccaatactcaggcttcttcagtcactgctcagcctaagaaagccaacaagatgaagagagttactgccaaggcagcccaaggctcccaatccccaactggccatgagggtggcactatacagctgaagtcacccttgcaggtcctaaagctaccagtcatctcacagaatattcacgctccaattgccaatgagtcagccagttcccaagccttgataacctctatcaagcctaagaaagcttccaaggctaagaaggctgcaaataaggccatagctagtgccaccgaggtctcgctggctgcaactgccacccatacagctaccacccaaggccaaattaccaatgagacagccagtatccacaccacagcagcctccatccgaaccaagaaagcctccaaagccaggaagacaattgctaaggtcataaatactgacactgagcatatagaggctctaaatgtcactgacgcagctaccaggcagattgaggcctcagtagtggctatcaggcccaaaaaatccaagggcaagaaggctgccagcaggggcccaaattctgtctctgagatctctgaggccccacttgccactcagatagtcacaaaccaagccctggcagccaccctgcgggtcaagagagggtctagggctcggaaggctgccactaaggctcgggcaactgaaagccagactccaaatgctgaccaaggggcccaggccaagatagcctctgctcagaccaacgtaagtgcccttgagactcaggttgctgctgctgtccaggccctggcagatgactatctggctcagttgagcctggagcccacaaccaggacccggggcaaaagaaaccgaaagtccaagcatctgaatggggatgagagaagtggcagtaattacaggcggatcccatggggccggaggcctgcaccaccgcgagatgtggccattttacaagaaagggctaataagttggtgaaatacctgttggttaaggaccagacaaagatccccatcaaacgctcagacatgctgagggatgtcatccaagaatatgatgaatatttcccagaaatcattgaacgagcaagctacactctggagaagatgtttcgagtcaatctgaaagaaattgataagcaaagtagcttgtatattctcatcagcactcaggaatcctctgcaggcatactgggaacgaccaaggacacacccaagctgggtctcctcatggtgattctgagtgtcatttttatgaatggcaacaaggccagtgaggctgtcatctgggaggtgctgcgcaagttggggctgcgccctggggtgaggcattcactctttggggaagtgaggaagctcatcacagacgagtttgtgaagcagaagtacctggagtacaagagggtccctaacagcagaccacctgaatatgagttcttctggggcttgcgctcctaccacgagactagcaagatgaaagtcctcaagtttgcatgcagggtgcagaagaaagaccccaaggactgggctgtgcagtaccgcgaggcagtggagatggaagtccaagctgcagctgtggctgtggctgaggctgaagccagggctgagatttattccccatgtttacagataccgctaataaattgcagtagtccttcccatggagccaaagtacatccttggaatctttgtccacacagcagtcaaggcagttatggccaatcagctgagggtgtcatgtgatggaaaaatctgtttgctgttcctgctttattgtttgctttctgtgtgctgtcatattttggtatcagagttacattaaatttgcaaaatgaa

SEQ ID NO: 195371 - DNA, 3488 bp, Homo sapiens
  Payload ID: 18579
  Gene Name: trophinin
  Uniprot ID: Q12816
  ENST ID: ENST00000375041
  CDS Start-End: 145-3249
agacgccttctggattcaagaagacgaggtgagctgaggtacctggctttagtgaagaccctgtgggggcttcctggctgcggcttcgacgtgcctgactccacacgcccctaaggctcacctgttactcggcctcccagaaagatggataggagaaatgactacggatatagggtgcctctatttcagtccaagcatctgaatggggatgagagaagtggcagtaattacaggcggatcccatggggccggaggcctgcaccaccgcgagatgtggccattttacaagaaagggctaataagttggtgaaatacctgttggttaaggaccagacaaagatccccatcaaacgctcagacatgctgagggatgtcatccaagaatatgatgaatatttcccagaaatcattgaacgagcaagctacactctggagaagatgtttcgagtcaatctgaaagaaattgataagcaaagtagcttgtatattctcatcagcactcaggaatcctctgcaggcatactgggaacgaccaaggacacacccaagctgggtctcctcatggtgattctgagtgtcatttttatgaatggcaacaaggccagtgaggctgtcatctgggaggtgctgcgcaagttggggctgcgccctggggtgaggcattcactctttggggaagtgaggaagctcatcacagacgagtttgtgaagcagaagtacctggagtacaagagggtccctaacagcagaccacctgaatatgagttcttctggggcttgcgctcctaccacgagactagcaagatgaaagtcctcaagtttgcatgcagggtgcagaagaaagaccccaaggactgggctgtgcagtaccgcgaggcagtggagatggaagtccaagctgcagctgtggctgtggctgaggctgaagccagggctgaggcaagagcccaaatggggattggagaggaagctgtggctgggccctggaattgggatgacatggatatcgactgcctaacaagggaagagttaggcgatgatgctcaggcctggagcagattttcatttgaaattgaggccagagcccaagaaaatgcagatgccagcaccaacgtcaacttcagcagaggagctagtaccagggctggcttcagcgatggtgctagtattagcttcaatggtgcacccagctccagtggtggcttcagtggtggacctggcattacctttggtgttgcacccagcaccagtgccagcttcagcaatacagccagcattagctttggtggtacactgagcactagctccagcttcagcagcgcagccagcattagctttggttgtgcacacagcaccagcactagtttcagcagtgaagccagcattagctttggtggcatgccttgtaccagtgccagctttagtggtggagtcagctctagttttagtggcccactcagcaccagtgccactttcagtggtggagccagctctggctttggaggcacactcagcaccacggctggctttagtggtgtactcagcactagcaccagctttggcagtgcacccacaacgagcacagtcttcagtagtgcgcttagcaccagcactggctttggaggcatactcagcaccagtgtctgttttggtggctctcccagctccagtggtagctttggtggtacactcagtaccagtatctgcttcggtggctctccctgcaccagcactggctttggaggcacacttagcaccagtgtctcctttggtggctcttccagcaccagtgccaattttggtggtacactaagtaccagcatctgctttgatggctctcccagcactggtgctggctttggtggtgctctcaacaccagtgccagctttggcagtgtgctcaacaccagtactggttttggtggtgctatgagcaccagtgctgactttggcggtacactaagcaccagtgtctgctttggtggctctcctggcaccagtgtcagctttggcagtgcactcaacaccaatgctggttatggtggtgctgtcagcaccaacactgactttggtggtacactaagcaccagcgtctgttttggtggctctcccagcaccagtgctggctttggtggtgcactcaacaccaatgccagctttggctgtgccgtcagcaccagtgccagcttcagtggtgctgtcagcaccagtgcttgcttcagtggtgcaccaatcaccaaccctggctttggcggtgcatttagcaccagtgctggcttcggtggggcacttagtaccgctgctgacttcggtggtactcccagcaacagcattggctttggtgctgctcccagcaccagtgtcagctttggtggtgctcatggcaccagcctctgttttggtggagctcccagcaccagcctctgctttggcagtgcatctaatactaacctatgctttggtggccctcctagcaccagtgcctgctttagtggtgctaccagccctagtttttgtgatggacccagcaccagtaccggtttcagctttggcaatgggttaagcaccaatgctggatttggtggtggactgaacaccagtgctggctttggtggtggcctaggcaccagtgctggcttcagtggtggcctaagcacaagttctggctttgatggtgggctaggtaccagcgctggcttcggtggaggaccaggcaccagcactggttttggtggtggactgggcaccagtgctggcttcagtggcggactgggcaccagtgctggctttggtggtggactggtcactagtgatggctttggtggtggactgggcaccaatgctagtttcggcagcacacttggcaccagtgctggctttagtggtggcctcagcaccagcgatggctttggcagtaggcctaatgccagcttcgacagaggactgagtaccatcattggctttggcagtggttccaacaccagcactggctttactggcgaacccagcaccagcacgggcttcagtagtggacccagttctattgttggcttcagcggtggaccaagcactggtgttggcttctgcagtggaccaagcaccagtggcttcagcggtggaccgagcacaggagctggcttcggcggtggaccaaacactggtgctggctttggtggtggaccgagcaccagtgctggctttggcagtggagccgccagtcttggtgcctgtggcttctcgtatggctagtgaggtttcagatttattccccatgtttacagataccgctaataaattgcagtagtccttcccatggagccaaagtacatccttggaatctttgtccacacagcagtcaaggcagttatggccaatcagctgagggtgtcatgtgatggaaaaatctgtttgctgttcctgctttattgtttgctttctgtgtgctgtcatattttggtatcagagttacattaaatttgcaaaatgaa

SEQ ID NO: 195372 - DNA, 1115 bp, Homo sapiens
  Payload ID: 18579
  Gene Name: trophinin
  Uniprot ID: Q12816
  ENST ID: ENST00000399736
  CDS Start-End: 93-1022
ataggctcagacacaaggagaggcttggagagagcagacgccttctggattcaagaagacgaggctcacctgttactcggcctcccagaaagatggataggagaaatgactacggatatagggtgcctctatttcagtccaagcatctgaatggggatgagagaagtggcagtaattacaggcggatcccatggggccggaggcctgcaccaccgcgagatgtggccattttacaagaaagggctaataagttggtgaaatacctgttggttaaggaccagacaaagatccccatcaaacgctcagacatgctgagggatgtcatccaagaatatgatgaatatttcccagaaatcattgaacgagcaagctacactctggagaagatgtttcgagtcaatctgaaagaaattgataagcaaagtagcttgtatattctcatcagcactcaggaatcctctgcaggcatactgggaacgaccaaggacacacccaagctgggtctcctcatggtgattctgagtgtcatttttatgaatggcaacaaggccagtgaggctgtcatctgggaggtgctgcgcaagttggggctgcgccctggggtgaggcattcactctttggggaagtgaggaagctcatcacagacgagtttgtgaagcagaagtacctggagtacaagagggtccctaacagcagaccacctgaatatgagttcttctggggcttgcgctcctaccacgagactagcaagatgaaagtcctcaagtttgcatgcagggtgcagaagaaagaccccaaggactgggctgtgcagtaccgcgaggcagtggagatggaagtccaagctgcagctgtggctgtggctgaggctgaagccagggctgagatttattccccatgtttacagataccgctaataaattgcagtagtccttcccatggagccaaagtacatccttggaatctttgtccacacagcagtcaaggcagttatggccaatcagctgagggtgtcatgtgatggaaaaatctgtttgctgttcctgctttattgtttgctttctgtgtgctgtcatattttggtatcagagttacattaaatttgcaaaatgaa

SEQ ID NO: 195373 - DNA, 976 bp, Homo sapiens
  Payload ID: 18579
  Gene Name: trophinin
  ENST ID: ENST00000452830
  CDS Start-End: 764-976
agagaactacattcctcctaggggaaacaggagaatcaaataggaacggagatacagagtggggaatagagaagtcaaatggagaataagagggagtgataactgaataggggtagtaagaagaaaaagggagctacattgaggagaatggaaagttgaaagtaggtatggaggggaggagactgacaggcaggaacggagacccccctctggaggcggaaagaggcaggaccacttccggccagggagggggataggctcagacacaaggagaggcttggagagagcagacgccttctggattcaagaagacgaggctcacctgttactcggcctcccagaaagatggataggagaaatgactacggatatagggtgcctctatttcaggtgaggcctctctgcattctctctaggccatctgccccatcctgagttcacttactgctcttcagaccccttccaccgtgtagtttcataattccctgcctaactcgtctcagtcctcccttacatggtgaaggagaggagaggaaaacctgcctgactctattccttccttgctccctaccccattttaattaaccactgctcagaggaagggaaggcctttgtggaaagggatgggctttagcgaggccaaatggcccagaggatggtaatcctaagtgtgtagggccctctgcctcccccggggagcctggggcttcccttccctccagatatacagactgagaccacagaagaggacagtgtcctgctgatgcataccctgttggcggcaaccaaggactccctggccatggacccaccagttgtcaaccggcctaagaaaagcaagaccaagaaggcccctataaagactattactaaggctgcacctgctgcccctccagtcccagctgccaatgagattgccaccaacaagcccaaaataacttggcaggctttaaacctgccagtcattacccagatc

SEQ ID NO: 195374 - DNA, 1196 bp, Homo sapiens
  Payload ID: 18579
  Gene Name: trophinin
  ENST ID: ENST00000411534
  CDS Start-End: 505-1196
agagcagctctagggaagagagacatagacacaaggtataacaacactatgtaaatagtgttgggatagagggtctgtaggaagggttggtgtgggagttcagagaactacattcctcctaggggaaacaggagaatcaaataggaacggagatacagagtggggaatagagaagtcaaatggagaataagagggagtgataactgaataggggtagtaagaagaaaaagggagctacattgaggagaatggaaagttgaaagtaggtatggaggggaggagactgacaggcaggaacggagacccccctctggaggcggaaagaggcaggaccacttccggccagggagggggataggctcagacacaaggagaggcttggagagagcagacgccttctggattcaagaagacgagggccctctgcctcccccggggagcctggggcttcccttccctccagatatacagactgagaccacagaagaggacagtgtcctgctgatgcataccctgttggcggcaaccaaggactccctggccatggacccaccagttgtcaaccggcctaagaaaagcaagaccaagaaggcccctataaagactattactaaggctgcacctgctgcccctccagtcccagctgccaatgagattgccaccaacaagcccaaaataacttggcaggctttaaacctgccagtcattacccagatcagccaggctttacctaccactgaggtaaccaatactcaggcttcttcagtcactgctcagcctaagaaagccaacaagatgaagagagttactgccaaggcagcccaaggctcccaatccccaactggccatgagggtggcactatacagctgaagtcacccttgcaggtcctaaagctaccagtcatctcacagaatattcacgctccaattgccaatgagtcagccagttcccaagccttgataacctctatcaagcctaagaaagcttccaaggctaagaaggctgcaaataaggccatagctagtgccaccgaggtctcgctggctgcaactgccacccatacagctaccacccaaggccaaattaccaatgagacagccagtatccacaccacagcagcctccatccgaaccaagaaagcctccaaagccaggaagacaattgctaaggtcataaatactgacactgagcatat

SEQ ID NO: 195375 - DNA, 578 bp, Homo sapiens
  Payload ID: 18579
  Gene Name: trophinin
  ENST ID: ENST00000449980
  CDS Start-End: 210-578
aagtaacgatctggactcggttcgggccgtgaaagggagggatgcagacctagttgggaccgcagaaaggaaggatcgagaaatccttcagacggctcacctgttactcggcctcccagaaagatggataggagaaatgactacggatatagggtgcctctatttcagatatacagactgagaccacagaagaggacagtgtcctgctgatgcataccctgttggcggcaaccaaggactccctggccatggacccaccagttgtcaaccggcctaagaaaagcaagaccaagaaggcccctataaagactattactaaggctgcacctgctgcccctccagtcccagctgccaatgagattgccaccaacaagcccaaaataacttggcaggctttaaacctgccagtcattacccagatcagccaggctttacctaccactgaggtaaccaatactcaggcttcttcagtcactgctcagcctaagaaagccaacaagatgaagagagttactgccaaggcagcccaaggctcccaatccccaactggccatgagggtggcactatacagctgaag

SEQ ID NO: 195376 - DNA, 626 bp, Homo sapiens
  Payload ID: 18579
  Gene Name: trophinin
  ENST ID: ENST00000442098
  CDS Start-End: 123-626
acttccggccagggagggggataggctcagacacaaggagaggcttggagagagcagacgccttctggattcaagaagacgaggtgagctgaggctcacctgttactcggcctcccagaaagatggataggagaaatgactacggatatagggtgcctctatttcagggccctctgcctcccccggggagcctggggcttcccttccctccagatatacagactgagaccacagaagaggacagtgtcctgctgatgcataccctgttggcggcaaccaaggactccctggccatggacccaccagttgtcaaccggcctaagaaaagcaagaccaagaaggcccctataaagactattactaaggctgcacctgctgcccctccagtcccagctgccaatgagattgccaccaacaagcccaaaataacttggcaggctttaaacctgccagtcattacccagatcagccaggctttacctaccactgaggtaaccaatactcaggcttcttcagtcactgctcagcctaagaaagccaacaagatgaagagagttactgccaaggcagcccaaggctcccaatccccaactggccatgagggtggcactatacagctgaagtca

SEQ ID NO: 195377 - DNA, 594 bp, Homo sapiens
  Payload ID: 18579
  Gene Name: trophinin
  ENST ID: ENST00000416704
  CDS Start-End: 89-594
ccggtttgaaagggaagagacaggacctggtagggtttgagaacaggaatacacagaaggctcacctgttactcggcctcccagaaagatggataggagaaatgactacggatatagggtgcctctatttcagggccctctgcctcccccggggagcctggggcttcccttccctccagatatacagactgagaccacagaagaggacagtgtcctgctgatgcataccctgttggcggcaaccaaggactccctggccatggacccaccagttgtcaaccggcctaagaaaagcaagaccaagaaggcccctataaagactattactaaggctgcacctgctgcccctccagtcccagctgccaatgagattgccaccaacaagcccaaaataacttggcaggctttaaacctgccagtcattacccagatcagccaggctttacctaccactgaggtaaccaatactcaggcttcttcagtcactgctcagcctaagaaagccaacaagatgaagagagttactgccaaggcagcccaaggctcccaatccccaactggccatgagggtggcactatacagctgaagtcacc

SEQ ID NO: 195378 - DNA, 2597 bp, Homo sapiens
  Payload ID: 18579
  Gene Name: trophinin
  ENST ID: ENST00000445561
  CDS Start-End: 93-2138
ataggctcagacacaaggagaggcttggagagagcagacgccttctggattcaagaagacgaggctcacctgttactcggcctcccagaaagatggataggagaaatgactacggatatagggtgcctctatttcagggccctctgcctcccccggggagcctggggcttcccttccctccagatatacagactgagaccacagaagaggacagtgtcctgctgatgcataccctgttggcggcaaccaaggactccctggccatggacccaccagttgtcaaccggcctaagaaaagcaagaccaagaaggcccctataaagactattactaaggctgcacctgctgcccctccagtcccagctgccaatgagattgccaccaacaagcccaaaataacttggcaggctttaaacctgccagtcattacccagatcagccaggctttacctaccactgaggtaaccaatactcaggcttcttcagtcactgctcagcctaagaaagccaacaagatgaagagagttactgccaaggcagcccaaggctcccaatccccaactggccatgagggtggcactatacagctgaagtcacccttgcaggtcctaaagctaccagtcatctcacagaatattcacgctccaattgccaatgagtcagccagttcccaagccttgataacctctatcaagcctaagaaagcttccaaggctaagaaggctgcaaataaggccatagctagtgccaccgaggtctcgctggctgcaactgccacccatacagctaccacccaaggccaaattaccaatgagacagccagtatccacaccacagcagcctccatccgaaccaagaaagcctccaaagccaggaagacaattgctaaggtcataaatactgacactgagcatatagaggctctaaatgtcactgacgcagctaccaggcagattgaggcctcagtagtggctatcaggcccaaaaaatccaagggcaagaaggctgccagcaggggcccaaattctgtctctgagatctctgaggccccacttgccactcagatagtcacaaaccaagccctggcagccaccctgcgggtcaagagagggtctagggctcggaaggctgccactaaggctcgggcaactgaaagccagactccaaatgctgaccaaggggcccaggccaagatagcctctgctcagaccaacgtaagtgcccttgagactcaggttgctgctgctgtccaggccctggcagatgactatctggctcagttgagcctggagcccacaaccaggacccggggcaaaagaaaccgaaagtccaagcatctgaatggggatgagagaagtggcagtaattacaggcggatcccatggggccggaggcctgcaccaccgcgagatgtggccattttacaagaaagggctaataagttggtgaaatacctgttggttaaggaccagacaaagatccccatcaaacgctcagacatgctgagggatgtcatccaagaatatgatgaatatttcccagaaatcattgaacgagcaagctacactctggagaagatgtttcgagtcaatctgaaagaaattgataagcaaagtagcttgtatattctcatcagcactcaggaatcctctgcaggcatactgggaacgaccaaggacacacccaagctgggtctcctcatggtgattctgagtgtcatttttatgaatggcaacaaggccagtgaggctgtcatctgggaggtgctgcgcaagttggggctgcgccctggggtgaggcattcactctttggggaagtgaggaagctcatcacagacgagtttgtgaagcagaagtacctggagtacaagagggtccctaacagcagaccacctgaatatgagttcttctggggcttgcgctcctaccacgagactagcaagatgaaagtcctcaagtttgcatgcagggtgcagaagaaagaccccaaggactgggctgtgcagtaccgcgaggcagtggagatggaagtccaagctgcagctgtggctgtggctgaggctgaagccagggctgagtggttccaacaccagcactggctttactggcgaacccagcaccagcacgggcttcagtagtggacccagttctattgttggcttcagcggtggaccaagcactggtgttggcttctgcagtggaccaagcaccagtggcttcagcggtggaccgagcacaggagctggcttcggcggtggaccaaacactggtgctggctttggtggtggaccgagcaccagtgctggctttggcagtggagccgccagtcttggtgcctgtggcttctcgtatggctagtgaggtttcagatttattccccatgtttacagataccgctaataaattgcagtagtccttcccatggagccaaagtacatccttggaatctttgtccacacagcagtcaaggcagttatggccaatcagctgagggtgtcatgtgatggaaaaatctgtttgctgttcctgctttattgtttgctttctgtgtgctgtcatattttggtatcagagttacattaaatttgcaaaatgaa

SEQ ID NO: 195379 - DNA, 599 bp, Homo sapiens
  Payload ID: 18579
  Gene Name: trophinin
  ENST ID: ENST00000440072
  CDS Start-End: 590-599
agacacaaggagaggcttggagagagcagacgccttctggattcaagaagacgaggtgagctgaggtacctggctttagtgaagaccctgtgggggcttcctggctgcggcttcgacgtgcctgactccacacgcccctaaggctcacctgttactcggcctcccagaaagatggataggagaaatgactacggatatagggtgcctctatttcaggtgaggcctctctgcattctctctaggccatctgccccatcctgagttcacttactgctcttcagaccccttccaccgtgtagtttcataattccctgcctaactcgtctcagtcctcccttacatggtgaaggagaggagaggaaaacctgcctgactctattccttccttgctccctaccccattttaattaaccactgctcagaggaagggaaggcctttgtggaaagggatgggctttagcgaggccaaatggcccagaggatggtaatcctaagtgtgtagggccctctgcctcccccggggagcctggggcttcccttccctccagatatacagactgagaccacagaagaggacagtgtcctgctgatgcataccc

SEQ ID NO: 195380 - DNA, 3613 bp, Homo sapiens
  Payload ID: 18579
  Gene Name: trophinin
  Uniprot ID: Q12816
  ENST ID: ENST00000420798
  CDS Start-End: 488-3376
agagaactacattcctcctaggggaaacaggagaatcaaataggaacggagatacagagtggggaatagagaagtcaaatggagaataagagggagtgataactgaataggggtagtaagaagaaaaagggagctacattgaggagaatggaaagttgaaagtaggtatggaggggaggagactgacaggcaggaacggagacccccctctggaggcggaaagaggcaggaccacttccggccagggagggggataggctcagacacaaggagaggcttggagagagcagacgccttctggattcaagaagacgagtccaagcatctgaatggggatgagagaagtggcagtaattacaggcggatcccatggggccggaggcctgcaccaccgcgagatgtggccattttacaagaaagggctaataagttggtgaaatacctgttggttaaggaccagacaaagatccccatcaaacgctcagacatgctgagggatgtcatccaagaatatgatgaatatttcccagaaatcattgaacgagcaagctacactctggagaagatgtttcgagtcaatctgaaagaaattgataagcaaagtagcttgtatattctcatcagcactcaggaatcctctgcaggcatactgggaacgaccaaggacacacccaagctgggtctcctcatggtgattctgagtgtcatttttatgaatggcaacaaggccagtgaggctgtcatctgggaggtgctgcgcaagttggggctgcgccctggggtgaggcattcactctttggggaagtgaggaagctcatcacagacgagtttgtgaagcagaagtacctggagtacaagagggtccctaacagcagaccacctgaatatgagttcttctggggcttgcgctcctaccacgagactagcaagatgaaagtcctcaagtttgcatgcagggtgcagaagaaagaccccaaggactgggctgtgcagtaccgcgaggcagtggagatggaagtccaagctgcagctgtggctgtggctgaggctgaagccagggctgaggcaagagcccaaatggggattggagaggaagctgtggctgggccctggaattgggatgacatggatatcgactgcctaacaagggaagagttaggcgatgatgctcaggcctggagcagattttcatttgaaattgaggccagagcccaagaaaatgcagatgccagcaccaacgtcaacttcagcagaggagctagtaccagggctggcttcagcgatggtgctagtattagcttcaatggtgcacccagctccagtggtggcttcagtggtggacctggcattacctttggtgttgcacccagcaccagtgccagcttcagcaatacagccagcattagctttggtggtacactgagcactagctccagcttcagcagcgcagccagcattagctttggttgtgcacacagcaccagcactagtttcagcagtgaagccagcattagctttggtggcatgccttgtaccagtgccagctttagtggtggagtcagctctagttttagtggcccactcagcaccagtgccactttcagtggtggagccagctctggctttggaggcacactcagcaccacggctggctttagtggtgtactcagcactagcaccagctttggcagtgcacccacaacgagcacagtcttcagtagtgcgcttagcaccagcactggctttggaggcatactcagcaccagtgtctgttttggtggctctcccagctccagtggtagctttggtggtacactcagtaccagtatctgcttcggtggctctccctgcaccagcactggctttggaggcacacttagcaccagtgtctcctttggtggctcttccagcaccagtgccaattttggtggtacactaagtaccagcatctgctttgatggctctcccagcactggtgctggctttggtggtgctctcaacaccagtgccagctttggcagtgtgctcaacaccagtactggttttggtggtgctatgagcaccagtgctgactttggcggtacactaagcaccagtgtctgctttggtggctctcctggcaccagtgtcagctttggcagtgcactcaacaccaatgctggttatggtggtgctgtcagcaccaacactgactttggtggtacactaagcaccagcgtctgttttggtggctctcccagcaccagtgctggctttggtggtgcactcaacaccaatgccagctttggctgtgccgtcagcaccagtgccagcttcagtggtgctgtcagcaccagtgcttgcttcagtggtgcaccaatcaccaaccctggctttggcggtgcatttagcaccagtgctggcttcggtggggcacttagtaccgctgctgacttcggtggtactcccagcaacagcattggctttggtgctgctcccagcaccagtgtcagctttggtggtgctcatggcaccagcctctgttttggtggagctcccagcaccagcctctgctttggcagtgcatctaatactaacctatgctttggtggccctcctagcaccagtgcctgctttagtggtgctaccagccctagtttttgtgatggacccagcaccagtaccggtttcagctttggcaatgggttaagcaccaatgctggatttggtggtggactgaacaccagtgctggctttggtggtggcctaggcaccagtgctggcttcagtggtggcctaagcacaagttctggctttgatggtgggctaggtaccagcgctggcttcggtggaggaccaggcaccagcactggttttggtggtggactgggcaccagtgctggcttcagtggcggactgggcaccagtgctggctttggtggtggactggtcactagtgatggctttggtggtggactgggcaccaatgctagtttcggcagcacacttggcaccagtgctggctttagtggtggcctcagcaccagcgatggctttggcagtaggcctaatgccagcttcgacagaggactgagtaccatcattggctttggcagtggttccaacaccagcactggctttactggcgaacccagcaccagcacgggcttcagtagtggacccagttctattgttggcttcagcggtggaccaagcactggtgttggcttctgcagtggaccaagcaccagtggcttcagcggtggaccgagcacaggagctggcttcggcggtggaccaaacactggtgctggctttggtggtggaccgagcaccagtgctggctttggcagtggagccgccagtcttggtgcctgtggcttctcgtatggctagtgaggtttcagatttattccccatgtttacagataccgctaataaattgcagtagtccttcccatggagccaaagtacatccttggaatctttgtccacacagcagtcaaggcagttatggccaatcagctgagggtgtcatgtgatggaaaaatctgtttgctgttcctgctttattgtttgctttctgtgtgctgtcatattttggtatcagagttacattaaatttgcaaaatg

SEQ ID NO: 195381 - DNA, 562 bp, Homo sapiens
  Payload ID: 18579
  Gene Name: trophinin
  ENST ID: ENST00000427099
  CDS Start-End: 199-562
gcgcactatcgagttgcggagggggcgtgtaaaggggtggggtcgtagaactgactctctcggaggcaaaaggagctgggccttggaaaccagatggcctgggttttttagggccctctgcctcccccggggagcctggggcttcccttccctccagatatacagactgagaccacagaagaggacagtgtcctgctgatgcataccctgttggcggcaaccaaggactccctggccatggacccaccagttgtcaaccggcctaagaaaagcaagaccaagaaggcccctataaagactattactaaggctgcacctgctgcccctccagtcccagctgccaatgagattgccaccaacaagcccaaaataacttggcaggctttaaacctgccagtcattacccagatcagccaggctttacctaccactgaggtaaccaatactcaggcttcttcagtcactgctcagcctaagaaagccaacaagatgaagagagttactgccaaggcagcccaaggctcccaatccccaactggccatgagggtggcactatacagc

SEQ ID NO: 195382 - DNA, 672 bp, Homo sapiens
  Payload ID: 18579
  Gene Name: trophinin
  ENST ID: ENST00000440759
  CDS Start-End: 145-672
agacgccttctggattcaagaagacgaggtgagctgaggtacctggctttagtgaagaccctgtgggggcttcctggctgcggcttcgacgtgcctgactccacacgcccctaaggctcacctgttactcggcctcccagaaagatggataggagaaatgactacggatatagggtgcctctatttcagggccctctgcctcccccggggagcctggggcttcccttccctccagatatacagactgagaccacagaagaggacagtgtcctgctgatgcataccctgttggcggcaaccaaggactccctggccatggacccaccagttgtcaaccggcctaagaaaagcaagaccaagaaggcccctataaagactattactaaggctgcacctgctgcccctccagtcccagctgccaatgagattgccaccaacaagcccaaaataacttggcaggctttaaacctgccagtcattacccagatcagccaggctttacctaccactgaggtaaccaatactcaggcttcttcagtcactgctcagcctaagaaagccaacaagatgaagagagttactgccaaggcagcccaaggctcccaatccccaactggccatgagggtggcactatacagctgaagtcacccttgcaggtcctaaagctacca

SEQ ID NO: 195383 - DNA, 405 bp, Homo sapiens
  Payload ID: 18579
  Gene Name: trophinin
  ENST ID: ENST00000431115
  CDS Start-End: 99-405
gacacaaggagaggcttggagagagcagacgccttctggattcaagaagacgaggcccattcccctcaggctcacctgttactcggcctcccagaaagatggataggagaaatgactacggatatagggtgcctctatttcagtccaagcatctgaatggggatgagagaagtggcagtaattacaggcggatcccatggggccggaggcctgcaccaccgcgagatgtggccattttacaagaaagggctaataagttggtgaaatacctgttggttaaggaccagacaaagatccccatcaaacgctcagacatgctgagggatgtcatccaagaatatgatgaatatttcccagaaatcattgaacgagcaagctacactctggagaagatgtttcgagtca

SEQ ID NO: 195384 - DNA, 868 bp, Homo sapiens
  Payload ID: 18579
  Gene Name: trophinin
  ENST ID: ENST00000430420
  CDS Start-End: 293-868
acttccggccagggagggggataggctcagacacaaggagaggcttggagagagcagacgccttctggattcaagaagacgaggtttgaagaaaacctgctggaggtttgggacctaaccgcatcaaagtcgcctttagcggtgcctggacccagttcgcacgggaggaagtaggaggctcacctgttactcggcctcccagaaagatggataggagaaatgactacggatatagggtgcctctatttcagatatacagactgagaccacagaagaggacagtgtcctgctgatgcataccctgttggcggcaaccaaggactccctggccatggacccaccagttgtcaaccggcctaagaaaagcaagaccaagaaggcccctataaagactattactaaggctgcacctgctgcccctccagtcccagctgccaatgagattgccaccaacaagcccaaaataacttggcaggctttaaacctgccagtcattacccagatcagccaggctttacctaccactgaggtaaccaatactcaggcttcttcagtcactgctcagcctaagaaagccaacaagatgaagagagttactgccaaggcagcccaaggctcccaatccccaactggccatgagggtggcactatacagctgaagtcacccttgcaggtcctaaagctaccagtcatctcacagaatattcacgctccaattgccaatgagtcagccagttcccaagccttgataacctctatcaagcctaagaaagcttccaaggctaagaaggctgcaaataaggccatagctagtgccaccgaggtctcgctggctgcaactgccacccatacagctaccacccaaggc

SEQ ID NO: 195385 - DNA, 722 bp, Homo sapiens
  Payload ID: 18579
  Gene Name: trophinin
  ENST ID: ENST00000453081
  CDS Start-End: 531-722
gggggataggctcagacacaaggagaggcttggagagagcagacgccttctggattcaagaagacgaggcccattcccctcaggctcacctgttactcggcctcccagaaagatggataggagaaatgactacggatatagggtgcctctatttcaggtgaggcctctctgcattctctctaggccatctgccccatcctgagttcacttactgctcttcagaccccttccaccgtgtagtttcataattccctgcctaactcgtctcagtcctcccttacatggtgaaggagaggagaggaaaacctgcctgactctattccttccttgctccctaccccattttaattaaccactgctcagaggaagggaaggcctttgtggaaagggatgggctttagcgaggccaaatggcccagaggatggtaatcctaagtgtgtagggccctctgcctcccccggggagcctggggcttcccttccctccagatatacagactgagaccacagaagaggacagtgtcctgctgatgcataccctgttggcggcaaccaaggactccctggccatggacccaccagttgtcaaccggcctaagaaaagcaagaccaagaaggcccctataaagactattactaaggctgcacctgctgcccctccagtcccagctgccaatgagattgccaccaacaagcccaaaataacttggcaggctttaaac

SEQ ID NO: 195386 - DNA, 1403 bp, Homo sapiens
  Payload ID: 18579
  Gene Name: trophinin
  ENST ID: ENST00000622017
  CDS Start-End: 93-1166
ataggctcagacacaaggagaggcttggagagagcagacgccttctggattcaagaagacgaggctcacctgttactcggcctcccagaaagatggataggagaaatgactacggatatagggtgcctctatttcagtccaagcatctgaatggggatgagagaagtggcagtaattacaggcggatcccatggggccggaggcctgcaccaccgcgagatgtggccattttacaagaaagggctaataagttggtgaaatacctgttggttaaggaccagacaaagatccccatcaaacgctcagacatgctgagggatgtcatccaagaatatgatgaatatttcccagaaatcattgaacgagcaagctacactctggagaagatgtttcgagtcaatctgaaagaaattgataagcaaagtagcttgtatattctcatcagcactcaggaatcctctgcaggcatactgggaacgaccaaggacacacccaagctgggtctcctcatggtgattctgagtgtcatttttatgaatggcaacaaggccagtgaggctgtcatctgggaggtgctgcgcaagttggggctgcgccctggggtgaggcattcactctttggggaagtgaggaagctcatcacagacgagtttgtgaagcagaagtacctggagtacaagagggtccctaacagcagaccacctgaatatgagttcttctggggcttgcgctcctaccacgagactagcaagatgaaagtcctcaagtttgcatgcagggtgcagaagaaagaccccaaggactgggctgtgcagtaccgcgaggcagtggagatggaagtccaactgcagctgtggctgtggctgaggctgaagccagggctgagtggttccaacaccagcactggctttactggcgaacccagcaccagcacgggcttcagtagtggacccagttctattgttggcttcagcggtggaccaagcactggtgttggcttctgcagtggaccaagcaccagtggcttcagcggtggaccgagcacaggagctggcttcggcggtggaccaaacactggtgctggctttggtggtggaccgagcaccagtgctggctttggcagtggagccgccagtcttggtgcctgtggcttctcgtatggctagtgaggtttcagatttattccccatgtttacagataccgctaataaattgcagtagtccttcccatggagccaaagtacatccttggaatctttgtccacacagcagtcaaggcagttatggccaatcagctgagggtgtcatgtgatggaaaaatctgtttgctgttcctgctttattgtttgctttctgtgtgctgtcatattttggtatcagagttacattaaatttgcaaaatg

SEQ ID NO: 195387 - DNA, 2527 bp, Homo sapiens
  Payload ID: 18580
  Gene Name: trophinin associated protein
  Uniprot ID: Q12815
  ENST ID: ENST00000257909
  CDS Start-End: 77-2413
ctccagcagcacccgagagggtcaggagaaaagcggaggaagctgggtaggccctgaggggcctcggtaagccatcatgaccacccggcaagccacgaaggatcccctcctccggggtgtatctcctacccctagcaagattccggtacgctctcagaaacgcacgcctttccccactgttacatcgtgcgccgtggaccaggagaaccaagatccaaggagatgggtgcagaaaccaccgctcaatattcaacgccccctcgttgattcagcaggccccaggccgaaagccaggcaccaggcagagacatcacaaagattggtggggatcagtcagcctcggaaccccttggaagagctcaggcctagccctaggggtcaaaatgtggggcctgggccccctgcccagacagaggctccagggaccatagagtttgtggctgaccctgcagccctggccaccatcctgtcaggtgagggtgtgaagagctgtcacctggggcgccagcctagtctggctaaaagagtactggttcgaggaagtcagggaggcaccacccagagggtccagggtgttcgggcctctgcatatttggcccccagaacccccacccaccgactggaccctgccagggcttcctgcttctctaggctggagggaccaggacctcgaggccggacattgtgcccccagaggctacaggctctgatttcaccttcaggaccttcctttcacccttccactcgccccagtttccaggagctaagaagggagacagctggcagcagccggacttcagtgagccaggcctcaggattgctcctggagaccccagtccagcctgctttctctcttcctaaaggagaacgcgaggttgtcactcactcagatgaaggaggtgtggcctctcttggtctggcccagcgagtaccattaagagaaaaccgagaaatgtcacataccagggacagccatgactcccacctgatgccctcccctgcccctgtggcccagcccttgcctggccatgtggtgccatgtccatcaccctttggacgggctcagcgtgtaccctccccaggccctccaactctgacctcatattcagtgttgcggcgtctcaccgttcaacctaaaacccggttcacacccatgccatcaacccccagagttcagcaggcccagtggctgcgtggtgtctcccctcagtcctgctctgaagatcctgccctgccctgggagcaggttgccgtccggttgtttgaccaggagagttgtataaggtcactggagggttctgggaaaccaccggtggccactccttctggaccccactctaacagaacccccagcctccaggaggtgaagattcaacgcatcggtatcctgcaacagctgttgagacaggaagtagaggggctggtagggggccagtgtgtccctcttaatggaggctcttctctggatatggttgaacttcagcccctgctgactgagatttctagaactctgaatgccacagagcataactctgggacttcccaccttcctggactgttaaaacactcagggctgccaaagccctgtcttccagaggagtgcggggaaccacagccctgccctccggcagagcctgggcccccagaggccttctgtaggagtgagcctgagataccagagccctccctccaggaacagcttgaagtaccagagccctaccctccagcagaacccaggcccctagagtcctgctgtaggagtgagcctgagataccggagtcctctcgccaggaacagcttgaggtacctgagccctgccctccagcagaacccaggcccctagagtcctactgtaggattgagcctgagataccggagtcctctcgccaggaacagcttgaggtacctgagccctgccctccagcagaacccgggccccttcagcccagcacccaggggcagtctggacccccagggccctgccctagggtagagctgggggcatcagagccctgcaccctggaacatagaagtctagagtccagtctaccaccctgctgcagtcagtgggctccagcaaccaccagcctgatcttctcttcccaacacccgctttgtgccagcccccctatctgctcactccagtctttgagacccccagcaggccaggcaggcctcagcaatctggcccctcgaaccctagccctgagggagcgcctcaaatcgtgtttaaccgccatccactgcttccacgaggctcgtctggacgatgagtgtgccttttacaccagccgagcccctccctcaggccccacccgggtctgcaccaaccctgtggctacattactcgaatggcaggatgccctgtgtttcattccagttggttctgctgccccccagggctctccatgatgagacaaccactcctgccctgccgtacttcttccttttagcccttatttattgtcggtctgcccatgggactgggagccgcccacttttgtcctcaataaagtttctaaagta

SEQ ID NO: 195388 - DNA, 675 bp, Homo sapiens
  Payload ID: 18580
  Gene Name: trophinin associated protein
  Uniprot ID: Q12815
  ENST ID: ENST00000380327
  CDS Start-End: 101-535
gtattttacaaactgagaaagtagctccagcagcacccgagagggtcaggagaaaagcggaggaagctgggtaggccctgaggggcctcggtaagccatcatgaccacccggcaagccacgaaggatcccctcctccggggtgtatctcctacccctagcaagattccggtacgctctcagaaacgcacgcctttccccactgttacatcgtgcgccgtggaccaggagaaccaagatccaaggagatgggtgcagaaaccaccgctcaatattcaacgccccctcgttgattcagcaggccccaggccgaaagccaggcaccaggcagagacatcacaaagattggtggggatcagtcagcctcggaaccccttggaagagctcaggcctagccctaggggtcaaaatgtggggcctgggccccctgcccagacagtcctggtcccagctcctggaaagctctttgctcttagaagatctccctttcctccagcaaaatgtcatctcgccaggtgccatggcttgtacctgtaatcacagctactcaggaggctgaagcaggaggatcactggaggccaggagttggagaccagcctggatgacagagggagatcccatctctttaaaaaataaataaataaataaataataaatatcacttcttctgaagcct

SEQ ID NO: 195389 - DNA, 932 bp, Homo sapiens
  Payload ID: 18580
  Gene Name: trophinin associated protein
  ENST ID: ENST00000549891
  CDS Start-End: 101-262
gtattttacaaactgagaaagtagctccagcagcacccgagagggtcaggagaaaagcggaggaagctgggtaggccctgaggggcctcggtaagccatcatgaccacccggcaagccacgaaggatcccctcctccggggtgtatctcctacccctagcaagattccggtacgctctcagaaacgcacgcctttccccactgttacatcgtgcgccgtggaccaggagaaccaagatccaaggaggctccagggaccatagagtttgtggctgaccctgcagccctggccaccatcctgtcaggacttcagtgagccaggcctcaggattgctcctggagaccccagtccagcctgctttctctcttcctaaaggagaacgcgaggttgtcactcactcagatgaaggaggtgtggcctctcttggtctggcccagcgagtaccattaagagaaaaccgagaaatgtcacataccagggacagccatgactcccacctgatgccctcccctgcccctgtggcccagcccttgcctggccatgtggtgccatgtccatcaccctttggacgggctcagcgtgtaccctccccaggccctccaactctgacctcatattcagtgttgcggcgtctcaccgttcaacctaaaacccggttcacacccatgccatcaacccccagagttcagcaggcccagtggctgcgtggtgtctcccctcagtcctgctctgaagatcctgccctgccctgggtaagtatcagaagcttccccctactgagatcccttgccctgtgctgccagcctggaggcccaggagtttgaggcacacgtgctttctgggccaggcatggtggctcacacctgtaatcccagcactttgggaggctgaggtaggaggattgcttgagctcagatctttgagaccagcct

SEQ ID NO: 195390 - DNA, 915 bp, Homo sapiens
  Payload ID: 18580
  Gene Name: trophinin associated protein
  ENST ID: ENST00000547807
  CDS Start-End: 46-915
agcggaggaagctgggtaggccctgaggggcctcggtaagccatcatgaccacccggcaagccacgaaggatcccctcctccggggtgtatctcctacccctagcaagattccggtacgctctcagaaacgcacgcctttccccactgttacatcgtgcgccgtggaccaggagaaccaagatccaaggagatgggtgcagaaaccaccgctcaatattcaacgccccctcgttgattcagcaggccccaggccgaaagccaggcaccaggcagagacatcacaaagattggtggggatcagtcagcctcggaaccccttggaagagctcaggcctagccctaggggtcaaaatgtggggcctgggccccctgcccagacagaggctccagggaccatagagtttgtggctgaccctgcagccctggccaccatcctgtcaggtgagggtgtgaagagctgtcacctggggcgccagcctagtctggctaaaagagtactggttcgaggaagtcagggaggcaccacccagagggtccagggtgttcgggcctctgcatatttggcccccagaacccccacccaccgactggaccctgccagggcttcctgcttctctaggctggagggaccaggacctcgaggccggacattgtgcccccagaggctacaggctctgatttcaccttcaggaccttcctttcacccttccactcgccccagtttccaggagctaagaagggagacagctggcagcagccggacttcagtgagccaggcctcaggattgctcctggagaccccagtccagcctggagaacgcgaggttgtcactcactcagatgaaggaggtgtggcctctcttggtctggcccagcgagtaccattaagagaaaaccgagaaatgtcacatacc

SEQ ID NO: 195391 - DNA, 577 bp, Homo sapiens
  Payload ID: 18580
  Gene Name: trophinin associated protein
  ENST ID: ENST00000551567
  CDS Start-End: 236-577
aacgaaggctgctgggttcatagggaggagggcagtttggggcccgagggcgaaagagtaggctcggggtgtctggagatagcacccataagagcggtcttgcaggcgccgggggcttgtgggcgcgtggattagggcggaggtatcagggatggcaggacaggtgccccgagaactggttgatctttgatcttagattctgcctgccttcttccccgtctcaattgtagccatcatgaccacccggcaagccacgaaggatcccctcctccggggtgtatctcctacccctagcaagattccggtacgctctcagaaacgcacgcctttccccactgttacatcgtgcgccgtggaccaggagaaccaagatccaaggagatgggtgcagaaaccaccgctcaatattcaacgccccctcgttgattcagcaggccccaggccgaaagccaggcaccaggcagagacatcacaaagattggtggggatcagtcagcctcggaaccccttggaagagctcaggcctagccctaggggtcaaaatgtggggcctgggccccctgcccagacagaggct

SEQ ID NO: 195392 - DNA, 1652 bp, Homo sapiens
  Payload ID: 18580
  Gene Name: trophinin associated protein
  ENST ID: ENST00000547923
  CDS Start-End: 188-1561
gctggctaatgtccttattgtcatcaggacttcagtgagccaggcctcaggattgctcctggagaccccagtccagcctgctttctctcttcctaaaggagaacgcgaggttgtcactcactcagatgaaggaggtgtggcctctcttggtctggcccagcgagtaccattaagagaaaaccgagaaatgtcacataccagggacagccatgactcccacctgatgccctcccctgcccctgtggcccagcccttgcctggccatgtggtgccatgtccatcaccctttggacgggctcagcgtgtaccctccccaggccctccaactctgacctcatattcagtgttgcggcgtctcaccgttcaacctaaaacccggttcacacccatgccatcaacccccagagttcagcaggcccagtggctgcgtggtgtctcccctcagtcctgctctgaagatcctgccctgccctgggagcaggttgccgtccggttgtttgaccaggagagttgtataaggtcactggagggttctgggaaaccaccggtggccactccttctggaccccactctaacagaacccccagcctccaggaggtgaagattcaacgcatcggtatcctgcaacagctgttgagacaggaagtagaggggctggtagggggccagtgtgtccctcttaatggaggctcttctctggatatggttgaacttcagcccctgctgactgagatttctagaactctgaatgccacagagcataactctgggacttcccaccttcctggactgttaaaacactcagggctgccaaagccctgtcttccagaggagtgcggggaaccacagccctgccctccggcagagcctgggcccccagaggccttctgtaggagtgagcctgagataccagagccctccctccaggaacagcttgaagtaccagagccctaccctccagcagaacccaggcccctagagtcctgctgtaggagtgagcctgagataccggagtcctctcgccaggaacagcttgaggaacagcttgaggtacctgagccctgccctccagcagaacccgggccccttcagcccagcacccaggggcagtctggacccccagggccctgccctagggtagagctgggggcatcagagccctgcaccctggaacatagaagtctagagtccagtctaccaccctgctgcagtcagtgggctccagcaaccaccagcctgatcttctcttcccaacacccgctttgtgccagcccccctatctgctcactccagtctttgagacccccagcaggccaggcaggcctcagcaatctggcccctcgaaccctagccctgagggagcgcctcaaatcgtgtttaaccgccatccactgcttccacgaggctcgtctggacgatgagtgtgccttttacaccagccgagcccctccctcaggccccacccgggtctgcaccaaccctgtggctacattactcgaatggcaggatgccctgtgtttcattccagttggttctgctgccccccagggctctccatgatgagacaaccactcctgccctgccgtacttcttccttttagcccttatttattgtcggtctgcccatgggactgggagccgcccacttttg

SEQ ID NO: 195393 - DNA, 2771 bp, Homo sapiens
  Payload ID: 18580
  Gene Name: trophinin associated protein
  ENST ID: ENST00000551245
  CDS Start-End: 112-2718
aagagcttggcgtattttacaaactgagaaagtagctccagcagcacccgagagggtcaggagaaaagcggaggaagctgggtaggccctgaggggcctcggtaagccatcatgaccacccggcaagccacgaaggatcccctcctccggggtgtatctcctacccctagcaagattccggtacgctctcagaaacgcacgcctttccccactgttacatcgtgcgccgtggaccaggagaaccaagatccaaggagatgggtgcagaaaccaccgctcaatattcaacgccccctcgttgattcagcaggccccaggccgaaagccaggcaccaggcagagacatcacaaagattggtggggatcagtcagcctcggaaccccttggaagagctcaggcctagccctaggggtcaaaatgtggggcctgggccccctgcccagacagaggctccagggaccatagagtttgtggctgaccctgcagccctggccaccatcctgtcaggtgagggtgtgaagagctgtcacctggggcgccagcctagtctggctaaaagagtactggttcgaggaagtcagggaggcaccacccagagggtccagggtgttcgggcctctgcatatttggcccccagaacccccacccaccgactggaccctgccagggcttcctgcttctctaggctggagggaccaggacctcgaggccggacattgtgcccccagaggctacaggctctgatttcaccttcaggaccttcctttcacccttccactcgccccagtttccaggagctaagaagggagacagctggcagcagccggacttcagtgagccaggcctcaggattgctcctggagaccccagtccagcctgctttctctcttcctaaaggagaacgcgaggttgtcactcactcagatgaaggaggtgtggcctctcttggtctggcccagcgagtaccattaagagaaaaccgagaaatgtcacataccagggacagccatgactcccacctgatgccctcccctgcccctgtggcccagcccttgcctggccatgtggtgccatgtccatcaccctttggacgggctcagcgtgtaccctccccaggccctccaactctgacctcatattcagtgttgcggcgtctcaccgttcaacctaaaacccggttcacacccatgccatcaacccccagagttcagcaggcccagtggctgcgtggtgtctcccctcagtcctgctctgaagatcctgccctgccctgggagcaggttgccgtccggttgtttgaccaggagagttgtataaggtcactggagggttctgggaaaccaccggtggccactccttctggaccccactctaacagaacccccagcctccaggaggtgaagattcaacgcatcggtatcctgcaacagctgttgagacaggaagtagaggggctggtagggggccagtgtgtccctcttaatggaggctcttctctggatatggttgaacttcagcccctgctgactgagatttctagaactctgaatgccacagagcataactctgggacttcccaccttcctggactgttaaaacactcagggctgccaaagccctgtcttccagaggagtgcggggaaccacagccctgccctccggcagagcctgggcccccagaggccttctgtaggagtgagcctgagataccagagccctccctccaggaacagcttgaagtaccagagccctaccctccagcagaacccaggcccctagagtcctgctgtaggagtgagcctgagataccggagtcctctcgccaggaacagcttgaggtacctgagccctgccctccagcagaacccaggcccctagagtcctactgtaggattgagcctgagataccggagtcctctcgccaggaacagcttgaggtacctgagccctgccctccagcagaacccgggccccttcagcccagcacccaggggcagtctggacccccagggccctgccctagggtagagctgggggcatcagagccctgcaccctggaacatagaagtctagagtccagtctaccaccctgctgcagtcagtgggctccagcaaccaccagcctgatcttctcttcccaacacccgctttgtgccagcccccctatctgctcactccagtctttgagacccccagcaggccaggcaggtaaggagttggctgggaaggagtgtgaacacaagaggtcctcacctcactgtgagctgcacacctgccctgcccctaccccaggcaatctcatgcttccacaccttccaccctggcccagcctggctctccctcaggaagaggggaggggctgcacttccagccctgtgctcctaattggcttggccgttggtgggggaggaggagaggacagtacatggtggaagtataggaccccagacctccctctaaattttccatgcccctcaggcctcagcaatctggcccctcgaaccctagccctgagggagcgcctcaaatcgtgtttaaccgccatccactgcttccacgaggctcgtctggacgatgagtgtgccttttacaccagccgagcccctccctcaggccccacccgggtctgcaccaaccctgtggctacattactcgaatggcaggatgccctgtgtttcattccagttggttctgctgccccccagggctctccatgatgagacaaccactcctgccctgccgtacttcttccttttagcccttatttatt

SEQ ID NO: 195394 - DNA, 1213 bp, Homo sapiens
  Payload ID: 18580
  Gene Name: trophinin associated protein
  ENST ID: ENST00000546735
  CDS Start-End: 99-260
attttacaaactgagaaagtagctccagcagcacccgagagggtcaggagaaaagcggaggaagctgggtaggccctgaggggcctcggtaagccatcatgaccacccggcaagccacgaaggatcccctcctccggggtgtatctcctacccctagcaagattccggtacgctctcagaaacgcacgcctttccccactgttacatcgtgcgccgtggaccaggagaaccaagatccaaggaggctccagggaccatagagtttgtggctgaccctgcagccctggccaccatcctgtcaggtgagggtgtgaagagctgtcacctggggcgccagcctagtctggctaaaagagtactggttcgaggaagtcagggaggcaccacccagagggtccagggtgttcgggcctctgcatatttggcccccagaacccccacccaccgactggaccctgccagggcttcctgcttctctaggctggagggaccaggacctcgaggccggacattgtgcccccagaggctacaggctctgatttcaccttcaggaccttcctttcacccttccactcgccccagtttccaggagctaagaagggagacagctggcagcagccggacttcagtgagccaggcctcaggattgctcctggagaccccagtccagcctgctttctctcttcctaaaggagaacgcgaggttgtcactcactcagatgaaggaggtgtggcctctcttggtctggcccagcgagtaccattaagagaaaaccgagaaatgtcacataccagggacagccatgactcccacctgatgccctcccctgcccctgtggcccagcccttgcctggccatgtggtgccatgtccatcaccctttggacgggctcagcgtgtaccctccccaggccctccaactctgacctcatattcagtgttgcggcgtctcaccgttcaacctaaaacccggttcacacccatgccatcaacccccagagttcagcaggcccagtggctgcgtggtgtctcccctcagtcctgctctgaagatcctgccctgccctgggtaagtatcagaagcttccccctactgagatcccttgccctgtgctgccagcctggaggcccaggagtttgaggcacacgtgctttctgggccaggcatggtggctcacacctgtaatcccagcactttgggaggctgaggtag

SEQ ID NO: 195395 - DNA, 623 bp, Homo sapiens
  Payload ID: 18580
  Gene Name: trophinin associated protein
  Uniprot ID: Q12815
  ENST ID: ENST00000548311
  CDS Start-End: 101-481
gtattttacaaactgagaaagtagctccagcagcacccgagagggtcaggagaaaagcggaggaagctgggtaggccctgaggggcctcggtaagccatcatgaccacccggcaagccacgaaggatcccctcctccggggtgtatctcctacccctagcaagattccggtacgctctcagaaacgcacgcctttccccactgttacatcgtgcgccgtggaccaggagaaccaagatccaaggagatgggtgcagaaaccaccgctcaatattcaacgccccctcgttgattcagcaggccccaggccgaaagccaggcaccaggcagagacatcacaaagattggtggggatcagtcagcctcggaaccccttggaagagctcaggcctagccctaggggtcaaaatgtggggcctgggccccctgcccagacaggtgccatggcttgtacctgtaatcacagctactcaggaggctgaagcaggaggatcactggaggccaggagttggagaccagcctggatgacagagggagatcccatctctttaaaaaataaataaataaataaataataaatatcacttcttctgaagccttttccagttccccatgtcacaatc

SEQ ID NO: 195396 - DNA, 839 bp, Homo sapiens
  Payload ID: 18580
  Gene Name: trophinin associated protein
  ENST ID: ENST00000549534
  CDS Start-End: 83-241
aagtagctccagcagcacccgagagggtcaggagaaaagcggaggaagctgggtaggccctgaggggcctcggtaagccatcatgaccacccggcaagccacgaaggatcccctcctccggggtgtatctcctacccctagcaagattccggtacgctctcagaaacgcacgcctttccccactgttacatcgtgcgccgtggaccaggagaaccaagatccaagggtaagaggggcctaatgggggaagacagtagtcacaccagtaatgcaccccaacactaaacctcacctttttgtccccgctccctcccctagagatgggtgcagaaaccaccgctcaatattcaacgccccctcgttgattcagcaggccccaggccgaaagccaggcaccaggcagagacatcacaaagattggtggggatcagtcagcctcggaaccccttggaagagctcaggcctagccctaggggtcaaaatgtggggcctgggccccctgcccagacaggtacctgttggagccatggtaacacggcctccatggctgagtaggggactaggaagggtaaaagtggggttttggggttttgcactcactcctgctgtctcctacttactgtgatagtcctggtcccagctcctggaaagctctttgctcttagaagatctccctttcctccagcaaaatgtcatctcgccaggtgccatggcttgtacctgtaatcacagctactcaggaggctgaagcaggaggatcactggaggccaggagttggagaccagcctggatgacagagggagatcccatctctttaaaaaataaataaataaataaa

SEQ ID NO: 195397 - DNA, 1011 bp, Homo sapiens
  Payload ID: 18580
  Gene Name: trophinin associated protein
  ENST ID: ENST00000546776
  CDS Start-End: 77-340
ctccagcagcacccgagagggtcaggagaaaagcggaggaagctgggtaggccctgaggggcctcggtaagccatcatgaccacccggcaagccacgaaggatcccctcctccggggtgtatctcctacccctagcaagattccggtacgctctcagaaacgcacgcctttccccactgttacatcgtgcgccgtggaccaggagaaccaagatccaaggagatgggtgcagaaaccaccgctcaatattcaacgccccctcgttgattcagcaggccccaggccgaaagccaggcaccaggcagagacatcacaaagattgaggctccagggaccatagagtttgtggctgaccctgcagccctggccaccatcctgtcaggtgagggtgtgaagagctgtcacctggggcgccagcctagtctggctaaaagagtactggttcgaggaagtcagggaggcaccacccagagggtccagggtgttcgggcctctgcatatttggcccccagaacccccacccaccgactggaccctgccagggcttcctgcttctctaggctggagggaccaggacctcgaggccggacattgtgcccccagaggctacaggctctgatttcaccttcaggaccttcctttcacccttccactcgccccagtttccaggagctaagaagggagacagctggcagcagccggacttcagtgagccaggcctcaggattgctcctggagaccccagtccagcctgctttctctcttcctaaaggagaacgcgaggttgtcactcactcagatgaaggaggtgtggcctctcttggtctggcccagcgagtaccattaagagaaaaccgagaaatgtcacataccagggacagccatgactcccacctgatgccctcccctgcccctgtggcccagcccttgcctggccatgtggtgccatgtccatcaccctttggacgggctcagcgtgtaccctccccaggccctccaactctggtttgt

SEQ ID NO: 195398 - DNA, 640 bp, Homo sapiens
  Payload ID: 18580
  Gene Name: trophinin associated protein
  ENST ID: ENST00000550346
  CDS Start-End: 100-640
tattttacaaactgagaaagtagctccagcagcacccgagagggtcaggagaaaagcggaggaagctgggtaggccctgaggggcctcggtaagccatcatgaccacccggcaagccacgaaggatcccctcctccggggtgtatctcctacccctagcaagattccggtacgctctcagaaacgcacgcctttccccactgttacatcgtgcgccgtggaccaggagaaccaagatccaaggggtgttcgggcctctgcatatttggcccccagaacccccacccaccgactggaccctgccagggcttcctgcttctctaggctggagggaccaggacctcgaggccggacattgtgcccccagaggctacaggctctgatttcaccttcaggaccttcctttcacccttccactcgccccagtttccaggagctaagaagggagacagctggcagcagccggacttcagtgagccaggcctcaggattgctcctggagaccccagtccagcctgctttctctcttcctaaaggagaacgcgaggttgtcactcactcagatgaaggaggtgtggcctctcttggtctggcccagcgagtaccattaagagaaaaccgagaaatgtcacataccaggg

SEQ ID NO: 195399 - DNA, 348 bp, Homo sapiens
  Payload ID: 18580
  Gene Name: trophinin associated protein
  ENST ID: ENST00000549275
  CDS Start-End: 120-326
ggccaatcaagagcttggcgtattttacaaactgagaaagtagctccagcagcacccgagagggtcaggagaaaagcggaggaagctgggtaggccctgaggggcctcggtaagccatcatgaccacccggcaagccacgaaggatcccctcctccggggtgtatctcctacccctagcaagattccggtacgctctcagaaacgcacgcctttccccactgttacatcgtgcgccgtggaccaggagaaccaagatccaaggcaaaatgtcatctcgccaggtgccatggcttgtacctgtaatcacagctactcaggaggctgaagcaggaggatcactggaggcc

SEQ ID NO: 195400 - DNA, 778 bp, Homo sapiens
  Payload ID: 18580
  Gene Name: trophinin associated protein
  ENST ID: ENST00000550709
  CDS Start-End: 99-479
attttacaaactgagaaagtagctccagcagcacccgagagggtcaggagaaaagcggaggaagctgggtaggccctgaggggcctcggtaagccatcatgaccacccggcaagccacgaaggatcccctcctccggggtgtatctcctacccctagcaagattccggtacgctctcagaaacgcacgcctttccccactgttacatcgtgcgccgtggaccaggagaaccaagatccaaggagatgggtgcagaaaccaccgctcaatattcaacgccccctcgttgattcagcaggccccaggccgaaagccaggcaccaggcagagacatcacaaagattggtggggatcagtcagcctcggaaccccttggaagagctcaggcctagccctaggggtcaaaatgtggggcctgggccccctgcccagacaggtacctgttggagccatggtaacacggcctccatggctgagtaggggactaggaagggtaaaagtggggttttggggttttgcactcactcctgctgtctcctacttactgtgatagtcctggtcccagctcctggaaagctctttgctcttagaagatctccctttcctccagcaaaatgtcatctcgccaggtgccatggcttgtacctgtaatcacagctactcaggaggctgaagcaggaggatcactggaggccaggagttggagaccagcctggatgacagagggagatcccatctctttaaaaaataaataaataaataaataataaatatcactt

SEQ ID NO: 195401 - DNA, 1469 bp, Homo sapiens
  Payload ID: 18580
  Gene Name: trophinin associated protein
  ENST ID: ENST00000551192
  CDS Start-End: 73-549
agcagcacccgagagggtcaggagaaaagcggaggaagctgggtaggccctgaggggcctcggtaagccatcatgaccacccggcaagccacgaaggatcccctcctccggggtgtatctcctacccctagcaagattccggtacgctctcagaaacgcacgcctttccccactgttacatcgtgcgccgtggaccaggagaaccaagatccaaggagatgggtgcagaaaccaccgctcaatattcaacgccccctcgttgattcagcaggccccaggccgaaagccaggcaccaggcagagacatcacaaagattggtggggatcagtcagcctcggaaccccttggaagagctcaggcctagccctaggggtcaaaatgtggggcctgggccccctgcccagacagaggctccagggaccatagagtttgtggctgaccctgcagccctggccaccatcctgtcagggtgttcgggcctctgcatatttggcccccagaacccccacccaccgactggaccctgccagggcttcctgcttctctaggctggagggaccaggacctcgaggccggacattgtgcccccagaggctacaggctctgatttcaccttcaggaccttcctttcacccttccactcgccccagtttccaggagctaagaagggagacagctggcagcagccggacttcagtgagccaggcctcaggattgctcctggagaccccagtccagcctgctttctctcttcctaaaggagaacgcgaggttgtcactcactcagatgaaggaggtgtggcctctcttggtctggcccagcgagtaccattaagagaaaaccgagaaatgtcacataccagggacagccatgactcccacctgatgccctcccctgcccctgtggcccagcccttgcctggccatgtggtgccatgtccatcaccctttggacgggctcagcgtgtaccctccccaggccctccaactctgacctcatattcagtgttgcggcgtctcaccgttcaacctaaaacccggttcacacccatgccatcaacccccagagttcagcaggcccagtggctgcgtggtgtctcccctcagtcctgctctgaagatcctgccctgccctgggtaagtatcagaagcttccccctactgagatcccttgccctgtgctgccagcctggaggcccaggagtttgaggcacacgtgctttctgggccaggcatggtggctcacacctgtaatcccagcactttgggaggctgaggtaggaggattgcttgagctcagatctttgagaccagcctgggcaacatagtgagaccctgtctccactaaaattttaaaaattagaaagtgctctctggaaaagctgcctaactctcactgcttctctgctgcccctcctaatgtacatctagggcctctcagttaggggcttcaatccattcctcatga

SEQ ID NO: 195402 - DNA, 6484 bp, Homo sapiens
  Payload ID: 18581
  Gene Name: trophoblast glycoprotein
  Uniprot ID: Q13641
  ENST ID: ENST00000369750
  CDS Start-End: 618-1880
gttaatttccaccaggaggaggcgcgcagcccagctcccctagtctctcttcttaaatccccctacctacggctgccgaggttggccgcgcgtcgggaatctccccgacagtcctggccctcccccgccccccgggttggtttttcccagctgcggaggttgggaggttgggccaggggctggggtgcgaagagagtcggcgcccgcaacgcggagccgggaagtcgtcgctactctggtggaactcagagttggttctggaggcggcggacgcggaggtccctcagaggatccagcgaggggcgccaacaagaggcgaagaggtggcaccagggcggcggcaggaagaggagcgggagcaggagcgcggagcggagcgtcccgacccgccgtgcgtactttctggagggaaggggcgggggaatcggcccctgagggaagcgcccggtggcgagggggttagccaagttccggctgcggcgccactccctcggttccacgagaggaaagttttttttttccagacgcttccgccggctcgcgccctccgggcccagcctcccgagccttcggagcgggcgccgtcccagcccagctccggggaaacgcgagccgcgatgcctggggggtgctcccggggccccgccgccggggacgggcgtctgcggctggcgcgactagcgctggtactcctgggctgggtctcctcgtcttctcccacctcctcggcatcctccttctcctcctcggcgccgttcctggcttccgccgtgtccgcccagcccccgctgccggaccagtgccccgcgctgtgcgagtgctccgaggcagcgcgcacagtcaagtgcgttaaccgcaatctgaccgaggtgcccacggacctgcccgcctacgtgcgcaacctcttccttaccggcaaccagctggccgtgctccctgccggcgccttcgcccgccggccgccgctggcggagctggccgcgctcaacctcagcggcagccgcctggacgaggtgcgcgcgggcgccttcgagcatctgcccagcctgcgccagctcgacctcagccacaacccactggccgacctcagtcccttcgctttctcgggcagcaatgccagcgtctcggcccccagtccccttgtggaactgatcctgaaccacatcgtgccccctgaagatgagcggcagaaccggagcttcgagggcatggtggtggcggccctgctggcgggccgtgcactgcaggggctccgccgcttggagctggccagcaaccacttcctttacctgccgcgggatgtgctggcccaactgcccagcctcaggcacctggacttaagtaataattcgctggtgagcctgacctacgtgtccttccgcaacctgacacatctagaaagcctccacctggaggacaatgccctcaaggtccttcacaatggcaccctggctgagttgcaaggtctaccccacattagggttttcctggacaacaatccctgggtctgcgactgccacatggcagacatggtgacctggctcaaggaaacagaggtagtgcagggcaaagaccggctcacctgtgcatatccggaaaaaatgaggaatcgggtcctcttggaactcaacagtgctgacctggactgtgacccgattcttcccccatccctgcaaacctcttatgtcttcctgggtattgttttagccctgataggcgctattttcctcctggttttgtatttgaaccgcaaggggataaaaaagtggatgcataacatcagagatgcctgcagggatcacatggaagggtatcattacagatatgaaatcaatgcggaccccagattaacgaacctcagttctaactcggatgtctgagaaatattagaggacagaccaaggacaactctgcatgagatgtagacttaagctttatccctactaggcttgctccactttcatcctccactatagatacaacggactttgactaaaagcagtgaaggggatttgcttccttgttatgtaaagtttctcggtgtgttctgttaatgtaagacgatgaacagttgtgtatagtgttttaccctcttctttttcttggaactcctcaacacgtatggagggatttttcaggtttcagcatgaacatgggcttcttgctgtctgtctctctctcagtacagttcaaggtgtagcaagtgtacccacacagatagcattcaacaaaagctgcctcaactttttcgagaaaaatactttattcataaatatcagttttattctcatgtacctaagttgtggagaaaataattgcatcctataaactgcctgcagacgttagcaggctcttcaaaataactccatggtgcacaggagcacctgcatccaagagcatgcttacattttactgttctgcatattacaaaaaataacttgcaacttcataacttctttgacaaagtaaattacttttttgattgcagtttatatgaaaatgtactgatttttttttaataaactgcatcgagatccaaccgactgaattgttaaaaaaaaaaaaaataaagattcttaaaagaattacagtgtgtgcaagtttgctttgaaaaaaggatgaagggcaggagtattcaatggtcttggttccgatgataattattacttaacatagctgagaatcaaactgtagcaatgtctaatataaatagacttgggagatcgttttgaaatggtggatccttttagtatttaaatggagagtttgagtattcatgtgactgtatggtcccaaagttaatgctatttatgaaacagttttgtaagaacataatgaagttggtaaaagctaagcgttctgcacaataaacagttcccagtttggggctttttcaaggctaatgaagttattgttggtctagaaaaatagtatttacttaataaaactctgtttgaaattgttctgtggatttttagagcagaatttgaaacaaatgtaatgcaaataaatataaagataaagtgtcttaaagacaatattctgaaataaaagatataaaatataatttaaaaaatatttctcaatgtcttaatgtaaattgaaacttagattttcttgaggatattttcaaaaaaacatttaaagtggaacataaatgttctttagtttatcagagacccagctaatatgtttaaaaagttgacttgacatggttgaatatgaacttgaggaaataaccacagataaatgtctacatctgtaaacacgtgtctcaagtatttataggttcttatcttcagttcagtgtttaagaatttgaggatattttgattttagctaagctgttcataatgtaagtatatacacctttgtgaagaataaatcacatttaggtgtaaatacaggcaatcattaattgatacatccataatatacaaggcttttattattttttcagtttattatctgtcatttaatctgaaaagtaaattccattaatcagtcttcaggctcttttatcaagtgatttaaatgtagccattattgcttaactgaaagtattaggtaaacttgcatcagtaagtcttagggcttgcttttcctttgaactggttatgtccttcagtgctttatgtttgaaataaaatctacattttcatatttttataaataaaataggatcagatagtattttaggttctagaaatctttgctgattccttctttgaattaaattcagaaattttcaaagtagggctaaaaataagtaaatcttcctttttataggttagaatatatagtcagaatacaaagctgtaattccttaaattccatcaggcttgttttgtgaaatatagtatttattatttaagggttatatttcagatcctataattacctcagaaaaagctaaatatttggcacttaaaattccatcaaacagtttaagtgttcatcagaaattcctaaactgtctggttgccattatttggtaagaacaatgagatactaatctgtcaaaaatagtgaccactatcttagtaaactgttgatggacttagtaagtcttctgatattgtaggaaacaaattataatattgatagagcctctattgagaagaattgtttcttcatcacatgataatctaacagtttaaagtggagctttatctaagaaccagggaagcagtagattcattagtctagcttttctcatcaactctttgaagcaatgatgaatctgataaagtgaagccaagttttccctgttaggtagatggcttctttgaagttataatttattgcttctttttcatccccctacttattctcttgtttggactttccaattgctactgctttgttttccatcacatcactccttcctgttctccaaaatatggaaataaaaaagtcaattaaaagaacaccttattcttaagataaaaaattgttattatttgacaactaattaatgttttgcagccctaatattcttaagtctataagcttataaaacattctaagttccttggaagatagaggctatataaattcaataagtataagggaatatgggaaaaataaaagtatcactttatttaaaaataagacaagtctgtttgttttaaatactgttcttactattaatgcattgttgactctagaaacctgcaagtatccatttttaaaattttattttagttggtaatactctttattactgaacgtaaaattttcaacataaaacacccttcatttatcctttacaagtttcatttgaagaaagttagaaaaaatacttagaaattcaaggacttgatatatcccttaatttagaaagctattcaactatcccataaatttctatttaaagtagcaaaaattttaggataatacagctatttggccctgaattataactgccccctttgattgtaaccattcagtttgcagcattcgtttttgtaatagcagtttggctgctatgggtgtgattcaatggtaacctacaaggcaaatttgtacaggagctgacagatttttctaacaaaataaggagactttgaagcacattgaataggagtttttaaatgaataggattttttaaaggaaaaagagtaggagcttgggggggaaggctggttgaaataaatgagcaaatcacaaataataaatcctttagaaataccttgattggcagtaagtgtggattatgctcatctcagtatttaattagaaataacttacctttgtcttttgtctttttaattaaagtggctgtaaaaaagaaggtccagatgaactgagattgtttgcttaggaattctgttttactcttttccttttacctgatgttctaaaacagggcttaccttgttgaggaccttagaggctttgcaattctagattgtgattctttcatatcattttagtttttctcccaagactacactaaaggagacatcacgagatttgcaaggttaaaaacaattctgcacgtgcttcctcctgctcccaaatccggtcatccacctttcagagcagcaccgtaaagtgaagacagacatttattagatgaaattctggtttcacttttacacttgtgcaagcatttttaacagtaaaggagaggaaagggaggaatttatatttctagataatatatgaaaattaccttgatattgtatttttaagatctttcaccaatactgcagtgctgcactagaaataattagtttaagaaaatacattcaacattgtccaggtgatcctgtcaccttttagatgacgaaaaacatcttgaggatgttttgtacagttattttcccattgttactcttagagacttttgtttcaaaaaggcaggctcattttattttgttttatcttagaacattttagcagctctttgtcatgggttaaaaaaatctagaattaaaaaaatgtttaatatatgatttatataattttgacaagaatacaaattcttagtcgttcaaaattggaagcgctcttagaagtgtcaagctcagctttccattccacaaatgaagtaactggtaactgtgacttattatgttatacagtgacagttattatgttatacagtgtcagttatacagtgacaaccaggacaaaatcctagggttctagattccccttctggtgctctttttaccagatgatggcattactaattgcctaccttgaggcctttgaaatcaccatgtctgataaaaacatgcaattgctttggtgaatttgtttgttttattgttgttgctttgagtgaatgcttcagtttgctctagattttactttgttaaaaattaccatgttttaacccccgaaaacatttaatgtttttgaaatgattttttcataacaatcttatgagtctattatataataggaagtattttggaaatttaatggtgatatttctttggaaaagaaaaataaaaactctggaatgca

SEQ ID NO: 195403 - DNA, 2881 bp, Homo sapiens
  Payload ID: 18581
  Gene Name: trophoblast glycoprotein
  Uniprot ID: Q13641
  ENST ID: ENST00000543496
  CDS Start-End: 426-1688
acccggaggccgaccttccgccgaggcggtgcaggaaggaacgggagagggagaagtttggtagggaaggaattggggattaagcggtccctcagaggatccagcgaggggcgccaacaagaggcgaagaggtggcaccagggcggcggcaggaagaggagcgggagcaggagcgcggagcggagcgtcccgacccgccgtgcgtactttctggagggaaggggcgggggaatcggcccctgagggaagcgcccggtggcgagggggttagccaagttccggctgcggcgccactccctcggttccacgagaggaaagttttttttttccagacgcttccgccggctcgcgccctccgggcccagcctcccgagccttcggagcgggcgccgtcccagcccagctccggggaaacgcgagccgcgatgcctggggggtgctcccggggccccgccgccggggacgggcgtctgcggctggcgcgactagcgctggtactcctgggctgggtctcctcgtcttctcccacctcctcggcatcctccttctcctcctcggcgccgttcctggcttccgccgtgtccgcccagcccccgctgccggaccagtgccccgcgctgtgcgagtgctccgaggcagcgcgcacagtcaagtgcgttaaccgcaatctgaccgaggtgcccacggacctgcccgcctacgtgcgcaacctcttccttaccggcaaccagctggccgtgctccctgccggcgccttcgcccgccggccgccgctggcggagctggccgcgctcaacctcagcggcagccgcctggacgaggtgcgcgcgggcgccttcgagcatctgcccagcctgcgccagctcgacctcagccacaacccactggccgacctcagtcccttcgctttctcgggcagcaatgccagcgtctcggcccccagtccccttgtggaactgatcctgaaccacatcgtgccccctgaagatgagcggcagaaccggagcttcgagggcatggtggtggcggccctgctggcgggccgtgcactgcaggggctccgccgcttggagctggccagcaaccacttcctttacctgccgcgggatgtgctggcccaactgcccagcctcaggcacctggacttaagtaataattcgctggtgagcctgacctacgtgtccttccgcaacctgacacatctagaaagcctccacctggaggacaatgccctcaaggtccttcacaatggcaccctggctgagttgcaaggtctaccccacattagggttttcctggacaacaatccctgggtctgcgactgccacatggcagacatggtgacctggctcaaggaaacagaggtagtgcagggcaaagaccggctcacctgtgcatatccggaaaaaatgaggaatcgggtcctcttggaactcaacagtgctgacctggactgtgacccgattcttcccccatccctgcaaacctcttatgtcttcctgggtattgttttagccctgataggcgctattttcctcctggttttgtatttgaaccgcaaggggataaaaaagtggatgcataacatcagagatgcctgcagggatcacatggaagggtatcattacagatatgaaatcaatgcggaccccagattaacgaacctcagttctaactcggatgtctgagaaatattagaggacagaccaaggacaactctgcatgagatgtagacttaagctttatccctactaggcttgctccactttcatcctccactatagatacaacggactttgactaaaagcagtgaaggggatttgcttccttgttatgtaaagtttctcggtgtgttctgttaatgtaagacgatgaacagttgtgtatagtgttttaccctcttctttttcttggaactcctcaacacgtatggagggatttttcaggtttcagcatgaacatgggcttcttgctgtctgtctctctctcagtacagttcaaggtgtagcaagtgtacccacacagatagcattcaacaaaagctgcctcaactttttcgagaaaaatactttattcataaatatcagttttattctcatgtacctaagttgtggagaaaataattgcatcctataaactgcctgcagacgttagcaggctcttcaaaataactccatggtgcacaggagcacctgcatccaagagcatgcttacattttactgttctgcatattacaaaaaataacttgcaacttcataacttctttgacaaagtaaattacttttttgattgcagtttatatgaaaatgtactgatttttttttaataaactgcatcgagatccaaccgactgaattgttaaaaaaaaaaaaaataaagattcttaaaagaattacagtgtgtgcaagtttgctttgaaaaaaggatgaagggcaggagtattcaatggtcttggttccgatgataattattacttaacatagctgagaatcaaactgtagcaatgtctaatataaatagacttgggagatcgttttgaaatggtggatccttttagtatttaaatggagagtttgagtattcatgtgactgtatggtcccaaagttaatgctatttatgaaacagttttgtaagaacataatgaagttggtaaaagctaagcgttctgcacaataaacagttcccagtttggggctttttcaaggctaatgaagttattgttggtctagaaaaatagtatttacttaataaaactctgtttgaaattgttctgtggatttttagagcagaatttgaaacaaatgtaatgcaaataaatataaagataaagtgtcttaaagacaatattctgaaataaaagatataaaatataatttaaa

SEQ ID NO: 195404 - DNA, 3392 bp, Homo sapiens
  Payload ID: 18581
  Gene Name: trophoblast glycoprotein
  Uniprot ID: Q13641
  ENST ID: ENST00000535040
  CDS Start-End: 937-2199
tttctctctctctctctcttaaagttggcgcgctctcttcacaagttccatcactacccaagaagtgagggggcgggggggacaggcgggaaggcattaattacacctaaatctgaagtttgcggcctcaagtaccactttgatggggagagcttctgaagcttccatacaacctgccgtgcctttgctgctgccgcagtagattttcagctcatttctttctgctgctgcttcgcgctgctctgtcatgcctaaatctatctcgtcactgccaaaggtgcctgaatcagggtgaattccacgagattcaccagcggttttgctccagtccaaggaggaggcgcgcagcccagctcccctagtctctcttcttaaatccccctacctacggctgccgaggttggccgcgcgtcgggaatctccccgacagtcctggccctcccccgccccccgggttggtttttcccagctgcggaggttgggaggttgggccaggggctggggtgcgaagagagtcggcgcccgcaacgcggagccgggaagtcgtcgctactctggtggaactcagagttggttctggaggcggcggacgcggaggtccctcagaggatccagcgaggggcgccaacaagaggcgaagaggtggcaccagggcggcggcaggaagaggagcgggagcaggagcgcggagcggagcgtcccgacccgccgtgcgtactttctggagggaaggggcgggggaatcggcccctgagggaagcgcccggtggcgagggggttagccaagttccggctgcggcgccactccctcggttccacgagaggaaagttttttttttccagacgcttccgccggctcgcgccctccgggcccagcctcccgagccttcggagcgggcgccgtcccagcccagctccggggaaacgcgagccgcgatgcctggggggtgctcccggggccccgccgccggggacgggcgtctgcggctggcgcgactagcgctggtactcctgggctgggtctcctcgtcttctcccacctcctcggcatcctccttctcctcctcggcgccgttcctggcttccgccgtgtccgcccagcccccgctgccggaccagtgccccgcgctgtgcgagtgctccgaggcagcgcgcacagtcaagtgcgttaaccgcaatctgaccgaggtgcccacggacctgcccgcctacgtgcgcaacctcttccttaccggcaaccagctggccgtgctccctgccggcgccttcgcccgccggccgccgctggcggagctggccgcgctcaacctcagcggcagccgcctggacgaggtgcgcgcgggcgccttcgagcatctgcccagcctgcgccagctcgacctcagccacaacccactggccgacctcagtcccttcgctttctcgggcagcaatgccagcgtctcggcccccagtccccttgtggaactgatcctgaaccacatcgtgccccctgaagatgagcggcagaaccggagcttcgagggcatggtggtggcggccctgctggcgggccgtgcactgcaggggctccgccgcttggagctggccagcaaccacttcctttacctgccgcgggatgtgctggcccaactgcccagcctcaggcacctggacttaagtaataattcgctggtgagcctgacctacgtgtccttccgcaacctgacacatctagaaagcctccacctggaggacaatgccctcaaggtccttcacaatggcaccctggctgagttgcaaggtctaccccacattagggttttcctggacaacaatccctgggtctgcgactgccacatggcagacatggtgacctggctcaaggaaacagaggtagtgcagggcaaagaccggctcacctgtgcatatccggaaaaaatgaggaatcgggtcctcttggaactcaacagtgctgacctggactgtgacccgattcttcccccatccctgcaaacctcttatgtcttcctgggtattgttttagccctgataggcgctattttcctcctggttttgtatttgaaccgcaaggggataaaaaagtggatgcataacatcagagatgcctgcagggatcacatggaagggtatcattacagatatgaaatcaatgcggaccccagattaacgaacctcagttctaactcggatgtctgagaaatattagaggacagaccaaggacaactctgcatgagatgtagacttaagctttatccctactaggcttgctccactttcatcctccactatagatacaacggactttgactaaaagcagtgaaggggatttgcttccttgttatgtaaagtttctcggtgtgttctgttaatgtaagacgatgaacagttgtgtatagtgttttaccctcttctttttcttggaactcctcaacacgtatggagggatttttcaggtttcagcatgaacatgggcttcttgctgtctgtctctctctcagtacagttcaaggtgtagcaagtgtacccacacagatagcattcaacaaaagctgcctcaactttttcgagaaaaatactttattcataaatatcagttttattctcatgtacctaagttgtggagaaaataattgcatcctataaactgcctgcagacgttagcaggctcttcaaaataactccatggtgcacaggagcacctgcatccaagagcatgcttacattttactgttctgcatattacaaaaaataacttgcaacttcataacttctttgacaaagtaaattacttttttgattgcagtttatatgaaaatgtactgatttttttttaataaactgcatcgagatccaaccgactgaattgttaaaaaaaaaaaaaataaagattcttaaaagaattacagtgtgtgcaagtttgctttgaaaaaaggatgaagggcaggagtattcaatggtcttggttccgatgataattattacttaacatagctgagaatcaaactgtagcaatgtctaatataaatagacttgggagatcgttttgaaatggtggatccttttagtatttaaatggagagtttgagtattcatgtgactgtatggtcccaaagttaatgctatttatgaaacagttttgtaagaacataatgaagttggtaaaagctaagcgttctgcacaataaacagttcccagtttggggctttttcaaggctaatgaagttattgttggtctagaaaaatagtatttacttaataaaactctgtttgaaattgttctgtggatttttagagcagaatttgaaacaaatgtaatgcaaataaatataaagataaagtgtcttaaagacaatattctgaaataaaagatataaaatataatttaaa

SEQ ID NO: 195405 - DNA, 2881 bp, Homo sapiens; identical to SEQ ID NO: 195403
  Payload ID: 18581
  Gene Name: Trophoblast glycoprotein
  ENST ID: ENST00000634826
  CDS Start-End: 426-1688

SEQ ID NO: 195406 - DNA, 6484 bp, Homo sapiens; identical to SEQ ID NO: 195402
  Payload ID: 18581
  Gene Name: Trophoblast glycoprotein
  ENST ID: ENST00000635036
  CDS Start-End: 618-1880

SEQ ID NO: 195407 - DNA, 3392 bp, Homo sapiens; identical to SEQ ID NO: 195404
  Payload ID: 18581
  Gene Name: Trophoblast glycoprotein
  ENST ID: ENST00000634817
  CDS Start-End: 937-2199

SEQ ID NO: 195408 - DNA, 2793 bp, Homo sapiens
  Payload ID: 18582
  Gene Name: trophoblast glycoprotein-like
  Uniprot ID: P0DKB5
  ENST ID: ENST00000562197
  CDS Start-End: 146-1294
ctcagactttcgagacagcgaacggaccgaccgggactgccagccgctccgggtcaaggactcgccccacccgtgccccccaccaggcgctcccaactcactggtgagcgcggcggcccgggcgctggatgcgggggcggccgcgatggccccgcgcgcgggacagccggggctccaggggctgctgctcgtggcggcggcgctgagccagcccgcggcaccctgccccttccagtgctactgcttcggcggccccaagctgctgctgcgctgcgcgtcgggagccgagctccgccagcctccgcgggacgtgccgcccgacgcgcgcaacctcaccatcgtaggcgccaacctgacggtgctgcgcgcggccgccttcgccggcggggacggggacggcgaccaggcggcgggcgtgcgcctgccgctcctgagcgcgctgcgcctcacgcacaaccacatcgaggtggtggaggacggcgccttcgacgggctgcccagcctggcggcgctcgacctcagccacaacccgctgcgcgccctgggcggcggcgccttccgcgggctgcccgcgctgcgctcgctgcagctcaaccacgcgctggtgcgcggcggccccgcgctgctggccgcgctggacgctgcgctggcaccgctggccgagcttcgcctgctgggcctagcgggcaacgcgctgagccgtctgccgccagccgccctgcgcctggcgcgcctggagcagctggacgtgcgcctcaacgcgctggccggcctggaccccgacgagctgcgcgcgctggagcgcgatggcggcctccccgggccgcgcctgctgctcgccgacaaccccctgcgctgcggctgtgccgcacgccccctgctggcctggctgcgcaacgccacggagcgcgtgcccgactcgcggcgcctgcgctgcgccgccccgcgggcgctgctagaccggccgctactggacctggacggggcgcggcttcgctgcgcggacagcggcgccgacgctcgcggagaggaggcggaggccgccggcccggagctggaagcctcctacgtgttcttcgggctggtgctggcactcatcggcctcatcttcctcatggtgctctacctaaaccgccgcggcatccagcgctggatgcgcaacctgcgcgaggcgtgccgggaccagatggagggctaccactaccgctacgagcaggacgccgacccgcgccgcgcgcccgcgcccgccgcgcccgcgggctcccgcgccacctccccgggctcggggctctgagcggcgcccccgggctcggggcttcccttgcctggcccgaagccgtggagatgagacacccgcgagccccgagctctgagaccttcccctgactcggaggcgctaagccgtaccctctcgttcccgcctccgagagctcccaccgtcaaagacccagagatagccggtccgaatccagaaaccccgcctgcccaccctagtttccgaaacctccctcctgaaccactgaaagtccgttccccgtctcggagctcacacagagaatctgtccttcaaggccaaagctctgagacttgcccccagcaccctgtgcttggagctccgacacccgagactgcactgacctccctcgccagctcggagccctcagtcccctccggggcttgagggcccttccatcccattctggactcgaagcacagcacccccatcagaatggttttgtggattttgagccctttgtcccatcccagagctcagagccctccatcctgcatggaggcccaaccctggggctctgaggattgggcaccctcccctcatctaagaatatatttcatacccctgcccccccttcacccacccccgcctctggctcaggcccttcccttcctcggctcaggcatggggctcagctcctagtctgtccctcccatcccagggacaagcacagcccatctagccttagtgtggagccaactctcagcctttcccaccagggcgctgacctcccgatactcagtgctggtccccagtctcagactctcagctcttcaccccgatctgactttcgtcctcctgcccaagcctttggctcttgaccccccccccatacccaatgctggcactcagcacccacccctgccattcactagtcaaggtccagtgaggaatccgtccctgggatgtcctcatccccttttcgtcccaggacgagctcttcagtcctgccggataggtgcaggtgccatgcacccctagtgcatactggcagatccttgtagggaaggagagagtcttgggtgtgtgaaagggatagtggggcatcgtggcctcagagaggggcaggaagtggggtctgaagggctggaagttgctgcccttcgatttctctatgctctctcccacccctgtggctcttcgcccttggggattccttgccaccaccgctaccaccaccacctcaccccgtgtatcttctgaaagagaagtaggtctttcctcctgcctcaggcacaagccctcctggttcagggtcagaagctcagcaccttgccttctccatgatcccaaagcacaattggtgagtgggggagaggaccccctctccctgactccccaccctctagatcaggcagaatggctggcctgtgctgcgtctgcacacaggaagtcaccttcctttaatatattggcttgaggcctgcctgccctccccatacccagaaaatctggatctcccttgagcagttttctataaagtctgcaataatctcaga

SEQ ID NO: 195409 - DNA, 3343 bp, Homo sapiens
  Payload ID: 18583
  Gene Name: tropomodulin 1
  Uniprot ID: P28289
  ENST ID: ENST00000259365
  CDS Start-End: 214-1293
agctcccgcccgcccgcggccgcccgggagctcgtccagccccgcgctgcgctcgcccgcccgctgcccgccggagcaccgcggcctccgcccgcgtccatctgcccgccgcccgcgcctgttccgcagcccgcgtccgcgccggccccacagctctgcgtccgggtattactcagcacagaaattcaggagacacagacaagttcttccacgatgtcgtacagacgagaactagagaaataccgtgacctggatgaagatgaaatccttggagccctaacagaggaagagctgaggaccctggaaaatgagctggatgagctggaccctgataatgcactgctgcctgcaggcctgaggcagaaggatcagaccaccaaggcgcccacgggcccctttaaaagagaggagctcttggatcacttggaaaagcaagcaaaggagtttaaggaccgagaagatctggtcccctacacaggggaaaaacgaggaaaggtctgggttcctaagcagaagccactggatcctgtgctggaaagtgtgacgctggaaccggagctggaggaagccttggcaaatgcttcagatgcagaactctgtgacattgcagcgatcctgggcatgcacacgctcatgagtaaccagcagtactaccaggccctgagcagcagctccatcatgaacaaggaggggctcaacagcgtgattaaacccacacaatacaagcctgtgcccgacgaagaaccaaattcaacagacgtagaggaaacgctggaacggataaagaacaacgacccaaaacttgaagaagttaacctcaataatatccggaatatccccatccccaccctcaaggcatatgcagaagccctgaaagaaaactcatatgtgaagaagttcagcatcgtggggacacggagtaatgaccccgtggcgtatgcccttgctgagatgctcaaggagaacaaggtgttgaagacactgaatgtggaatccaacttcatttctggagctgggattctgcgcctggtagaagccctcccatacaacacttctctggtggaaatgaaaattgacaaccagagccagcccctgggcaacaaagtggaaatggagattgtgagcatgttggaaaaaaacgcaacacttctcaaattcggctaccactttacccagcaaggaccccggcttcgggcatccaacgcaatgatgaacaacaatgaccttgtgaggaagaggaggcttgcggacctgactgggcccatcattcccaagtgccggagtggtgtctagtgtgtggcggtggagtccatgcctttgaactggatgtgttctattgatgacctgtgctctgcaggggaaaccagaaggcaaaatgctggcagcatgaaacccttttgtggttcagttctttatgcactaaggttttaggttgactagtggttgtagttgaaaattttataaaataccgttaatgtgaagtttttctttagtcacagaagttgaatctggttattatttaaaaactagaagcccccaaaccagcagatcttactgaagatgatgttccagcagcagcgacttagccccaggagcccagtttcaatggccttgctgtgtggtgtttcaagtgcatttaaaatgtgtgacacagaaacggcacactcttccacatgcttttgaagtattataaaacactttattacaaatttgtcttagctattagcaaataaaactgattatcattctttattaaccctccttggaattttgaaaacctcgattaaagttgccaaattgattactggatccagaacacaattttcccctcagaacagatagacagactgaagccactgaactctgccaggagtcaacatgagattccttttgctggatatgcagaaatgataggaaaaaaaccaatggtgaaatttcaagtttcaaaaaccaacctttcattaccaatcccaggcaacaaacatgtccctgagtgttctttaagaacatttgggatttatgtacaatttaatactggagttagaactttttccttattgaatgccaaccttatgatggatgtgaaaatctacggccaaatacttttgaaaacacctttctatattgcacagtgggcaaatggcttatgtgaggtaagacactagagggataaatttccagatcaacatggctatggtatttagtaatggcccagcttagagacttcagctactgatctcatcacttattagacaaattgctgctgaccttacgcctgtatattaagcctccgcaggatgccggacaatggtgaagaaactccagatatcaaggaattgggaaatcctggccaaaccaccccaagatgattacactgaaatgtagtattagtactgctgccagatctctttttaacatcatgtgcgtctcttgggatccagcaaaagtgttaagccacaatgcccttgtgccttttaatataccacagtgccagttaaactaatatttttgtttgttgcttttgggagttattttcattagtgatttcagcaaatctcatgataaaggacaaggtcaagaactccagagcactgagcagagaggctggtgatgaaaaggtgaaggcctgcgcactgaactgtaaggcagtgggcagtacagggtaactggaggcggggccagggcctcagcgctatggaagagtgtccactgaggctgcacatggcccaggagtggcaccatgttgcagggacaaccatccccatttggcttctccttaaaacacaattgcagctgcattctgcatcgctgaaaactgcaatataatattaaatctgttggtctatgcatggctgcgtatgtgtttcttggaacctgtgtgacagggacatgtgcctggcacactggccagaagactgggcagccaccatggcagtgctggatgacctcagtaagaatgtgtcatgtattccaggtgctgatctaaaaactgtggctcaaatgtcaccgagcttatatgaagctcccagagagaacatttaaaagctcagagagtaagtgctggggaaagcagagctatcagaggaaatctctcatagaaacgaaaccaaaccaacagaaaatgaagaaggccacatctttaaggccacctctgcctctatcagatgagctgctggtctagatcaggggctggcaaacttttctgtaaaaggccagacagtaaaaatttccgattttgcaggccacatagtgtctgttgcaactattcaactctgccatagatcatgtgtaaaggaatgggtgtggctgttcaataaactatacagttgacccttgaacaata

SEQ ID NO: 195410 - DNA, 2516 bp, Homo sapiens
  Payload ID: 18583
  Gene Name: tropomodulin 1
  Uniprot ID: P28289
  ENST ID: ENST00000375175
  CDS Start-End: 262-960
gtgccaggtcagagctgcaactctgtgctacgtttctgtgtggctttcttgaaactacttctctttatttttgttggcgtggctatttattgttatctgtaacgacgcaatatgctgccgaagtctgggaaggagaggggagctgtaagtctacaccagtgttaactggctaaccttggatgcctgtcatttgatgttggacatttgaaagatggcagcatctctggggaaggagggactgaacacttttgaccacctaccatgtcccaggttctatcgatcctgggcatgcacacgctcatgagtaaccagcagtactaccaggccctgagcagcagctccatcatgaacaaggaggggctcaacagcgtgattaaacccacacaatacaagcctgtgcccgacgaagaaccaaattcaacagacgtagaggaaacgctggaacggataaagaacaacgacccaaaacttgaagaagttaacctcaataatatccggaatatccccatccccaccctcaaggcatatgcagaagccctgaaagaaaactcatatgtgaagaagttcagcatcgtggggacacggagtaatgaccccgtggcgtatgcccttgctgagatgctcaaggagaacaaggtgttgaagacactgaatgtggaatccaacttcatttctggagctgggattctgcgcctggtagaagccctcccatacaacacttctctggtggaaatgaaaattgacaaccagagccagcccctgggcaacaaagtggaaatggagattgtgagcatgttggaaaaaaacgcaacacttctcaaattcggctaccactttacccagcaaggaccccggcttcgggcatccaacgcaatgatgaacaacaatgaccttgtgaggaagaggaggcttgcggacctgactgggcccatcattcccaagtgccggagtggtgtctagtgtgtggcggtggagtccatgcctttgaactggatgtgttctattgatgacctgtgctctgcaggggaaaccagaaggcaaaatgctggcagcatgaaacccttttgtggttcagttctttatgcactaaggttttaggttgactagtggttgtagttgaaaattttataaaataccgttaatgtgaagtttttctttagtcacagaagttgaatctggttattatttaaaaactagaagcccccaaaccagcagatcttactgaagatgatgttccagcagcagcgacttagccccaggagcccagtttcaatggccttgctgtgtggtgtttcaagtgcatttaaaatgtgtgacacagaaacggcacactcttccacatgcttttgaagtattataaaacactttattacaaatttgtcttagctattagcaaataaaactgattatcattctttattaaccctccttggaattttgaaaacctcgattaaagttgccaaattgattactggatccagaacacaattttcccctcagaacagatagacagactgaagccactgaactctgccaggagtcaacatgagattccttttgctggatatgcagaaatgataggaaaaaaaccaatggtgaaatttcaagtttcaaaaaccaacctttcattaccaatcccaggcaacaaacatgtccctgagtgttctttaagaacatttgggatttatgtacaatttaatactggagttagaactttttccttattgaatgccaaccttatgatggatgtgaaaatctacggccaaatacttttgaaaacacctttctatattgcacagtgggcaaatggcttatgtgaggtaagacactagagggataaatttccagatcaacatggctatggtatttagtaatggcccagcttagagacttcagctactgatctcatcacttattagacaaattgctgctgaccttacgcctgtatattaagcctccgcaggatgccggacaatggtgaagaaactccagatatcaaggaattgggaaatcctggccaaaccaccccaagatgattacactgaaatgtagtattagtactgctgccagatctctttttaacatcatgtgcgtctcttgggatccagcaaaagtgttaagccacaatgcccttgtgccttttaatataccacagtgccagttaaactaatatttttgtttgttgcttttgggagttattttcattagtgatttcagcaaatctcatgataaaggacaaggtcaagaactccagagcactgagcagagaggctggtgatgaaaaggtgaaggcctgcgcactgaactgtaaggcagtgggcagtacagggtaactggaggcggggccagggcctcagcgctatggaagagtgtccactgaggctgcacatggcccaggagtggcaccatgttgcagggacaaccatccccatttggcttctccttaaaacacaattgcagctgcattctgcatcgctgaaaactgcaatataatattaaatctgttggtctatgca

SEQ ID NO: 195411 - DNA, 3259 bp, Homo sapiens
  Payload ID: 18583
  Gene Name: tropomodulin 1
  Uniprot ID: P28289
  ENST ID: ENST00000395211
  CDS Start-End: 137-1216
agacaaaacgatcgcggttaaagcttgcggctcagagcccacctggccgcgctgctgggaaacggacggagcggcgcttcaatcagaggtattactcagcacagaaattcaggagacacagacaagttcttccacgatgtcgtacagacgagaactagagaaataccgtgacctggatgaagatgaaatccttggagccctaacagaggaagagctgaggaccctggaaaatgagctggatgagctggaccctgataatgcactgctgcctgcaggcctgaggcagaaggatcagaccaccaaggcgcccacgggcccctttaaaagagaggagctcttggatcacttggaaaagcaagcaaaggagtttaaggaccgagaagatctggtcccctacacaggggaaaaacgaggaaaggtctgggttcctaagcagaagccactggatcctgtgctggaaagtgtgacgctggaaccggagctggaggaagccttggcaaatgcttcagatgcagaactctgtgacattgcagcgatcctgggcatgcacacgctcatgagtaaccagcagtactaccaggccctgagcagcagctccatcatgaacaaggaggggctcaacagcgtgattaaacccacacaatacaagcctgtgcccgacgaagaaccaaattcaacagacgtagaggaaacgctggaacggataaagaacaacgacccaaaacttgaagaagttaacctcaataatatccggaatatccccatccccaccctcaaggcatatgcagaagccctgaaagaaaactcatatgtgaagaagttcagcatcgtggggacacggagtaatgaccccgtggcgtatgcccttgctgagatgctcaaggagaacaaggtgttgaagacactgaatgtggaatccaacttcatttctggagctgggattctgcgcctggtagaagccctcccatacaacacttctctggtggaaatgaaaattgacaaccagagccagcccctgggcaacaaagtggaaatggagattgtgagcatgttggaaaaaaacgcaacacttctcaaattcggctaccactttacccagcaaggaccccggcttcgggcatccaacgcaatgatgaacaacaatgaccttgtgaggaagaggaggcttgcggacctgactgggcccatcattcccaagtgccggagtggtgtctagtgtgtggcggtggagtccatgcctttgaactggatgtgttctattgatgacctgtgctctgcaggggaaaccagaaggcaaaatgctggcagcatgaaacccttttgtggttcagttctttatgcactaaggttttaggttgactagtggttgtagttgaaaattttataaaataccgttaatgtgaagtttttctttagtcacagaagttgaatctggttattatttaaaaactagaagcccccaaaccagcagatcttactgaagatgatgttccagcagcagcgacttagccccaggagcccagtttcaatggccttgctgtgtggtgtttcaagtgcatttaaaatgtgtgacacagaaacggcacactcttccacatgcttttgaagtattataaaacactttattacaaatttgtcttagctattagcaaataaaactgattatcattctttattaaccctccttggaattttgaaaacctcgattaaagttgccaaattgattactggatccagaacacaattttcccctcagaacagatagacagactgaagccactgaactctgccaggagtcaacatgagattccttttgctggatatgcagaaatgataggaaaaaaaccaatggtgaaatttcaagtttcaaaaaccaacctttcattaccaatcccaggcaacaaacatgtccctgagtgttctttaagaacatttgggatttatgtacaatttaatactggagttagaactttttccttattgaatgccaaccttatgatggatgtgaaaatctacggccaaatacttttgaaaacacctttctatattgcacagtgggcaaatggcttatgtgaggtaagacactagagggataaatttccagatcaacatggctatggtatttagtaatggcccagcttagagacttcagctactgatctcatcacttattagacaaattgctgctgaccttacgcctgtatattaagcctccgcaggatgccggacaatggtgaagaaactccagatatcaaggaattgggaaatcctggccaaaccaccccaagatgattacactgaaatgtagtattagtactgctgccagatctctttttaacatcatgtgcgtctcttgggatccagcaaaagtgttaagccacaatgcccttgtgccttttaatataccacagtgccagttaaactaatatttttgtttgttgcttttgggagttattttcattagtgatttcagcaaatctcatgataaaggacaaggtcaagaactccagagcactgagcagagaggctggtgatgaaaaggtgaaggcctgcgcactgaactgtaaggcagtgggcagtacagggtaactggaggcggggccagggcctcagcgctatggaagagtgtccactgaggctgcacatggcccaggagtggcaccatgttgcagggacaaccatccccatttggcttctccttaaaacacaattgcagctgcattctgcatcgctgaaaactgcaatataatattaaatctgttggtctatgcatggctgcgtatgtgtttcttggaacctgtgtgacagggacatgtgcctggcacactggccagaagactgggcagccaccatggcagtgctggatgacctcagtaagaatgtgtcatgtattccaggtgctgatctaaaaactgtggctcaaatgtcaccgagcttatatgaagctcccagagagaacatttaaaagctcagagagtaagtgctggggaaagcagagctatcagaggaaatctctcatagaaacgaaaccaaaccaacagaaaatgaagaaggccacatctttaaggccacctctgcctctatcagatgagctgctggtctagatcaggggctggcaaacttttctgtaaaaggccagacagtaaaaatttccgattttgcaggccacatagtgtctgttgcaactattcaactctgccatagatcatgtgtaaaggaatgggtgtggctgttcaataaactatacagttgacccttg

SEQ ID NO: 195412 - DNA, 9191 bp, Homo sapiens
  Payload ID: 18584
  Gene Name: tropomodulin 2 (neuronal)
  Uniprot ID: Q9NZR1
  ENST ID: ENST00000249700
  CDS Start-End: 222-1277
gcgcgccccggcgccgcgcccggccgggagccgcctgttgatcgccgcgctcgccccggccacggcgccgcccctgttctcccggccccgctccaccggggctgacggactgacggccagcacagccggctccgggatgagcgcacggacggtattctgaagtctcaggaaactggaccatttaaatgtgcatggcccatgagaaaggcttataagaagccatggcactcccctttcaaaaagagctggagaaatacaagaacattgatgaagatgagcttcttggcaaactctcagaagaggaactgaaacagttggaaaatgttctagatgacctagatcctgagagtgccatgctgccagctggatttcgacagaaagaccagacacagaaggcagccaccggcccctttgaccgcgagcacctcctcatgtacctggagaaggaggctttggaacagaaagacagagaggactttgtgcccttcactggagaaaagaaagggagagtctttatccctaaagaaaagcctatagaaactcgtaaagaagaaaaagtgacccttgacccagaactggaagaagctttggccagtgcctctgacaccgaactctatgatcttgcagctgtccttggagtacacaatttgctcaacaatccaaagttcgatgaagaaacagccaacaataaaggtggcaaaggacctgtcagaaatgttgtcaaaggtgaaaaagtaaagccagtatttgaggaaccaccaaatcccacaaatgtggaaataagcctgcagcagatgaaagccaatgatcctagcttgcaagaagtcaacctcaacaacattaagaacattccaattccaaccctgagggaatttgcaaaggctctggagaccaacactcacgtgaagaagttcagcctggccgcaactcgcagcaatgaccctgtggccattgcttttgcagacatgctgaaagtaaacaagaccttgacaagtctaaacatagaatccaattttatcactggaactgggatcctggccctggtagaggcactgaaagaaaatgacaccttgacagaaatcaagattgacaaccagaggcagcagttgggaacagctgtagagatggaaattgcccagatgctggaggagaattcaaggatcctcaagtttggataccagtttaccaagcaagggccacgaacaagggtggcagctgccatcacaaagaataatgacctggttcgtaagaagagagttgaagcagaccgaaggtaaacttccttgaggagaagtgaagtttcactgtggtatggccattgaaaaacaaaaactcttcttcttccccatcaggaccattttatcaaagttcgttcatttccgttaaccacataactaataatttaattgttattcttttttagcactacttatttatcttggattttgtaatatatgcaattgttttatttgctcatgggcacttctggcaacttgacaaatggaccgatgcagattttagagagtgacgacatggaaaatgaatttaaccactttcttattgggttgtcttgctttcttacatgaacttgtttttttaatcactgaaaggaatttagtgtataatatgtgtttgtaactgtgattatgatagaggcctatctctgtttacatgcatagctttgagttaggctaaatacatcagaagtgttctactgaccacataagaagttagtattgccaatctttcactgcatgtgaaaatgtgaccaatttagcacaaattctctcttagttccagaaaaatcagtaaatgcacatgccctgttgattggagatcagtagtgtcatcttcataaagcaagacaacattatgacactttaaaacagtagcaaagaagtctatttattaacccacaaatgtagcatcaagccagactcacaggtagcaaaatgaattacacacctacttttactgactattcaacataaattgaatctttaacatgactttaaaggctatttacaaagctgttttaaagtttttcaaacatgatagaaattttctaaattttagtaagagagaagcttttaaaacagtacattcctgaataaaacaacaatattgtatcttaatcaaggctgtctgatgcagatgattgcattttttggcaaattttagaagcatttattgctttgtctttagtgtaacaagatcactggattaaatataaacattcaggttaattatctagatttttgtccacagtatatgatccatccagacatttgcaaacgtcaggagaaaaatgtgaattatttatccagatgcatgtcatctcaaggacaaagcctgtgaaagtacaagtgagatggttgcattgtagtatgcattaatctttcaatgtagtggtgtaaaaatgcagtgctaaactaatgaagcaggtgactgcagcctttggctcaagctcacaactctgataactgtcagtgcctgaggttgtgattggtgacattctgacactgcccaaggcaactcaccctctattcctcctttctcccctccctttcttccaattcattgtcttttttttcctcttttctctgtaatttgttactaaacaaattccagaatttgtttagtagctgagtgttcctgagttgcctagtagcaataaaacaagtgaataggaaaataattaatatattattctatttagcttgtaaaacacatggaatctgtttaagatagcccttgtaaaattgaacatttacctgtattgtaagtacccacatctgtgtctctgaagtcctttgaaacatctcattatcttgaaatttttttaatgtttgagaacaccataagcagaatattctaacacctttggcccctgaaaatcctttaattagtttatggcttcatctccttatctatttaaaaaacatagtaaataatgtttatggttttcagtctgatttttccttccctttcacccatttaggtgtgatgtgttggagtcaacttgtacaggcttgccaactgttatattttcaagaattttgcaaactggttgttcaatacagccattatttaaaattaaatgatgtgcacttacaactgaatgaattatattaaggacagaagtaacaaatactgtactcaaaaatcttacattttactattttctaacctcttagattatttacatctagtaggtatgtatgtagaaatattaccaaacagtatgctactgaacgtatcctctcaactccatgttcactaccttcttgttactacagtggcttgaaattggccatggtagaaatatttacaccacagaaattagcaatatgtaagaaattggggttttctccctctccagattgctggttgataaacattcatcagcacaccactgggtgaaattatacatttttttatacatatgtttcgcttatcatgttgccgaagggaagaacatttctcttagatgtcttttctcctctttggatttgttacaaacctgtttaagtgctgagtccctgacctgcctctccaagtaagcctttttcctttttttttttttttttcttactctcattcttgccttgactcttaaaatcctggaccctatagagcattccttgcagccccacagtgctgtgggctgggggctaaagcagttcttggcaaactctggcagaaagcaagaaaaaaagaatcagaattcaatcatggctgtttcttttgtacaagcagttgttgatagtattaaagcaagataatgggacattatcaaaaatatagcactgtttttaccttatgaaatagttgggttgcatgcaacagagtctatgaaatcaaatgttttttactaatcagtttgttttcttattacctgtgtttttaaagtggcttgaaaggtggcatttccatgagtgtgcacatattgatgataacccttagaaaaacatacacttgaggagcctatccatcatttaattagcctaggacttcatctccctctctgcccaaagtgtggaagtggtagctctttcatgatcatgggcacagttaatcctttgctatccattgtgatggggcataatgtatataaaatatttttctatgtatttgttctgccagatactgtgttgagatatttggcaatatctggataactgactgaagggagataacttctccccaggcctatctccctcccccttttagagttgtgcaggtccactttaagtgtaaaatcactcacctggacttgtgggcttgtatcaccaacatctattatggcacatgtagatgacatttaggagaaaaaccttagaagtctagaaatcatatgattagttcagcactgcagctccccatctgcttatagtgtataactggaagctctttcatcctcatcagcatgattaaatgacttcgtttctttcatctttggagggtataatgtaaataagtgtcgtgtgtgtatgtgtgtgtgtactgtcagatatctaactaggtatttggctacatctggacaactgattgaagggagatgctctctccccagtcctcttcccttgtcctttttagaattgctgcaggcccaggttaaatatgaaattactccctaggctttgcagtttatgttaccaaccaccacattttatagctatgtagaggatgactcttaggaaataaatattagaagcctagaaatcatttagttgttctagcaccaaatctatccatttgcctaatgtatttaacattccatcctcatcaacatgatgaagcccctttcttccatctttgtagggcacattgtatataaatattttgtacataaagatcatcaaataccataatggggtatttggcttcatctggaaaattgactggagggagatgctgtctcccagccctgcttccctcgtccctgtccaagttgctgcaggcccaggttagaagattaccaacctggaggggcatgcagttcatcttacaataaaagcccattcatttaaaaactcagaaatcatcccagtgcctgtactcctcaaaccaatttccctaagggaagactggcacaccagcccaaagagcaggtgcttctcttccaacagaaacatggcccctgacagggcaccagcattagggaaaccaatgtcctccgaatagctgccatgagaacatttcagatgctcaaactgaaaattcttaaaaccaatattaagcatcagcatgctttaagtgtaagatagccctttggaatttacaaacacatgtgcagctatttccttcttcacagatatgatgtactcagccccctcctaggcactacgaagaagacagaggaagcataaaaattctggactaatataattttatatgtgtttctgagattggggagtagactgagtgccttttttacaaagaagatcccatatttaattcaagtatttatagcatcagcaaaaatgggcagagggcgggaagttgagaacactaggttctgtgctatgttacctgtattcagtagaagtgtttctggagtcaggttttaagtcatgatcctgaagcttccttcccctcttccactaatgatgcaataatagctgttttcattttaacgagcagagaactaagaggaaaggtcctagctctgccttccacttgcagcttccctttacctcctcttattgctttcatctcaaatatccctgctactcaaccaatcctaaagctaaagtactgagatgcacacaaaggaaaggtgtgagagtgcttggaagcatccagctgagcccactggatgaaaatcagacgatagggcctcctgttgtaatatactagccagagaaaagcgccaagaacttcagggatattattcactgctttattgctccctaaccctagatcagattggattttactttgtagttcaggagttaagaagtcaaattgctgaccgaggtggggaaggatgatggaaattaaaggtttacatttgtttaatggcagaactgagatttgctcagcttatctctttcccatctgtctgtaatagcaatgactgaataatcagtagaccaatggaagaggagttgcaagtttaaatttgtaacctgactctgggttctgttctaggaatagtgcatgttttagaggctttgccagttgggatacattgttgacttgggggaggatgaaggagagaactgatgacctagacatagaaaagagtagttaactaactagatgttcttctgatctcttccatggtagacattctgagcacattggcccagttagttggtatggtgaaggggcaccgtactaacagatttggagactgaaacctaatcccatcaccaacacttagcaggtatatgatcatgggcaattcattcaattgcctgccaattatagactatatagggggaagagcactggatttggagtcaagaaacctggacacttggctccacacttccttagctgggtaactttgggcaaaccgcttggtctctcaagcctaaggttcttcagctataaaatgggaataatacttcactaactacctcacagagttgtggtaagaatataatcagataactggataaaaacactatataaactggaaagcgccgtacaaatgtgagagatcagttttattatcaaatcactgttttccactgcctcttgaatcggctttattctaaccaaccattacatctttctcatcttttggagtatgggtaattgaggcttgggtgtgtcatcagggactggagttatttcagctcccatgtagaggtgggagaggtggttgatggggcagtggaagttagataccagcgatgtatatggtaggacattttcctgggtcactttgacagtaccttgggaaattgtcagtccttgcagagggcctaggctgggcacaagggagaaagcgaacagttgactaagaattgaggggagggtctggagcgctactgccctcctgtcattgctgtgggtgggagaggctaagacttcaggtttgactggaggcctaggagagaagagtgtccttagggtttcaagaattttaatgcctagcagctgagtaacaggcattagttctgatagatagtgaaggggagaaagtgccacctgttgtgagatcacctctccagggcagcagctgccttgttatcaccagcaaccttagccctggtcagtaatatttctgctaagaaaggttttgaagcatggcctccaatgactttcataagcccttggaggcaggactgtgtctcatccatctttgtatcttcagtaccatcttgtaaggtgccttgtacatagtaggtgcttaatgaacaaatgttgcttgaatttagctgtcgtccagccccacagagttatgctccatttgccaccatgtgatatttttgagaaacaatagtgatttggatgccagctctatgtgactttgggcaagactctccatctatcttgtcttcatttcatctgtaaaatgaagtgagtagattcaatgctccctaaggtcccttccagctccaatacttgacaagcttgtgattctaaatcgtttccgttgcctctgaacatgggtgagtaatgcctccactgcagctgtttctctccaggaggctttgttcagaggaggtctgactattgcacagccagttttttcttcctcttcagcagttctttactgtcttcagaatggttctggataagcggccttttctgaaaggatatttaaaaatatatactatttaggctgggcccagtggctcatgcctgtaatcccagcactttgggaggtgaaggtgggtggatcacctgaggtcaggagttcaagaccagcctggccaacatggtgaaaccccgtctctactaaaaatacagaaattagctgggccctgtggcaagagcctgttatcccagctactggggaggctgaggcaggaaaatcgcttgaacccaggaggtggaggttgtagtgagccgagatcacaccactgcactccagcctgggtgacaagaacgaaactccatctcaaaaaataaaataaaatatatactatcttgctcctcagaaccagtggggaagaagagggaaggcaaagaaagaaactgagcatagtaaacacagcatttttttgtaggctcttatttaaaatgtgtgtgtgtgtgtgtatgtgtgtgtttctgagtaagtattgactgggaaaaagagagaagtcaatcaaaagtatactgtgcaattgagagaggctggcccaagatttaaaacttcctgtgggtaatctaactgtgagtagataggaatcggccatatgacgaaatgagatcaataggaaatgtgctttttgaggaaattttattttagtaccaaatgttgccagtgacaatcttcagttaagaagtaagttattctgacctaaaattcttatctctgccactttggtttaaaaacaaaaacccttatatacatggaatagttatattttaattaagcatttattttagttgttttcatccattcaagcaaaatgaataagcagcatttttcattgcacttaaaaatgtaaaatacctgcatgccactaatctgtaacattttaccagttcagatgcctgtaatgtgtgactttatgtgtgtctgtgttgttttgaagagaataaaggaaataatactttgcaaactgtttaaacaagtgtttaaacttctattggcaacatttattgggctaagcagttattgaaaactccgcatagttttattttccatttgaaacttcaatcaaatcaagactattatattcattagggaattaaagactaatttgctttttaaatgtgaagttgaacactgtgtggaaagtaaatgtgtgatgaagcaaaatgtataaagtatgaaatattatacttttaccctggataattattcaggaccccagttggcccaaataggtgcaatttttaatcctttgaaattagccagccagacctaatgctaaggtaaatgtaaactgttttaattaattaagatctttctgctttcgaaggtataatgtatctatttctgtcaggaatgatatttccaaatgaaaatgtaaagaacattgggaaataataaactttcctttcaaagtaaaagtaaa

SEQ ID NO: 195413 - DNA, 1490 bp, Homo sapiens
  Payload ID: 18584
  Gene Name: tropomodulin 2 (neuronal)
  Uniprot ID: Q9NZR1
  ENST ID: ENST00000435126
  CDS Start-End: 116-1063
ggactgacggccagcacagccggctccgggatgagcgcacggacggtattctgaagtctcaggaaactggaccatttaaatgtgcatggcccatgagaaaggcttataagaagccatggcactcccctttcaaaaagagctggagaaatacaagaacattgatgaagatgagcttcttggcaaactctcagaagaggaactgaaacagttggaaaatgttctagatgacctagatcctgagagtgccatgctgccagctggatttcgacagaaagaccagacacagaaggcagccaccggcccctttgaccgcgagcacctcctcatgtacctggagaaggaggctttggaacagaaagacagagaggactttgtgcccttcactggagaaaagaaagggagagtctttatccctaaagaaaagcctatagaaactcgtaaagaagaaaaagtgacccttgacccagaactggaagaagctttggccagtgcctctgacaccgaactctatgatcttgcagctgtccttggagtacacaatttgctcaacaatccaaagttcgatgaagaaacagccaacaataaaggtggcaaaggacctgtcagaaatgttgtcaaaggtgaaaaagtaaagccagtatttgaggaaccaccaaatcccacaaatgtggaaataagcctgcagcagatgaaagccaatgatcctagcttgcaagaagtcaacctcaacaacattaaggcttttgcagacatgctgaaagtaaacaagaccttgacaagtctaaacatagaatccaattttatcactggaactgggatcctggccctggtagaggcactgaaagaaaatgacaccttgacagaaatcaagattgacaaccagaggcagcagttgggaacagctgtagagatggaaattgcccagatgctggaggagaattcaaggatcctcaagtttggataccagtttaccaagcaagggccacgaacaagggtggcagctgccatcacaaagaataatgacctggttcgtaagaagagagttgaagcagaccgaaggtaaacttccttgaggagaagtgaagtttcactgtggtatggccattgaaaaacaaaaactcttcttcttccccatcaggaccattttatcaaagttcgttcatttccgttaaccacataactaataatttaattgttattcttttttagcactacttatttatcttggattttgtaatatatgcaattgttttatttgctcatgggcacttctggcaacttgacaaatggaccgatgcagattttagagagtgacgacatggaaaatgaatttaaccactttcttattgggttgtcttgctttcttacatgaacttgtttttttaatcactgaaaggaatttagtgtataatatgtgtttgtaactgtgattatgatagaggcctatctctgtttacatgcatagctttgagttaggctaaatacatcag

SEQ ID NO: 195414 - DNA, 3000 bp, Homo sapiens
  Payload ID: 18584
  Gene Name: tropomodulin 2 (neuronal)
  ENST ID: ENST00000539962
  CDS Start-End: 400-1323
gttgatcgccgcgctcgccccggccacggcgccgcccctgttctcccggccccgctccaccggggctgacggactgacggccagcacagccggctccgggatgagcgcacggacggtattctgaagtctcaggaaactggaccatttaaatgtgcatggcccatgagaaaggcttataagaagccatggcactcccctttcaaaaagagctggagaaatacaagaacattgatgaagatgagcttcttggcaaactctcagaagaggaactgaaacagttggaaaatgttctagatgacctagatcctgaggctggagtgccgtggcaagatctcggctcactgcaacctctgcctcccagattcaagcgattctcctacctcagcctcccagagtgccatgctgccagctggatttcgacagaaagaccagacacagaaggcagccaccggcccctttgaccgcgagcacctcctcatgtacctggagaaggaggctttggaacagaaagacagagaggactttgtgcccttcactggagaaaagaaagggagagtctttatccctaaagaaaagcctatagaaactcgtaaagaagaaaaagtgacccttgacccagaactggaagaagctttggccagtgcctctgacaccgaactctatgatcttgcagctgtccttggagtacacaatttgctcaacaatccaaagttcgatgaagaaacagccaacaataaaggtggcaaaggacctgtcagaaatgttgtcaaaggtgaaaaagtaaagccagtatttgaggaaccaccaaatcccacaaatgtggaaataagcctgcagcagatgaaagccaatgatcctagcttgcaagaagtcaacctcaacaacattaagaacattccaattccaaccctgagggaatttgcaaaggctctggagaccaacactcacgtgaagaagttcagcctggccgcaactcgcagcaatgaccctgtggccattgcttttgcagacatgctgaaagtaaacaagaccttgacaagtctaaacatagaatccaattttatcactggaactgggatcctggccctggtagaggcactgaaagaaaatgacaccttgacagaaatcaagattgacaaccagaggcagcagttgggaacagctgtagagatggaaattgcccagatgctggaggagaattcaaggatcctcaagtttggataccagtttaccaagcaagggccacgaacaagggtggcagctgccatcacaaagaataatgacctggttcgtaagaagagagttgaagcagaccgaaggtaaacttccttgaggagaagtgaagtttcactgtggtatggccattgaaaaacaaaaactcttcttcttccccatcaggaccattttatcaaagttcgttcatttccgttaaccacataactaataatttaattgttattcttttttagcactacttatttatcttggattttgtaatatatgcaattgttttatttgctcatgggcacttctggcaacttgacaaatggaccgatgcagattttagagagtgacgacatggaaaatgaatttaaccactttcttattgggttgtcttgctttcttacatgaacttgtttttttaatcactgaaaggaatttagtgtataatatgtgtttgtaactgtgattatgatagaggcctatctctgtttacatgcatagctttgagttaggctaaatacatcagaagtgttctactgaccacataagaagttagtattgccaatctttcactgcatgtgaaaatgtgaccaatttagcacaaattctctcttagttccagaaaaatcagtaaatgcacatgccctgttgattggagatcagtagtgtcatcttcataaagcaagacaacattatgacactttaaaacagtagcaaagaagtctatttattaacccacaaatgtagcatcaagccagactcacaggtagcaaaatgaattacacacctacttttactgactattcaacataaattgaatctttaacatgactttaaaggctatttacaaagctgttttaaagtttttcaaacatgatagaaattttctaaattttagtaagagagaagcttttaaaacagtacattcctgaataaaacaacaatattgtatcttaatcaaggctgtctgatgcagatgattgcattttttggcaaattttagaagcatttattgctttgtctttagtgtaacaagatcactggattaaatataaacattcaggttaattatctagatttttgtccacagtatatgatccatccagacatttgcaaacgtcaggagaaaaatgtgaattatttatccagatgcatgtcatctcaaggacaaagcctgtgaaagtacaagtgagatggttgcattgtagtatgcattaatctttcaatgtagtggtgtaaaaatgcagtgctaaactaatgaagcaggtgactgcagcctttggctcaagctcacaactctgataactgtcagtgcctgaggttgtgattggtgacattctgacactgcccaaggcaactcaccctctattcctcctttctcccctccctttcttccaattcattgtcttttttttcctcttttctctgtaatttgttactaaacaaattccagaatttgtttagtagctgagtgttcctgagttgcctagtagcaataaaacaagtgaataggaaaataattaatatattattctatttagcttgtaaaacacatggaatctgtttaagatagcccttgtaaaattgaacatttacctgtattgtaagtacccacatctgtgtctctgaagtcctttgaaacatctcattatcttgaaatttttttaatgtttgagaacaccataagcagaatattctaacacctttggcccctgaaaatcctttaattagtttatggcttcatctccttatctatttaaaaaacatagtaaataa

SEQ ID NO: 195415 - DNA, 535 bp, Homo sapiens
  Payload ID: 18584
  Gene Name: tropomodulin 2 (neuronal)
  ENST ID: ENST00000561407
  CDS Start-End: 1-331
ggccattgcttttgcagacatgctgaaagtaaacaagaccttgacaagtctaaacatagaatccaattttatcactggaactgggatcctggccctggtagaggcactgaaagaaaatgacaccttgacagaaatcaagattgacaaccagaggcagcagttgggaacagctgtagagatggaaattgcccagatgctggaggagaattcaaggatcctcaagtttggataccagtttaccaagcaagggccacgaacaagggtggcagctgccatcacaaagaataatgacctggttcgtaagaagagagttgaagcagaccgaaggtaaacttccttgaggagaagtgaagtttcactgtggtatggccattgaaaaacaaaaactcttcttcttccccatcaggaccattttatcaaagtgtgatgtgttggagtcaacttgtacaggcttgccaactgttatattttcaagaattttgcaaactggttgttcaatacagccattatttaaaattaaatgatgtgcacttac

SEQ ID NO: 195416 - DNA, 8255 bp, Homo sapiens
  Payload ID: 18585
  Gene Name: tropomodulin 3 (ubiquitous)
  Uniprot ID: Q9NYL9
  ENST ID: ENST00000308580
  CDS Start-End: 282-1340
gagtgcgcacgcgcgtcggaggcgaaggaggaacccaccgcacctacagggcggtcgagtgagggagctgctggcgggtgggtctggcaactctttgggaggccgacgcgggcggaccggcgggtgctgggaaccgagcctcggcttgcggccggcagtttccgtgggtctgtgaagaggtcggcggcccctgcgggcgccagtcagctttaagaaaaagtagagatcacttctgactgtactgaacagcaaaaattaagtgacttgctgccctgcacatcatggcactgccattccgtaaggacttagaaaagtacaaagaccttgatgaagatgagctccttgggaatctgtcagaaacagaactgaaacaactggaaactgttttggatgatcttgaccccgagaatgcccttctgcctgcagggttccggcagaagaaccagacatcaaagtccaccacagggccatttgatagagagcatctcctttcatatctggagaaagaagcattggagcataaagacagggaagactatgtgccctacactggagaaaaaaaagggaaaatatttatccccaaacagaaacctgtacagacttttacagaagaaaaagtgtctcttgatccagaattagaagaagctttgacaagtgcttctgatacagaattgtgtgacctcgcagcaattcttgggatgcacaatttgataacgaatacaaagttctgtaatataatgggaagtagtaatggtgttgaccaagaacatttttcaaatgtggtcaaaggtgaaaagattcttccggtatttgatgagccaccaaatccaaccaatgtagaagagagtttgaagagaactaaagaaaacgatgctcatcttgttgaagttaatttgaataatataaagaatatcccaattccaaccctaaaagattttgcaaaggctttggaaaccaacacacatgtgaaatgtttcagtcttgcagccacccggagcaatgaccctgttgctactgcttttgcagaaatgctgaaagtgaacaaaactttgaagagcttaaatgtggagtccaactttatcacgggagttgggattctggcactgattgatgcgttaagagataatgaaaccctggcagagctcaagattgacaatcagaggcagcagttggggacagctgtagaattggaaatggccaagatgcttgaggaaaatacaaatatccttaaatttggatatcagtttacacagcagggaccacgaaccagagcagctaatgctataacaaaaaacaatgacttagtgcgtaagagacgagttgaaggagatcaccagtaagtctgcaaaggtgtaatctttggaagacttcagaagatcaccaagggctcatgttggtgacatcatgtaaaattttcctgggtagaagggaaaagactggaaaaatttttttagtgacatgcattttttttttagttgttatcaaattgtaaaatcagtaatgtgatattttatattctgaaacatttctactttctgctaaaatcaattttaatttagtttaattgaatgatttatgatgaatcttgggcaaaaaaatacaactgtaaaaaatttcacaggtcatttgtgtagaataatttgaacattgtgaggaccaatcttttttaaatcaaaagggatgttgctggtatcagaattgttattgcttcatttagacataaaacacttaagtgttttcttcactccgtgacctggagagttttccattttttaaaatacatgaacttggcaagggtgtgatttttctttatcaagagaacaaaatgccagaatgttaaaacagttaactcaaaatctagtcatctgtgtaggagctaaagcaggtctccagggagagagggtggtcgtctgtgcattccaggttactgcacttgtctgatgtgacgtagcaacacccaggtcttcttaaaacaaagtcatcagctttgccaggttacatactttatttaaaagtatagtgaggtcgaagttcattccagtgtttcattttaataatgtgggcattattaaatttttgtggaagctaatagtaaaaaataaaagctgttttcaccacctccctccccaccccccaaaaaaggcgtacagccaactcttagttatttagggtaagagaaaaaagaaaactgttaaacaatgaaatcaaagataataaatatgatagatttccagtatgaggcacttgcaaaacagtcatttaaactgatggttactgtaagtcagttggaagctggcatgtatgtaaattacttggtgttacaccatatccgaagaagttcctatgtgcagtgcagaattgcataaacagtatttaatcactgctacaaatcttccaaccaagaaggaaaactgctattcttcataaatctaatttttagtatatgcttcctttcatcttatacttttatcaatatttataaaagtcatttctataataaaagcagtctttcttgctcaaagtattaaggtgaacaattgaatagagtactgtggtcgggagactgatttgagactgcagagctgatgctgggtagagggtctggacttgtattcatgttctgtctcagggcagcccctggagcaggagatggcagaggcatttacagctgcagaaaacagggaggaatggaatctgaggtagccctggcctcaaaattcaggcctggctgtatcatttacagagatttttctggagggaaaagtctcatttctgaggaaggcaaggtggctaatcattattaattttttttaaactttttgggccgggcgcagtggctcacgcctgtaatcccagcacttttgggaagccaaagtgggtggatcacttaaggtcaggagttcaagaccagcctggccaacatggtgaaaccctgtctctactaaaaatcaaaaaagtagccgggtgtggtggtgcacacctgtaatcccagctactcaggaggctgaggcaggagaattgcttgaacctgggagatggagattgcagtgagctgagatcgtaccactgcactgcagtctgggtgacaaagcaagactctgtctcaaaaaacaaacaaacaaacaaactttttgaaattgaattgcaatatgtctgctactttggcttgggctggacagtttatctaataagcaaggcagcttcttgtgtgctatggtaataagccttcttaacaggctaagcttccctcataagaactgtggtgtttctctttttttttttttgttttggtttgttttggttttttggttttgttttgttttgttttttaaatcagtatccaatgttttataggggccaaaggttaactttgcactattccctgtcagttaaaggccactgatatttttctaagttagcaaggctcacttgcttgctttcttgcctcccttgcctccatccctctcccttcctaccttctctatttacctatttctctccctccctctcttctcctctctttttttttccccgcatatgcagctttttgattgtacttgattttatagagactgcacagttccagcaagattgggagtcaggcatggagcaggcatctcaggctaccagaaagaattggtcacctagactttcagtcaggcatcctcgtttgcattgtcctgtaagtcaattagttgataaatagttcccccttcatcccttaagttttgtttttgtttttgtttttaatataggtaagtgggactctacctaaaattttgcatcatacttatgggtaatatctttttcatatattatttatcaaagtatgaagttgagtattttgcttgtaccatttcaattctgcattatagtagttcattgtataactgaaagaaatgatttcttcataagtgacattaaatatgaacattcatccaattgaatttacaaaatctttccaaaattataagggagaaaaatcgggtttacttcaatctttaaaaatctggcacctcttagtaactttcagtatttctaaattgctctaaaattttataataaatagattagggttttgcaatagtcttaatttttaagccaaaggttttctgagaccttaggttttgtagtctaaccagcttatgtggttatttaaaagaatattctttgtgtttttaaattgctatttttaaaaaagctttttattacccattttataaaatgttatactcatatttgtctgaatttttccagtattcctacatgaaattgtatgtattaaaaactcaatattagtggcaaatattaatactattaaaatggattttggtgctatattcttgtagctaaagcctagtagaattctcaagaataggtgaaatacactttcaaagttgcctgtcatttaaaagaccaaataagcattttgtattaaataaattagcagatggttagagacttcaaggagagttagcttggtcatttaattgcgacttcatgttatttgattgaaataacccacatccttgctttgtataagatattcgctctggagaagttacatgtaaatagaattctataaattgttttccagttgaccgagtatctgttgtgtttttgtttaaaaagaggattccatgacataataaaaattattttaaaaaatgttttgggccgggtgcggtggctcacgcctgtaatcctagcactttgggaggccgaggtgggcggatcacctgaggtcaggagttcgagaccagcctgaccaacatggagaaaccctgtctctactaaaaatacaaaattagccaggcgtggtggcacacacctgtgatctcagctactcgggaggctgaggcaggagaatcactagaactcgggaggcggaggttgcagttagctgaggtcgcgccattgcactccagcatgggcaacaagagtgaaactccgtctcaaaaaaaaaaaaatttttttttttttataaaatgttactcatatcatattgtacgttatatttaactcttgctgtcattaaaataagatgacaacatttatgaagttttataaaatcttacattttagggtctgtgttcccagggctgcctcactttttccctaaaaaactaggaaccactgttaacctcccagcagatgcaaggatcatgctttctctggagtccttagtcacttccattctttgcaagtttagtactgcccaaatttactcattctacagtgttactgcactttgaacgtattgacccatgtcacccaagagaagcaaacatatggatgcactagagacaactcgggttgctgctctcagttaagggctatgagttcttggggtctaagtatctgtaaaattatcctctccatcagctctcactgatcattaatgtttctggatatttcttaccctaagatttgcttaccaacaaatcaaagaaacgcttcactaattatttttaaattgagaaaatagtattcagaggcaaagatttttatattcttttttgagaccaagtctcactctgtcatccaggctggagtgcagtggtgcgatctcagctcactgcagcttccacctcccagattcaagtgattctcctgcctcagcctcccaagtagctgggattacaggcgtccgccaccacgcccggataactttttgtatttttaatagagacggggtttcaccatgttggccgggctgttctcaaagtgacctcaggtgatccactcgcctcggcctcccaaagtgctgggattacaggcttgagccaccacactcagccttattcttatattttaatttggtcattcttagatctacagattgaacatccctaattgaaaactttttgagtactaacatagtgttcaaaggaaatgcttattggagcatttagaatttcagattttcagattagggatgctgaactggtgtaatgcccagtattccaaaatccaaaataatttgaaatctgaaacacttaatggtcccagcatgttggataagggatactcaacctgtattgatttttctccactataattcagttctataagttcttccctataaaaaatgaatgaattagaaatttgataataaaacatattttattaattttaaactctatcttgcagtctgatcattcagaaaggtcaacctagaaaaaagacatggctaagtaaactattttaagccataactaagtattttggaaagccttcattaacacataaagaattttggccaagtactgtggcttatgcctgtaatcctagcactttggaaagccgaggccgacggatcacttgagctcaggagtttgagaccaacctgcgtaacatggtgaaaccccatatctacaaaaagtacaaaaattagctgggtgcggtggcgcatgcctgtagtcccatctactcggaagactgaggcagcagaaccgcttgagcctaggaggtggaggttgcagtaagatgagatcatgctgctgtactctagcctgggcaatgagagtgaaactcttatctcaaaaaaaaaaaaaaaaaaagagctatactcatagtactttgggagaccaagcagggaggattacttgagaccaggagtttgagactaccatggacaacatagcaagaccccatctttacaaaaaatttaaaaattagccagacacctatagtaccagctacttaggagtctaaagtgggagaattgcttgagcctgggaggttgaagcagcagtgagctttgatcatgccactgcattccagcctgggtaacaagagtgagactgtctcaaaaaacaaaacaaaacaaaaaaatgggtttttttgttgttgtttttgtcttttacttaggacacctgctctagaggctagataaaaatagattgtaatggccgggtgcagtggctcacacttgtaatcccagcactgtggaggctgaggtgggcggatcacttgaggtcaggagtacgagaccagtctggccaacatggtgaaaccccatctctactaaaaatacaaaaaattagttgggcgtggtgatgcgcacctgtaattctagctacttgggagcctaaggcaggagaatcacttgaacctgggaggcagaagttgcagtgagccgagattgtgccattgcactccagcctgggtgacagagtgagactccatctcaaaaaaatatatgtattaagaaataccaccagcagtgttttgctaacatagctgtaacaaattattaagttcttttttttttttaagatggaggttcactcttgtcgcccaggctggagcgcaatggtgcgatctcagctcactgcaacctccgcctcctgggttcagatgattttcctgcctcagcctcctgggtagctgggactacaggtgcccgccaccacgcctgactaatttttgtattttcagtagagacggagtttcaccatcttggccaggctggtctcgaactcctgacctcgtaatccacccgcctcggcctcccaaagtgctgggattacaggtgtttgccaccgcgcccagcccaaattattacattcgtaagacagacacctcttagaatctatatatatgaggttttactcccttttctacactcagtatgttttaattgatgcaaagcaattaattggcctaaaatgtttcaaatattatagtctatacattcagaaagtaaggtttaagaatgaattattggtgcttcttggtgggtgtatatagcagtttttagaagtttaaatttcacctctactcagaaagataagcttttgattcagtggtttcaaattttcagatcaatccatttaagaattgttttttcaaatgtatatacacgtataacataaaaatttttgtaatttcaaatgtctttttttcagttttttggatgaattattatatttggttttagttacatttaaaagcttgaaaattacctttctaacaatcatttgaatgtcattcattgtcacatgaaatcaggtatttacgtttttttctaatgctaaaatatccaacattgtaattgccctatttttccatttttataagtataaaagcaatgaattttaacactggtatttaaataatacaaaatattatccaaattcataacagcacagtgaagtttcttttgaagactatgtactggaagcatttagaacttaccaatatatactgggataaatcgtttcaataaagtttatcaaatattctgtaaa

SEQ ID NO: 195417 - DNA, 2054 bp, Homo sapiens
  Payload ID: 18585
  Gene Name: tropomodulin 3 (ubiquitous)
  Uniprot ID: Q9NYL9
  ENST ID: ENST00000544199
  CDS Start-End: 48-1106
gactgtactgaacagcaaaaattaagtgacttgctgccctgcacatcatggcactgccattccgtaaggacttagaaaagtacaaagaccttgatgaagatgagctccttgggaatctgtcagaaacagaactgaaacaactggaaactgttttggatgatcttgaccccgagaatgcccttctgcctgcagggttccggcagaagaaccagacatcaaagtccaccacagggccatttgatagagagcatctcctttcatatctggagaaagaagcattggagcataaagacagggaagactatgtgccctacactggagaaaaaaaagggaaaatatttatccccaaacagaaacctgtacagacttttacagaagaaaaagtgtctcttgatccagaattagaagaagctttgacaagtgcttctgatacagaattgtgtgacctcgcagcaattcttgggatgcacaatttgataacgaatacaaagttctgtaatataatgggaagtagtaatggtgttgaccaagaacatttttcaaatgtggtcaaaggtgaaaagattcttccggtatttgatgagccaccaaatccaaccaatgtagaagagagtttgaagagaactaaagaaaacgatgctcatcttgttgaagttaatttgaataatataaagaatatcccaattccaaccctaaaagattttgcaaaggctttggaaaccaacacacatgtgaaatgtttcagtcttgcagccacccggagcaatgaccctgttgctactgcttttgcagaaatgctgaaagtgaacaaaactttgaagagcttaaatgtggagtccaactttatcacgggagttgggattctggcactgattgatgcgttaagagataatgaaaccctggcagagctcaagattgacaatcagaggcagcagttggggacagctgtagaattggaaatggccaagatgcttgaggaaaatacaaatatccttaaatttggatatcagtttacacagcagggaccacgaaccagagcagctaatgctataacaaaaaacaatgacttagtgcgtaagagacgagttgaaggagatcaccagtaagtctgcaaaggtgtaatctttggaagacttcagaagatcaccaagggctcatgttggtgacatcatgtaaaattttcctgggtagaagggaaaagactggaaaaatttttttagtgacatgcattttttttttagttgttatcaaattgtaaaatcagtaatgtgatattttatattctgaaacatttctactttctgctaaaatcaattttaatttagtttaattgaatgatttatgatgaatcttgggcaaaaaaatacaactgtaaaaaatttcacaggtcatttgtgtagaataatttgaacattgtgaggaccaatcttttttaaatcaaaagggatgttgctggtatcagaattgttattgcttcatttagacataaaacacttaagtgttttcttcactccgtgacctggagagttttccattttttaaaatacatgaacttggcaagggtgtgatttttctttatcaagagaacaaaatgccagaatgttaaaacagttaactcaaaatctagtcatctgtgtaggagctaaagcaggtctccctccccaccccccaaaaaaggcgtacagccaactcttagttatttagggtaagagaaaaaagaaaactgttaaacaatgaaatcaaagataataaatatgatagatttccagtatgaggcacttgcaaaacagtcatttaaactgatggttactgtaagtcagttggaagctggcatgtatgtaaattacttggtgttacaccatatccgaagaagttcctatgtgcagtgcagaattgcataaacagtatttaatcactgctacaaatcttccaaccaagaaggaaaactgctattcttcataaatctaatttttagtatatgcttcctttcatcttatacttttatcaatatttataaaagtcatttctataataaaagcagtctttcttgctca

SEQ ID NO: 195418 - DNA, 1139 bp, Homo sapiens
  Payload ID: 18585
  Gene Name: tropomodulin 3 (ubiquitous)
  ENST ID: ENST00000561438
  CDS Start-End: 1-563
atgtggtcaaaggtgaaaagattcttccggtatttgatgagccaccaaatccaaccaatgtagaagagagtttgaagagaactaaagaaaacgatgctcatcttgttgaagttaatttgaataatataaagaatatcccaattccaaccctaaaagattttgcaaaggctttggaaaccaacacacatgtgaaatgtttcagtcttgcagccacccggagcaatgaccctgttgctactgcttttgcagaaatgctgaaagtgaacaaaactttgaagagcttaaatgtggagtccaactttatcacgggagttgggattctggcactgattgatgcgttaagagataatgaaaccctggcagagctcaagattgacaatcagaggcagcagttggggacagctgtagaattggaaatggccaagatgcttgaggaaaatacaaatatccttaaatttggatatcagtttacacagcagggaccacgaaccagagcagctaatgctataacaaaaaacaatgacttagtgcgtaagagacgagttgaaggagatcaccagtaagtctgcaaaggtgtaatctttggaagacttcagaagatcaccaagggctcatgttggtgacatcatagactgcacagttccagcaagattgggagtcaggcatggagcaggcatctcaggctaccagaaagaattggtcacctagactttcagtcaggcatcctcgtttgcattgtcctagacaggagactctctccatcatgtgaagatacagcaaaacagcagctgtctgcaagccaggaagggaaccctcaccaggaaccaaaccatgatctcggacgtcccagcctctaggaacgtcacttgctctggggaaagccacctgccatgccgtgaggacattcaaactgcctatggagaggtccacatagtgaaaaactaaggcccctgccaaaacccatgtgagccatcttggaaacagatccttcagccctaggcaagcccttagataatgtagtgccagccaacatcttgacagcagcctgcaagagactctgagttagaaacaaccagcgaagccattcctgaattcctaatcctcagaatcagcatgataatagtaaatgcttattgtaa

SEQ ID NO: 195419 - DNA, 1474 bp, Homo sapiens
  Payload ID: 18585
  Gene Name: tropomodulin 3 (ubiquitous)
  ENST ID: ENST00000560549
  CDS Start-End: 380-1021
aaaggtaaatttaacccagttgccttaaactaaggacttcccatatgctgtccaagttatttattcacagttatgttagctttccagaaaacctcctctttctcacctttctgagtatgtgatttctttggaggaaagacagacctgatcccttagtaaaccagaaagatcatgattataaacctgcctacatcaagaggattacataaccaccactgggcaattggtttccgctaagtccaaagggaaaatatttatccccaaacagaaacctgtacagacttttacagaagaaaaagtgtctcttgatccagaattagaagaagctttgacaagtgcttctgatacagaattgtgtgacctcgcagcaattcttgggatgcacaatttgataacgaatacaaagttctgtaatataatgggaagtagtaatggtgttgaccaagaacatttttcaaatgtggtcaaaggtgaaaagattcttccggtatttgatgagccaccaaatccaaccaatgtagaagagagtttgaagagaactaaagaaaacgatgctcatcttgttgaagttaatttgaataatataaagaatatcccaattccaaccctaaaagattttgcaaaggctttggaaaccaacacacatgtgaaatgtttcagtcttgcagccacccggagcaatgaccctgttgctactgcttttgcagaaatgctgaaagtgaacaaaactttgaagagcttaaatgtggagtccaactttatcacgggagttgggattctggcactgattgatgcgttaagagataatgaaaccctggcagagctcaagattgacaatcagaggcagcagttggggacagctgtagaattggaaatggccaagatgcttgaggaaaatacaaatatccttaaatttggatatcagtttacacagcagggaccacgaaccagagcagctaatgctataacaaaaaacaatgacttagtgcgtaagagacgagttgaaggagatcaccagtaagtctgcaaaggtgtaatctttggaagacttcagaagatcaccaagggctcatctttttgattgtacttgattttatagagactgcacagttccagcaagattgggagtcaggcatggagcaggcatctcaggctaccagaaagaattggtcacctagactttcagtcaggcatcctcgtttgcattgtcctagacaggagactctctccatcatgtgaagatacagcaaaacagcagctgtctgcaagccaggaagggaaccctcaccaggaaccaaaccatgatctcggacgtcccagcctctaggaacgcctttccatcttcctagagtgcctaacctggcctgtgtgcttgtaagcttctgctcattcttcaatacccagcagagacttcctcctccatgcagccttccaagacccacctgagtacagaaattggctcttcctcctgctg

SEQ ID NO: 195420 - DNA, 447 bp, Homo sapiens
  Payload ID: 18585
  Gene Name: tropomodulin 3 (ubiquitous)
  ENST ID: ENST00000558455
  CDS Start-End: 349-447
gggagtgcgcacgcgcgtcggaggcgaaggaggaacccaccgcacctacagggcggtcgagtgagggagctgctggcgggtgggtctggcaactctttgggaggccgacgcgggcggaccggcgggtgctgggaaccgagcctcggcttgcggccggcagtttccgtgggtctgtgaagaggtcggcggcccctgcgggcgccagtcagattgggacttgactgagattgatccagggctagttaccatgtatttcctgatggaagaatgttaactttaagaaaaagtagagatcacttctgactgtactgaacagcaaaaattaagtgacttgctgccctgcacatcatggcactgccattccgtaaggacttagaaaagtacaaagaccttgatgaagatgagctccttgggaatctgtcagaaacagaactgaaacaactggaa

SEQ ID NO: 195421 - DNA, 1267 bp, Homo sapiens
  Payload ID: 18586
  Gene Name: tropomodulin 4 (muscle)
  Uniprot ID: Q9NZQ9
  ENST ID: ENST00000295314
  CDS Start-End: 136-1173
ccgggctcctcctgctgctgggacagtgctctagtagaacagacagacctactgacacaggggaggtgagaagggaggtgaccaccaggactggctctgtgagtaccacacagtggggagggggtgggggccaccatgtcatcatatcagaaggaactggagaaatacagagacatagatgaagatgagatcctaaggaccttgagccccgaggagctagagcagctggactgcgaactacaggagatggatcctgagaacatgctcctgccagctggactaagacaacgtgaccagacaaagaagagcccaacggggccactggaccgagaggcccttttgcagtacttggagcaacaggcactagaagtcaaagagcgtgatgacttggtgcccttcacaggcgagaagaaggggaaaccctatattcagcccaagagggaaatcccagcagaggagcagatcaccctggagcctgagctggaggaggcactggcacatgccacagatgctgaaatgtgtgacattgcagcaattctggacatgtacacactgatgagtaacaagcaatactatgatgccctctgcagtggagaaatctgcaacactgaaggcattagcagtgtggtacagcctgacaagtataagccagtgccggatgaacccccaaatcccacaaacattgaggagatactaaagagggtccgaagcaatgacaaggagctggaggaggtgaacttgaataatatacaggacatcccaatacccatgctaagtgagctgtgtgaggcaatgaaggcaaatacctatgtgcggagcttcagtctggtagccacgaggagtggtgaccccattgccaatgcagtggctgacatgttgcgtgagaatcgtagcctccagagcctaaacatcgaatccaacttcattagcagcacaggactcatggctgtgctgaaggcagttcgggaaaatgccacactcactgagctccgtgtagacaatcagcgccagtggcctggtgatgcagtggagatggagatggccaccgtgctagagcagtgtccctctattgtccgctttggctaccactttacacagcaggggccacgagctcgggcagcccaggccatgacccgaaacaatgaactacgtcgccagcaaaagaagagataacactgcatttccctttaccaactagcgctgggagcactggacacttaaatcctcatctgtcctcctttcctgtaaataaaagcccttctatcca

SEQ ID NO: 195422 - DNA, 493 bp, Homo sapiens
  Payload ID: 18586
  Gene Name: tropomodulin 4 (muscle)
  ENST ID: ENST00000441701
  CDS Start-End: 68-493
agacagacctactgacacaggggaggctctgtgagtaccacacagtggggagggggtgggggccaccatgtcatcatatcagaaggaactggagaaatacagagacatagatgaagatgagatcctaaggaccttgagccccgaggagctagagcagctggactgcgaactacaggagatggatcctgagaacatgctcctgccagctggactaagacaacgtgaccagacaaagaagagcccaacggggccactggaccgagaggcccttttgcagtacttggagcaacaggcactagaagtcaaagagcgtgatgacttggtgcccttcacaggcgagaagaaggggaaaccctatattcagcccaagagggaaatcccagcagaggagcagatcaccctggagcctgagctggaggaggcactggcacatgccacagatgctgaaatgtgtgacattgcagcaattctggacatgtacacactgatgagt

SEQ ID NO: 195423 - DNA, 441 bp, Homo sapiens
  Payload ID: 18586
  Gene Name: tropomodulin 4 (muscle)
  ENST ID: ENST00000466891
  CDS Start-End: 1-371
atgatgccctctgcagtggagaaatctgcaacactgaaggcattagcagtgtggtacagcctgacaagtataagccagtgccggatgaacccccaaatcccacaaacattgaggagatactaaagagggtccgaagcaatgacaaggagctggaggaggtgaacttgaataatatacaggcagtggctgacatgttgcgtgagaatcgtagcctccagagcctaaacatcgaatccaacttcattagcagcacaggactcatggctgtgctgaaggcagttcgggaaaatgccacactcactgagctccgtgtagacaatcaggtcgccagcaaaagaagagataacactgcatttccctttaccaactagcgctgggagcactggacacttaaatcctcatctgtcctcctttcctgtaaataaaagcccttctatccat

SEQ ID NO: 195424 - DNA, 1183 bp, Homo sapiens
  Payload ID: 18586
  Gene Name: tropomodulin 4 (muscle)
  ENST ID: ENST00000463543
  CDS Start-End: 73-204
agaacagacagacctactgacacaggggaggctctgtgagtaccacacagtggggagggggtgggggccaccatgtcatcatatcagaaggaactggagaaatacagagacatagatgaagatgagatcctaaggaccttgagccccgaggagctagagcagctggactgcgaactacaggagatggatcctgagctggactaagacaacgtgaccagacaaagaagagcccaacggggccactggaccgagaggcccttttgcagtacttggagcaacaggcactagaagtcaaagagcgtgatgacttggtgcccttcacaggcgagaagaaggggaaaccctatattcagcccaagagggaaatcccagcagaggagcagatcaccctggagcctgagctggaggaggcactggcacatgccacagatgctgaaatgtgtgacattgcagcaattctggacatgtacacactgatgagtaacaagcaatactatgatgccctctgcagtggagaaatctgcaacactgaaggcattagcagtgtggtacagcctgacaagtataagccagtgccggatgaacccccaaatcccacaaacattgaggagatactaaagagggtccgaagcaatgacaaggagctggaggaggtgaacttgaataatatacaggacatcccaatacccatgctaagtgagctgtgtgaggcaatgaaggcaaatacctatgtgcggagcttcagtctggtagccacgaggagtggtgaccccattgccaattggctgacatgttgcgtgagaatcgtagcctccagagcctaaacatcgaatccaacttcattagcagcacaggactcatggctgtgctgaaggcagttcgggaaaatgccacactcactgagctccgtgtagacaatcagcgccagtggcctggtgatgcagtggagatggagatggccaccgtgctagagcagtgtccctctattgtccgctttggctaccactttacacagcaggggccacgagctcgggcagcccaggccatgacccgaaacaatgaactacgtcgccagcaaaagaagagataacactgcatttccctttaccaactagcgctgggagcactggacacttaaatcctcatctgtcctcctttcctgtaaataaaagcccttctatcc

SEQ ID NO: 195425 - DNA, 1670 bp, Homo sapiens
  Payload ID: 18587
  Gene Name: tropomyosin 1 (alpha)
  Uniprot ID: P09493
  ENST ID: ENST00000267996
  CDS Start-End: 73-927
cgctcctccgcccgaccgcgcgctcgccccgccgctcctgctgcagccccagggcccctcgccgccgccaccatggacgccatcaagaagaagatgcagatgctgaagctcgacaaggagaacgccttggatcgagctgagcaggcggaggccgacaagaaggcggcggaagacaggagcaagcagctcgaggaggacatcgcggccaaggagaagttgctgcgggtgtcggaggacgagcgggaccgggtgctggaggagctgcacaaggcggaggacagcctcctggccgccgaagaggccgccgccaaggctgaagccgacgtagcttctctgaacagacgcatccagctggttgaggaagagttggatcgtgcccaggagcgtctggcaacagctttgcagaagctggaggaagctgagaaggcagcagatgagagtgagagaggcatgaaagtcattgagagtcgagcccaaaaagatgaagaaaaaatggaaattcaggagatccaactgaaagaggccaagcacattgctgaagatgccgaccgcaaatatgaagaggtggcccgtaagctggtcatcattgagagcgacctggaacgtgcagaggagcgggctgagctctcagaaggcaaatgtgccgagcttgaagaagaattgaaaactgtgacgaacaacttgaagtcactggaggctcaggctgagaagtactcgcagaaggaagacagatatgaggaagagatcaaggtcctttccgacaagctgaaggaggctgagactcgggctgagtttgcggagaggtcagtaactaaattggagaaaagcattgatgacttagaagagaaagtggctcatgccaaagaagaaaaccttagtatgcatcagatgctggatcagactttactggagttaaacaacatgtgaaaacctccttagctgcgaccacattctttcgttttgttttgttttgtttttaaacacctgcttaccccttaaatgcaatttatttacttttaccactgtcacagaaacatccacaagataccagctaggtcagggggtggggaaaacacatacaaaaaggcaagcccatgtcagggcgatcctggttcaaatgtgccatttcccgggttgatgctgccacactttgtagagagtttagcaacacagtgtgcttagtcagcgtaggaatcctcactaaagcagaagaagttccattcaaagtgccaatgatagagtcaacaggaaggttaatgttggaaacacaatcaggtgtggattggtgctactttgaacaaaaggtccccctgtggtcttttgttcaacattgtacaatgtagaactctgtccaacactaatttattttgtcttgagttttactacaagatgagactatggatcccgcatgcctgaattcactaaagccaagggtctgtaagccacgctgctcttccgagacttccattcctttctgattggcacacgtgcagctcatgacaatctgtaggataacaatcagtgtggatttccactcttttcagtccttcatgttaaagatttagacaccacatacaactggtaaaggacgttttcttgagagttttaactatatgtaaacattgtataatgatatggaataaaatgcacattgtaggacattttctaaa

SEQ ID NO: 195426 - DNA, 1295 bp, Homo sapiens
  Payload ID: 18587
  Gene Name: tropomyosin 1 (alpha)
  Uniprot ID: P09493
  ENST ID: ENST00000288398
  CDS Start-End: 199-1053
gagaggaggaaggggggcaggagaaaaaagcttttccaaaaaagtattggctgtcttgaggaatgcggtcgcccccttgggaaagtacatatctgggagaagcaggcggctccgcgctcgcactcccgctcctccgcccgaccgcgcgctcgccccgccgctcctgctgcagccccagggcccctcgccgccgccaccatggacgccatcaagaagaagatgcagatgctgaagctcgacaaggagaacgccttggatcgagctgagcaggcggaggccgacaagaaggcggcggaagacaggagcaagcagctggaagatgagctggtgtcactgcaaaagaaactcaagggcaccgaagatgaactggacaaatactctgaggctctcaaagatgcccaggagaagctggagctggcagagaaaaaggccaccgatgctgaagccgacgtagcttctctgaacagacgcatccagctggttgaggaagagttggatcgtgcccaggagcgtctggcaacagctttgcagaagctggaggaagctgagaaggcagcagatgagagtgagagaggcatgaaagtcattgagagtcgagcccaaaaagatgaagaaaaaatggaaattcaggagatccaactgaaagaggccaagcacattgctgaagatgccgaccgcaaatatgaagaggtggcccgtaagctggtcatcattgagagcgacctggaacgtgcagaggagcgggctgagctctcagaaggccaagtccgacagctggaagaacaattaagaataatggatcagaccttgaaagcattaatggctgcagaggataagtactcgcagaaggaagacagatatgaggaagagatcaaggtcctttccgacaagctgaaggaggctgagactcgggctgagtttgcggagaggtcagtaactaaattggagaaaagcattgatgacttagaagacgagctgtacgctcagaaactgaagtacaaagccatcagcgaggagctggaccacgctctcaacgatatgacttccatgtaaacgttcatccactctgcctgcttacaccctgccctcatgctaatataagtttctttgcttcacttctcccaagactccctcgtcgagctggatgtcccacctctctgagctctgcatttgtctattctccagctgaccctggttctctctcttagcatcctgccttagagccaggcacacactgtgctttctattgtacagaagctcttcgtttcagtgtcaaataaacactgtgtaagcta

SEQ ID NO: 195427 - DNA, 738 bp, Homo sapiens
  Payload ID: 18587
  Gene Name: tropomyosin 1 (alpha)
  ENST ID: ENST00000317516
  CDS Start-End: 1-738
atggcggggagtagctcgctggaggcggtgcgcaggaagatccggagcctgcaggagcaggcggacgccgctgaggagcgcgcgggcaccctgcagcgcgagctggaccacgagaggaagctgagggagaccgctgaagccgacgtagcttctctgaacagacgcatccagctggttgaggaagagttggatcgtgcccaggagcgtctggcaacagctttgcagaagctggaggaagctgagaaggcagcagatgagagtgagagaggcatgaaagtcattgagagtcgagcccaaaaagatgaagaaaaaatggaaattcaggagatccaactgaaagaggccaagcacattgctgaagatgccgaccgcaaatatgaagaggtggcccgtaagctggtcatcattgagagcgacctggaacgtgcagaggagcgggctgagctctcagaaggccaagtccgacagctggaagaacaattaagaataatggatcagaccttgaaagcattaatggctgcagaggataagtactcgcagaaggaagacagatatgaggaagagatcaaggtcctttccgacaagctgaaggaggctgagactcgggctgagtttgcggagaggtcagtaactaaattggagaaaagcattgatgacttagaagatcaactctaccagcaacttgagcaaaatcgccgcctcactaatgaactaaagctggccctgaatgaggattaa

SEQ ID NO: 195428 - DNA, 1637 bp, Homo sapiens
  Payload ID: 18587
  Gene Name: tropomyosin 1 (alpha)
  Uniprot ID: P09493
  ENST ID: ENST00000334895
  CDS Start-End: 211-948
cgcgcgcgcccgcctgcggtttgtctgcgcagccctggaggctgcgacttccggactgctcctggccgcagggggcgccgccatcgcacagagaggcctgggcggggcggaccggcgctgggcagccaggacagccgcggcagccgggtccgcagggcagcagccggcctctcccactgcagccctcccgcccgcctaccgtccggcgcgatggcggggagtagctcgctggaggcggtgcgcaggaagatccggagcctgcaggagcaggcggacgccgctgaggagcgcgcgggcaccctgcagcgcgagctggaccacgagaggaagctgagggagaccgctgaagccgacgtagcttctctgaacagacgcatccagctggttgaggaagagttggatcgtgcccaggagcgtctggcaacagctttgcagaagctggaggaagctgagaaggcagcagatgagagtgagagaggcatgaaagtcattgagagtcgagcccaaaaagatgaagaaaaaatggaaattcaggagatccaactgaaagaggccaagcacattgctgaagatgccgaccgcaaatatgaagaggtggcccgtaagctggtcatcattgagagcgacctggaacgtgcagaggagcgggctgagctctcagaaggcaaatgtgccgagcttgaagaagaattgaaaactgtgacgaacaacttgaagtcactggaggctcaggctgagaagtactcgcagaaggaagacagatatgaggaagagatcaaggtcctttccgacaagctgaaggaggctgagactcgggctgagtttgcggagaggtcagtaactaaattggagaaaagcattgatgacttagaagatcaactctaccagcaacttgagcaaaatcgccgcctcactaatgaactaaagctggccctgaatgaggattaaacttaagagtgaaaaaacttgggctgaattctaggcgtggagcccatgtgcagaaaatctaagactgtcctaccttcaactaatagagttgaaaacagttgctttctgcagaaatgcaaatgcaaggaattggctgaaaggctggccttgcctgcttgtttctctatatggctggaataattacgttctctttaatcacaaaacagcttttatggtagaatacttatatcaattcagcactgctccttgaaatagcaggtcctcttgtttgaactgataaataatgaggagcccccccaaaaaatgttttctatttcctgacagccatgagtcctactttaagtatgtatatatatatatatatgtgtgtgtgtgtgtgtgtgtatatattcctatcagatactcatattcctaacttctaaatatctggtatagtgtttgaaatatgattaaatgtacctatgcttgggcaaaatagcttttgaaaacaggaactcatgccagaagcccctggttgtctgaaaggtatgctttactcagtctaatggtgctgttggagtctggggagaatgtcatgctaataaatagaacactataaaaatattaagagaatgtcctaatgaagtgtgcatgaaacatgttgacaattttttatgagcaacagaaataaatcattttaaaagttctca

SEQ ID NO: 195429 - DNA, 1800 bp, Homo sapiens
  Payload ID: 18587
  Gene Name: tropomyosin 1 (alpha)
  ENST ID: ENST00000357980
  CDS Start-End: 80-1060
gcactcccgctcctccgcccgaccgcgcgctcgccccgccgctcctgctgcagccccagggcccctcgccgccgccaccatggacgccatcaagaagaagatgcagatgctgaagctcgacaaggagaacgccttggatcgagctgagcaggcggaggccgacaagaaggcggcggaagacaggagcaagcagctcgaggaggacatcgcggccaaggagaagttgctgcgggtgtcggaggacgagcgggaccgggtgctggaggagctgcacaaggcggaggacagcctcctggccgccgaagaggccgccgccaagctggaagatgagctggtgtcactgcaaaagaaactcaagggcaccgaagatgaactggacaaatactctgaggctctcaaagatgcccaggagaagctggagctggcagagaaaaaggccaccgatgctgaagccgacgtagcttctctgaacagacgcatccagctggttgaggaagagttggatcgtgcccaggagcgtctggcaacagctttgcagaagctggaggaagctgagaaggcagcagatgagagtgagagaggcatgaaagtcattgagagtcgagcccaaaaagatgaagaaaaaatggaaattcaggagatccaactgaaagaggccaagcacattgctgaagatgccgaccgcaaatatgaagaggtggcccgtaagctggtcatcattgagagcgacctggaacgtgcagaggagcgggctgagctctcagaaggcaaatgtgccgagcttgaagaagaattgaaaactgtgacgaacaacttgaagtcactggaggctcaggctgagaagtactcgcagaaggaagacagatatgaggaagagatcaaggtcctttccgacaagctgaaggaggctgagactcgggctgagtttgcggagaggtcagtaactaaattggagaaaagcattgatgacttagaagagaaagtggctcatgccaaagaagaaaaccttagtatgcatcagatgctggatcagactttactggagttaaacaacatgtgaaaacctccttagctgcgaccacattctttcgttttgttttgttttgtttttaaacacctgcttaccccttaaatgcaatttatttacttttaccactgtcacagaaacatccacaagataccagctaggtcagggggtggggaaaacacatacaaaaaggcaagcccatgtcagggcgatcctggttcaaatgtgccatttcccgggttgatgctgccacactttgtagagagtttagcaacacagtgtgcttagtcagcgtaggaatcctcactaaagcagaagaagttccattcaaagtgccaatgatagagtcaacaggaaggttaatgttggaaacacaatcaggtgtggattggtgctactttgaacaaaaggtccccctgtggtcttttgttcaacattgtacaatgtagaactctgtccaacactaatttattttgtcttgagttttactacaagatgagactatggatcccgcatgcctgaattcactaaagccaagggtctgtaagccacgctgctcttccgagacttccattcctttctgattggcacacgtgcagctcatgacaatctgtaggataacaatcagtgtggatttccactcttttcagtccttcatgttaaagatttagacaccacatacaactggtaaaggacgttttcttgagagttttaactatatgtaaacattgtataatgatatggaataaaatgcacattgtaggacattttct

SEQ ID NO: 195430 - DNA, 1717 bp, Homo sapiens
  Payload ID: 18587
  Gene Name: tropomyosin 1 (alpha)
  Uniprot ID: P09493
  ENST ID: ENST00000358278
  CDS Start-End: 146-1000
tcttgaggaatgcggtcgcccccttgggaaagtacatatctgggagaagcaggcggctccgcgctcgcactcccgctcctccgcccgaccgcgcgctcgccccgccgctcctgctgcagccccagggcccctcgccgccgccaccatggacgccatcaagaagaagatgcagatgctgaagctcgacaaggagaacgccttggatcgagctgagcaggcggaggccgacaagaaggcggcggaagacaggagcaagcagctggaagatgagctggtgtcactgcaaaagaaactcaagggcaccgaagatgaactggacaaatactctgaggctctcaaagatgcccaggagaagctggagctggcagagaaaaaggccaccgatgctgaagccgacgtagcttctctgaacagacgcatccagctggttgaggaagagttggatcgtgcccaggagcgtctggcaacagctttgcagaagctggaggaagctgagaaggcagcagatgagagtgagagaggcatgaaagtcattgagagtcgagcccaaaaagatgaagaaaaaatggaaattcaggagatccaactgaaagaggccaagcacattgctgaagatgccgaccgcaaatatgaagaggtggcccgtaagctggtcatcattgagagcgacctggaacgtgcagaggagcgggctgagctctcagaaggccaagtccgacagctggaagaacaattaagaataatggatcagaccttgaaagcattaatggctgcagaggataagtactcgcagaaggaagacagatatgaggaagagatcaaggtcctttccgacaagctgaaggaggctgagactcgggctgagtttgcggagaggtcagtaactaaattggagaaaagcattgatgacttagaagagaaagtggctcatgccaaagaagaaaaccttagtatgcatcagatgctggatcagactttactggagttaaacaacatgtgaaaacctccttagctgcgaccacattctttcgttttgttttgttttgtttttaaacacctgcttaccccttaaatgcaatttatttacttttaccactgtcacagaaacatccacaagataccagctaggtcagggggtggggaaaacacatacaaaaaggcaagcccatgtcagggcgatcctggttcaaatgtgccatttcccgggttgatgctgccacactttgtagagagtttagcaacacagtgtgcttagtcagcgtaggaatcctcactaaagcagaagaagttccattcaaagtgccaatgatagagtcaacaggaaggttaatgttggaaacacaatcaggtgtggattggtgctactttgaacaaaaggtccccctgtggtcttttgttcaacattgtacaatgtagaactctgtccaacactaatttattttgtcttgagttttactacaagatgagactatggatcccgcatgcctgaattcactaaagccaagggtctgtaagccacgctgctcttccgagacttccattcctttctgattggcacacgtgcagctcatgacaatctgtaggataacaatcagtgtggatttccactcttttcagtccttcatgttaaagatttagacaccacatacaactggtaaaggacgttttcttgagagttttaactatatgtaaacattgtataatgatatggaataaa

SEQ ID NO: 195431 - DNA, 1568 bp, Homo sapiens
  Payload ID: 18587
  Gene Name: tropomyosin 1 (alpha)
  ENST ID: ENST00000404484
  CDS Start-End: 110-856
gcggggcggaccggcgctgggcagccaggacagccgcggcagccgggtccgcagggcagcagccggcctctcccactgcagccctcccgcccgcctaccgtccggcgcgatggcggggagtagctcgctggaggcggtgcgcaggaagatccggagcctgcaggagcaggcggacgccgctgaggagcgcgcgggcaccctgcagcgcgagctggaccacgagaggaagctgagggagaccgctgaagccgacgtagcttctctgaacagacgcatccagctggttgaggaagagttggatcgtgcccaggagcgtctggcaacagctttgcagaagctggaggaagctgagaaggcagcagatgagagtgagagaggcatgaaagtcattgagagtcgagcccaaaaagatgaagaaaaaatggaaattcaggagatccaactgaaagaggccaagcacattgctgaagatgccgaccgcaaatatgaagaggtggcccgtaagctggtcatcattgagagcgacctggaacgtgcagaggagcgggctgagctctcagaaggccaagtccgacagctggaagaacaattaagaataatggatcagaccttgaaagcattaatggctgcagaggataagtactcgcagaaggaagacagatatgaggaagagatcaaggtcctttccgacaagctgaaggaggctgagactcgggctgagtttgcggagaggtcagtaactaaattggagaaaagcattgatgacttagaagagaaagtggctcatgccaaagaagaaaaccttagtatgcatcagatgctggatcagactttactggagttaaacaacatgtgaaaacctccttagctgcgaccacattctttcgttttgttttgttttgtttttaaacacctgcttaccccttaaatgcaatttatttacttttaccactgtcacagaaacatccacaagataccagctaggtcagggggtggggaaaacacatacaaaaaggcaagcccatgtcagggcgatcctggttcaaatgtgccatttcccgggttgatgctgccacactttgtagagagtttagcaacacagtgtgcttagtcagcgtaggaatcctcactaaagcagaagaagttccattcaaagtgccaatgatagagtcaacaggaaggttaatgttggaaacacaatcaggtgtggattggtgctactttgaacaaaaggtccccctgtggtcttttgttcaacattgtacaatgtagaactctgtccaacactaatttattttgtcttgagttttactacaagatgagactatggatcccgcatgcctgaattcactaaagccaagggtctgtaagccacgctgctcttccgagacttccattcctttctgattggcacacgtgcagctcatgacaatctgtaggataacaatcagtgtggatttccactcttttcagtccttcatgttaaagatttagacaccacatacaactggtaaaggacgttttcttgagagttttaactatatgtaaacattgtataatgatatgga

SEQ ID NO: 195432 - DNA, 1049 bp, Homo sapiens
  Payload ID: 18587
  Gene Name: tropomyosin 1 (alpha)
  Uniprot ID: P09493
  ENST ID: ENST00000403994
  CDS Start-End: 81-935
cgcactcccgctcctccgcccgaccgcgcgctcgccccgccgctcctgctgcagccccagggcccctcgccgccgccaccatggacgccatcaagaagaagatgcagatgctgaagctcgacaaggagaacgccttggatcgagctgagcaggcggaggccgacaagaaggcggcggaagacaggagcaagcagctggaagatgagctggtgtcactgcaaaagaaactcaagggcaccgaagatgaactggacaaatactctgaggctctcaaagatgcccaggagaagctggagctggcagagaaaaaggccaccgatgctgaagccgacgtagcttctctgaacagacgcatccagctggttgaggaagagttggatcgtgcccaggagcgtctggcaacagctttgcagaagctggaggaagctgagaaggcagcagatgagagtgagagaggcatgaaagtcattgagagtcgagcccaaaaagatgaagaaaaaatggaaattcaggagatccaactgaaagaggccaagcacattgctgaagatgccgaccgcaaatatgaagaggtggcccgtaagctggtcatcattgagagcgacctggaacgtgcagaggagcgggctgagctctcagaaggcaaatgtgccgagcttgaagaagaattgaaaactgtgacgaacaacttgaagtcactggaggctcaggctgagaagtactcgcagaaggaagacagatatgaggaagagatcaaggtcctttccgacaagctgaaggaggctgagactcgggctgagtttgcggagaggtcagtaactaaattggagaaaagcattgatgacttagaagacgagctgtacgctcagaaactgaagtacaaagccatcagcgaggagctggaccacgctctcaacgatatgacttccatataagtttctttgcttcacttctcccaagactccctcgtcgagctggatgtcccacctctctgagctctgcatttgtctattctccagctgaccctggttctctctcttagcatcctg

SEQ ID NO: 195433 - DNA, 2687 bp, Homo sapiens
  Payload ID: 18587
  Gene Name: tropomyosin 1 (alpha)
  ENST ID: ENST00000558264
  CDS Start-End: 1395-1673
aacatacattcaaagtggatgaggatattttacctgattagtaaattccatctcccacttccatgcacaatatttaaacagccaccagtgcaagtgtgtataatggaccatcatagtcttataagtgttctgaggctcatagcaacaatttcttatgacaggaaaaaaatcattgcctctcaaagaaaccaacattttatttcagtgacagataccaagtaaaaacagtacttgtattatttttctttttaggagtttgatacttttcttgtattaaccttgacttcaaagaaaaatcataggcttacatcaaaaacacttgggaaatttgtcttggctctgttccaatgaggccagttattctaaaaggggttactggattgtgttgggccttcatgtggtgtgtattttagaaccactgaattttaaactatttaagttcctttgtaaggatcctatgataaagtggcttgaaggaaagagttgagtgaaactcttgagtccgatttctggctgtactgctattgtcttacatggctgagcctgggtaagtcttgtctcagttcacacttcaggcccccagtgagtgaggtggccgtgatgacgctcttgtttaacaggcaagtaaagccagggtgttgaactctacggaagtgggccgggcgcagtggctcacgcctgtaatcccagcactttgagaggccaaggcaggtggataaggaggtcaggagattgagaccatcctggctaacacggtgaaaccccgtctctactaaaaatacaaaaaaattagccgggcgttgtggcgggcgcctgtagtcccaactactcgggaggctgaggcaggagaatggcgtgaatccaggaggcggagtttgcagtgagctgagatcgtgccactgcaccccagcctgggtgatagagcgagaccctgtctcaaaaacaaaacaaaacaaaacaaaaaaatctacggaagaaaggaaccatgtgaaagagcgtttgctaatgatctgtctgtctgatgagaattgtgtgtatagatttgtgtatacacaaatatggatgttcactgtataaatcaatgtgtaaatgtgtccgagaactccagagttgatgagggcttgtaatgcacttaaaggtagctcaccacaagacagtcttcctatctgaaatcagcattgcagtcccagccatttcctgaagctaccaccctcactttctccccaactctgaaatgcttttcactctctacctaggctgaagccgacgtagcttctctgaacagacgcatccagctggttgaggaagagttggatcgtgcccaggagcgtctggcaacagctttgcagaagctggaggaagctgagaaggcagcagatgagagtgagagaggcatgaaagtcattgagagtcgagcccaaaaagatgaagaaaaaatggaaattcaggagatccaactgaaagaggccaagcacattgctgaagatgccgaccgcaaatatgaagaggtggcccgtaagctggtcatcattgagagcgacctggaacgtgcagaggagcgggctgagctctcagaaggccaagtccgacagctggaagaacaattaagaataatggatcagaccttgaaagcattaatggctgcagaggataagcaaatgtgccgagcttgaagaagaattgaaaactgtgacgaacaacttgaagtcactggaggctcaggctgagaagtactcgcagaaggaagacagatatgaggaagagatcaaggtcctttccgacaagctgaaggaggctgagactcgggctgagtttgcggagaggtcagtaactaaattggagaaaagcattgatgacttagaagagaaagtggctcatgccaaagaagaaaaccttagtatgcatcagatgctggatcagactttactggagttaaacaacatgtgaaaacctccttagctgcgaccacattctttcgttttgttttgttttgtttttaaacacctgcttaccccttaaatgcaatttatttacttttaccactgtcacagaaacatccacaagataccagctaggtcagggggtggggaaaacacatacaaaaaggcaagcccatgtcagggcgatcctggttcaaatgtgccatttcccgggttgatgctgccacactttgtagagagtttagcaacacagtgtgcttagtcagcgtaggaatcctcactaaagcagaagaagttccattcaaagtgccaatgatagagtcaacaggaaggttaatgttggaaacacaatcaggtgtggattggtgctactttgaacaaaaggtccccctgtggtcttttgttcaacattgtacaatgtagaactctgtccaacactaatttattttgtcttgagttttactacaagatgagactatggatcccgcatgcctgaattcactaaagccaagggtctgtaagccacgctgctcttccgagacttccattcctttctgattggcacacgtgcagctcatgacaatctgtaggataacaatcagtgtggatttccactcttttcagtccttcatgttaaagatttagacaccacatacaactggtaaaggacgttttcttgagagttttaactatatgtaaacattgtataatgatatggaataaaatgcacattgtaggacattttct

SEQ ID NO: 195434 - DNA, 851 bp, Homo sapiens
  Payload ID: 18587
  Gene Name: tropomyosin 1 (alpha)
  ENST ID: ENST00000559281
  CDS Start-End: 1-747
atggcggggagtagctcgctggaggcggtgcgcaggaagatccggagcctgcaggagcaggcggacgccgctgaggagcgcgcgggcaccctgcagcgcgagctggaccacgagaggaagctgagggagaccgctgaagccgacgtagcttctctgaacagacgcatccagctggttgaggaagagttggatcgtgcccaggagcgtctggcaacagctttgcagaagctggaggaagctgagaaggcagcagatgagagtgagagaggcatgaaagtcattgagagtcgagcccaaaaagatgaagaaaaaatggaaattcaggagatccaactgaaagaggccaagcacattgctgaagatgccgaccgcaaatatgaagaggtggcccgtaagctggtcatcattgagagcgacctggaacgtgcagaggagcgggctgagctctcagaaggcaaatgtgccgagcttgaagaagaattgaaaactgtgacgaacaacttgaagtcactggaggctcaggctgagaagtactcgcagaaggaagacagatatgaggaagagatcaaggtcctttccgacaagctgaaggaggctgagactcgggctgagtttgcggagaggtcagtaactaaattggagaaaagcattgatgacttagaagacgagctgtacgctcagaaactgaagtacaaagccatcagcgaggagctggaccacgctctcaacgatatgacttccatataagtttctttgcttcacttctcccaagactccctcgtcgagctggatgtcccacctctctgagctctgcatttgtctattctccagctgaccctggttctctctct

SEQ ID NO: 195435 - DNA, 1232 bp, Homo sapiens
  Payload ID: 18587
  Gene Name: tropomyosin 1 (alpha)
  ENST ID: ENST00000558910
  CDS Start-End: 1-100
cattgatgacttagaagacgagctgtacgctcagaaactgaagtacaaagccatcagcgaggagctggaccacgctctcaacgatatgacttccatgtaaacgttcatccactctgcctgcttacaccctgccctcatgctaatgtaataaactcaccaccatgccttccttgctccctaatctccatctttgcactcttgtgttcaccctttttgtcataacctagaatagtcattgttttttcactttctgctaatataaaggccaattagattaagtctgtctatacaaaccattttcttttcagaatccgtttattttgtaaacgctgaactagagcagtgaactagaatgagtgaccttgagcactgtccttttgggaaattaagctaaactcaagtaaaactagaaggccatgccgtttgttgtacaggaacttctcaaaaaatatcaaaatttgtttcctgaaattcaactaagtacaacataatcattttcgttaaatataatttgaaggaacccttaaagtgtcaggttattgagaatctgaggataaggaaattggcatgatccaatacagctttaacagtggtactacaaaagatcatctcttttacttttaagaattctagagtaggccgggcacagtggctcacgcctgtaatcccagcactttgggaggccgaggcgggcggatcacgaggtcaggagattgagaccatcctggctaacacggtgaaaccctgtctctactaaaaatacaaaaaaaattagccgggcgtggtggtggatgcctgtagtcccagctactcaggaggctgaggcaggagaatggcatgaacccgggaggtggagcttgcagtcagccgagatcgcaccaccgcactccagcctggacgacagagcgagactctgtctcaagaaaaaaaagaatggtagagtaaaaagaaccctctgctgagtaaccaagcctttaattttgtgtttttatgaaaggaattaaaatacccacgataaatatttaccacaacctgtgtcaaataaatgggaaattaaacacagattgtacaatgtgagcttgggagttaatggcccagattttactgttaggcagtaagagttggagtaggtagtcttgttatcatgagaagaaccttgaacagatacaactaatttacatattactaaccaaacttaaacattaaactttttctactactttaaattctaa

SEQ ID NO: 195436 - DNA, 1655 bp, Homo sapiens
  Payload ID: 18587
  Gene Name: tropomyosin 1 (alpha)
  Uniprot ID: P09493
  ENST ID: ENST00000559397
  CDS Start-End: 73-927
cgctcctccgcccgaccgcgcgctcgccccgccgctcctgctgcagccccagggcccctcgccgccgccaccatggacgccatcaagaagaagatgcagatgctgaagctcgacaaggagaacgccttggatcgagctgagcaggcggaggccgacaagaaggcggcggaagacaggagcaagcagctcgaggaggacatcgcggccaaggagaagttgctgcgggtgtcggaggacgagcgggaccgggtgctggaggagctgcacaaggcggaggacagcctcctggccgccgaagaggccgccgccaaggctgaagccgacgtagcttctctgaacagacgcatccagctggttgaggaagagttggatcgtgcccaggagcgtctggcaacagctttgcagaagctggaggaagctgagaaggcagcagatgagagtgagagaggcatgaaagtcattgagagtcgagcccaaaaagatgaagaaaaaatggaaattcaggagatccaactgaaagaggccaagcacattgctgaagatgccgaccgcaaatatgaagaggtggcccgtaagctggtcatcattgagagcgacctggaacgtgcagaggagcgggctgagctctcagaaggccaagtccgacagctggaagaacaattaagaataatggatcagaccttgaaagcattaatggctgcagaggataagtactcgcagaaggaagacagatatgaggaagagatcaaggtcctttccgacaagctgaaggaggctgagactcgggctgagtttgcggagaggtcagtaactaaattggagaaaagcattgatgacttagaagagaaagtggctcatgccaaagaagaaaaccttagtatgcatcagatgctggatcagactttactggagttaaacaacatgtgaaaacctccttagctgcgaccacattctttcgttttgttttgttttgtttttaaacacctgcttaccccttaaatgcaatttatttacttttaccactgtcacagaaacatccacaagataccagctaggtcagggggtggggaaaacacatacaaaaaggcaagcccatgtcagggcgatcctggttcaaatgtgccatttcccgggttgatgctgccacactttgtagagagtttagcaacacagtgtgcttagtcagcgtaggaatcctcactaaagcagaagaagttccattcaaagtgccaatgatagagtcaacaggaaggttaatgttggaaacacaatcaggtgtggattggtgctactttgaacaaaaggtccccctgtggtcttttgttcaacattgtacaatgtagaactctgtccaacactaatttattttgtcttgagttttactacaagatgagactatggatcccgcatgcctgaattcactaaagccaagggtctgtaagccacgctgctcttccgagacttccattcctttctgattggcacacgtgcagctcatgacaatctgtaggataacaatcagtgtggatttccactcttttcagtccttcatgttaaagatttagacaccacatacaactggtaaaggacgttttcttgagagttttaactatatgtaaacattgtataatgatatggaataaaatgcacattgt

SEQ ID NO: 195437 - DNA, 1525 bp, Homo sapiens
  Payload ID: 18587
  Gene Name: tropomyosin 1 (alpha)
  ENST ID: ENST00000558347
  CDS Start-End: 76-549
tcccgctcctccgcccgaccgcgcgctcgccccgccgctcctgctgcagccccagggcccctcgccgccgccaccatggacgccatcaagaagaagatgcagatgctgaagctcgacaaggagaacgccttggatcgagctgagcaggcggaggccgacaagaaggcggcggaagacaggagcaagcagctggaagatgagctggtgtcactgcaaaagaaactcaagggcaccgaagatgaactggacaaatactctgaggctctcaaagatgcccaggagaagctggagctggcagagaaaaaggccaccgatgctgaagccgacgtagcttctctgaacagacgcatccagctggttgaggaagagttggatcgtgcccaggagcgtctggcaacagctttgcagaagctggaggaagctgagaaggcagcagatgagagtgagaggtggcccgtaagctggtcatcattgagagcgacctggaacgtgcagaggagcgggctgagctctcagaaggccaagtccgacagctggaagaacaattaagaataatggatcagaccttgaaagcattaatggctgcagaggataagtactcgcagaaggaagacagatatgaggaagagatcaaggtcctttccgacaagctgaaggaggctgagactcgggctgagtttgcggagaggtcagtaactaaattggagaaaagcattgatgacttagaagagaaagtggctcatgccaaagaagaaaaccttagtatgcatcagatgctggatcagactttactggagttaaacaacatgtgaaaacctccttagctgcgaccacattctttcgttttgttttgttttgtttttaaacacctgcttaccccttaaatgcaatttatttacttttaccactgtcacagaaacatccacaagataccagctaggtcagggggtggggaaaacacatacaaaaaggcaagcccatgtcagggcgatcctggttcaaatgtgccatttcccgggttgatgctgccacactttgtagagagtttagcaacacagtgtgcttagtcagcgtaggaatcctcactaaagcagaagaagttccattcaaagtgccaatgatagagtcaacaggaaggttaatgttggaaacacaatcaggtgtggattggtgctactttgaacaaaaggtccccctgtggtcttttgttcaacattgtacaatgtagaactctgtccaacactaatttattttgtcttgagttttactacaagatgagactatggatcccgcatgcctgaattcactaaagccaagggtctgtaagccacgctgctcttccgagacttccattcctttctgattggcacacgtgcagctcatgacaatctgtaggataacaatcagtgtggatttccactcttttcagtccttcatgttaaagatttagacaccacatacaactggtaaaggacgttttcttgagagttttaactatatgtaaacattgtataatgatatggaa

SEQ ID NO: 195438 - DNA, 573 bp, Homo sapiens
  Payload ID: 18587
  Gene Name: tropomyosin 1 (alpha)
  ENST ID: ENST00000559831
  CDS Start-End: 1-429
aaggccaccgatgctgaagccgacgtagcttctctgaacagacgcatccagctggttgaggaagagttggatcgtgcccaggagcgtctggcaacagctttgcagaagctggaggaagctgagaaggcagcagatgagagtgagagaggcatgaaagtcattgagagtcgagcccaaaaagatgaagaaaaaatggaaattcaggagatccaactgaaagaggccaagcacattgctgaagatgccgaccgcaaatatgaagaggtggcccgtaagctggtcatcattgagagcgacctggaacgtgcagaggagcgggctgagctctcagaaggccaagtccgacagctggaagaacaattaagaataatggatcagaccttgaaagcattaatggctgcagaggataagcaaatgtgccgagcttgaagaagaattgaaaactgtgacgaacaacttgaagtcactggaggctcaggctgagaagtactcgcagaaggaagacagatatgaggaagagatcaaggtcctttccgacaagctgaaggaggctgagactcgggctgagtttgc

SEQ ID NO: 195439 - DNA, 485 bp, Homo sapiens
  Payload ID: 18587
  Gene Name: tropomyosin 1 (alpha)
  ENST ID: ENST00000560445
  CDS Start-End: 84-296
gctcgcactcccgctcctccgcccgaccgcgcgctcgccccgccgctcctgctgcagccccagggcccctcgccgccgccaccatggacgccatcaagaagaagatgcagatgctgaagctcgacaaggagaacgccttggatcgagctgagcaggcggaggccgacaagaaggcggcggaagacaggagcaagcagctggaagatgagctggtgtcactgcaaaagaaactcaagggcaccgaagatgaactggacaaatactctgagctctgcatttgtctattctccagctgaccctggttctctctcttagcatcctgccttagagccaggcacacactgtgctttctattgtacagaagctcttcgtttcagtgtcaaataaacactgtgtaagctatttctgtttgctattctttttacttcttatttattgacattttagtttcaacattgaataaaactacaaagctgcttcacaca

SEQ ID NO: 195440 - DNA, 570 bp, Homo sapiens
  Payload ID: 18587
  Gene Name: tropomyosin 1 (alpha)
  ENST ID: ENST00000560615
  CDS Start-End: 247-570
ccacgcctccagggcgcacctggcgcacctgggccagctggcggcgggctctggggaggggcccggcctgttctcctgagcctttgttttccatctcgctgatccaaagctgaagccgacgtagcttctctgaacagacgcatccagctggttgaggaagagttggatcgtgcccaggagcgtctggcaacagctttgcagaagctggaggaagctgagaaggcagcagatgagagtgagagaggcatgaaagtcattgagagtcgagcccaaaaagatgaagaaaaaatggaaattcaggagatccaactgaaagaggccaagcacattgctgaagatgccgaccgcaaatatgaagaggtggcccgtaagctggtcatcattgagagcgacctggaacgtgcagaggagcgggctgagctctcagaaggccaagtccgacagctggaagaacaattaagaataatggatcagaccttgaaagcattaatggctgcagaggataagtactcgcagaaggaagacagatatgaggaagagatcaaggtcctttccgacaagctgaaggag

SEQ ID NO: 195441 - DNA, 1039 bp, Homo sapiens
  Payload ID: 18587
  Gene Name: tropomyosin 1 (alpha)
  ENST ID: ENST00000560970
  CDS Start-End: 1-797
atcgagctgagcaggcggaggccgacaagaaggcggcggaagacaggagcaagcagctggaagatgagctggtgtcactgcaaaagaaactcaagggcaccgaagatgaactggacaaatactctgaggctctcaaagatgcccaggagaagctggagctggcagagaaaaaggccaccgatgctgaagccgacgtagcttctctgaacagacgcatccagctggttgaggaagagttggatcgtgcccaggagcgtctggcaacagctttgcagaagctggaggaagctgagaaggcagcagatgagagtgagagaggcatgaaagtcattgagagtcgagcccaaaaagatgaagaaaaaatggaaattcaggagatccaactgaaagaggccaagcacattgctgaagatgccgaccgcaaatatgaagaggtggcccgtaagctggtcatcattgagagcgacctggaacgtgcagaggagcgggctgagctctcagaaggcaaatgtgccgagcttgaagaagaattgaaaactgtgacgaacaacttgaagtcactggaggctcaggctgagaagtactcgcagaaggaagacagatatgaggaagagatcaaggtcctttccgacaagctgaaggaggctgagactcgggctgagtttgcggagaggtcagtaactaaattggagaaaagcattgatgacttagaagacgagctgtacgctcagaaactgaagtacaaagccatcagcgaggagctggaccacgctctcaacgatatgacttccatgtaaacgttcatccactctgcctgcttacaccctgccctcatgctaatataagtttctttgcttcacttctcccaagactccctcgtcgagctggatgtcccacctctctgagctctgcatttgtctattctccagctgaccctggttctctctcttagcatcctgccttagagccaggcacacactgtgctttctattgtacagaagctcttcgtttcagtgtcaaataaacactgtgtaagcta

SEQ ID NO: 195442 - DNA, 673 bp, Homo sapiens
  Payload ID: 18587
  Gene Name: tropomyosin 1 (alpha)
  ENST ID: ENST00000561395
  CDS Start-End: 1-207
ctgaacagacgcatccagctggttgaggaagagttggatcgtgcccaggagcgtctggcaacagctttgcagaagctggaggaagctgagaaggcagcagatgagagtgagagaggcatgaaagtcattgagagtcgagcccaaaaagatgaagaaaaaatggaaattcaggagatccaactgaaagagcaaatgtgccgagcttgaagaagaattgaaaactgtgacgaacaacttgaagtcactggaggctcaggctgagaagtactcgcagaaggaagacagatatgaggaagagatcaaggtcctttccgacaagctgaaggaggctgagactcgggctgagtttgcggagaggtcagtaactaaattggagaaaagcattgatgacttagaagacgagctgtacgctcagaaactgaagtacaaagccatcagcgaggagctggaccacgctctcaacgatatgacttccatataagtttctttgcttcacttctcccaagactccctcgtcgagctggatgtcccacctctctgagctctgcatttgtctattctccagctgaccctggttctctctcttagcatcctgccttagagccaggcacacactgtgctttctattgtacagaagctcttcgtttcagtgtcaaataaacactgtgtaagc

SEQ ID NO: 195443 - DNA, 292 bp, Homo sapiens
  Payload ID: 18587
  Gene Name: tropomyosin 1 (alpha)
  ENST ID: ENST00000560679
  CDS Start-End: 269-292
atgtgcaaggctggaatgaacatgaggtgctgtttccttcctttctggtgactcggctgtgtggggagctggggatagagacctgtcacccagagggttctttccccaaagcataaacagtcgtctttctgctgaagccgacgtagcttctctgaacagacgcatccagctggttgaggaagagttggatcgtgcccaggagcgtctggcaacagctttgcagaagctggaggaagctgagaaggcagcagatgagagtgagagaggcatgaaagtcattgagagtcgagcc

SEQ ID NO: 195444 - DNA, 582 bp, Homo sapiens
  Payload ID: 18587
  Gene Name: tropomyosin 1 (alpha)
  ENST ID: ENST00000561425
  CDS Start-End: 80-202
gcactcccgctcctccgcccgaccgcgcgctcgccccgccgctcctgctgcagccccagggcccctcgccgccgccaccatggacgccatcaagaagaagatgcagatgctgaagctcgacaaggagaacgccttggatcgagctgagcaggcggaggccgacaagaaggcggcggaagacaggagcaagcagtggacttgagcccgctgagacctcggcaggagtctcgtcccagggcaggtgggtgtgcggggtgagccgcggagcggttccagctcgggtaaagaggaagttacctcgggtcctttgcactccaactcggcggcgccccgagcccgaggggccccagccaacccgacgcccgtgtgttgtgtgtgtctaacacccggtccgtgccggccgcccgcgcccgcccgccgctgcccccagctcgaggaggacatcgcggccaaggagaagttgctgcgggtgtcggaggacgagcgggaccgggtgctggaggagctgcacaaggcggaggacagcctcctggccgccgaagaggccgccgccaaggctgaagccgacgtagcttctctgaa

SEQ ID NO: 195445 - DNA, 925 bp, Homo sapiens
  Payload ID: 18587
  Gene Name: tropomyosin 1 (alpha)
  ENST ID: ENST00000560959
  CDS Start-End: 15-842
taccgtccggcgcgatggcggggagtagctcgctggaggcggtgcgcaggaagatccggagcctgcaggagcaggcggacgccgctgaggagcgcgcgggcaccctgcagcgcgagctggaccacgagaggaagctgagggagaccgctgaagccgacgtagcttctctgaacagacgcatccagctggttgaggaagagttggatcgtgcccaggagcgtctggcaacagctttgcagaagctggaggaagctgagaaggcagcagatgagagtgagagaggcatgaaagtcattgagagtcgagcccaaaaagatgaagaaaaaatggaaattcaggagatccaactgaaagaggccaagcacattgctgaagatgccgaccgcaaatatgaagaggtggcccgtaagctggtcatcattgagagcgacctggaacgtgcagaggagcgggctgagctctcagaaggccaagtccgacagctggaagaacaattaagaataatggatcagaccttgaaagcattaatggctgcagaggataagtactcgcagaaggaagacagatatgaggaagagatcaaggtcctttccgacaagctgaaggaggctgagactcgggctgagtttgcggagaggtcagtaactaaattggagaaaagcattgatgacttagaaggtaagatcttaagtagtgtttttagtttaatccttatggttgaataccaacctggcaaaacaattttccaattcaagggcatccacattgatacgctcctttgcacttgcacattcttcctgtgtgtcctctggggtttttctctgtggctcttgaactcatgaacctaagtcttctgctcacgaggtgactagttagccaccagccatagtggcaaatgccatccagcttgacttcatgctcatta

SEQ ID NO: 195446 - DNA, 1399 bp, Homo sapiens
  Payload ID: 18587
  Gene Name: tropomyosin 1 (alpha)
  ENST ID: ENST00000558544
  CDS Start-End: 77-226
ccgcggcagccgggtccgcagggcagcagccggcctctcccactgcagccctcccgcccgcctaccgtccggcgcgatggcggggagtagctcgctggaggcggtgcgcaggaagatccggagcctgcaggagcaggcggacgccgctgaggagcgcgcgggcaccctgcagcgcgagctggaccacgagaggaagctgagggagaccaggcatgaaagtcattgagagtcgagcccaaaaagatgaagaaaaaatggaaattcaggagatccaactgaaagaggccaagcacattgctgaagatgccgaccgcaaatatgaagaggtggcccgtaagctggtcatcattgagagcgacctggaacgtgcagaggagcgggctgagctctcagaaggccaagtccgacagctggaagaacaattaagaataatggatcagaccttgaaagcattaatggctgcagaggataagtactcgcagaaggaagacagatatgaggaagagatcaaggtcctttccgacaagctgaaggaggctgagactcgggctgagtttgcggagaggtcagtaactaaattggagaaaagcattgatgacttagaagagaaagtggctcatgccaaagaagaaaaccttagtatgcatcagatgctggatcagactttactggagttaaacaacatgtgaaaacctccttagctgcgaccacattctttcgttttgttttgttttgtttttaaacacctgcttaccccttaaatgcaatttatttacttttaccactgtcacagaaacatccacaagataccagctaggtcagggggtggggaaaacacatacaaaaaggcaagcccatgtcagggcgatcctggttcaaatgtgccatttcccgggttgatgctgccacactttgtagagagtttagcaacacagtgtgcttagtcagcgtaggaatcctcactaaagcagaagaagttccattcaaagtgccaatgatagagtcaacaggaaggttaatgttggaaacacaatcaggtgtggattggtgctactttgaacaaaaggtccccctgtggtcttttgttcaacattgtacaatgtagaactctgtccaacactaatttattttgtcttgagttttactacaagatgagactatggatcccgcatgcctgaattcactaaagccaagggtctgtaagccacgctgctcttccgagacttccattcctttctgattggcacacgtgcagctcatgacaatctgtaggataacaatcagtgtggatttccactcttttcagtccttcatgttaaagatttagacaccacatacaactggtaaaggacgttttcttgagagttttaactatatgtaaacattgtataatgatatg

SEQ ID NO: 195447 - DNA, 977 bp, Homo sapiens
  Payload ID: 18587
  Gene Name: tropomyosin 1 (alpha)
  Uniprot ID: P09493
  ENST ID: ENST00000559556
  CDS Start-End: 73-927
cgctcctccgcccgaccgcgcgctcgccccgccgctcctgctgcagccccagggcccctcgccgccgccaccatggacgccatcaagaagaagatgcagatgctgaagctcgacaaggagaacgccttggatcgagctgagcaggcggaggccgacaagaaggcggcggaagacaggagcaagcagctggaagatgagctggtgtcactgcaaaagaaactcaagggcaccgaagatgaactggacaaatactctgaggctctcaaagatgcccaggagaagctggagctggcagagaaaaaggccaccgatgctgaagccgacgtagcttctctgaacagacgcatccagctggttgaggaagagttggatcgtgcccaggagcgtctggcaacagctttgcagaagctggaggaagctgagaaggcagcagatgagagtgagagaggcatgaaagtcattgagagtcgagcccaaaaagatgaagaaaaaatggaaattcaggagatccaactgaaagaggccaagcacattgctgaagatgccgaccgcaaatatgaagaggtggcccgtaagctggtcatcattgagagcgacctggaacgtgcagaggagcgggctgagctctcagaaggcaaatgtgccgagcttgaagaagaattgaaaactgtgacgaacaacttgaagtcactggaggctcaggctgagaagtactcgcagaaggaagacagatatgaggaagagatcaaggtcctttccgacaagctgaaggaggctgagactcgggctgagtttgcggagaggtcagtaactaaattggagaaaagcattgatgacttagaagagaaagtggctcatgccaaagaagaaaaccttagtatgcatcagatgctggatcagactttactggagttaaacaacatgtgaaaacctccttagctgcgaccacattctttcgttttgttttgttttgtttt

SEQ ID NO: 195448 - DNA, 671 bp, Homo sapiens
  Payload ID: 18587
  Gene Name: tropomyosin 1 (alpha)
  ENST ID: ENST00000561266
  CDS Start-End: 1-671
aggagctgcacaaggcggaggacagcctcctggccgccgaagaggccgccgccaaggctgaagccgacgtagcttctctgaacagacgcatccagctggttgaggaagagttggatcgtgcccaggagcgtctggcaacagctttgcagaagctggaggaagctgagaaggcagcagatgagagtgagagaggcatgaaagtcattgagagtcgagcccaaaaagatgaagaaaaaatggaaattcaggagatccaactgaaagaggccaagcacattgctgaagatgccgaccgcaaatatgaagaggtggcccgtaagctggtcatcattgagagcgacctggaacgtgcagaggagcgggctgagctctcagaaggcaaatgtgccgagcttgaagaagaattgaaaactgtgacgaacaacttgaagtcactggaggctcaggctgagaagtactcgcagaaggaagacagatatgaggaagagatcaaggtcctttccgacaagctgaaggaggctgagactcgggctgagtttgcggagaggtcagtaactaaattggagaaaagcattgatgacttagaagacgagctgtacgctcagaaactgaagtacaaagccatcagcgaggagctggaccacgctctcaacgatatgacttccatgtaa

SEQ ID NO: 195449 - DNA, 3957 bp, Homo sapiens
  Payload ID: 18587
  Gene Name: tropomyosin 1 (alpha)
  ENST ID: ENST00000610733
  CDS Start-End: 144-464
ttgaggaatgcggtcgcccccttgggaaagtacatatctgggagaagcaggcggctccgcgctcgcactcccgctcctccgcccgaccgcgcgctcgccccgccgctcctgctgcagccccagggcccctcgccgccgccaccatggacgccatcaagaagaagatgcagatgctgaagctcgacaaggagaacgccttggatcgagctgagcaggcggaggccgacaagaaggcggcggaagacaggagcaagcagctggaagatgagctggtgtcactgcaaaagaaactcaagggcaccgaagatgaactggacaaatactctgaggctctcaaagatgcccaggagaagctggagctggcagagaaaaaggccaccgatgtaagtgcacgctcacactgcttccctcacctcttgcctgcgtggccactccggggtcaccacagggctggagagcaatgaaggaagtttaccttttcctgctggacacctgcacacagccctgccatggcccagagcattggatgccgcctctgactgctactgcacacattcatttatatttcatccactcctctcttcttctcctttcctttacctccctgggggtggaggtgggtggatgagaggctgggagaatagagcagctgaaattggactctggaggtgaacttcacctccctggtggcagaaaacccttgaggtgtcatcaccaaggtttgtgtagagaatgccaggttttcttcactttctttccttttgccgtttccagtgggtgggaagttctgggtttggtggtgggtctagtcagggttcagagaacctggcctctaaatgaaagaaatgacacagcggtacctttacttagatggctgcacttcatggtggggcacagagacactttgaggcttcctttctcattagtgtaagccttaatccaccccttaagatctgcctgggaagatgatacttgcttgggtctgcagtctgaaggcactagatccagaaagtaagctgtgagttatatatagctcagtgctttatatggtatagtgagctagctgccccctgcccctcctgctggccccgcccccacctgtcagccttctgacaaccaccacatagttgcaggggtgatgcacacagctaaggctctcctaagctctttgtccactgccctttggaagctttttaattgatagcttgcctcttctgcctcggaaagtcaagccaaaggaccaacttcttttcacaccgttggattccattctaaaagctaattaagcctagaggcccaattagaaaagaattccttgggaagttggtaacaattccaagaatgtgtgagcaccagggaaagctatgccagcagttgaaacaccgagagcaacagcagacttttttatatgaaagtaacatgcaaataactgaagggtctcaggtcttgaaattagtgaagtcttttgtagcatgaaaggcttgagatgtatatccaggtgtgctttgtaaatgagaactccagagacgacatttaggatctgacaaaaagaaattttcagtgaaaatcaagcttcctggaaaggggatttggggggaagcactgatttcgctaaaacatttaaattctaaactacctggctttggaaaaagagccaaaaaccatatatgactctgagcctactttgtataatgcagatcagatgcctgctctatatatggctaaatggaagatgcctgcctcccgcaaattctccagcaggacgtttatttagctttttcaaaagagctgctaatagatcaaggaaagatattccttataaggaaaagaatgcagagaatttgaaaatagcccagtaagactgaaggcaaaagagggagaaaaaggttactacaattcttaagggaaaaaaataggataataattattgtaactatgtagtgctaacatgtctttattgaaaagtcttgttgaagggagcgctggaatggggtggggcagaaatgggaaagaagttatttaaagtcagctggtgtgggaagcagcaggggagggagcttcttgaatcttgttttggttatttttcccaccgggaaactgcccctaaatctggcatatatggcttttttgatagtgtattgatcacattcccttttaggacactttaggttgtctggagtttggagcccgtaggaatattgaagaagttagtgaagaaatgctatacagtcatttgttgattaatgaagggggataaggtctgagacatgtgtcgttaggtgatttattcattgtgcaaacaccatagagtgtatggtacttacacaaacctagagggtatagcctactaaacacctaggctacaaacttgtacagtgtgttactgtactgaatactgtcaacaattgtaacacaaatcaccaggcgataggaattttttagttctattgtaatcttatgaggctactctcatatatgcagcccctcattgaccaaaacatcattatgcagtgcatgaccatattgagagtattcgttttttatttactaaaaaatagtcaaaacttgaggaggaagagacagatgtcactagaaaaagggagaagtccggtaagggagaagtcagcttcctgaggtggaatcgtattacctttgggattaggacatttcattgtcattattcaccagtgtaaaacacttttacatttttctactattattactaaaaacatttttctactactttacaaatcctattctggaagtgggctctacctagcttagaagattgtcattcaggagtagtatccctgatggtcttgtttcgaattttgtgttgtctttccacctaagtcaaaagtgaggctgaaggggatcgaagactccatttttttctggcccccaatctcttccccagtaactgtgatatatctgatatttatagcatatgagtctttatccctttgtaggtctttacttcttaacttagggattctcaaccttctctaaacataatcacttagggagcttttaaaacccaaagttaggatgcacccaaagccagttaaatcagaatccctggggatgcaacccaggcggcagcatttaaaaaatacccaagtgattccaacctacagacaaggatgagaaaactctcctaaactcttgtataatgacatcggcatgaaaatgaactcacctgaaactgaccttcccaggacattaagtcactagttggctgcttatggcacttgccagtgtccagcagtttcctggctgctcctggaggttgccagacacccggttcccccattctcaatgttggaggcccacagtctctgcacttaggggaccagctgtaacctccccacctgaccagatgaaccgcggggaaacaaagcgagaagctcccacctacaggatgcaaggacccaagctgggatttgtgagagtctcagcagaggctgtgaggaactccacagaaaatgaggcaggaaagcaaaagttccttgttagggcttggaggaggagagggttgtcaagcatgttttctttattattcccacacataagggagctggctttaagagctttctgtgacaaacctgaggagaaaaagccctgagacttagaaggcatttaagaatacagctcaagggggaaatcggtggagactgtatctgcggtggttttctccacctgtagccagaggctctctcatagggttctgtggctttccttggggtgccttttaaaggcatcccagtccagcccaggactgactggattccaggagatctcagaggctggtctgacaccaaagaaggctgtaaagagaagagaccatttggatgactgttttcatggaaagtgagccccagggaggctggcctgagattacacagctgattatgggcctcagcctgactcttaaaacaatgcttgtgtatttcttaa

SEQ ID NO: 195450 - DNA, 1189 bp, Homo sapiens
  Payload ID: 18588
  Gene Name: tropomyosin 2 (beta)
  Uniprot ID: P07951
  ENST ID: ENST00000360958
  CDS Start-End: 106-960
cccgctccgtcctcctcgcctgccaccggtgcacccagtccgctcacccagcccagtccgtccggtcctcaccgcctgccggccggcccaccccccaccgcagccatggacgccatcaagaagaagatgcagatgctgaagctggacaaggagaacgccatcgaccgcgccgagcaggccgaagccgacaagaagcaagctgaggaccgctgcaagcagctggaggaggagcagcaggccctccagaagaagctgaaggggacagaggatgaggtggaaaagtattctgaatccgtgaaggaggcccaggagaaactggagcaggccgagaagaaggccactgatgctgaggcagatgtggcctccctgaaccgccgcattcagctggttgaggaggagctggaccgggcccaggagcgcctggctacagccctgcagaagctggaggaggccgagaaggcggctgatgagagcgagagaggaatgaaggtcatcgaaaaccgggccatgaaggatgaggagaagatggaactgcaggagatgcagctgaaggaggccaagcacatcgctgaggattcagaccgcaaatatgaagaggtggccaggaagctggtgatcctggaaggagagctggagcgctcggaggagagggctgaggtggccgagagtaaatgtggggacctagaggaggagctgaaaattgttaccaacaacttgaaatccctggaggcccaggcggacaagtattccaccaaagaagataaatatgaagaggagatcaaactgttggaggagaagctgaaggaggctgagacccgagcagagtttgccgagaggtctgtggcaaagttggagaaaaccatcgatgacctagaagatgaagtctatgcccagaagatgaagtacaaggccattagcgaggaactggacaacgcactcaatgacatcacctccctctgagccccacgccagcgtggccacctcagctctcttctctcctctcctttccattctctctatggggaggggagcaggcaggaggagcagaaattgccaacattgcacagccaggctgggagcagcctagggagagcccccatcatgcccaccacccactctggcactggcttcatcctttacctatccccttccaccctcctttgctgcttaataaattctgaacttggtc

SEQ ID NO: 195451 - DNA, 1018 bp, Homo sapiens
  Payload ID: 18588
  Gene Name: tropomyosin 2 (beta)
  ENST ID: ENST00000329305
  CDS Start-End: 97-951
tcctcctcgcctgccaccggtgcacccagtccgctcacccagcccagtccgtccggtcctcaccgcctgccggccggcccaccccccaccgcagccatggacgccatcaagaagaagatgcagatgctgaagctggacaaggagaacgccatcgaccgcgccgagcaggccgaagccgacaagaagcaagctgaggaccgctgcaagcagctggaggaggagcagcaggccctccagaagaagctgaaggggacagaggatgaggtggaaaagtattctgaatccgtgaaggaggcccaggagaaactggagcaggccgagaagaaggccactgatgctgaggcagatgtggcctccctgaaccgccgcattcagctggttgaggaggagctggaccgggcccaggagcgcctggctacagccctgcagaagctggaggaggccgagaaggcggctgatgagagcgagagaggaatgaaggtcatcgaaaaccgggccatgaaggatgaggagaagatggaactgcaggagatgcagctgaaggaggccaagcacatcgctgaggattcagaccgcaaatatgaagaggtggccaggaagctggtgatcctggaaggagagctggagcgctcggaggagagggctgaggtggccgagagtaaatgtggggacctagaggaggagctgaaaattgttaccaacaacttgaaatccctggaggcccaggcggacaagtattccaccaaagaagataaatatgaagaggagatcaaactgttggaggagaagctgaaggaggctgagacccgagcagagtttgccgagaggtctgtggcaaagttggagaaaaccatcgatgacctagaagagaccttggccagtgccaaggaggagaacgtcgagattcaccagaccttggaccagaccctgctggaactcaacaacctgtgagggccagccccacccccagccaggctatggttgccaccccaacccaataaaactgatgttactagcc

SEQ ID NO: 195452 - DNA, 2147 bp, Homo sapiens
  Payload ID: 18588
  Gene Name: tropomyosin 2 (beta)
  Uniprot ID: P07951
  ENST ID: ENST00000378292
  CDS Start-End: 1204-2058
gagaaggcacctcgccccggaccccctatgccccgcagctcagtgactcttcccctcgccctccgccttccccgccgcagcccggctccgcctcccaatggggaaacatcccaaaaaagggcagaaaagaaatttcagcataaagttggcccactgggaaagagaggagcgtccgcggggagcgggggagaagagggaaggcgcgcggaggggagtggggccaggcggagccaggggcggggagcggaggggctcgggacgcgtccgggtgggagcgggggcggggaacgcgcggtgaccagcctggccgcagccgcgtggaaaatatgcggggcacgtggggggcggggcggggagctgggtcctgagccgccgggtgctcgcaggaagggcctggctccaggggcaggggctgggaggggaggcgaggggatgagaggtcaggccggtcctgggggcagcaagcccggccacactccccaccgcgaccggggctctgggctcgcttcctgcttcagtttccccaagctcccgatgagactccgctactaccaccacgtcgataacgcaaacctagagggactcagggtaaactgaggcactcaaactgccgaggagctccgcctcccgagagacatttaatccggggggatttgcaggaaacttctaaattaagggtagcggctgctgcagctgagggggggcacgccggtccctgcgcccgggcagctgccgtgagctcacgccccgaaatagccccaggggccccagccgcagctgccactgggtccggctgtcactcagaggaagcacggagcccccagcccaagggtcccctccccttcgcatcgccggggtttttccagccgaccgtcggccactttttcctccgacggctggcagggaagagggggatgggggcgggaccccaagggaggcggtccccagtgggtgggcgaagggggcggccgcaccccccggccgggccgtgcttctgcccctacaaggtttgggccgaggtgggggagggtcctggttgccggccccgcccggtccctccccgccttttaggcgcccgcgtggccgggacgtcccagtcccgctccgtcctcctcgcctgccaccggtgcacccagtccgctcacccagcccagtccgtccggtcctcaccgcctgccggccggcccaccccccaccgcagccatggacgccatcaagaagaagatgcagatgctgaagctggacaaggagaacgccatcgaccgcgccgagcaggccgaagccgacaagaagcaagctgaggaccgctgcaagcagctggaggaggagcagcaggccctccagaagaagctgaaggggacagaggatgaggtggaaaagtattctgaatccgtgaaggaggcccaggagaaactggagcaggccgagaagaaggccactgatgctgaggcagatgtggcctccctgaaccgccgcattcagctggttgaggaggagctggaccgggcccaggagcgcctggctacagccctgcagaagctggaggaggccgagaaggcggctgatgagagcgagagaggaatgaaggtcatcgaaaaccgggccatgaaggatgaggagaagatggaactgcaggagatgcagctgaaggaggccaagcacatcgctgaggattcagaccgcaaatatgaagaggtggccaggaagctggtgatcctggaaggagagctggagcgctcggaggagagggctgaggtggccgagagccgagccagacagctggaggaggaacttcgaaccatggaccaggccctcaagtccctgatggcctcagaggaggagtattccaccaaagaagataaatatgaagaggagatcaaactgttggaggagaagctgaaggaggctgagacccgagcagagtttgccgagaggtctgtggcaaagttggagaaaaccatcgatgacctagaagagaccttggccagtgccaaggaggagaacgtcgagattcaccagaccttggaccagaccctgctggaactcaacaacctgtgagggccagccccacccccagccaggctatggttgccaccccaacccaataaaactgatgttactagcctctcaaggccctttaatccttt

SEQ ID NO: 195453 - DNA, 1771 bp, Homo sapiens
  Payload ID: 18588
  Gene Name: tropomyosin 2 (beta)
  ENST ID: ENST00000378300
  CDS Start-End: 87-1055
ctgccaccggtgcacccagtccgctcacccagcccagtccgtccggtcctcaccgcctgccggccggcccaccccccaccgcagccatggacgccatcaagaagaagatgcagatgctgaagctggacaaggagaacgccatcgaccgcgccgagcaggccgaagccgacaagaagcaagctgaggaccgctgcaagcagctggaggaggagcagcaggccctccagaagaagctgaaggggacagaggatgaggtggaaaagtattctgaatccgtgaaggaggcccaggagaaactggagcaggccgagaagaaggccactgatgctgaggcagatgtggcctccctgaaccgccgcattcagctggttgaggaggagctggaccgggcccaggagcgcctggctacagccctgcagaagctggaggaggccgagaaggcggctgatgagagcgagagaggaatgaaggtcatcgaaaaccgggccatgaaggatgaggagaagatggaactgcaggagatgcagctgaaggaggccaagcacatcgctgaggattcagaccgcaaatatgaagaggtggccaggaagctggtgatcctggaaggagagctggagcgctcggaggagagggctgaggtggccgagagtaaatgtggggacctagaggaggagctgaaaattgttaccaacaacttgaaatccctggaggcccaggcggacaagtattccaccaaagaagataaatatgaagaggagatcaaactgttggaggagaagctgaaggaggctgagacccgagcagagtttgccgagaggtctgtggcaaagttggagaaaaccatcgatgacctagaagagagcacctctatcgccaccacggagcactggttcactcctgacaccctggcacttactgacacccccagcccctgcactgagcccacccacaaaacaccatggcccacgctgaaacccctctgcacaggcactccctggctgtcgctctctgattcaccactgcatgtgggcacgtgtggccccatcaaaccatgaccgcctctggtgccaatccctgacctcagagcacttagctggggttccaggatcaaacagagtgactggaaaggaagtagggtggtgaggtgcaggacaggggcaagaaggttgcaaaaggtctggaatggagcttggaaaaatgttggatatcagcaacatggggctttcactgcagcagcaggtctgttttctacctcaagtctgtctgtctggcccttcctttcctggcgcagtctttgtcttaccttctgtctccaacttccttaaaccttctaaagaagaggataaagtagtttatgactcagccctccccaccccacctctatgaccccaaggccttgagtgaggcatccacgtccgtcctgttcccctcatcctagtcagtccatctgtttgtccctgccaaggggccctgaggtccgtgaatgcatgtgtcttccttgacccactccatgtctatatgtcaccttcccctggccctgcctccccacgtctcccccttgtgtctcccttctccctcacctgctgcttcccctcacagagaccttggccagtgccaaggaggagaacgtcgagattcaccagaccttggaccagaccctgctggaactcaacaacctgtgagggccagccccacccccagccaggctatggttgccaccccaacccaataaaactgatgttactagcctctcaaggccctttaatccttt

SEQ ID NO: 195454 - DNA, 518 bp, Homo sapiens
  Payload ID: 18588
  Gene Name: tropomyosin 2 (beta)
  ENST ID: ENST00000607559
  CDS Start-End: 1-336
atcgctgaggattcagaccgcaaatatgaagaggtggccaggaagctggtgatcctggaaggagagctggagcgctcggaggagagggctgaggtggccgagagtaaatgtggggacctagaggaggagctgaaaattgttaccaacaacttgaaatccctggaggcccaggcggacaagtattccaccaaagaagataaatatgaagaggagatcaaactgttggaggagaagctgaaggaggctgagacccgagcagagtttgccgagaggtctgtggcaaagttggagaaaaccatcgatgacctagaaggtaaaagaagcctttataagtaggtccacacctgccgtgattatcagtctgtcctgtaccttctcatcccattttatttgccaccaataaactagggttgggccacctaggaccctaccaactccccaactctgtgggccatgtctacaattcaagtaattgtagctgcccacggcgcaacaactccagtgcttctcaaacttca

SEQ ID NO: 195455 - DNA, 1219 bp, Homo sapiens
  Payload ID: 18589
  Gene Name: tropomyosin 3
  ENST ID: ENST00000271850
  CDS Start-End: 41-898
ctccagtgttcacaggtgagcctaccaacagccactgctcatgatggaggccatcaagaaaaagatgcagatgctgaagttagacaaggagaatgctctggatcgggcagagcaagctgaagctgagcagaagcaggcagaagaaagaagtaaacagctggaggatgagctggcagccatgcagaagaagctgaaagggacagaggatgagctggacaagtattctgaagctttgaaggatgcccaggagaagctggaactggcagagaagaaggctgctgatgctgaggctgaggtggcctccttgaaccgtaggatccagctggttgaagaagagctggaccgtgctcaggagcgcctggccactgccctgcaaaagctggaagaagctgaaaaagctgctgatgagagtgagagaggtatgaaggttattgaaaaccgggccttaaaagatgaagaaaagatggaactccaggaaatccaactcaaagaagctaagcacattgcagaagaggcagataggaagtatgaagaggtggctcgtaagttggtgatcattgaaggagacttggaacgcacagaggaacgagctgagctggcagagtcccgttgccgagagatggatgagcagattagactgatggaccagaacctgaagtgtctgagtgctgctgaagaaaagtactctcaaaaagaagataaatatgaggaagaaatcaagattcttactgataaactcaaggaggcagagacccgtgctgagtttgctgagagatcggtagccaagctggaaaagacaattgatgacctggaagataaactgaaatgcaccaaagaggagcacctctgtacacaaaggatgctggaccagaccctgcttgacctgaatgagatgtagaacgccccagtcccaccctgctgctgctcctccctctgacccagactccgcctgaggccagcctgcgggaagctgacctttaactgagggctgatctttaactggaaggctgctttctcctttcaccaccccctccttccctgtgtctttttcgccaaactgtctctgcctcttcccggagaatccagctgggctagaggctgagcacctttggaaacaacatttaagggaatgtgagcacaatgcataatgtctttaaaaagcatgttgtgatgtacacattttgtaattaccttttttgttgttttgtagcaaccattt

SEQ ID NO: 195456 - DNA, 741 bp, Homo sapiens
  Payload ID: 18589
  Gene Name: tropomyosin 3
  Uniprot ID: P06753
  ENST ID: ENST00000302206
  CDS Start-End: 209-685
ggtgagctgcatgatgtcttacatttcatgagcttcctctaaatctagttgtatttttcgtctgaggggggctgaggctgaggtggcctccttgaaccgtaggatccagctggttgaagaagagctggaccgtgctcaggagcgcctggccactgccctgcaaaagctggaagaagctgaaaaagctgctgatgagagtgagagaggtatgaaggttattgaaaaccgggccttaaaagatgaagaaaagatggaactccaggaaatccaactcaaagaagctaagcacattgcagaagaggcagataggaagtatgaagaggtggctcgtaagttggtgatcattgaaggagacttggaacgcacagaggaacgagctgagctggcagagtctaagtgttctgagctggaggaggagctgaagaatgtcaccaacaacctcaagtctcttgaggctcaggcggagaagtactctcaaaaagaagataaatatgaggaagaaatcaagattcttactgataaactcaaggaggcagagacccgtgctgagtttgctgagagatcggtagccaagctggaaaagacaattgatgacctggaagataaactgaaatgcaccaaagaggagcacctctgtacacaaaggatgctggaccagaccctgcttgacctgaatgagatgtagaacgccccagtcccaccctgctgctgctcctccctctgacccagactccgcctgag

SEQ ID NO: 195457 - DNA, 2108 bp, Homo sapiens
  Payload ID: 18589
  Gene Name: tropomyosin 3
  Uniprot ID: P06753
  ENST ID: ENST00000330188
  CDS Start-End: 87-833
gcaggcggaagtaagggtgagaggaggctgcaacgccgagcggaggaggcaggaaccggagcgcgagcagtagctgggtgggcaccatggctgggatcaccaccatcgaggcggtgaagcgcaagatccaggttctgcagcagcaggcagatgatgcagaggagcgagctgagcgcctccagcgagaagttgagggagaaaggcgggcccgggaacaggctgaggctgaggtggcctccttgaaccgtaggatccagctggttgaagaagagctggaccgtgctcaggagcgcctggccactgccctgcaaaagctggaagaagctgaaaaagctgctgatgagagtgagagaggtatgaaggttattgaaaaccgggccttaaaagatgaagaaaagatggaactccaggaaatccaactcaaagaagctaagcacattgcagaagaggcagataggaagtatgaagaggtggctcgtaagttggtgatcattgaaggagacttggaacgcacagaggaacgagctgagctggcagagtctaagtgttctgagctggaggaggagctgaagaatgtcaccaacaacctcaagtctcttgaggctcaggcggagaagtactctcaaaaagaagataaatatgaggaagaaatcaagattcttactgataaactcaaggaggcagagacccgtgctgagtttgctgagagatcggtagccaagctggaaaagacaattgatgacctggaagataaactgaaatgcaccaaagaggagcacctctgtacacaaaggatgctggaccagaccctgcttgacctgaatgagatgtagaacgccccagtcccaccctgctgctgctcctccctctgacccagactccgcctgaggccagcctgcgggaagctgacctttaactgagggctgatctttaactggaaggctgctttctcctttcaccaccccctccttccctgtgtctttttcgccaaactgtctctgcctcttcccggagaatccagctgggctagaggctgagcacctttggaaacaacatttaagggaatgtgagcacaatgcataatgtctttaaaaagcatgttgtgatgtacacattttgtaattaccttttttgttgttttgtagcaaccatttgtaaaacattccaaataattccacagtcctgaagcagcaatcgaatccctttctcacttttggaaggtgacttttcaccttaatgcatattcccctctccatagaggagaggaaaaggtgtaggcctgccttaccgagagccaaacagagcccagggagactccgctgtgggaaacctcattgttctgtacaaagtactagctaaaccagaaaggtgattccaggaggagttagccaaacaacaacaaaaacaaaaaatgtgctgttcaagttttcagctttaagatatctttggataatgttatttctattttttatttttttcattagaagttaccaaattaagatggtaagacctctgagaccaaaattttgtcccatctctaccccctcacaactgcttacagaatggatcatgtcccccttatgttgaggtgaccacttaattgctttcctgcctccttgaaagaaagaaagaaagaagactgtgtttttgccactgatttagccatgtgaaactcatctcattacccttttctgggtttgaagctgctgtctctagaagtgccatctcaattgtgctttgtatcagtcagtgctggagaaatcttgaatagcttatgtacaaaactttttaaattttatattattttgaaactttgctttgggtttgtggcaccctggccaccccatctggctgtgacagcctctgcagtccgtgggctggcagtttgttgatcttttaagtttccttccctacccagtccccattttctggtaaggtttctaggaggtctgttaggtgtacatcctgcagcttattggcttaaaatgtactctccttttatgtggtctctttggggccgattgggagaaagagaaatcaatagtgcaactgttttgatactgaatattgacaagtgtctttttgaaataaagaaccagtccctccaa

SEQ ID NO: 195458 - DNA, 2007 bp, Homo sapiens
  Payload ID: 18589
  Gene Name: tropomyosin 3
  ENST ID: ENST00000341372
  CDS Start-End: 63-734
aggctgcaacgccgagcggaggaggcaggaaccggagcgcgagcagtagctgggtgggcaccatggctgggatcaccaccatcgaggcggtgaagcgcaagatccaggttctgcagcagcaggcagatgatgcagaggagcgagctgagcgcctccagcgagaagttgagggagaaagccgtgctcaggagcgcctggccactgccctgcaaaagctggaagaagctgaaaaagctgctgatgagagtgagagaggtatgaaggttattgaaaaccgggccttaaaagatgaagaaaagatggaactccaggaaatccaactcaaagaagctaagcacattgcagaagaggcagataggaagtatgaagaggtggctcgtaagttggtgatcattgaaggagacttggaacgcacagaggaacgagctgagctggcagagtcccgttgccgagagatggatgagcagattagactgatggaccagaacctgaagtgtctgagtgctgctgaagaaaagtactctcaaaaagaagataaatatgaggaagaaatcaagattcttactgataaactcaaggaggcagagacccgtgctgagtttgctgagagatcggtagccaagctggaaaagacaattgatgacctggaagataaactgaaatgcaccaaagaggagcacctctgtacacaaaggatgctggaccagaccctgcttgacctgaatgagatgtagaacgccccagtcccaccctgctgctgctcctccctctgacccagactccgcctgaggccagcctgcgggaagctgacctttaactgagggctgatctttaactggaaggctgctttctcctttcaccaccccctccttccctgtgtctttttcgccaaactgtctctgcctcttcccggagaatccagctgggctagaggctgagcacctttggaaacaacatttaagggaatgtgagcacaatgcataatgtctttaaaaagcatgttgtgatgtacacattttgtaattaccttttttgttgttttgtagcaaccatttgtaaaacattccaaataattccacagtcctgaagcagcaatcgaatccctttctcacttttggaaggtgacttttcaccttaatgcatattcccctctccatagaggagaggaaaaggtgtaggcctgccttaccgagagccaaacagagcccagggagactccgctgtgggaaacctcattgttctgtacaaagtactagctaaaccagaaaggtgattccaggaggagttagccaaacaacaacaaaaacaaaaaatgtgctgttcaagttttcagctttaagatatctttggataatgttatttctattttttatttttttcattagaagttaccaaattaagatggtaagacctctgagaccaaaattttgtcccatctctaccccctcacaactgcttacagaatggatcatgtcccccttatgttgaggtgaccacttaattgctttcctgcctccttgaaagaaagaaagaaagaagactgtgtttttgccactgatttagccatgtgaaactcatctcattacccttttctgggtttgaagctgctgtctctagaagtgccatctcaattgtgctttgtatcagtcagtgctggagaaatcttgaatagcttatgtacaaaactttttaaattttatattattttgaaactttgctttgggtttgtggcaccctggccaccccatctggctgtgacagcctctgcagtccgtgggctggcagtttgttgatcttttaagtttccttccctacccagtccccattttctggtaaggtttctaggaggtctgttaggtgtacatcctgcagcttattggcttaaaatgtactctccttttatgtggtctctttggggccgattgggagaaagagaaatcaatagtgcaactgttttgatactgaatattgacaagtgtctttttgaaataaagaaccagtccctcc

SEQ ID NO: 195459 - DNA, 2063 bp, Homo sapiens
  Payload ID: 18589
  Gene Name: tropomyosin 3
  ENST ID: ENST00000341485
  CDS Start-End: 90-788
gtagcaggcggaagtaagggtgagaggaggctgcaacgccgagcggaggaggcaggaaccggagcgcgagcagtagctgggtgggcaccatggctgggatcaccaccatcgaggcggtgaagcgcaagatccaggttctgcagcagcaggcagatgatgcagaggagcgagctgagcgcctccagcgagaagttgagggagaaaggcgggcccgggaacaggctgaggctgaggtggcctccttgaaccgtaggatccagctggttgaagaagagctggaccgtgctcaggagcgcctggccactgccctgcaaaagctggaagaagctgaaaaagctgctgatgaagaaaagatggaactccaggaaatccaactcaaagaagctaagcacattgcagaagaggcagataggaagtatgaagaggtggctcgtaagttggtgatcattgaaggagacttggaacgcacagaggaacgagctgagctggcagagtcccgttgccgagagatggatgagcagattagactgatggaccagaacctgaagtgtctgagtgctgctgaagaaaagtactctcaaaaagaagataaatatgaggaagaaatcaagattcttactgataaactcaaggaggcagagacccgtgctgagtttgctgagagatcggtagccaagctggaaaagacaattgatgacctggaagataaactgaaatgcaccaaagaggagcacctctgtacacaaaggatgctggaccagaccctgcttgacctgaatgagatgtagaacgccccagtcccaccctgctgctgctcctccctctgacccagactccgcctgaggccagcctgcgggaagctgacctttaactgagggctgatctttaactggaaggctgctttctcctttcaccaccccctccttccctgtgtctttttcgccaaactgtctctgcctcttcccggagaatccagctgggctagaggctgagcacctttggaaacaacatttaagggaatgtgagcacaatgcataatgtctttaaaaagcatgttgtgatgtacacattttgtaattaccttttttgttgttttgtagcaaccatttgtaaaacattccaaataattccacagtcctgaagcagcaatcgaatccctttctcacttttggaaggtgacttttcaccttaatgcatattcccctctccatagaggagaggaaaaggtgtaggcctgccttaccgagagccaaacagagcccagggagactccgctgtgggaaacctcattgttctgtacaaagtactagctaaaccagaaaggtgattccaggaggagttagccaaacaacaacaaaaacaaaaaatgtgctgttcaagttttcagctttaagatatctttggataatgttatttctattttttatttttttcattagaagttaccaaattaagatggtaagacctctgagaccaaaattttgtcccatctctaccccctcacaactgcttacagaatggatcatgtcccccttatgttgaggtgaccacttaattgctttcctgcctccttgaaagaaagaaagaaagaagactgtgtttttgccactgatttagccatgtgaaactcatctcattacccttttctgggtttgaagctgctgtctctagaagtgccatctcaattgtgctttgtatcagtcagtgctggagaaatcttgaatagcttatgtacaaaactttttaaattttatattattttgaaactttgctttgggtttgtggcaccctggccaccccatctggctgtgacagcctctgcagtccgtgggctggcagtttgttgatcttttaagtttccttccctacccagtccccattttctggtaaggtttctaggaggtctgttaggtgtacatcctgcagcttattggcttaaaatgtactctccttttatgtggtctctttggggccgattgggagaaagagaaatcaatagtgcaactgttttgatactgaatattgacaagtgtctttttgaaataaagaaccagtccctccaa

SEQ ID NO: 195460 - DNA, 1523 bp, Homo sapiens
  Payload ID: 18589
  Gene Name: tropomyosin 3
  Uniprot ID: P06753
  ENST ID: ENST00000368530
  CDS Start-End: 194-1051
gttcccccaggagaacaatgatggggtggagggagctggaaagaccatattaggaacaaaaggtggagctatgagcacagataaagactcaagtctggggacctcctggtcactcaggcagcagccccttctttcttgccccagtctccagttctccagtgttcacaggtgagcctaccaacagccactgctcatgatggaggccatcaagaaaaagatgcagatgctgaagttagacaaggagaatgctctggatcgggcagagcaagctgaagctgagcagaagcaggcagaagaaagaagtaaacagctggaggatgagctggcagccatgcagaagaagctgaaagggacagaggatgagctggacaagtattctgaagctttgaaggatgcccaggagaagctggaactggcagagaagaaggctgctgatgctgaggctgaggtggcctccttgaaccgtaggatccagctggttgaagaagagctggaccgtgctcaggagcgcctggccactgccctgcaaaagctggaagaagctgaaaaagctgctgatgagagtgagagaggtatgaaggttattgaaaaccgggccttaaaagatgaagaaaagatggaactccaggaaatccaactcaaagaagctaagcacattgcagaagaggcagataggaagtatgaagaggtggctcgtaagttggtgatcattgaaggagacttggaacgcacagaggaacgagctgagctggcagagtctaagtgttctgagctggaggaggagctgaagaatgtcaccaacaacctcaagtctcttgaggctcaggcggagaagtactctcaaaaagaagataaatatgaggaagaaatcaagattcttactgataaactcaaggaggcagagacccgtgctgagtttgctgagagatcggtagccaagctggaaaagacaattgatgacctggaagatgagctctatgcccagaaactgaagtacaaggccattagcgaggagctggaccacgccctcaatgacatgacctctatataattatcaccgtttctgctctgttctggatctgccccctttactcctcggggaacccaaggccccactctcgctctggattccatttgggtcagcctggctggtccccaaggcattaggatgggggagcaaaaagcaacttatgtattttcttccacccccaccccaaattaaaatgttaagctgctggaaacctcatgccaccctgcatttgtgtcattgacaaagctgttgctgtccctaagaaggagccttgggggtgtgatgtggggaagagctattgtaggctccccctcctctgacttatgtaatcaaagccacttttgtgtgtgtctattttttcttgacatttaaactcagctgatctgattctaccagagtgatggatttagtacaggttactcaggatagtaattttagttatactcctcaagctgaacaagattaaattccttatttccaggttcttaaatca

SEQ ID NO: 195461 - DNA, 1115 bp, Homo sapiens
  Payload ID: 18589
  Gene Name: tropomyosin 3
  Uniprot ID: P06753
  ENST ID: ENST00000368531
  CDS Start-End: 12-755
gggtgggcaccatggctgggatcaccaccatcgaggcggtgaagcgcaagatccaggttctgcagcagcaggcagatgatgcagaggagcgagctgagcgcctccagcgagaagttgagggagaaaggcgggcccgggaacaggctgaggctgaggtggcctccttgaaccgtaggatccagctggttgaagaagagctggaccgtgctcaggagcgcctggccactgccctgcaaaagctggaagaagctgaaaaagctgctgatgagagtgagagaggtatgaaggttattgaaaaccgggccttaaaagatgaagaaaagatggaactccaggaaatccaactcaaagaagctaagcacattgcagaagaggcagataggaagtatgaagaggtggctcgtaagttggtgatcattgaaggagacttggaacgcacagaggaacgagctgagctggcagagtcccgttgccgagagatggatgagcagattagactgatggaccagaacctgaagtgtctgagtgctgctgaagaaaagtactctcaaaaagaagataaatatgaggaagaaatcaagattcttactgataaactcaaggaggcagagacccgtgctgagtttgctgagagatcggtagccaagctggaaaagacaattgatgacctggaagagcgtctctacagccaacttgagcgaaaccgcctgctttctaatgagctgaagctaacgctgcatgatctgtgtgactgatgggcagggctcaatgatgcccattaaactgagcttactgctcacaccactgacctggaccccaacaaaaagctgattgtctttttaaaagttattattttgccctgagcaaattgcattttaattggggcagttagaatgttgatttcctaacagcattgtgaagttgaccattgtgaagtttctgtccctttagaagagattatgggtgaagaagggaggggcctgagagattatagtgagaaaacttgcgagaattttgttttccacccttatttgctgctctttcacttgggcactgactgtaggatatgttcccttgcatggatgtttttaacaataaaaggactgacttgacaa

SEQ ID NO: 195462 - DNA, 1088 bp, Homo sapiens
  Payload ID: 18589
  Gene Name: tropomyosin 3
  Uniprot ID: P06753
  ENST ID: ENST00000323144
  CDS Start-End: 46-789
ggaggaggcaggaaccggagcgcgagcagtagctgggtgggcaccatggctgggatcaccaccatcgaggcggtgaagcgcaagatccaggttctgcagcagcaggcagatgatgcagaggagcgagctgagcgcctccagcgagaagttgagggagaaaggcgggcccgggaacaggctgaggctgaggtggcctccttgaaccgtaggatccagctggttgaagaagagctggaccgtgctcaggagcgcctggccactgccctgcaaaagctggaagaagctgaaaaagctgctgatgagagtgagagaggtatgaaggttattgaaaaccgggccttaaaagatgaagaaaagatggaactccaggaaatccaactcaaagaagctaagcacattgcagaagaggcagataggaagtatgaagaggtggctcgtaagttggtgatcattgaaggagacttggaacgcacagaggaacgagctgagctggcagagtctaagtgttctgagctggaggaggagctgaagaatgtcaccaacaacctcaagtctcttgaggctcaggcggagaagtactctcaaaaagaagataaatatgaggaagaaatcaagattcttactgataaactcaaggaggcagagacccgtgctgagtttgctgagagatcggtagccaagctggaaaagacaattgatgacctggaagagcgtctctacagccaacttgagcgaaaccgcctgctttctaatgagctgaagctaacgctgcatgatctgtgtgactgatgggcagggctcaatgatgcccattaaactgagcttactgctcacaccactgacctggaccccaacaaaaagctgattgtctttttaaaagttattattttgccctgagcaaattgcattttaattggggcagttagaatgttgatttcctaacagcattgtgaagttgaccattgtgaagtttctgtccctttagaagagattatgggtgaagaagggaggggcctgagagattatagtgagaaaacttgcgagaattttgttttccacccttatttgctgctctttcacttgggcac

SEQ ID NO: 195463 - DNA, 1771 bp, Homo sapiens
  Payload ID: 18589
  Gene Name: tropomyosin 3
  Uniprot ID: P06753
  ENST ID: ENST00000328159
  CDS Start-End: 1-747
atggctgggatcaccaccatcgaggcggtgaagcgcaagatccaggttctgcagcagcaggcagatgatgcagaggagcgagctgagcgcctccagcgagaagttgagggagaaaggcgggcccgggaacaggctgaggctgaggtggcctccttgaaccgtaggatccagctggttgaagaagagctggaccgtgctcaggagcgcctggccactgccctgcaaaagctggaagaagctgaaaaagctgctgatgagagtgagagaggtatgaaggttattgaaaaccgggccttaaaagatgaagaaaagatggaactccaggaaatccaactcaaagaagctaagcacattgcagaagaggcagataggaagtatgaagaggtggctcgtaagttggtgatcattgaaggagacttggaacgcacagaggaacgagctgagctggcagagtcccgttgccgagagatggatgagcagattagactgatggaccagaacctgaagtgtctgagtgctgctgaagaaaagtactctcaaaaagaagataaatatgaggaagaaatcaagattcttactgataaactcaaggaggcagagacccgtgctgagtttgctgagagatcggtagccaagctggaaaagacaattgatgacctggaagatgagctctatgcccagaaactgaagtacaaggccattagcgaggagctggaccacgccctcaatgacatgacctctatataaactgaaatgcaccaaagaggagcacctctgtacacaaaggatgctggaccagaccctgcttgacctgaatgagatgtagaacgccccagtcccaccctgctgctgctcctccctctgacccagactccgcctgaggccagcctgcgggaagctgacctttaactgagggctgatctttaactggaaggctgctttctcctttcaccaccccctccttccctgtgtctttttcgccaaactgtctctgcctcttcccggagaatccagctgggctagaggctgagcacctttggaaacaacatttaagggaatgtgagcacaatgcataatgtctttaaaaagcatgttgtgatgtacacattttgtaattaccttttttgttgttttgtagcaaccatttgtaaaacattccaaataattccacagtcctgaagcagcaatcgaatccctttctcacttttggaaggtgacttttcaccttaatgcatattcccctctccatagaggagaggaaaaggtgtaggcctgccttaccgagagccaaacagagcccagggagactccgctgtgggaaacctcattgttctgtacaaagtactagctaaaccagaaaggtgattccaggaggagttagccaaacaacaacaaaaacaaaaaatgtgctgttcaagttttcagctttaagatatctttggataatgttatttctattttttatttttttcattagaagttaccaaattaagatggtaagacctctgagaccaaaattttgtcccatctctaccccctcacaactgcttacagaatggatcatgtcccccttatgttgaggtgaccacttaattgctttcctgcctccttgaaagaaagaaagaaagaagactgtgtttttgccactgatttagccatgtgaaactcatctcattacccttttctgggtttgaagctgctgtctctagaagtgccatctcaattgtgctttgtatcagtcagtgctggagaaatcttgaatagcttatgt

SEQ ID NO: 195464 - DNA, 3131 bp, Homo sapiens
  Payload ID: 18589
  Gene Name: tropomyosin 3
  Uniprot ID: P06753
  ENST ID: ENST00000368533
  CDS Start-End: 54-800
cgccgagcggaggaggcaggaaccggagcgcgagcagtagctgggtgggcaccatggctgggatcaccaccatcgaggcggtgaagcgcaagatccaggttctgcagcagcaggcagatgatgcagaggagcgagctgagcgcctccagcgagaagttgagggagaaaggcgggcccgggaacaggctgaggctgaggtggcctccttgaaccgtaggatccagctggttgaagaagagctggaccgtgctcaggagcgcctggccactgccctgcaaaagctggaagaagctgaaaaagctgctgatgagagtgagagaggtatgaaggttattgaaaaccgggccttaaaagatgaagaaaagatggaactccaggaaatccaactcaaagaagctaagcacattgcagaagaggcagataggaagtatgaagaggtggctcgtaagttggtgatcattgaaggagacttggaacgcacagaggaacgagctgagctggcagagtcccgttgccgagagatggatgagcagattagactgatggaccagaacctgaagtgtctgagtgctgctgaagaaaagtactctcaaaaagaagataaatatgaggaagaaatcaagattcttactgataaactcaaggaggcagagacccgtgctgagtttgctgagagatcggtagccaagctggaaaagacaattgatgacctggaagataaactgaaatgcaccaaagaggagcacctctgtacacaaaggatgctggaccagaccctgcttgacctgaatgagatgtagaacgccccagtcccaccctgctgctgctcctccctctgacccagactccgcctgaggccagcctgcgggaagctgacctttaactgagggctgatctttaactggaaggctgctttctcctttcaccaccccctccttccctgtgtctttttcgccaaactgtctctgcctcttcccggagaatccagctgggctagaggctgagcacctttggaaacaacatttaagggaatgtgagcacaatgcataatgtctttaaaaagcatgttgtgatgtacacattttgtaattaccttttttgttgttttgtagcaaccatttgtaaaacattccaaataattccacagtcctgaagcagcaatcgaatccctttctcacttttggaaggtgacttttcaccttaatgcatattcccctctccatagaggagaggaaaaggtgtaggcctgccttaccgagagccaaacagagcccagggagactccgctgtgggaaacctcattgttctgtacaaagtactagctaaaccagaaaggtgattccaggaggagttagccaaacaacaacaaaaacaaaaaatgtgctgttcaagttttcagctttaagatatctttggataatgttatttctattttttatttttttcattagaagttaccaaattaagatggtaagacctctgagaccaaaattttgtcccatctctaccccctcacaactgcttacagaatggatcatgtcccccttatgttgaggtgaccacttaattgctttcctgcctccttgaaagaaagaaagaaagaagactgtgtttttgccactgatttagccatgtgaaactcatctcattacccttttctgggtttgaagctgctgtctctagaagtgccatctcaattgtgctttgtatcagtcagtgctggagaaatcttgaatagcttatgtacaaaactttttaaattttatattattttgaaactttgctttgggtttgtggcaccctggccaccccatctggctgtgacagcctctgcagtccgtgggctggcagtttgttgatcttttaagtttccttccctacccagtccccattttctggtaaggtttctaggaggtctgttaggtgtacatcctgcagcttattggcttaaaatgtactctccttttatgtggtctctttggggccgattgggagaaagagaaatcaatagtgcaactgttttgatactgaatattgacaagtgtctttttgaaataaagaaccagtccctccaaccctcagacctatttgacttttatttattaaaactaaatgtgctttctccacagaagctatgaggtttgggttaaaaatagcatctttgtgggtggtagcaacaggatttattctttattattattatttttgagatgaagtttcattcttgttgcctgggctggagcgtaatggctcgatctcggctcactgcaacctccgcctcctggttcaagagattctcctgcctcagcctcccgagtagctgggattacaggcacctgccaccatgcccgggtaattttttatattttaagtagagacagggcttcaccatgttggccaggctggtctcgaactcctgaccttcaggtgatccacctgcctcagcttcccaaaatgctgggattacgggcgtgagccaccgcacccagctggagcaacaggatttaatatagagcaaatgtttagttttatcatctgtaaaatggagataagtattgtcagagtaaacatgaagattagaaagaacacttaatgtgctgggccttttataggttaacactgacatctcaggctgaactatatacattttccttcacaaccatatcaatccttataaactatggatttatgctccttaaaacaatatataatgctgatcactactataaatgcgtggttttaaccaactgtactgaaacagctttgagtttatattctgtttggatatttggagaaaacaacaagtgctctcaagagtatttgcttagaggccggctgtgtgagtggataactttgaaagctgcttttgagacgccagtgtctggcatttcctgcattctggcctggaggccggacgtgaatctgacttctagtaaaaatacacggttcccttgacaaagtcgagctgtttatcccagagactgcacaattttccgttgataggcatggaccaatgctaactggaaatcattgcaaaaagtttttttgtcgggcggagggtgtggtgttaagataaacagtgtgcaacagaagaaattaaaactggaagaaattaaagggttttttttaga

SEQ ID NO: 195465 - DNA, 543 bp, Homo sapiens
  Payload ID: 18589
  Gene Name: tropomyosin 3
  ENST ID: ENST00000509601
  CDS Start-End: 90-377
gtagcaggcggaagtaagggtgagaggaggctgcaacgccgagcggaggaggcaggaaccggagcgcgagcagtagctgggtgggcaccatggctgggatcaccaccatcgaggcggtgaagcgcaagatccaggttctgcagcagcaggcagatgatgcagaggagcgagctgagcgcctccagcgagaagttgagggagaaaggcgggcccgggaacaggctgaggctgaggtggcctccttgaaccgtaggatccagctggttgaagaagagctggaccgtgctcaggagcgcctggccactgccctgcaaaagctggaagaagctgaaaaagctgctgatgagagtgagagatggatgagcagattagactgatggaccagaacctgaagtgtctgagtgctgctgaagaaaagtactctcaaaaagaagataaatatgaggaagaaatcaagattcttactgataaactcaaggaggcagagacccgtgctgagtttgctgagagatcggtagccaagctggaaaagacaattgatga

SEQ ID NO: 195466 - DNA, 587 bp, Homo sapiens
  Payload ID: 18589
  Gene Name: tropomyosin 3
  ENST ID: ENST00000515609
  CDS Start-End: 362-587
gagaaatttcccatgtgggaatccggctggatccctgtgagggaagacccttggagaacgcagcctggagttctggtaaaaagccctagaagaggagaggactcctgtggactgcaggctgcttcctggcagaagtttcctctcttaccctcagtctaaagccttagtttcaattctgccaggcaaggtggggaactataagtcttctcttctggagcccacgatggagcctgccagggagacaagttattcttctgttctggacatccaagggtgactttaaggaggatgcctggaggacatggggagaagtctccagttctccagtgttcacaggtgagcctaccaacagccactgctcatgatggaggccatcaagaaaaagatgcagatgctgaagttagacaaggagaatgctctggatcgggcagagcaagctgaagctgagcagaagcaggcagaagaaagaagtaaacagctggaggatgagctggcagccatgcagaagaagctgaaagggacagaggatgagctggacaagtattctgaagctttgaaggatgcccaggagaagctggaactggcag

SEQ ID NO: 195467 - DNA, 1248 bp, Homo sapiens
  Payload ID: 18589
  Gene Name: tropomyosin 3
  ENST ID: ENST00000509409
  CDS Start-End: 109-258
agttccggtatttcagggcgtagcaggcggaagtaagggtgagaggaggctgcaacgccgagcggaggaggcaggaaccggagcgcgagcagtagctgggtgggcaccatggctgggatcaccaccatcgaggcggtgaagcgcaagatccaggttctgcagcagcaggcagatgatgcagaggagcgagctgagcgcctccagcgagaagttgagggagaaaggcgggcccgggaacagaggtatgaaggttattgaaaaccgggccttaaaagatgaagaaaagatggaactccaggaaatccaactcaaagaagctaagcacattgcagaagaggcagataggaagtatgaagaggtggctcgtaagttggtgatcattgaaggagacttggaacgcacagaggaacgagctgagctggcagagtcccgttgccgagagatggatgagcagattagactgatggaccagaacctgaagtgtctgagtgctgctgaagaaaagtactctcaaaaagaagataaatatgaggaagaaatcaagattcttactgataaactcaaggaggcagagacccgtgctgagtttgctgagagatcggtagccaagctggaaaagacaattgatgacctggaagataaactgaaatgcaccaaagaggagcacctctgtacacaaaggatgctggaccagaccctgcttgacctgaatgagatgtagaacgccccagtcccaccctgctgctgctcctccctctgacccagactccgcctgaggccagcctgcgggaagctgacctttaactgagggctgatctttaactggaaggctgctttctcctttcaccaccccctccttccctgtgtctttttcgccaaactgtctctgcctcttcccggagaatccagctgggctagaggctgagcacctttggaaacaacatttaagggaatgtgagcacaatgcataatgtctttaaaaagcatgttgtgatgtacacattttgtaattaccttttttgttgttttgtagcaaccatttgtaaaacattccaaataattccacagtcctgaagcagcaatcgaatccctttctcacttttggaaggtgacttttcaccttaatgcatattcccctctccatagaggagaggaaaaggtgtaggcctgccttaccgagagccaaacagagcccagggagactccgctgtgggaaacctcattgttctgtacaaagtactagctaaa

SEQ ID NO: 195468 - DNA, 3149 bp, Homo sapiens
  Payload ID: 18589
  Gene Name: tropomyosin 3
  ENST ID: ENST00000611659
  CDS Start-End: 131-814
gtcacatccgggcgggttggtgagttccggtatttcagggcgtagcaggcggaagtaagggtgagaggaggctgcaacgccgagcggaggaggcaggaaccggagcgcgagcagtagctgggtgggcaccatggctgggatcaccaccatcgaggcggtgaagcgcaagatccaggttctgcagcagcaggcagatgatgcagaggagcgagctgagcgcctccagcgagaagttgagggagaaaggcgggcccgggaacaggctgaggctgaggtggcctccttgaaccgtaggatccagctggttgaagaagagctggaccgtgctcaggagcgcctggccactgccctgcaaaagctggaagaagctgaaaaagctgctgatgagagtgagagaggtatgaaggttattgaaaaccgggccttaaaagatgaagaaaagatggaactccaggaaatccaactcaaagaagctaagcacattgcagaagaggcagataggaagtatgaagaggtggctcgtaagttggtgatcattgaaggagacttggaacgcacagaggaacgagctgagctggcagagtcccgttgccgagagatggatgagcagattagactgatggaccagaacctgaagtgtctgagtgctgctgaagaaaaggcagagacccgtgctgagtttgctgagagatcggtagccaagctggaaaagacaattgatgacctggaagataaactgaaatgcaccaaagaggagcacctctgtacacaaaggatgctggaccagaccctgcttgacctgaatgagatgtagaacgccccagtcccaccctgctgctgctcctccctctgacccagactccgcctgaggccagcctgcgggaagctgacctttaactgagggctgatctttaactggaaggctgctttctcctttcaccaccccctccttccctgtgtctttttcgccaaactgtctctgcctcttcccggagaatccagctgggctagaggctgagcacctttggaaacaacatttaagggaatgtgagcacaatgcataatgtctttaaaaagcatgttgtgatgtacacattttgtaattaccttttttgttgttttgtagcaaccatttgtaaaacattccaaataattccacagtcctgaagcagcaatcgaatccctttctcacttttggaaggtgacttttcaccttaatgcatattcccctctccatagaggagaggaaaaggtgtaggcctgccttaccgagagccaaacagagcccagggagactccgctgtgggaaacctcattgttctgtacaaagtactagctaaaccagaaaggtgattccaggaggagttagccaaacaacaacaaaaacaaaaaatgtgctgttcaagttttcagctttaagatatctttggataatgttatttctattttttatttttttcattagaagttaccaaattaagatggtaagacctctgagaccaaaattttgtcccatctctaccccctcacaactgcttacagaatggatcatgtcccccttatgttgaggtgaccacttaattgctttcctgcctccttgaaagaaagaaagaaagaagactgtgtttttgccactgatttagccatgtgaaactcatctcattacccttttctgggtttgaagctgctgtctctagaagtgccatctcaattgtgctttgtatcagtcagtgctggagaaatcttgaatagcttatgtacaaaactttttaaattttatattattttgaaactttgctttgggtttgtggcaccctggccaccccatctggctgtgacagcctctgcagtccgtgggctggcagtttgttgatcttttaagtttccttccctacccagtccccattttctggtaaggtttctaggaggtctgttaggtgtacatcctgcagcttattggcttaaaatgtactctccttttatgtggtctctttggggccgattgggagaaagagaaatcaatagtgcaactgttttgatactgaatattgacaagtgtctttttgaaataaagaaccagtccctccaaccctcagacctatttgacttttatttattaaaactaaatgtgctttctccacagaagctatgaggtttgggttaaaaatagcatctttgtgggtggtagcaacaggatttattctttattattattatttttgagatgaagtttcattcttgttgcctgggctggagcgtaatggctcgatctcggctcactgcaacctccgcctcctggttcaagagattctcctgcctcagcctcccgagtagctgggattacaggcacctgccaccatgcccgggtaattttttatattttaagtagagacagggcttcaccatgttggccaggctggtctcgaactcctgaccttcaggtgatccacctgcctcagcttcccaaaatgctgggattacgggcgtgagccaccgcacccagctggagcaacaggatttaatatagagcaaatgtttagttttatcatctgtaaaatggagataagtattgtcagagtaaacatgaagattagaaagaacacttaatgtgctgggccttttataggttaacactgacatctcaggctgaactatatacattttccttcacaaccatatcaatccttataaactatggatttatgctccttaaaacaatatataatgctgatcactactataaatgcgtggttttaaccaactgtactgaaacagctttgagtttatattctgtttggatatttggagaaaacaacaagtgctctcaagagtatttgcttagaggccggctgtgtgagtggataactttgaaagctgcttttgagacgccagtgtctggcatttcctgcattctggcctggaggccggacgtgaatctgacttctagtaaaaatacacggttcccttgacaaagtcgagctgtttatcccagagactgcacaattttccgttgataggcatggaccaatgctaactggaaatcattgcaaaaagtttttttgtcgggcggagggtgtggtgttaagataaacagtgtgcaacagaagaaattaaaactggaagaaattaaagggttttttttagacttt

SEQ ID NO: 195469 - DNA, 2666 bp, Homo sapiens
  Payload ID: 18590
  Gene Name: tropomyosin 4
  Uniprot ID: P67936
  ENST ID: ENST00000300933
  CDS Start-End: 261-1007
aagtcccgaaaaggggcactttccagcagctgtggccagcggtgccgacgtcaggccctcccccagcggtgctgacgtcggcggtccggccgggtgacctcatcgccccgacggcagccggcccggggggcggggagaggcgggggcggcccccgcgcaggcaaaggcttggggggccggggcgcggctgtgcagctctcgccggagccgagcccagccgagcgtccgccgctgcccgtgcgcctctgcgcctccgcgccatggccggcctcaactccctggaggcggtgaaacgcaagatccaggccctgcagcagcaggcggacgaggcggaagaccgcgcgcagggcctgcagcgggagctggacggcgagcgcgagcggcgcgagaaagctgaaggtgatgtggccgccctcaaccgacgcatccagctcgttgaggaggagttggacagggctcaggaacgactggccacggccctgcagaagctggaggaggcagaaaaagctgcagatgagagtgagagaggaatgaaggtgatagaaaaccgggccatgaaggatgaggagaagatggagattcaggagatgcagctcaaagaggccaagcacattgcggaagaggctgaccgcaaatacgaggaggtagctcgtaagctggtcatcctggagggtgagctggagagggcagaggagcgtgcggaggtgtctgaactaaaatgtggtgacctggaagaagaactcaagaatgttactaacaatctgaaatctctggaggctgcatctgaaaagtattctgaaaaggaggacaaatatgaagaagaaattaaacttctgtctgacaaactgaaagaggctgagacccgtgctgaatttgcagagagaacggttgcaaaactggaaaagacaattgatgacctggaagagaaacttgcccaggccaaagaagagaacgtgggcttacatcagacactggatcagacactaaacgaacttaactgtatataagcaaaacagaagagtcttgttccaacagaaactctggagctccgtgggtctttctcttctcttgtaagaagttccttttgttattgccatcttcgctttgctggaaatgtcaagcaaattatgaatacatgaccaaatattttgtatcggagaagctttgagcaccagttaaatctcattccttccctttttttttcaaatggcaccagctttttcagctctcttattttttccttaagtagcatttattcctaaggtaggcagggtatttcctagtaagcatactttcttaagacggaggccatttggttcctgggagaataggcagccccacactttgaagaatacagaccccagtatctagtcgtggatataattaaaacgctgaagaccataaccttttgggtcaactgttggtcaaactataggagagaccagggaccatcacatgggtagggattttccatccagagccaataaaaggactggtgggggccgggggtggctattgtgggaagtcataacccacagatagatcaacctaagaatcctggcccttctccactctccaccatgcaggacaaacatcttctcaagcagtcaacgtagaatgcttgggaaatagtcataattacccacatatagtaattaatagatggtaattaattgatccttgatgtgatgttcttttgcatatttccttcattctaaagttgttccctggccgggagcgttggctttcgcctgtaatcccaacactttgggaggccaggacagatcacttgaggtcaggagttcgagaccagcccagccaacatggcgaaaccatgtctctactaaaaatacaaaaattatggtgacgcctgcctgtagtcccagctactcgggaggctgaggcaggaggatcgcttgaacccaggaagtggagactgcagtgagccgatatcgcaccacagcgctccagcctggtcgacagagtgagactccatctcaagaaaaaataaaaataaagttgttctctgaagagcaaatgtctcattccagtaatgacccactcagcaggaatatggtggagttcagtccaattcaggtcagccatatccaaaagaccacaagtcattactaagttgagcaaaagagtttttatctattagcagaaagggcctctctggcagcagagattaaaaactggcccaacttcatttccatacttcagggaacagcaaattgaggatttacttatctaggacttgaattccttctttgggaccaagttaataaaagaccaagaaactcctgattaaactggataatgaaggattctgtagacagggctgcacgtatcggctttgtttgacttctcttttctcagttaacatctcagagctagaacattccacattccccagcagcgtgtgggggctgactaaagtttacaattccaactaaaaatcaccctgcttctggcttatctgaatcccttacccaccccaccccaccaccctactcctatttattcagcaccacactacccaggaaatacactagcaaattgtgcaatggaataaaatccacactttagattcttgcaactgtatcatatgtaatagtatcactttttctacattttggtcaaataaatttttacataaactacaa

SEQ ID NO: 195470 - DNA, 1417 bp, Homo sapiens
  Payload ID: 18590
  Gene Name: tropomyosin 4
  Uniprot ID: P67936
  ENST ID: ENST00000344824
  CDS Start-End: 119-973
ataaggccctctcctccaccctgccaggctcactctgccccacagccacagcccctgactgccgcagcccccacagagcccgccgcgcaccccacgtcccccacgccagcgcccagccatggaggccatcaagaagaaaatgcagatgctgaagttggacaaggagaatgccatcgaccgcgcggagcaggcggaggcggataagaaagccgctgaggacaagtgcaagcaggtggaggaggagctgacgcacctccagaagaaactaaaagggacagaggacgagctggataaatattccgaggacctgaaggacgcgcaggagaagctggagctcacggagaagaaggcctccgacgctgaaggtgatgtggccgccctcaaccgacgcatccagctcgttgaggaggagttggacagggctcaggaacgactggccacggccctgcagaagctggaggaggcagaaaaagctgcagatgagagtgagagaggaatgaaggtgatagaaaaccgggccatgaaggatgaggagaagatggagattcaggagatgcagctcaaagaggccaagcacattgcggaagaggctgaccgcaaatacgaggaggtagctcgtaagctggtcatcctggagggtgagctggagagggcagaggagcgtgcggaggtgtctgaactaaaatgtggtgacctggaagaagaactcaagaatgttactaacaatctgaaatctctggaggctgcatctgaaaagtattctgaaaaggaggacaaatatgaagaagaaattaaacttctgtctgacaaactgaaagaggctgagacccgtgctgaatttgcagagagaacggttgcaaaactggaaaagacaattgatgacctggaagagaaacttgcccaggccaaagaagagaacgtgggcttacatcagacactggatcagacactaaacgaacttaactgtatataagcaaaacagaagagtcttgttccaacagaaactctggagctccgtgggtctttctcttctcttgtaagaagttccttttgttattgccatcttcgctttgctggaaatgtcaagcaaattatgaatacatgaccaaatattttgtatcggagaagctttgagcaccagttaaatctcattccttccctttttttttcaaatggcaccagctttttcagctctcttattttttccttaagtagcatttattcctaaggtaggcagggtatttcctagtaagcatactttcttaagacggaggccatttggttcctgggagaataggcagccccacactttgaagaatacagaccccagtatctagtcgtggatataattaaaacgctgaagaccataaccttttgggtcaactgttggtcaaactataggagagaccagggacca

SEQ ID NO: 195471 - DNA, 801 bp, Homo sapiens
  Payload ID: 18590
  Gene Name: tropomyosin 4
  ENST ID: ENST00000588483
  CDS Start-End: 752-801
gaaaatgacaaagcggggattccagcccagcactttttggccctggagttcctggtttaatgcttcccattgtacttcctttcttgtaggtaaaaacaccttgaaaagccaataacactattggggtatgtcttccatgcctgcaaccaagttttctttccctttccatatctttttgtcctgccatctctcagccaggcggattgaaggatggaattccaacgaggctcccccgcctcgtcccaccttggtaattgcatggccaacatttaactgagggctccatagtcttgcatttatcttgccattcaggtgaatgggagcggaactcacaggacacaatgagccgggtcactgatggccttgctttctaagaatctcacagtgagccctagaactctctacgtggtaacactgtgtgcctttttcagagaagagcctatcttagatcttagcctaacgttgggtctattgtgttgctggagagaccagcactgacattcatctcaaagcacatggctggagtgcagtggcacgatctcagctcacggcaacctccgcctcccgggttcaagtgattcttctgcctcagcctcctgagcatgtggaactacaggcacgtgatgtggccgccctcaaccgacgcatccagctcgttgaggaggagttggacagggctcaggaacgactggccacggccctgcagaagctggaggaggcagaaaaagctgcagatgagagtgagagaggaatgaaggtgatagaaaaccgggccatgaaggatgaggagaagatggagat

SEQ ID NO: 195472 - DNA, 586 bp, Homo sapiens
  Payload ID: 18590
  Gene Name: tropomyosin 4
  ENST ID: ENST00000589897
  CDS Start-End: 378-586
agagaaaagtgtgtgtgtgggcggtgggggaggggggaaacggggaattgctcattttacttaacaagtactttcccatttttaggggaccaggtactcagtgggccacagacaagaccaaggcagaaaagacaggcgcctccccacattgcagcaccgggaccccgagcccacccacagccctcttcattcctcccaacgatggatggggaaactgaggcagcccagagcagcccccaccctaggtcctgcccgggacacgcccacgcgggacctgtgtcaccaggctcactctgccccacagccacagcccctgactgccgcagcccccacagagcccgccgcgcaccccacgtcccccacgccagcgcccagccatggaggccatcaagaagaaaatgcagatgctgaagttggacaaggagaatgccatcgaccgcgcggagcaggcggaggcggataagaaagccgctgaggacaagtgcaagcaggtggaggaggagctgacgcacctccagaagaaactaaaagggacagaggacgagctggataaatattccgaggacctgaaggacgcgcaggagaa

SEQ ID NO: 195473 - DNA, 635 bp, Homo sapiens
  Payload ID: 18590
  Gene Name: tropomyosin 4
  ENST ID: ENST00000592138
  CDS Start-End: 329-635
tgtttttcccagacattttccgggaagatcatactgaaattttggtatgagtgtaaattccctatggcctggactcctgggtgggctttgacggggaagatcaggttaacagagggcaggacatgggggaggctcccactggtggctggcctgatacttcttaacatggctgcacctccgacctccccaggctgaaggtgatgtggccgccctcaaccgacgcatccagctcgttgaggaggagttggacagggctcaggaacgactggccacggccctgcagaagctggaggaggcagaaaaagctgcagatgagagtgagagaggaatgaaggtgatagaaaaccgggccatgaaggatgaggagaagatggagattcaggagatgcagctcaaagaggccaagcacattgcggaagaggctgaccgcaaatacgaggaggtagctcgtaagctggtcatcctggagggtgagctggagagggcagaggagcgtgcggaggtgtctgaactaaaatgtggtgacctggaagaagaactcaagaatgttactaacaatctgaaatctctggaggctgcatctgaaaagtattctgaaaaggaggacaaatatgaagaagaaattaaacttctgt

SEQ ID NO: 195474 - DNA, 558 bp, Homo sapiens
  Payload ID: 18590
  Gene Name: tropomyosin 4
  ENST ID: ENST00000586833
  CDS Start-End: 22-558
gagattgcttaactccagatcatggtggaggaggagctgacgcacctccagaagaaactaaaagggacagaggacgagctggataaatattccgaggacctgaaggacgcgcaggagaagctggagctcacggagaagaaggcctccgacgctgaaggtgatgtggccgccctcaaccgacgcatccagctcgttgaggaggagttggacagggctcaggaacgactggccacggccctgcagaagctggaggaggcagaaaaagctgcagatgagagtgagagaggaatgaaggtgatagaaaaccgggccatgaaggatgaggagaagatggagattcaggagatgcagctcaaagaggccaagcacattgcggaagaggctgaccgcaaatacgaggaggtagctcgtaagctggtcatcctggagggtgagctggagagggcagaggagcgtgcggaggtgtctgaactaaaatgtggtgacctggaagaagaactcaagaatgttactaacaatctgaaatctctggaggctgcatctgaaaagtattctgaa

SEQ ID NO: 195475 - DNA, 563 bp, Homo sapiens
  Payload ID: 18590
  Gene Name: tropomyosin 4
  ENST ID: ENST00000588410
  CDS Start-End: 149-563
gtgcaggctccgactccggggctggcgccggggtcccgggccgaggggaacccgcgaccggacttgtgggggagaatgaggatgaaaacgtggagcttccattgtctagggtaaaaacaccttgaaaagccaataacactattggggtatgtcttccatgcctgcaaccaagttttctttccctttccatatctttttgtcctgccatctctcagccaggcggattgaaggatggaattccaacgaggctcccccgcctcgtcccaccttggctgaaggtgatgtggccgccctcaaccgacgcatccagctcgttgaggaggagttggacagggctcaggaacgactggccacggccctgcagaagctggaggaggcagaaaaagctgcagatgagagtgagagaggaatgaaggtgatagaaaaccgggccatgaaggatgaggagaagatggagattcaggagatgcagctcaaagaggccaagcacattgcggaagaggctgaccgcaaatacgaggaggtagctcgtaagctggtcatcctggagggtgagctggaga

SEQ ID NO: 195476 - DNA, 712 bp, Homo sapiens
  Payload ID: 18590
  Gene Name: tropomyosin 4
  ENST ID: ENST00000588032
  CDS Start-End: 1-331
gctggagagggcagaggagcgtgcggaggtgtctgaactaaaatgtggtgacctggaagaagaactcaagaatgttactaacaatctgaaatctctggaggctgcatctgaaaagtattctgaaaaggaggacaaatatgaagaagaaattaaacttctgtctgacaaactgaaagaggctgagacccgtgctgaatttgcagagagaacggttgcaaaactggaaaagacaattgatgacctggaagagaaacttgcccaggccaaagaagagaacgtgggcttacatcagacactggatcagacactaaacgaacttaactgtatataagcaaaacagaagagtcttgttccaacagaaactctggagctccgtgggtctttctcttctcttttgttccctggccgggagcgttggctttcgcctgtaatcccaacactttgggaggccaggacagatcacttgaggtcaggagttcgagaccagcccagccaacatggcgaaaccatgtctctactaaaaatacaaaaattatggtgacgcctgcctgtagtcccagctactcgggaggctgaggcaggaggatcgcttgaacccaggaagtggagactgcagtgagccgatatcgcaccacagcgctccagcctggtcgacagagtgagactccatctcaagaaaaaataaaaataaagttgttctctgaagagcaaa

SEQ ID NO: 195477 - DNA, 367 bp, Homo sapiens
  Payload ID: 18590
  Gene Name: tropomyosin 4
  ENST ID: ENST00000588507
  CDS Start-End: 78-367
gctggataaatattccgaggacctgaaggacgcgcaggagaagctggagctcacggagaagaaggcctccgacaggaatgaaggtgatagaaaaccgggccatgaaggatgaggagaagatggagattcaggagatgcagctcaaagaggccaagcacattgcggaagaggctgaccgcaaatacgaggaggtagctcgtaagctggtcatcctggagggtgagctggagagggcagaggagcgtgcggaggtgtctgaactaaaatgtggtgacctggaagaagaactcaagaatgttactaacaatctgaaatctctggaggctgcatctgaaaagtattctgaaaaggaggacaaatatgaaga

SEQ ID NO: 195478 - DNA, 262 bp, Homo sapiens
  Payload ID: 18590
  Gene Name: tropomyosin 4
  ENST ID: ENST00000592822
  CDS Start-End: 1-180
aaacttctgtctgacaaactgaaagaggctgagacccgtgctgaatttgcagagagaacggttgcaaaactggaaaagacaattgatgacctggaagatgagttatacgctcagaagctcaagtacaaagctatcagcgaggaactggaccacgctctcaacgacatgacctctctctgagaggcagccaggtcgctgccctctgtccttctcacatggtgcctcctacgcccctgtgggcttctaggagctccggtggcct

SEQ ID NO: 195479 - DNA, 708 bp, Homo sapiens
  Payload ID: 18590
  Gene Name: tropomyosin 4
  ENST ID: ENST00000586499
  CDS Start-End: 198-708
gaggcggataagaaagccgctgaggacaagtgcaagcaggtgaggtgccctccgctgggccgctccgggctgctgggagtcctctctgtgcggaaggccggggtctggagcccagttgggggtcgcagacacctgcgggaggataggaggctgatgctttggcggaggaagagcgaggggaccattgccttccttggatggggtcctgggctggaagaggggtgacgatcggacccacccccagcagggccagtgcgaacaaagtggaggaggagctgacgcacctccagaagaaactaaaagggacagaggacgagctggataaatattccgaggacctgaaggacgcgcaggagaagctggagctcacggagaagaaggcctccgacgctgaaggtgatgtggccgccctcaaccgacgcatccagctcgttgaggaggagttggacagggctcaggaacgactggccacggccctgcagaagctggaggaggcagaaaaagctgcagatgagagtgagagaggaatgaaggtgatagaaaaccgggccatgaaggatgaggagaagatggagattcaggagatgcagctcaaagaggccaagcacattgcggaagaggctgaccgcaaatacgaggaggtagctcgtaagctggtcatcctggagggtgagctggagagggcagaggagcgtgcggaggtgtctg

SEQ ID NO: 195480 - DNA, 714 bp, Homo sapiens
  Payload ID: 18591
  Gene Name: troponin C type 1 (slow)
  Uniprot ID: P63316
  ENST ID: ENST00000232975
  CDS Start-End: 56-541
atttaagtcaagggccggctggcaaccccagcaagctgtcctgtgagccgccagcatggatgacatctacaaggctgcggtagagcagctgacagaagagcagaaaaatgagttcaaggcagccttcgacatcttcgtgctgggcgctgaggatggctgcatcagcaccaaggagctgggcaaggtgatgaggatgctgggccagaaccccacccctgaggagctgcaggagatgatcgatgaggtggacgaggacggcagcggcacggtggactttgatgagttcctggtcatgatggttcggtgcatgaaggacgacagcaaagggaaatctgaggaggagctgtctgacctcttccgcatgtttgacaaaaatgctgatggctacatcgacctggatgagctgaagataatgctgcaggctacaggcgagaccatcacggaggacgacatcgaggagctcatgaaggacggagacaagaacaacgacggccgcatcgactatgatgagttcctggagttcatgaagggtgtggagtagatgctgaccttcacccagagctgcctatgcccagcctccaactccagctgagtcctggggttggggagggggtcggggtcccaggacctgagcctggccatgtcctcaaccccaaatcccccgactccctccccagatctgtcctgggggatgcaaataaagcctgctctccc

SEQ ID NO: 195481 - DNA, 727 bp, Homo sapiens
  Payload ID: 18591
  Gene Name: troponin C type 1 (slow)
  ENST ID: ENST00000496590
  CDS Start-End: 430-727
cagctgtccttcgggccacccagcttgagtttcatcaggggccgaaagggcattgagtggtcactgactattgttactgagggtcaccttggtcctgaagggggtgcccacctgtcaccctggccctgagcccagtcgcagtgaggccagctgggtcacgtcagggctttgggggcagggagggaggactgagacctccactctgtggcctggaaatagcctgcctcctccagctccagccttctcacctgtggaatgggttggtttcctcagcagcagctatacctgagtctgagccttgagattccctttcctttctaggtagagcagctgacagaagagcagaaaaatgagttcaaggcagccttcgacatcttcgtgctgggcgctgaggatggctgcatcagcaccaaggagctgggcaaggtgatgaggatgctgggccagaaccccacccctgaggagctgcaggagatgatcgatgaggtggacgaggacggcagcggcacggtggactttgatgagttcctggtcatgatggttcggtgcatgaaggacgacagcaaagggaaatctgaggaggagctgtctgacctcttccgcatgtttgacaaaaatgctgatggctacatcgacctggatgagctgaagataatgctgcaggctacaggcgagaccatcacggaggacgacatcgaggagctcatgaaggacggagacaagaaca

SEQ ID NO: 195482 - DNA, 710 bp, Homo sapiens
  Payload ID: 18592
  Gene Name: troponin C type 2 (fast)
  Uniprot ID: P02585
  ENST ID: ENST00000372555
  CDS Start-End: 94-576
aaatcccgggggctagagcaggccaggtcatctttgggtggtggagtgcaaaggaggcgacctgcaacagaggagtcccggtcaccagcaaccatgacggaccagcaggctgaggccaggtcctacctcagcgaagagatgatcgctgagttcaaggctgcctttgacatgtttgatgctgatggtggtggggacatcagcgtcaaggagttgggcacggtgatgaggatgctgggccagacacccaccaaggaggagctggacgccatcatcgaggaggtggatgaggacggcagcggcaccatcgacttcgaggagttcttggtcatgatggtgcgccagatgaaagaggacgcgaaagggaagagcgaggaggagctggccgagtgcttccgcatcttcgacaggaatgcagacggctacatcgacccggaggagctggctgagattttcagggcctccggggagcacgtgacggacgaggagatcgaatctctgatgaaagacggcgacaagaacaacgacggccgcattgacttcgacgagttcctgaagatgatggagggcgtgcagtaaggagtggacagtcgcctctaccaagatcgcgtgtccctagggtgtgggagactccgccctgccgggtccccaccagggaggcgcgaccccttgtgggtctttgtctggaaggaataaaagcaaatgttccaaaa

SEQ ID NO: 195483 - DNA, 780 bp, Homo sapiens
  Payload ID: 18592
  Gene Name: troponin C type 2 (fast)
  ENST ID: ENST00000372557
  CDS Start-End: 209-646
gggcccttggctccaggagggacttgggaagcctgggtcggcctgagggagtcccaggcctgccgcagagtcatcccagtccggccagtgttcacaggcttgcacaatctgatttgaacctcacacatgggaagtaggcaaacagggaaactgaggaccagagaggacggaccagcaggctgaggccaggtcctacctcagcgaagagatgatcgctgagttcaaggctgcctttgacatgtttgatgctgatggtggtggggacatcagcgtcaaggagttgggcacggtgatgaggatgctgggccagacacccaccaaggaggagctggacgccatcatcgaggaggtggatgaggacggcagcggcaccatcgacttcgaggagttcttggtcatgatggtgcgccagatgaaagaggacgcgaaagggaagagcgaggaggagctggccgagtgcttccgcatcttcgacaggaatgcagacggctacatcgacccggaggagctggctgagattttcagggcctccggggagcacgtgacggacgaggagatcgaatctctgatgaaagacggcgacaagaacaacgacggccgcattgacttcgacgagttcctgaagatgatggagggcgtgcagtaaggagtggacagtcgcctctaccaagatcgcgtgtccctagggtgtgggagactccgccctgccgggtccccaccagggaggcgcgaccccttgtgggtctttgtctggaaggaataaaagcaaatgttccaaaa

SEQ ID NO: 195484 - DNA, 1750 bp, Homo sapiens
  Payload ID: 18593
  Gene Name: troponin I type 1 (skeletal, slow)
  Uniprot ID: P19237
  ENST ID: ENST00000336092
  CDS Start-End: 798-1361
aaactgccccagcaggccccagggaaggacggcaggctgggatgccgtccccacggactccctctcctctcttagccctggcactaagtgcgttcctctggcaaagaagaaaataatttctgtccctcgccatctgctgcatgggaagatgggaatggagtgagcacggcaagacagatgctgcgtcctgcaatggccccaccatggaccctcgtcatccaaccgaagtcgcccccttgcctggctttatcttcactatattgtgaggctgcttcattgaatcttatcccagactttaacttttccatgactgccgtgattttgccatgttgttcacacagagtgtgtctgaccttagctgcattgccaccgcctttgggaccctgagccttcttgccagcactgtcactcccagaggttgcttccactttccccttttccagaaccacttgttcctttgggtggcatcctggaaacttgctgttgaagtctcaactgcctcagtggttcttcaagggaggtcctcaggccaccacctgagaaattgttagaaatgcaagtttctgggctgcatcccagacctgctgaatcagaaatttggggaggagcacggactttggcaccagagagctgggtgcagctctcagctctgcgtcatccttgctgtgggaccctgggttattgctgagccactgtgagtctgtttcctcgtgggtatagtaggtctgcagtctacggcgaggcacaggccagcccagctccacgaggactgaacaaggtgctgtctcactgccaccatgccggaagtcgagagaaaacccaagatcactgcctcccgcaaactcttgctgaagagcctgatgctggccaaggccaaggaatgctgggagcaggagcacgaggagcgcgaggctgagaaggtgcgctacctggcagagcgcatccccacgctgcagacccgtggcctgtccctcagtgccctgcaggacctgtgccgggagctgcacgccaaggtggaggtggtggatgaggagcgatacgacattgaggccaaatgcctccacaacaccagggagattaaggacctgaagctgaaggtgatggacctccgtgggaagttcaagcgcccgcccctgcgtcgagtccgtgtctcggctgacgccatgctccgggccctgctgggctccaagcacaaggtgtccatggatctgcgggccaacctcaagtctgtgaagaaggaagacacagagaaggagcggcctgtggaggtgggtgactggaggaagaacgtggaggccatgtctggcatggaaggccggaagaagatgtttgatgccgccaagtctccgacctcacaatagaggccagcttgctgtgctgcgctctgagctcctgcttcatgcttcttctccaacccagctcactcacctctctgcctgtgtctggagcatcccttcccacctctcccccacttcttccctccagcctgcatgccctcctctggaactgggattaaacagatacccaagaggcaggaaaaacgcgagtgtctgaagacctcaccctggcagggtgggcttctatccacccatgaggcacctggggcttctcagccaccccgtggtgtaacaagtggaggaggaggagggggtgagaacacctttcctccagccctgtgccacactccttctatgtgtgtacagtgtccacaggcatcacaccttcttcattaaaaacccagtttcctggt

SEQ ID NO: 195485 - DNA, 5413 bp, Homo sapiens
  Payload ID: 18593
  Gene Name: troponin I type 1 (skeletal, slow)
  Uniprot ID: P19237
  ENST ID: ENST00000361379
  CDS Start-End: 94-657
ctcggctctgcccctcacagtctgcagtctacggcgaggcacaggccagcccagctccacgaggactgaacaaggtgctgtctcactgccaccatgccggaagtcgagagaaaacccaagatcactgcctcccgcaaactcttgctgaagagcctgatgctggccaaggccaaggaatgctgggagcaggagcacgaggagcgcgaggctgagaaggtgcgctacctggcagagcgcatccccacgctgcagacccgtggcctgtccctcagtgccctgcaggacctgtgccgggagctgcacgccaaggtggaggtggtggatgaggagcgatacgacattgaggccaaatgcctccacaacaccagggagattaaggacctgaagctgaaggtgatggacctccgtgggaagttcaagcgcccgcccctgcgtcgagtccgtgtctcggctgacgccatgctccgggccctgctgggctccaagcacaaggtgtccatggatctgcgggccaacctcaagtctgtgaagaaggaagacacagagaaggagcggcctgtggaggtgggtgactggaggaagaacgtggaggccatgtctggcatggaaggccggaagaagatgtttgatgccgccaagtctccgacctcacaatagaggccagcttgctgtgctgcgctctgagctcctgcttcatgcttcttctccaacccagctcactcacctctctgcctgtgtctggagcatcccttcccacctctcccccacttcttccctccagcctgcatgccctcctctggaactgggattaaacagatacccaagaggcaggaaaaacgcgagtgtctgaagacctcaccctggcagggtgggcttctatccacccatgaggcacctggggcttctcagccaccccgtggtgtaacaagtggaggaggaggagggggtgagaacacctttcctccagccctgtgccacactccttctatgtgtgtacagtgtccacaggcatcacaccttcttcattaaaaacccagtttcctggtcatttctgcagctctgactgtgagccctgagaagaaagggaagacttggggcttgggaagagagggctgtgctgggctccagtcaccctgtctgcagtccggagctcgggatctgaagggagggctaaggaattggtggctgcttgccagggtcccctggggccccttctgcccagtccctgtgacgtcacactgcacacactcaccacccaggatgctcagctcaccagagccctgacctccgagaaatgaccccgtcctgcccctgactctggccatcagaagaggcctctccattaagagccgcttctcctgccggctttcatactctccttcctctgcaaacctggattaactctccctgatgtgtgctgggttgagaggtcagggcactttcaatccctcacctagtcctgctgcacagggcaggaggcctcacagaagagatacttgcagttccaggcctggccaccaggtgacgccttccttctctcctgggctctcctgtccctccggcctctgctctccccacgttcacccaccctcctcccaattgtttccccttcacactcctgcactggtcctatcccccaggactgattctttcccggagatggggtggccacttatctgtcctctggatcaggtcctttctccatcccactacctcctgggtccaaagcctggtgagagcatagggccttctggggtggaaggggggtctggggcagcctctcttcccccaacatactcactagagtggctcctgtgaagcagagaccaaagttctgacttttctttttccttttttttttttttttgagatggagtctcgctgtgtcacccaggctggagtgcagtgacgcgatctcgactcactgcaacctccgcctcccaggttcaagcgattctcctgcttcaacctcctgagtagctgggattacaggtgcgtgccaccacaccccgctaatttttgtatttttagtagagacagggtttcaccatgttggtcaggctggtctcgaactcctgacctcgtaatctgcccacctcggcctcccaaagttctgggattacaggtgtgagcgaccacatccggtcaagttctgacttttcagggcagtgggatggtgacttctgagctaagcctgcaagggaagtggctgttcccagacctggggtcccttggcttttcgaccaccctagcactggccctaggaggggctgagttatcagagcagcaacccttctacccaccctactgagtccccattctaccttcgaatcccatgtattatcttccataagtgccagaaattggtacaaagtgcagtgccagctgctccccagggcatggtctggctctctgggctgctgggctgccagcccctttcagaaagcatggcagtgggaaccagcaacttgggctaccttaggggaagcagcactctgcccagggttcttgctataaataggtcagtgggcagagaggcagatgtgtgcaaaaagcacaaccccaatcacacacagaaacccgtaggcacggacacacccagtctcaatgcacgaagttggagaacctgacagggctggtccaggccacagaggatggggttaggcttcatgccttcatgcccaggcagccacagaaacccactcttccccgcctcacagggctcctccggttggcctggatccaaagcgatctccttgtttcacctctttccagctcttccctagagcctggccccaagttccagagtcaaatcccagttttgcagtcaactattaacctggggccctggcagattggggtatccacccagtcatgtaaaggcaggagacctgctctgggcctgactcaaagcaaacacgtgggtgcagaagacccatgggaggaggaggtggggcccactcaacacacctaagccagtggccctctaggaggggcagaagagccaaccagagggttcctggaggtcatcgggttcctccttctgcttccaggcagcaacagacctaattcatctcctgtgaggatggagcaagggcgaatataggcatagacatatctggagcgcaaggattgagaggccctgtggacaaggggaaggagagcttgggggtgggagagggatctatggaaggggctgttgtagccaagaatggggcctgggctgggggcctggcctctggagagccctgattctactccagtcttctctcaccatggagacaacaccagtagagctgggagctggggcctgccactgagtaacagctcacacatgtagcacacttatgcgtcaggcaccagcatgtacaccttaatttatttaactttcacaacaaccctaggagaaaggtacagctactattctcatggtacagtggggaaaactgaggcacagagaggttagggacttttcatgatcacacagctaataagtggtggtcccaggattcaacccaagaagtctgttagaatccatactcttatcgactattttaataacagcatttcaataatagtaatatgtgatgttaaatgctttatctgagttatatcattgcattctcacaaaaatggtacatttgttagctcaaatttacagatgaggaaatggaggcctggagagttcaagtagctcactctaagttacagggtttgctagctgcagactggagactagatctcaggtcactctgccttggggttgcccttttctgagatcagactggccttaacagagcccaactttcttggaaggacacagctgggggtcgagggtcctgcatatgcacctggggagtccccacacacccgcaccaaaggggaaacattcaaaggagatgcaggtgacatacagatgggctaaggtgaggccttcctccaacatggggccctggctgagagtggagggatagggtgctacttgggggatatctattactaatcagcacacaatagctgggtgggcaccccctctctctgcagctggtggagatgggcctggtgctcctctctgcttggtaggaatgaccagggcaggatgccacctgctacactcttgcctgtcccagagcccttgggagaccagctgttgctcccacctttccccacagggtgcccggtccccacggcgcaaggaggccaagctcagctgtgtgtctgagcccactcagcagcaggcatgatcagggcagggcccagcgctaagggctgctggggctaaagtgccttgctgaaggaggggcagagttaaacattagccacaatggccccccgcgaagtgagtcatactccccacaagtctctgggctgggcagccgggggcgggggggttagcttcgttccaggtgggtgaccaagctgcggaagcccaggacagttcgctgggaccagtgctaatggcagcttctgctcctgacccccatcaggtctctttcctcagacatccccaaagcttgtctgcctgtgggtctttcattaaaggtgacgggcaagggttttctcttccttccaagacacacttctaggctggcttgtgggtcccctgagacgaaggctgagcagggtgagcctcgaaaaccccatagcactggcccagagcactgcggtcaatgtccgaaggaccagagagggagggtgacttgctcaaggtcacaaacctaactggagctaggaagtaggtccccagactcccagtctgaggaaattggatgtggacagggctttggtctcctggccagaggcaaacgcccagggatctgaacaggctgcccatctctggcctcaactcagcaccccaactggctccagtgccaaccattggcctctctcactggttggcacaggctgggtgagcctggccctttgccctgggttcaggagagaggtatggctttgcctggcagtcaggggaggtgttccaacctgggagcccctgggggaggagcgtgtgtgtgaacgcttgtgcctgttcatcagaaggggtgagcatggtgtgtatgcgtgggcatgcagaatgcagggtgatgacctgtctgcccgccctgagtgtcacagacacctgtgtgtcccctgtactagtgcctcccagatgctcttctcctgactggctctttgtgacctaaatttcaactgctccaccccacaaggaggaaaccagggccacaaatgtagtgagattttcataaagctaaatgtattcagtggaaacgaccttcctctgatctaaaagcatgcatgcctttgttttattactggagtattaaattagcccttacttatggaataggaggacagtaggtggcaattgttttctaatgctcttacttcacaaaataaaatggtggcagcacaa

SEQ ID NO: 195486 - DNA, 1100 bp, Homo sapiens
  Payload ID: 18593
  Gene Name: troponin I type 1 (skeletal, slow)
  Uniprot ID: P19237
  ENST ID: ENST00000367312
  CDS Start-End: 66-629
ctacggcgaggcacaggccagcccagctccacgaggactgaacaaggtgctgtctcactgccaccatgccggaagtcgagagaaaacccaagatcactgcctcccgcaaactcttgctgaagagcctgatgctggccaaggccaaggaatgctgggagcaggagcacgaggagcgcgaggctgagaaggtgcgctacctggcagagcgcatccccacgctgcagacccgtggcctgtccctcagtgccctgcaggacctgtgccgggagctgcacgccaaggtggaggtggtggatgaggagcgatacgacattgaggccaaatgcctccacaacaccagggagattaaggacctgaagctgaaggtgatggacctccgtgggaagttcaagcgcccgcccctgcgtcgagtccgtgtctcggctgacgccatgctccgggccctgctgggctccaagcacaaggtgtccatggatctgcgggccaacctcaagtctgtgaagaaggaagacacagagaaggagcggcctgtggaggtgggtgactggaggaagaacgtggaggccatgtctggcatggaaggccggaagaagatgtttgatgccgccaagtctccgacctcacaatagaggtacctagagaccagctcccttctctggggtccatcagagtctagaggataatgagggagtccacaatgggcaggcgggttgtacttagtgtggtgcacggatgcacggactaaggcaccgatgagactgatttgagtcggctctcctgggctcagtcctggctccagcaccatgatacttgggcatgtcatttctgtttggcggccctttttgttcccattatctatgaaattgggggctgtatcaaatcagtggttctccaagtgtggtcctgggaccagcagcgtctacatcacctgggatgcaaatgatcagcccccaccccagatccactaaattggaaactctggggtgaggccagccttctaggtgattctgatgcacatgagagtttgagaaccactaggttagagggtccctgggatcccttcatctctgactttctgagaatctatgcacttttaaata

SEQ ID NO: 195487 - DNA, 580 bp, Homo sapiens
  Payload ID: 18593
  Gene Name: troponin I type 1 (skeletal, slow)
  ENST ID: ENST00000555948
  CDS Start-End: 77-394
cagtctgcagtctacggcgaggcacaggccagcccagctccacgaggactgaacaaggtgctgtctcactgccaccatgccggaagtcgagagaaaacccaagatcactgcctcccgcaaactcttgctgaagagcctgatgctggccaaggccaaggaatgctgggagcaggagcacgaggagcgcgaggctgagaaggtgcgctacctggcagagcgcatccccacgctgcagacccgtggcctgtccctcagtgccctgcaggacctgtgccgggagctgcacgccaaggtggaggtggtggatgaggagcgatacgacattgaggccatgtctggcatggaaggccggaagaagatgtttgatgccgccaagtctccgacctcacaatagaggccagcttgctgtgctgcgctctgagctcctgcttcatgcttcttctccaacccagctcactcacctctctgcctgtgtctggagcatcccttcccacctctcccccacttcttccctccagcctgcatgccctcctctggaactgggattaaacagatacccaagaggcaggaaaaacgcgag

SEQ ID NO: 195488 - DNA, 565 bp, Homo sapiens
  Payload ID: 18593
  Gene Name: troponin I type 1 (skeletal, slow)
  ENST ID: ENST00000555340
  CDS Start-End: 173-565
tctgcagtctacggcgaggcacaggccagcccagctccacgaggactgaacaaggtgctgtctcactgccaccatgccggaagtgtaagtagtctcactgccatctggggccccaggaagcgagagaaaacccaagatcactgcctcccgcaaactcttgctgaagagcctgatgctggccaaggccaaggaatgctgggagcaggagcacgaggagcgcgaggctgagaaggtgcgctacctggcagagcgcatccccacgctgcagacccgtggcctgtccctcagtgccctgcaggacctgtgccgggagctgcacgccaaggtggaggtggtggatgaggagcgatacgacattgaggccaaatgcctccacaacaccagggagattaaggacctgaagctgaaggtgatggacctccgtgggaagttcaagcgcccgcccctgcgtcgagtccgtgtctcggctgacgccatgctccgggccctgctgggctccaagcacaaggtgtccatggatctgcgggccaacctcaagtctgtgaagaaggaagacacagagaag

SEQ ID NO: 195489 - DNA, 633 bp, Homo sapiens
  Payload ID: 18593
  Gene Name: troponin I type 1 (skeletal, slow)
  ENST ID: ENST00000556362
  CDS Start-End: 223-633
cctcttcccccagctgctacttgcccctctgggccttcactgtggccctttgctctccctcattccccctcccagtcccatctctgctcagtccccacacctggtctggctgctcattctttccctttctgcagctcgagtctccccagtctgcagtctacggcgaggcacaggccagcccagctccacgaggactgaacaaggtgctgtctcactgccaccatgccggaagtcgagagaaaacccaagatcactgcctcccgcaaactcttgctgaagagcctgatgctggccaaggccaaggaatgctgggagcaggagcacgaggagcgcgaggctgagaaggtgcgctacctggcagagcgcatccccacgctgcagacccgtggcctgtccctcagtgccctgcaggacctgtgccgggagctgcacgccaaggtggaggtggtggatgaggagcgatacgacattgaggccaaatgcctccacaacaccagggagattaaggacctgaagctgaaggtgatggacctccgtgggaagttcaagcgcccgcccctgcgtcgagtccgtgtctcggctgacgccatgctccgggccctgctgggctccaagcacaaggtgtccatggat

SEQ ID NO: 195490 - DNA, 6142 bp, Homo sapiens
  Payload ID: 18593
  Gene Name: troponin I type 1 (skeletal, slow)
  ENST ID: ENST00000622580
  CDS Start-End: 94-657
ctcggctctgcccctcacagtctgcagtctacggcgaggcacaggccagcccagctccacgaggactgaacaaggtgctgtctcactgccaccatgccggaagtacagagaaaacccaagatcactgcctcccgcaaactcttgctgaagagcctgatgctggccaaggccaaggaatgctgggagcaggagcacgaggagcgcgaggctgagaaggtgcgctacctggcagagcgcatccccacgctgcagacccgtggcctgtccctcagtgccctgcaggacctgtgccgggagctgcacgccaaggtggaggtggtggatgaggagcgatacgacattgaggccaaatgcctccacaacaccagggagattaaggacctgaagctgaaggtgatggacctccgtgggaagttcaagcgcccgcccctgcgtcgagtccgtgtctcggctgacgccatgctccgggccctgctgggctccaagcacaaggtgtccatggatctgcgggccaacctcaagtctgtgaagaaggaagacacagagaaggagcggcctgtggaggtgggtgactggaggaagaacgtggaggccatgtctggcatggaaggccggaagaagatgtttgatgccgccaagtctccgacctcacaatagaggccagcttgctgtgctgcgctctgagctcctgcttcatgcttcttctccaacccagctcactcacctctctgcctgtgtctggagcatcccttcccacctctcccccacttcttccctccagcctgcatgccctcctctggaactgggattaaacagatacccaagaggcaggaaaaacgcgagtgtctgaagacctcaccctggcagggtgggcttctatccacccatgaggcacctggggcttctcagccaccccgtggtgtaacaagtggaggaggaggagggggtgagaacacctttcctccagccctgtgccacactccttctatgtgtgtacagtgtccacaggcatcacaccttcttcattaaaaacccagtttcctggtcatttctgcagctctgactgtgagccctgagaagaaagggaagacttggggcttgggaagagagggctgtgctgggctccagtcaccctgtctgcagtccggagctcgggatctgaagggagggctaaggaattggtggctgcttgccagggtcccctggggccccttctgcccagtccctgtgacgtcacactgcacacactcaccacccaggatgctcagctcaccagagccctgacctccgagaaatgaccccgtcctgcccctgactctggccatcagaagaggcctctccattaagagccgcttctcctgccggctttcatactctccttcctctgcaaacctggattaactctccctgatgtgtgctgggttgagaggtcagggcactttcaatccctcacctagtcctgctgcacagggcaggaggcctcacagaagagatacttgcagttccaggcctggccaccaggtgacgccttccttctctcctgggctctcctgtccctccggcctctgctctccccacgttcacccaccctcctcccaattgtttccccttcacactcctgcactggtcctatcccccaggactgattctttcccggagatggggtggccacttatctgtcctctggatcaggtcctttctccatcccactacctcctgggtccaaagcctggtgagagcatagggccttctggggtggaaggggggtctggggcagcctctcttcccccaacatactcactagagtggctcctgtgaagcagagaccaaagttctgacttttctttttccttttttttttttttttgagatggagtctcgctgtgtcacccaggctggagtgcagtgacgcgatctcgactcactgcaacctccgcctcccaggttcaagcgattctcctgcttcaacctcctgagtagctgggattacaggtgcgtgccaccacaccccgctaatttttgtatttttagtagagacagggtttcaccatgttggtcaggctggtctcgaactcctgacctcgtaatctgcccacctcggcctcccaaagttctgggattacaggtgtgagcgaccacatccggtcaagttctgacttttcagggcagtgggatggtgacttctgagctaagcctgcaagggaagtggctgttcccagacctggggtcccttggcttttcgaccaccctagcactggccctaggaggggctgagttatcagagcagcaacccttctacccaccctactgagtccccattctaccttcgaatcccatgtattatcttccataagtgccagaaattggtacaaagtgcagtgccagctgctccccagggcatggtctggctctctgggctgctgggctgccagcccctttcagaaagcatggcagtgggaaccagcaacttgggctaccttaggggaagcagcactctgcccagggttcttgctataaataggtcagtgggcagagaggcagatgtgtgcaaaaagcacaaccccaatcacacacagaaacccgtaggcacggacacacccagtctcaatgcacgaagttggagaacctgacagggctggtccaggccacagaggatggggttaggcttcatgccttcatgcccaggcagccacagaaacccactcttccccgcctcacagggctcctccggttggcctggatccaaagcgatctccttgtttcacctctttccagctcttccctagagcctggccccaagttccagagtcaaatcccagttttgcagtcaactattaacctggggccctggcagattggggtatccacccagtcatgtaaaggcaggagacctgctctgggcctgactcaaagcaaacacgtgggtgcagaagacccatgggaggaggaggtggggcccactcaacacacctaagccagtggccctctaggaggggcagaagagccaaccagagggttcctggaggtcatcgggttcctccttctgcttccaggcagcaacagacctaattcatctcctgtgaggatggagcaagggcgaatataggcatagacatatctggagcgcaaggattgagaggccctgtggacaaggggaaggagagcttgggggtgggagagggatctatggaaggggctgttgtagccaagaatggggcctgggctgggggcctggcctctggagagccctgattctactccagtcttctctcaccatggagacaacaccagtagagctgggagctggggcctgccactgagtaacagctcacacatgtagcacacttatgcgtcaggcaccagcatgtacaccttaatttatttaactttcacaacaaccctaggagaaaggtacagctactattctcatggtacagtggggaaaactgaggcacagagaggttagggacttttcatgatcacacagctaataagtggtggtcccaggattcaacccaagaagtctgttagaatccatactcttatcgactattttaataacagcatttcaataatagtaatatgtgatgttaaatgctttatctgagttatatcattgcattctcacaaaaatggtacatttgttagctcaaatttacagatgaggaaatggaggcctggagagttcaagtagctcactctaagttacagggtttgctagctgcagactggagactagatctcaggtcactctgccttggggttgcccttttctgagatcagactggccttaacagagcccaactttcttggaaggacacagctgggggtcgagggtcctgcatatgcacctggggagtccccacacacccgcaccaaaggggaaacattcaaaggagatgcaggtgacatacagatgggctaaggtgaggccttcctccaacatggggccctggctgagagtggagggatagggtgctacttgggggatatctattactaatcagcacacaatagctgggtgggcaccccctctctctgcagctggtggagatgggcctggtgctcctctctgcttggtaggaatgaccagggcaggatgccacctgctacactcttgcctgtcccagagcccttgggagaccagctgttgctcccacctttccccacagggtgcccggtccccacggcgcaaggaggccaagctcagctgtgtgtctgagcccactcagcagcaggcatgatcagggcagggcccagcgctaagggctgctggggctaaagtgccttgctgaaggaggggcagagttaaacattagccacaatggccccccgcgaagtgagtcatactccccacaagtctctgggctgggcagccgggggcgggggggttagcttcgttccaggtgggtgaccaagctgcggaagcccaggacagttcgctgggaccagtgctaatggcagcttctgctcctgacccccatcaggtctctttcctcagacatccccaaagcttgtctgcctgtgggtctttcattaaaggtgacgggcaagggttttctcttccttccaagacacacttctaggctggcttgtgggtcccctgagacgaaggctgagcagggtgagcctcgaaaaccccatagcactggcccagagcactgcggtcaatgtccgaaggaccagagagggagggtgacttgctcaaggtcacaaacctaactggagctaggaagtaggtccccagactcccagtctgaggaaattggatgtggacagggctttggtctcctggccagaggcaaacgcccagggatctgaacaggctgcccatctctggcctcaactcagcaccccaactggctccagtgccaaccattggcctctctcactggttggcacaggctgggtgagcctggccctttgccctgggttcaggagagaggtatggctttgcctggcagtcaggggaggtgttccaacctgggagcccctgggggaggagcgtgtgtgtgaacgcttgtgcctgttcatcagaaggggtgagcatggtgtgtatgcgtgggcatgcagaatgcagggtgatgacctgtctgcccgccctgagtgtcacagacacctgtgtgtcccctgtactagtgcctcccagatgctcttctcctgactggctctttgtgacctaaatttcaactgctccaccccacaaggaggaaaccagggccacaaatgtagtgagattttcataaagctaaatgtattcagtggaaacgaccttcctctgatctaaaagcatgcatgcctttgttttattactggagtattaaattagcccttacttatggaataggaggacagtaggtggcaattgttttctaatgctcttacttcacaaaataaaatggtggcagcacaatgtcagtatttatattacacaatattattagtttgtaaaaaccgaaagccagggagcttactgccctggattctttagggcgtgggtcttatcacctcattcatttcttcccttcccctaagagtgccacaagcatggcagttgctcagctgagacacatgaatgggaacagaactgaaatatcaggatgtgacctcgagccagctggttggggctggggatccccctggatctccactctgtcctgtccgagaaaggggaagctgccctatgagtcttttttctgggggattccagaggttgaacgtctgttctgaggctcctcagaacctcgagggaggggacgagagagatgaccccttgcccaaccactggctgaaaaatcttgaaattccctgactttgaccagggaattcccagttgtgctaagccctgcctggtggaatgtccctggaggaagtaaccaggacacgcatacgtttttaatgtacgtataaagaatcgtaaagtgaacacccatctgccaaccactcattttaagaactaggatatggcacatacttttgaagcccttatgcgtccctccccaatcacaaccccttcctctccacaaaggtaaatacaatcctcaattttgtgtttgttattctcttggttctcttcataatgttactacgtatttatgaattcctaatacatcattcagttttggatctttttgtaaacctt

SEQ ID NO: 195491 - DNA, 678 bp, Homo sapiens
  Payload ID: 18594
  Gene Name: troponin I type 2 (skeletal, fast)
  Uniprot ID: P48788
  ENST ID: ENST00000252898
  CDS Start-End: 1-549
atgggagatgaggagaagcggaacagggccatcacggcccgcaggcagcacctgaagagtgtgatgctgcagatagcggccacggagctggagaaggaggagagccgccgtgaggcagagaagcagaactacctggcggagcactgcccgccgctgcatatcccgggctccatgtctgaagtgcaggagctctgcaaacagctgcacgccaagatcgatgcggctgaagaggagaagtacgacatggaggtgagggtgcagaagaccagcaaggagctggaggacatgaaccagaagctatttgatctgcggggcaagttcaagcggcccccactgcggagggtgcgcatgtcggccgatgccatgctcaaggccctgctgggctcgaagcacaaggtgtgcatggacctgagggccaacctgaagcaggtcaagaaggaggacacagagaaggagcgggacctgcgagacgtgggtgactggaggaagaacatcgaggagaagtctggcatggagggccggaagaagatgtttgagtccgagtcctaggccactcgctgcccctacgcctgccccggtgcccggctcccagcagaacatactagggagatgcacccagagcctgccagggagggctggcctcaccaccaccgtcaataaaggatttgaatccccatg

SEQ ID NO: 195492 - DNA, 706 bp, Homo sapiens
  Payload ID: 18594
  Gene Name: troponin I type 2 (skeletal, fast)
  Uniprot ID: P48788
  ENST ID: ENST00000381905
  CDS Start-End: 31-579
ctggcaaagtgtcacacaccacacagcaccatgtcccagtgcaagaagcggaacagggccatcacggcccgcaggcagcacctgaagagtgtgatgctgcagatagcggccacggagctggagaaggaggagagccgccgtgaggcagagaagcagaactacctggcggagcactgcccgccgctgcatatcccgggctccatgtctgaagtgcaggagctctgcaaacagctgcacgccaagatcgatgcggctgaagaggagaagtacgacatggaggtgagggtgcagaagaccagcaaggagctggaggacatgaaccagaagctatttgatctgcggggcaagttcaagcggcccccactgcggagggtgcgcatgtcggccgatgccatgctcaaggccctgctgggctcgaagcacaaggtgtgcatggacctgagggccaacctgaagcaggtcaagaaggaggacacagagaaggagcgggacctgcgagacgtgggtgactggaggaagaacatcgaggagaagtctggcatggagggccggaagaagatgtttgagtccgagtcctaggccactcgctgcccctacgcctgccccggtgcccggctcccagcagaacatactagggagatgcacccagagcctgccagggagggctggcctcaccaccaccgtcaataaaggatttgaatcccca

SEQ ID NO: 195493 - DNA, 745 bp, Homo sapiens
  Payload ID: 18594
  Gene Name: troponin I type 2 (skeletal, fast)
  Uniprot ID: P48788
  ENST ID: ENST00000381906
  CDS Start-End: 70-618
tcttacttctcaccctggggaattccaagacattgtccttgaaggaggctccaagctcaggacctcaggatgggagatgaggagaagcggaacagggccatcacggcccgcaggcagcacctgaagagtgtgatgctgcagatagcggccacggagctggagaaggaggagagccgccgtgaggcagagaagcagaactacctggcggagcactgcccgccgctgcatatcccgggctccatgtctgaagtgcaggagctctgcaaacagctgcacgccaagatcgatgcggctgaagaggagaagtacgacatggaggtgagggtgcagaagaccagcaaggagctggaggacatgaaccagaagctatttgatctgcggggcaagttcaagcggcccccactgcggagggtgcgcatgtcggccgatgccatgctcaaggccctgctgggctcgaagcacaaggtgtgcatggacctgagggccaacctgaagcaggtcaagaaggaggacacagagaaggagcgggacctgcgagacgtgggtgactggaggaagaacatcgaggagaagtctggcatggagggccggaagaagatgtttgagtccgagtcctaggccactcgctgcccctacgcctgccccggtgcccggctcccagcagaacatactagggagatgcacccagagcctgccagggagggctggcctcaccaccaccgtcaataaaggatttgaatcccca

SEQ ID NO: 195494 - DNA, 743 bp, Homo sapiens
  Payload ID: 18594
  Gene Name: troponin I type 2 (skeletal, fast)
  Uniprot ID: P48788
  ENST ID: ENST00000381911
  CDS Start-End: 68-616
gctgccggcctgacctcgctcccagccctgctgcccagattctaggctccaagctcaggacctcaggatgggagatgaggagaagcggaacagggccatcacggcccgcaggcagcacctgaagagtgtgatgctgcagatagcggccacggagctggagaaggaggagagccgccgtgaggcagagaagcagaactacctggcggagcactgcccgccgctgcatatcccgggctccatgtctgaagtgcaggagctctgcaaacagctgcacgccaagatcgatgcggctgaagaggagaagtacgacatggaggtgagggtgcagaagaccagcaaggagctggaggacatgaaccagaagctatttgatctgcggggcaagttcaagcggcccccactgcggagggtgcgcatgtcggccgatgccatgctcaaggccctgctgggctcgaagcacaaggtgtgcatggacctgagggccaacctgaagcaggtcaagaaggaggacacagagaaggagcgggacctgcgagacgtgggtgactggaggaagaacatcgaggagaagtctggcatggagggccggaagaagatgtttgagtccgagtcctaggccactcgctgcccctacgcctgccccggtgcccggctcccagcagaacatactagggagatgcacccagagcctgccagggagggctggcctcaccaccaccgtcaataaaggatttgaatcccca

SEQ ID NO: 195495 - DNA, 699 bp, Homo sapiens
  Payload ID: 18594
  Gene Name: troponin I type 2 (skeletal, fast)
  ENST ID: ENST00000617947
  CDS Start-End: 25-573
aggctccaagctcaggacctcaggatgggagacctgcagaagcggaacagggccatcacggcccgcaggcagcacctgaagagtgtgatgctgcagatagcggccacggagctggagaaggaggagagccgccgtgaggcagagaagcagaactacctggcggagcactgcccgccgctgcatatcccgggctccatgtctgaagtgcaggagctctgcaaacagctgcacgccaagatcgatgcggctgaagaggagaagtacgacatggaggtgagggtgcagaagaccagcaaggagctggaggacatgaaccagaagctatttgatctgcggggcaagttcaagcggcccccactgcggagggtgcgcatgtcggccgatgccatgctcaaggccctgctgggctcgaagcacaaggtgtgcatggacctgagggccaacctgaagcaggtcaagaaggaggacacagagaaggagcgggacctgcgagacgtgggtgactggaggaagaacatcgaggagaagtctggcatggagggccggaagaagatgtttgagtccgagtcctaggccactcgctgcccctacgcctgccccggtgcccggctcccagcagaacatactagggagatgcacccagagcctgccagggagggctggcctcaccaccaccgtcaataaaggatttgaatcccc

SEQ ID NO: 195496 - DNA, 840 bp, Homo sapiens
  Payload ID: 18595
  Gene Name: troponin I type 3 (cardiac)
  Uniprot ID: P19429
  ENST ID: ENST00000344887
  CDS Start-End: 144-776
agtgtcctcggggagtctcaagcagcccggaggagactgacggtccctgggaccctgaaggtcacccgggcggccccctcactgaccctccaaacgcccctgtcctcgccctgcctcctgccattcccggcctgagtctcagcatggcggatgggagcagcgatgcggctagggaacctcgccctgcaccagccccaatcagacgccgctcctccaactaccgcgcttatgccacggagccgcacgccaagaaaaaatctaagatctccgcctcgagaaaattgcagctgaagactctgctgctgcagattgcaaagcaagagctggagcgagaggcggaggagcggcgcggagagaaggggcgcgctctgagcacccgctgccagccgctggagttggccgggctgggcttcgcggagctgcaggacttgtgccgacagctccacgcccgtgtggacaaggtggatgaagagagatacgacatagaggcaaaagtcaccaagaacatcacggagattgcagatctgactcagaagatctttgaccttcgaggcaagtttaagcggcccaccctgcggagagtgaggatctctgcagatgccatgatgcaggcgctgctgggggcccgggctaaggagtccctggacctgcgggcccacctcaagcaggtgaagaaggaggacaccgagaaggaaaaccgggaggtgggagactggcgcaagaacatcgatgcactgagtggaatggagggccgcaagaaaaagtttgagagctgagccttcctgcctactgcccctgccctgaggagggccctgaggaataaagcttctctctgagctg

SEQ ID NO: 195497 - DNA, 286 bp, Homo sapiens
  Payload ID: 18595
  Gene Name: troponin I type 3 (cardiac)
  ENST ID: ENST00000586858
  CDS Start-End: 116-286
gcgtggcctcccgtagactcagggctcaagttggacgtgggcccaaatctggaccggctgggtttgctgggggtgtcttgaggtcccctccaccgtcgtctccgaatccccctccatgatccttccttgctccatctcaccctggcagaaaaaatctaagatctccgcctcgagaaaattgcagctgaagccccgggtgggctgcgcttccctcccacccctctgcagactctgctgctgcagattgcaaagcaagagctggagcgagaggcggaggagcggcgcg

SEQ ID NO: 195498 - DNA, 669 bp, Homo sapiens
  Payload ID: 18595
  Gene Name: troponin I type 3 (cardiac)
  ENST ID: ENST00000588882
  CDS Start-End: 49-606
tgggggtgtcttgaggtcccctccaccgtcgtctccgaatccccctccatgatccttccttgctccatctcaccctggcagaaaaaatctaagatctccgcctcgagaaaattgcagctgaagactctgctgctgcagattgcaaagcaagagctggagcgagaggcggaggagcggcgcggagagaaggggcgcgctctgagcacccgctgccagccgctggagttggccgggctgggcttcgcggagctgcaggacttgtgccgacagctccacgcccgtgtggacaaggtggatgaagagagatacgacatagaggcaaaagtcaccaagaacatcacggagattgcagatctgactcagaagatctttgaccttcgaggcaagtttaagcggcccaccctgcggagagtgaggatctctgcagatgccatgatgcaggcgctgctgggggcccgggctaaggagtccctggacctgcgggcccacctcaagcaggtgaagaaggaggacaccgagaaggaaaaccgggaggtgggagactggcgcaagaacatcgatgcactgagtggaatggagggccgcaagaaaaagtttgagagctgagccttcctgcctactgcccctgccctgaggagggccctgaggaataaagcttctctctgagct

SEQ ID NO: 195499 - DNA, 967 bp, Homo sapiens
  Payload ID: 18596
  Gene Name: troponin T type 1 (skeletal, slow)
  Uniprot ID: P13805
  ENST ID: ENST00000291901
  CDS Start-End: 58-846
agcaaggctcagcctcaagattcacagcatctcagacacagcctaggccgcaccaggatgtcggacaccgaggagcaggaatatgaggaggagcagccggaagaggaggctgcggaggaggaggaggaagcccccgaagagccggagccggtggcagagccagaagaggaacgccccaaaccaagccgccccgtggtgcctcctttgatcccgccaaagatcccagaaggggagcgcgttgacttcgatgacatccaccgcaagcgcatggagaaagacctgctggagctgcagacactcatcgatgtacatttcgagcagcggaagaaggaggaagaggagctggttgccttgaaggagcgcattgagcggcgccggtcagagagagccgagcaacagcgcttcagaactgagaaggaacgcgaacgtcaggctaagctggcggaggagaagatgaggaaggaagaggaagaggccaagaagcgggcagaggatgatgccaagaaaaagaaggtgctgtccaacatgggggcccattttggcggctacctggtcaaggcagaacagaagcgtggtaagcggcagacggggcgggagatgaaggtgcgcatcctctccgagcgtaagaagcctctggacattgactacatgggggaggaacagctccgggagaaagcccaggagctgtcggactggatccaccagctggagtctgagaagttcgacctgatggcgaagctgaaacagcagaaatatgagatcaacgtgctgtacaaccgcatcagccacgcccagaagttccggaagggggcagggaagggccgcgttggaggccgctggaagtgaggatgccgccccggacagtggcacctgggaagcctgggagtgtttgtcccatcggtagcttgaaataaacgctcccctcagacacccgctgggttctctgatgttattatggttgagatgc

SEQ ID NO: 195500 - DNA, 934 bp, Homo sapiens
  Payload ID: 18596
  Gene Name: troponin T type 1 (skeletal, slow)
  Uniprot ID: P13805
  ENST ID: ENST00000356783
  CDS Start-End: 58-813
agcaaggctcagcctcaagattcacagcatctcagacacagcctaggccgcaccaggatgtcggacaccgaggagcaggaatatgaggaggagcagccggaagaggaggctgcggaggaggaggaggaagaagaggaacgccccaaaccaagccgccccgtggtgcctcctttgatcccgccaaagatcccagaaggggagcgcgttgacttcgatgacatccaccgcaagcgcatggagaaagacctgctggagctgcagacactcatcgatgtacatttcgagcagcggaagaaggaggaagaggagctggttgccttgaaggagcgcattgagcggcgccggtcagagagagccgagcaacagcgcttcagaactgagaaggaacgcgaacgtcaggctaagctggcggaggagaagatgaggaaggaagaggaagaggccaagaagcgggcagaggatgatgccaagaaaaagaaggtgctgtccaacatgggggcccattttggcggctacctggtcaaggcagaacagaagcgtggtaagcggcagacggggcgggagatgaaggtgcgcatcctctccgagcgtaagaagcctctggacattgactacatgggggaggaacagctccgggagaaagcccaggagctgtcggactggatccaccagctggagtctgagaagttcgacctgatggcgaagctgaaacagcagaaatatgagatcaacgtgctgtacaaccgcatcagccacgcccagaagttccggaagggggcagggaagggccgcgttggaggccgctggaagtgaggatgccgccccggacagtggcacctgggaagcctgggagtgtttgtcccatcggtagcttgaaataaacgctcccctcagacacccgctgggttctctgatgttattatggttgagatgc

SEQ ID NO: 195501 - DNA, 901 bp, Homo sapiens
  Payload ID: 18596
  Gene Name: troponin T type 1 (skeletal, slow)
  ENST ID: ENST00000536926
  CDS Start-End: 240-818
agcaaggctcagcctcaagattcacagcatctcagacacagcctaggccgcaccaggatgtcggacaccgaggagcaggaatatgaggagtgagtgctgcactgggagaggaggctgcggaggaggaggaggaagaagaggaacgccccaaaccaagccgccccgtggtgcctcctttgatcccgccaaagatcccagaaggggagcgcgttgacttcgatgacatccaccgcaagcgcatggagaaagacctgctggagctgcagacactcatcgatgtacatttcgagcagcggaagaaggaggaagaggagctggttgccttgaaggagcgcattgagcggcgccggtcagagagagccgagcaacagcgcttcagaactgagaaggaacgcgaacgtcaggctaagctggcggaggagaagatgaggaaggaagaggaagaggccaagaagcgggcagaggatgatgccaagaaaaagaaggtgctgtccaacatgggggcccattttggcggctacctggtcaaggcagaacagaagcgtggtaagcggcagacggggcgggagatgaaggtgcgcatcctctccgagcgtaagaagcctctggacattgactacatgggggaggaacagctccgggagaaagcccaggagctgtcggactggatccaccagctggagtctgagaagttcgacctgatggcgaagctgaaacagcagaaatatgagatcaacgtgctgtacaaccgcatcagccacgcccagaagttccggaagggggcagggaagggccgcgttggaggccgctggaagtgaggatgccgccccggacagtggcacctgggaagcctgggagtgtttgtcccatcggtagcttgaaataaacgctcccctcagac

SEQ ID NO: 195502 - DNA, 1065 bp, Homo sapiens
  Payload ID: 18596
  Gene Name: troponin T type 1 (skeletal, slow)
  ENST ID: ENST00000587465
  CDS Start-End: 407-985
gggaggcgaggagtgtggcactttggcggggaaggggcggctcagccctcgggccctcgcccgccctctccgggtctggagcgtctcctcgcgccatccctgcaccgccagggggaacgtgcccatcgcagccgaggccagagggacccccgtccagcagagactggaaccctggtctctggccaccgcccccatccctcccccagctcctaacgccttctcttctgtgcccccatctccagaggaggctgcggaggaggaggaggaagcccccgaagagccggagccggtggcagagccagaagaggaacgccccaaaccaagccgccccgtggtgcctcctttgatcccgccaaagatcccagaaggggagcgcgttgacttcgatgacatccaccgcaagcgcatggagaaagacctgctggagctgcagacactcatcgatgtacatttcgagcagcggaagaaggaggaagaggagctggttgccttgaaggagcgcattgagcggcgccggtcagagagagccgagcaacagcgcttcagaactgagaaggaacgcgaacgtcaggctaagctggcggaggagaagatgaggaaggaagaggaagaggccaagaagcgggcagaggatgatgccaagaaaaagaaggtgctgtccaacatgggggcccattttggcggctacctggtcaaggcagaacagaagcgtggtaagcggcagacggggcgggagatgaaggtgcgcatcctctccgagcgtaagaagcctctggacattgactacatgggggaggaacagctccgggagaaagcccaggagctgtcggactggatccaccagctggagtctgagaagttcgacctgatggcgaagctgaaacagcagaaatatgagatcaacgtgctgtacaaccgcatcagccacgcccagaagttccggaagggggcagggaagggccgcgttggaggccgctggaagtgaggatgccgccccggacagtggcacctgggaagcctgggagtgtttgtcccatcggtagcttgaaataaacgctcccctca

SEQ ID NO: 195503 - DNA, 880 bp, Homo sapiens
  Payload ID: 18596
  Gene Name: troponin T type 1 (skeletal, slow)
  ENST ID: ENST00000587089
  CDS Start-End: 1-203
cggagccggtggcagagccagaagaggaacgccccaaaccaagcccgcctcagctgggaccctccacgttcaggagcctcccggggctggcggctacctcactggacggcacatcccggaggtgggaggtggctcagggaggtcgggccactcatggtctctgtgtttctgtccactcagccgccccgtggtgcctcctttgatcccgccaaagatcccagaaggggagcgcgttgacttcgatgacatccaccgcaagcgcatggagaaagacctgctggagctgcagacactcatcgatgtacatttcgagcagcggaagaaggaggaagaggagctggttgccttgaaggagcgcattgagcggcgccggtcagagagagccgagcaacagcgcttcagaactgagaaggaacgcgaacgtcaggctaagctggcggaggagaagatgaggaaggaagaggaagaggccaagaagcgggcagaggatgatgccaagaaaaagaaggtgctgtccaacatgggggcccattttggcggctacctggtcaaggcagaacagaagcgtggtaagcggcagacggggcgggagatgaaggtgcgcatcctctccgagcgtaagaagcctctggacattgactacatgggggaggaacagctccgggagaaagcccaggagctgtcggactggatccaccagctggagtctgagaagttcgacctgatggcgaagctgaaacagcagaaatatgagatcaacgtgctgtacaaccgcatcagccacgcccagaagttccggaagggggcagggaagggccgcgttggaggccgctggaagtgaggatgccgccccggacagtggcacctgggaagcctggga

SEQ ID NO: 195504 - DNA, 529 bp, Homo sapiens
  Payload ID: 18596
  Gene Name: troponin T type 1 (skeletal, slow)
  ENST ID: ENST00000589745
  CDS Start-End: 1-442
cagaactgagaaggaacgcgaacgtcaggctaagctggcggaggagaagatgaggaaggaagaggaagaggccaagaagcgggcagaggatgatgccaagaaaaagaaggtgctgtccaacatgggggcccattttggcggctacctggtcaaggcagaacagaagcgtggtaagcggcagacggggcgggagatgaaggtgcgcatcctctccgagcgtaagaagcctctggacattgactacatgggggaggaacagctccgggagaaagcccaggagctgtcggactggatccaccagctggagtctgagaagttcgacctgatggcgaagctgaaacagcagaaatatgagatcaacgtgctgtacaaccgcatcagccacgcccagaagttccggaagggggcagggaagggccgcgttggaggccgctggaagtgaggatgccgccccggacagtggcacctgggaagcctgggagtgtttgtcccatcggtagcttgaaataaacgctcccctcagacaccc

SEQ ID NO: 195505 - DNA, 683 bp, Homo sapiens
  Payload ID: 18596
  Gene Name: troponin T type 1 (skeletal, slow)
  ENST ID: ENST00000588426
  CDS Start-End: 83-562
agcaaggctcagcctcaagattcacagcatctcagacacagcctaggccgcaccaggatgtcggacaccgaggagcaggaatatgaggaggagcagccggaagaggaggctgcggaggaggaggaggaagaaggaacgcgaacgtcaggctaagctggcggaggagaagatgaggaaggaagaggaagaggccaagaagcgggcagaggatgatgccaagaaaaagaaggtgctgtccaacatgggggcccattttggcggctacctggtcaaggcagaacagaagcgtggtaagcggcagacggggcgggagatgaaggtgcgcatcctctccgagcgtaagaagcctctggacattgactacatgggggaggaacagctccgggagaaagcccaggagctgtcggactggatccaccagctggagtctgagaagttcgacctgatggcgaagctgaaacagcagaaatatgagatcaacgtgctgtacaaccgcatcagccacgcccagaagttccggaagggggcagggaagggccgcgttggaggccgctggaagtgaggatgccgccccggacagtggcacctgggaagcctgggagtgtttgtcccatcggtagcttgaaataaacgctcccctcagacacccgctgggttctctgatgttattatggttgagatgc

SEQ ID NO: 195506 - DNA, 1163 bp, Homo sapiens
  Payload ID: 18596
  Gene Name: troponin T type 1 (skeletal, slow)
  Uniprot ID: P13805
  ENST ID: ENST00000588981
  CDS Start-End: 206-1042
ctggactctgagtgtggagccaggggcagcagggctgtctctgaactcccaggcttgtgtttgagcaaaggaattctctccccctccctctcccctcggggcgggcccgagcctccagctataaactccccggagcttcagtgccctcagcaaggctcagcctcaagattcacagcatctcagacacagcctaggccgcaccaggatgtcggacaccgaggagcaggaatatgaggaggagcagccggaagaggaggctgcggaggaggaggaggaagcccccgaagagccggagccggtggcagagccagaagaggaacgccccaaaccaagccgccccgtggtgcctcctttgatcccgccaaagatcccagaaggggagcgcgttgacttcgatgacatccaccgcaagcgcatggagaaagacctgctggagctgcagacactcatcgatgtacatttcgagcagcggaagaaggaggaagaggagctggttgccttgaaggagcgcattgagcggcgccggtcagagagagccgagcaacagcgcttcagaactgagaaggaacgcgaacgtcaggctaagctggcggaggagaagatgaggaaggaagaggaagaggccaagaagcgggcagaggatgatgccaagaaaaagaaggtgctgtccaacatgggggcccattttggcggctacctggtcaaggcagaacagaagcgtggtaagcggcagacggggcgggagatgaaggtgcgcatcctctccgagcgtaagaagcctctggacattgactacatgggggaggaacagctccgggcccggtctgcctggctgcctccatcacagccctcctgccctgccagggagaaagcccaggagctgtcggactggatccaccagctggagtctgagaagttcgacctgatggcgaagctgaaacagcagaaatatgagatcaacgtgctgtacaaccgcatcagccacgcccagaagttccggaagggggcagggaagggccgcgttggaggccgctggaagtgaggatgccgccccggacagtggcacctgggaagcctgggagtgtttgtcccatcggtagcttgaaataaacgctcccctcagacacccgctgggttctctgatgttattatggttgagatgc

SEQ ID NO: 195507 - DNA, 489 bp, Homo sapiens
  Payload ID: 18596
  Gene Name: troponin T type 1 (skeletal, slow)
  ENST ID: ENST00000588147
  CDS Start-End: 58-489
agcaaggctcagcctcaagattcacagcatctcagacacagcctaggccgcaccaggatgtcggacaccgaggagcaggaatatgaggaggagcagccggaagaggaggctgcggaggaggaggaggaaggtgaggtcccggactccgcagaagaggaacgccccaaaccaagccgccccgtggtgcctcctttgatcccgccaaagatcccagaaggggagcgcgttgacttcgatgacatccaccgcaagcgcatggagaaagacctgctggagctgcagacactcatcgatgtacatttcgagcagcggaagaaggaggaagaggagctggttgccttgaaggagcgcattgagcggcgccggtcagagagagccgagcaacagcgcttcagaactgagaaggaacgcgaacgtcaggctaagctggcggaggagaagatgaggaaggaagaggaagaggccaagaagcgggcagaggatgatgcc

SEQ ID NO: 195508 - DNA, 1016 bp, Homo sapiens
  Payload ID: 18596
  Gene Name: troponin T type 1 (skeletal, slow)
  Uniprot ID: P13805
  ENST ID: ENST00000587758
  CDS Start-End: 140-895
ctcaagattcacagcatctcagacacagcctaggttcccatggacttgtcataagacaaaagaggacagctgtgctgagggggcagggtctgcagcctcctggctgtgccaggaccacacctaccaaggccgcaccaggatgtcggacaccgaggagcaggaatatgaggaggagcagccggaagaggaggctgcggaggaggaggaggaagaagaggaacgccccaaaccaagccgccccgtggtgcctcctttgatcccgccaaagatcccagaaggggagcgcgttgacttcgatgacatccaccgcaagcgcatggagaaagacctgctggagctgcagacactcatcgatgtacatttcgagcagcggaagaaggaggaagaggagctggttgccttgaaggagcgcattgagcggcgccggtcagagagagccgagcaacagcgcttcagaactgagaaggaacgcgaacgtcaggctaagctggcggaggagaagatgaggaaggaagaggaagaggccaagaagcgggcagaggatgatgccaagaaaaagaaggtgctgtccaacatgggggcccattttggcggctacctggtcaaggcagaacagaagcgtggtaagcggcagacggggcgggagatgaaggtgcgcatcctctccgagcgtaagaagcctctggacattgactacatgggggaggaacagctccgggagaaagcccaggagctgtcggactggatccaccagctggagtctgagaagttcgacctgatggcgaagctgaaacagcagaaatatgagatcaacgtgctgtacaaccgcatcagccacgcccagaagttccggaagggggcagggaagggccgcgttggaggccgctggaagtgaggatgccgccccggacagtggcacctgggaagcctgggagtgtttgtcccatcggtagcttgaaataaacgctcccctcagacacccgctgggttctctgatgttattatggttgagatgc

SEQ ID NO: 195509 - DNA, 721 bp, Homo sapiens
  Payload ID: 18596
  Gene Name: troponin T type 1 (skeletal, slow)
  ENST ID: ENST00000593194
  CDS Start-End: 1-632
caaagatcccagaaggggagcgcgttgacttcgatgacatccaccgcaagcgcatggagaaagacctgctggagctgcagacactcatcgatgtacatttcgagcagcggaagaaggaggaagaggagctggttgccttgaaggagcgcattgagcggcgccggtcagagagagccgagcaacagcgcttcagaactgagaaggaacgcgaacgtcaggctaagctggcggaggagaagatgaggaaggaagaggaagaggccaagaagcgggcagaggatgatgccaagaaaaagaaggtgctgtccaacatgggggcccattttggcggctacctggtcaaggcagaacagaagcgtggtaagcggcagacggggcgggagatgaaggtgcgcatcctctccgagcgtaagaagcctctggacattgactacatgggggaggaacagctccgggagaaagcccaggagctgtcggactggatccaccagctggagtctgagaagttcgacctgatggcgaagctgaaacagcagaaatatgagatcaacgtgctgtacaaccgcatcagccacgcccagaagttccggaagggggcagggaagggccgcgttggaggccgctggaagtgaggatgccgccccggacagtggcacctgggaagcctgggagtgtttgtcccatcggtagcttgaaataaacgctcccctcagacacccgc

SEQ ID NO: 195510 - DNA, 995 bp, Homo sapiens
  Payload ID: 18596
  Gene Name: troponin T type 1 (skeletal, slow)
  ENST ID: ENST00000585321
  CDS Start-End: 367-945
gaggagtgtggcactttggcggggaaggggcggctcagccctcgggccctcgcccgccctctccgggtctggagcgtctcctcgcgccatccctgcaccgccagggggaacgtgcccatcgcagccgaggccagagggacccccgtccagcagagactggaaccctggtctctggccaccgcccccatccctcccccagctcctaacgccttctcttctgtgcccccatctccagaggaggctgcggaggaggaggaggaagaagaggaacgccccaaaccaagccgccccgtggtgcctcctttgatcccgccaaagatcccagaaggggagcgcgttgacttcgatgacatccaccgcaagcgcatggagaaagacctgctggagctgcagacactcatcgatgtacatttcgagcagcggaagaaggaggaagaggagctggttgccttgaaggagcgcattgagcggcgccggtcagagagagccgagcaacagcgcttcagaactgagaaggaacgcgaacgtcaggctaagctggcggaggagaagatgaggaaggaagaggaagaggccaagaagcgggcagaggatgatgccaagaaaaagaaggtgctgtccaacatgggggcccattttggcggctacctggtcaaggcagaacagaagcgtggtaagcggcagacggggcgggagatgaaggtgcgcatcctctccgagcgtaagaagcctctggacattgactacatgggggaggaacagctccgggagaaagcccaggagctgtcggactggatccaccagctggagtctgagaagttcgacctgatggcgaagctgaaacagcagaaatatgagatcaacgtgctgtacaaccgcatcagccacgcccagaagttccggaagggggcagggaagggccgcgttggaggccgctggaagtgaggatgccgccccggacagtggcacctgggaagcctgggagtgtttgtccc

SEQ ID NO: 195511 - DNA, 340 bp, Homo sapiens
  Payload ID: 18596
  Gene Name: troponin T type 1 (skeletal, slow)
  ENST ID: ENST00000586649
  CDS Start-End: 1-313
ggagatgaaggtgcgcatcctctccgagcgtaagaagcctctggacattgactacatgggggaggaacagctccgggagaaagcccaggagctgtcggactggatccaccagctggagtctgagaagttcgacctgatggcgaagctgaaacagcagaaatatgagatcaacgtgctgtacaaccgcatcagccacgcccagaagttactgcgtctcgctctgtcacccaggctggagtgcagtggagtgatctcagctcactgcaacttccatctcccgggttcaagcgattctcctgcctcagccccctgagtagctgggattacagccggaaggggg

SEQ ID NO: 195512 - DNA, 800 bp, Homo sapiens
  Payload ID: 18596
  Gene Name: troponin T type 1 (skeletal, slow)
  ENST ID: ENST00000593046
  CDS Start-End: 190-800
ggccccagctcctcctctctcacacccaggagtccagaccccagctcctcctctctcacacccaggagtccagacccaggagtccaggcccccagcccctcctccctcacacccaggagtctaggtcgccccctccttggggccccaccccactgggcctcttctctctggtccttaggccgcaccaggatgtcggacaccgaggagcaggaatatgaggaggagcagccggaagaggaggctgcggaggaggaggaggaagcccccgaagagccggagccggtggcagagccagaagaggaacgccccaaaccaagccgccccgtggtgcctcctttgatcccgccaaagatcccagaaggggagcgcgttgacttcgatgacatccaccgcaagcgcatggagaaagacctgctggagctgcagacactcatcgatgtacatttcgagcagcggaagaaggaggaagaggagctggttgccttgaaggagcgcattgagcggcgccggtcagagagagccgagcaacagcgcttcagaactgagaaggaacgcgaacgtcaggctaagctggcggaggagaagatgaggaaggaagaggaagaggccaagaagcgggcagaggatgatgccaagaaaaagaaggtgctgtccaacatgggggcccattttggcggctacctggtcaaggcagaacagaagcgtggtaagcggcagacggggcgggagatgaaggtgcgcatcctctccgagcgtaagaagcctctggacattgactacatgggggaggaacagctccg

SEQ ID NO: 195513 - DNA, 604 bp, Homo sapiens
  Payload ID: 18596
  Gene Name: troponin T type 1 (skeletal, slow)
  ENST ID: ENST00000589226
  CDS Start-End: 152-604
ccccagctcctcctctctcacacccaggagtccagacccaggagtccaggcccccagcccctcctccctcacacccaggagtctaggtcgccccctccttggggccccaccccactgggcctcttctctctggtccttaggccgcaccaggatgtcggacaccgaggagcaggaatatgaggaggagcagccggaagaggaggctgcggaggaggaggaggaagaagaggaacgccccaaaccaagccgccccgtggtgcctcctttgatcccgccaaagatcccagaaggggagcgcgttgacttcgatgacatccaccgcaagcgcatggagaaagacctgctggagctgcagacactcatcgatgtacatttcgagcagcggaagaaggaggaagaggagctggttgccttgaaggagcgcattgagcggcgccggtcagagagagccgagcaacagcgcttcagaactgagaaggaacgcgaacgtcaggctaagctggcggaggagaagatgaggaaggaagaggaagaggccaagaagcgggcagaggatgatgccaagaaaaagaaggtgctgtccaacatgggggcccattttggc

SEQ ID NO: 195514 - DNA, 1098 bp, Homo sapiens
  Payload ID: 18597
  Gene Name: troponin T type 2 (cardiac)
  Uniprot ID: P45379
  ENST ID: ENST00000236918
  CDS Start-End: 1-897
atgtctgacatagaagaggtggtggaagagtacgaggaggaggagcaggaagaagcagctgttgaagaagaggaggactggagagaggacgaagacgagcaggaggaggcagcggaagaggatgctgaagcagaggctgagaccgaggagaccagggcagaagaagatgaagaagaagaggaagcaaaggaggctgaagatggcccaatggaggagtccaaaccaaagcccaggtcgttcatgcccaacttggtgcctcccaagatccccgatggagagagagtggactttgatgacatccaccggaagcgcatggagaaggacctgaatgagttgcaggcgctgatcgaggctcactttgagaacaggaagaaagaggaggaggagctcgtttctctcaaagacaggatcgagagacgtcgggcagagcgggccgagcagcagcgcatccggaatgagcgggagaaggagcggcagaaccgcctggctgaagagagggctcgacgagaggaggaggagaacaggaggaaggctgaggatgaggcccggaagaagaaggctttgtccaacatgatgcattttgggggttacatccagaagcaggcccagacagagcggaaaagtgggaagaggcagactgagcgggaaaagaagaagaagattctggctgagaggaggaaggtgctggccattgaccacctgaatgaagatcagctgagggagaaggccaaggagctgtggcagagcatctataacttggaggcagagaagttcgacctgcaggagaagttcaagcagcagaaatatgagatcaatgttctccgaaacaggatcaacgataaccagaaagtctccaagacccgcgggaaggctaaagtcaccgggcgctggaaatagagcctggcctccttcaccaaagatctgctcctcgctcgcacctgcctccggcctgcactcccccagttcccgggccctcctgggcaccccaggcagctcctgtttggaaatggggagctggcctaggtgggagccaccactcctgcctgcccccacacccactccacaccagtaataaaaagccaccacacactgactggc

SEQ ID NO: 195515 - DNA, 969 bp, Homo sapiens
  Payload ID: 18597
  Gene Name: troponin T type 2 (cardiac)
  Uniprot ID: P45379
  ENST ID: ENST00000360372
  CDS Start-End: 1-768
atgtctgacatagaagaggtggtggaagagtacgaggaggaggagcaggaagaagcagctgttgaagaagaggaggactggagagaggacgaagacgagcaggaggaggcagcggaagaggatgctgaagcagaggctgagaccgaggagaccagggcagaagatgaagaagaagaggaagcaaaggaggctgaagatggcccaatggaggagtccaaaccaaagcccaggtcgttcatgcccaacttggtgcctcccaagatccccgatggagagagagtggactttgatgagagacgtcgggcagagcgggccgagcagcagcgcatccggaatgagcgggagaaggagcggcagaaccgcctggctgaagagagggctcgacgagaggaggaggagaacaggaggaaggctgaggatgaggcccggaagaagaaggctttgtccaacatgatgcattttgggggttacatccagaagacagagcggaaaagtgggaagaggcagactgagcgggaaaagaagaagaagattctggctgagaggaggaaggtgctggccattgaccacctgaatgaagatcagctgagggagaaggccaaggagctgtggcagagcatctataacttggaggcagagaagttcgacctgcaggagaagttcaagcagcagaaatatgagatcaatgttctccgaaacaggatcaacgataaccagaaagtctccaagacccgcgggaaggctaaagtcaccgggcgctggaaatagagcctggcctccttcaccaaagatctgctcctcgctcgcacctgcctccggcctgcactcccccagttcccgggccctcctgggcaccccaggcagctcctgtttggaaatggggagctggcctaggtgggagccaccactcctgcctgcccccacacccactccacaccagtaataaaaagccaccacacactgactggc

SEQ ID NO: 195516 - DNA, 1083 bp, Homo sapiens
  Payload ID: 18597
  Gene Name: troponin T type 2 (cardiac)
  ENST ID: ENST00000367315
  CDS Start-End: 13-888
agagcagagaccatgtctgacatagaagaggtggtggaagagtacgaggaggagtatctggagcatgcagaagcagctgttgaagagcaggaggaggcagcggaagaggatgctgaagcagaggctgagaccgaggagaccagggcagaagaagatgaagaagaagaggaagcaaaggaggctgaagatggcccaatggaggagtccaaaccaaagcccaggtcgttcatgcccaacttggtgcctcccaagatccccgatggagagagagtggactttgatgacatccaccggaagcgcatggagaaggacctgaatgagttgcaggcgctgatcgaggctcactttgagaacaggaagaaagaggaggaggagctcgtttctctcaaagacaggatcgagagacgtcgggcagagcgggccgagcagcagcgcatccggaatgagcgggagaaggagcggcagaaccgcctggctgaagagagggctcgacgagaggaggaggagaacaggaggaaggctgaggatgaggcccggaagaagaaggctttgtccaacatgatgcattttgggggttacatccagaagcacaccctccagacagagcggaaaagtgggaagaggcagactgagcgggaaaagaagaagaagattctggctgagaggaggaaggtgctggccattgaccacctgaatgaagatcagctgagggagaaggccaaggagctgtggcagagcatctataacttggaggcagagaagttcgacctgcaggagaagttcaagcagcagaaatatgagatcaatgttctccgaaacaggatcaacgataaccagaaagtctccaagacccgcgggaaggctaaagtcaccgggcgctggaaatagagcctggcctccttcaccaaagatctgctcctcgctcgcacctgcctccggcctgcactcccccagttcccgggccctcctgggcaccccaggcagctcctgtttggaaatggggagctggcctaggtgggagccaccactcctgcctgcccccacacccactccacaccagtaataaaaagccaccacacactg

SEQ ID NO: 195517 - DNA, 1050 bp, Homo sapiens
  Payload ID: 18597
  Gene Name: troponin T type 2 (cardiac)
  ENST ID: ENST00000367317
  CDS Start-End: 1-849
atgtctgacatagaagaggtggtggaagagtacgaggaggaggagcaggaagagcaggaggaggcagcggaagaggatgctgaagcagaggctgagaccgaggagaccagggcagaagaagatgaagaagaagaggaagcaaaggaggctgaagatggcccaatggaggagtccaaaccaaagcccaggtcgttcatgcccaacttggtgcctcccaagatccccgatggagagagagtggactttgatgacatccaccggaagcgcatggagaaggacctgaatgagttgcaggcgctgatcgaggctcactttgagaacaggaagaaagaggaggaggagctcgtttctctcaaagacaggatcgagagacgtcgggcagagcgggccgagcagcagcgcatccggaatgagcgggagaaggagcggcagaaccgcctggctgaagagagggctcgacgagaggaggaggagaacaggaggaaggctgaggatgaggcccggaagaagaaggctttgtccaacatgatgcattttgggggttacatccagaaggcccagacagagcggaaaagtgggaagaggcagactgagcgggaaaagaagaagaagattctggctgagaggaggaaggtgctggccattgaccacctgaatgaagatcagctgagggagaaggccaaggagctgtggcagagcatctataacttggaggcagagaagttcgacctgcaggagaagttcaagcagcagaaatatgagatcaatgttctccgaaacaggatcaacgataaccagaaagtctccaagacccgcgggaaggctaaagtcaccgggcgctggaaatagagcctggcctccttcaccaaagatctgctcctcgctcgcacctgcctccggcctgcactcccccagttcccgggccctcctgggcaccccaggcagctcctgtttggaaatggggagctggcctaggtgggagccaccactcctgcctgcccccacacccactccacaccagtaataaaaagccaccacacactgactggc

SEQ ID NO: 195518 - DNA, 1122 bp, Homo sapiens
  Payload ID: 18597
  Gene Name: troponin T type 2 (cardiac)
  Uniprot ID: P45379
  ENST ID: ENST00000367318
  CDS Start-End: 54-920
cagacgcctccaggatctgtcggcagctgctgttctgagggagagcagagaccatgtctgacatagaagaggtggtggaagagtacgaggaggaggagcaggaagaagcagctgttgaagagcaggaggaggcagcggaagaggatgctgaagcagaggctgagaccgaggagaccagggcagaagaagatgaagaagaagaggaagcaaaggaggctgaagatggcccaatggaggagtccaaaccaaagcccaggtcgttcatgcccaacttggtgcctcccaagatccccgatggagagagagtggactttgatgacatccaccggaagcgcatggagaaggacctgaatgagttgcaggcgctgatcgaggctcactttgagaacaggaagaaagaggaggaggagctcgtttctctcaaagacaggatcgagagacgtcgggcagagcgggccgagcagcagcgcatccggaatgagcgggagaaggagcggcagaaccgcctggctgaagagagggctcgacgagaggaggaggagaacaggaggaaggctgaggatgaggcccggaagaagaaggctttgtccaacatgatgcattttgggggttacatccagaagcaggcccagacagagcggaaaagtgggaagaggcagactgagcgggaaaagaagaagaagattctggctgagaggaggaaggtgctggccattgaccacctgaatgaagatcagctgagggagaaggccaaggagctgtggcagagcatctataacttggaggcagagaagttcgacctgcaggagaagttcaagcagcagaaatatgagatcaatgttctccgaaacaggatcaacgataaccagaaagtctccaagacccgcgggaaggctaaagtcaccgggcgctggaaatagagcctggcctccttcaccaaagatctgctcctcgctcgcacctgcctccggcctgcactcccccagttcccgggccctcctgggcaccccaggcagctcctgtttggaaatggggagctggcctaggtgggagccaccactcctgcctgcccccacacccactccacaccagtaataaaaagccaccacacactgactggca

SEQ ID NO: 195519 - DNA, 1007 bp, Homo sapiens
  Payload ID: 18597
  Gene Name: troponin T type 2 (cardiac)
  Uniprot ID: P45379
  ENST ID: ENST00000367320
  CDS Start-End: 54-821
cagacgcctccaggatctgtcggcagctgctgttctgagggagagcagagaccatgtctgacatagaagaggtggtggaagagtacgaggaggaggagcaggaagaagcagctgttgaagaagaggaggactggagagaggacgaagacgagcaggaggaggcagcggaagaggatgctgaagcagaggctgagaccgaggagaccagggcagaagatgaagaagaagaggaagcaaaggaggctgaagatggcccaatggaggagtccaaaccaaagcccaggtcgttcatgcccaacttggtgcctcccaagatccccgatggagagagagtggactttgatgagagacgtcgggcagagcgggccgagcagcagcgcatccggaatgagcgggagaaggagcggcagaaccgcctggctgaagagagggctcgacgagaggaggaggagaacaggaggaaggctgaggatgaggcccggaagaagaaggctttgtccaacatgatgcattttgggggttacatccagaagacagagcggaaaagtgggaagaggcagactgagcgggaaaagaagaagaagattctggctgagaggaggaaggtgctggccattgaccacctgaatgaagatcagctgagggagaaggccaaggagctgtggcagagcatctataacttggaggcagagaagttcgacctgcaggagaagttcaagcagcagaaatatgagatcaatgttctccgaaacaggatcaacgataaccagaaagtctccaagacccgcgggaaggctaaagtcaccgggcgctggaaatagagcctggcctccttcaccaaagatctgctcctcgctcgcacctgcctccggcctgcactcccccagttcccgggccctcctgggcaccccaggcagctcctgtttggaaatggggagctggcctaggtgggagccaccactcctgcctgcccccacacccactccacaccagtaataaaaagccac

SEQ ID NO: 195520 - DNA, 1132 bp, Homo sapiens
  Payload ID: 18597
  Gene Name: troponin T type 2 (cardiac)
  Uniprot ID: P45379
  ENST ID: ENST00000367322
  CDS Start-End: 73-930
agtccccgctgagactgagcagacgcctccaggatctgtcggcagctgctgttctgagggagagcagagaccatgtctgacatagaagaggtggtggaagagtacgaggaggaggagcaggaagaagcagctgttgaagagcaggaggaggcagcggaagaggatgctgaagcagaggctgagaccgaggagaccagggcagaagaagatgaagaagaagaggaagcaaaggaggctgaagatggcccaatggaggagtccaaaccaaagcccaggtcgttcatgcccaacttggtgcctcccaagatccccgatggagagagagtggactttgatgacatccaccggaagcgcatggagaaggacctgaatgagttgcaggcgctgatcgaggctcactttgagaacaggaagaaagaggaggaggagctcgtttctctcaaagacaggatcgagagacgtcgggcagagcgggccgagcagcagcgcatccggaatgagcgggagaaggagcggcagaaccgcctggctgaagagagggctcgacgagaggaggaggagaacaggaggaaggctgaggatgaggcccggaagaagaaggctttgtccaacatgatgcattttgggggttacatccagaagacagagcggaaaagtgggaagaggcagactgagcgggaaaagaagaagaagattctggctgagaggaggaaggtgctggccattgaccacctgaatgaagatcagctgagggagaaggccaaggagctgtggcagagcatctataacttggaggcagagaagttcgacctgcaggagaagttcaagcagcagaaatatgagatcaatgttctccgaaacaggatcaacgataaccagaaagtctccaagacccgcgggaaggctaaagtcaccgggcgctggaaatagagcctggcctccttcaccaaagatctgctcctcgctcgcacctgcctccggcctgcactcccccagttcccgggccctcctgggcaccccaggcagctcctgtttggaaatggggagctggcctaggtgggagccaccactcctgcctgcccccacacccactccacaccagtaataaaaagccaccacacactgactggca

SEQ ID NO: 195521 - DNA, 1182 bp, Homo sapiens
  Payload ID: 18597
  Gene Name: troponin T type 2 (cardiac)
  ENST ID: ENST00000458432
  CDS Start-End: 301-981
ctccatcctctgcctcacccagtccccgctgagactgagcagacgcctccaggatctgtcggcagctgctgttctgagggagagcagagaccatgtctgacatagaagaggtggtggaagagtacgaggaggagtgagtatgcagaagcagctgttgaagaagaggaggactggagagaggacgaagacgagcaggaggaggcagcggaagaggatgctgaagcagaggctgagaccgaggagaccagggcagaagaagatgaagaagaagaggaagcaaaggaggctgaagatggcccaatggaggagtccaaaccaaagcccaggtcgttcatgcccaacttggtgcctcccaagatccccgatggagagagagtggactttgatgacatccaccggaagcgcatggagaaggacctgaatgagttgcaggcgctgatcgaggctcactttgagaacaggaagaaagaggaggaggagctcgtttctctcaaagacaggatcgagagacgtcgggcagagcgggccgagcagcagcgcatccggaatgagcgggagaaggagcggcagaaccgcctggctgaagagagggctcgacgagaggaggaggagaacaggaggaaggctgaggatgaggcccggaagaagaaggctttgtccaacatgatgcattttgggggttacatccagaagacagagcggaaaagtgggaagaggcagactgagcgggaaaagaagaagaagattctggctgagaggaggaaggtgctggccattgaccacctgaatgaagatcagctgagggagaaggccaaggagctgtggcagagcatctataacttggaggcagagaagttcgacctgcaggagaagttcaagcagcagaaatatgagatcaatgttctccgaaacaggatcaacgataaccagaaagtctccaagacccgcgggaaggctaaagtcaccgggcgctggaaatagagcctggcctccttcaccaaagatctgctcctcgctcgcacctgcctccggcctgcactcccccagttcccgggccctcctgggcaccccaggcagctcctgtttggaaatggggagctggcctaggtgggagccaccactcctgcctgcccccacacccactccacaccagtaataaaaagccaccacacactgactggc

SEQ ID NO: 195522 - DNA, 386 bp, Homo sapiens
  Payload ID: 18597
  Gene Name: troponin T type 2 (cardiac)
  ENST ID: ENST00000422165
  CDS Start-End: 45-386
ccaggatctgtcggcagctgctgttctgagggagagcagagaccatgtctgacatagaagaggtggtggaagagtacgaggaggaggagcaggaagaagaggaggactggagagaggacgaagacgagcaggaggaggcagcggaagaggatgctgaagcagaggctgagaccgaggagaccagggcagaagaagatgaagaagaagaggaagcaaaggaggctgaagatggcccaatggaggagtccaaaccaaagcccaggtcgttcatgcccaacttggtgcctcccaagatccccgatggagagagagtggactttgatgacatccaccggaagcgcatggagaaggacctgaatgagttgcaggcgctgatcgaggctcac

SEQ ID NO: 195523 - DNA, 565 bp, Homo sapiens
  Payload ID: 18597
  Gene Name: troponin T type 2 (cardiac)
  ENST ID: ENST00000455702
  CDS Start-End: 26-565
gctgttctgagggagagcagagaccatgtctgacatagaagaggtggtggaagagtacgaggaggaggagcaggaagaagcagctgttgaagaagaggaggactggagagaggacgaagacgagcaggaggaggcagcggaagaggatgctgaagcagaggctgagaccgaggagaccagggcagaagaagatgaagaagaagaggaagcaaaggaggctgaagatggcccaatggaggagtccaaaccaaagcccaggtcgttcatgcccaacttggtgcctcccaagatccccgatggagagagagtggactttgatgacatccaccggaagcgcatggagaaggacctgaatgagttgcaggcgctgatcgaggctcactttgagaacaggaagaaagaggaggaggagctcgtttctctcaaagacaggatcgagagacgtcgggcagagcgggccgagcagcagcgcatccggaatgagcgggagaaggagcggcagaaccgcctggctgaagagagggctcgacgagaggaggaggagaacaggaggaaggctgaggat

SEQ ID NO: 195524 - DNA, 1084 bp, Homo sapiens
  Payload ID: 18597
  Gene Name: troponin T type 2 (cardiac)
  ENST ID: ENST00000421663
  CDS Start-End: 213-893
gagcagacgcctccaggatctgtcggcagctgctgttctgagggagagcagagaccatgtctgacatagaagaggtggtggaagagtacgaggaggagtgagagcaggaggaggcagcggaagaggatgctgaagcagaggctgagaccgaggagaccagggcagaagaagatgaagaagaagaggaagcaaaggaggctgaagatggcccaatggaggagtccaaaccaaagcccaggtcgttcatgcccaacttggtgcctcccaagatccccgatggagagagagtggactttgatgacatccaccggaagcgcatggagaaggacctgaatgagttgcaggcgctgatcgaggctcactttgagaacaggaagaaagaggaggaggagctcgtttctctcaaagacaggatcgagagacgtcgggcagagcgggccgagcagcagcgcatccggaatgagcgggagaaggagcggcagaaccgcctggctgaagagagggctcgacgagaggaggaggagaacaggaggaaggctgaggatgaggcccggaagaagaaggctttgtccaacatgatgcattttgggggttacatccagaagacagagcggaaaagtgggaagaggcagactgagcgggaaaagaagaagaagattctggctgagaggaggaaggtgctggccattgaccacctgaatgaagatcagctgagggagaaggccaaggagctgtggcagagcatctataacttggaggcagagaagttcgacctgcaggagaagttcaagcagcagaaatatgagatcaatgttctccgaaacaggatcaacgataaccagaaagtctccaagacccgcgggaaggctaaagtcaccgggcgctggaaatagagcctggcctccttcaccaaagatctgctcctcgctcgcacctgcctccggcctgcactcccccagttcccgggccctcctgggcaccccaggcagctcctgtttggaaatggggagctggcctaggtgggagccaccactcctgcctgcccccacacccactccacaccagtaataaaaagccaccacac

SEQ ID NO: 195525 - DNA, 349 bp, Homo sapiens
  Payload ID: 18597
  Gene Name: troponin T type 2 (cardiac)
  ENST ID: ENST00000412633
  CDS Start-End: 57-349
gagcagacgcctccaggatctgtcggcagctgctgttctgagggagagcagagaccatgtctgacatagaagaggtggtggaagagtacgaggaggaggagcaggaagaagcagctgttgaagagcaggaggaggcagcggaagaggatgctgaagcagaggctgagaccgaggagaccagggcagaagatgaagaagaagaggaagcaaaggaggctgaagatggcccaatggaggagtccaaaccaaagcccaggtcgttcatgcccaacttggtgcctcccaagatccccgatggagagagagtggactttgatgacatccaccggaagcgcatggagaaggacct

SEQ ID NO: 195526 - DNA, 870 bp, Homo sapiens
  Payload ID: 18597
  Gene Name: troponin T type 2 (cardiac)
  ENST ID: ENST00000438742
  CDS Start-End: 57-870
gagcagacgcctccaggatctgtcggcagctgctgttctgagggagagcagagaccatgtctgacatagaagaggtggtggaagagtacgaggaggaggagcaggaagagcaggaggaggcagcggaagaggatgctgaagcagaggctgagaccgaggagaccagggcagaagaagatgaagaagaagaggaagcaaaggaggctgaagatggcccaatggaggagtccaaaccaaagcccaggtcgttcatgcccaacttggtgcctcccaagatccccgatggagagagagtggactttgatgacatccaccggaagcgcatggagaaggacctgaatgagttgcaggcgctgatcgaggctcactttgagaacaggaagaaagaggaggaggagctcgtttctctcaaagacaggatcgagagacgtcgggcagagcgggccgagcagcagcgcatccggaatgagcgggagaaggagcggcagaaccgcctggctgaagagagggctcgacgagaggaggaggagaacaggaggaaggctgaggatgaggcccggaagaagaaggctttgtccaacatgatgcattttgggggttacatccagaaggcccagacagagcggaaaagtgggaagaggcagactgagcgggaaaagaagaagaagattctggctgagaggaggaaggtgctggccattgaccacctgaatgaagatcagctgagggagaaggccaaggagctgtggcagagcatctataacttggaggcagagaagttcgacctgcaggagaagttcaagcagcagaaatatgagatcaatgttctccgaaacaggatcaacgataaccagaaagtctccaagaccc

SEQ ID NO: 195527 - DNA, 1330 bp, Homo sapiens
  Payload ID: 18597
  Gene Name: troponin T type 2 (cardiac)
  Uniprot ID: P45379
  ENST ID: ENST00000509001
  CDS Start-End: 288-1154
acattcctccctccgcagggctggctcaccaggccccagcccacatgcctgcttaaagccctctccatcctctgcctcacccagtccccgctgagactgagcagacgcctccaggatctgtcggcagctgctgttctgaggtcacacagctcatgaggggtggaactagattcaccctaggcctcgctgatctctgtacaacgggggccagagctcttctgaggaaggcaggcttccctttgtacctgcactgacttttttctccttttggagggagagcagagaccatgtctgacatagaagaggtggtggaagagtacgaggaggaggagcaggaagaagcagctgttgaagagcaggaggaggcagcggaagaggatgctgaagcagaggctgagaccgaggagaccagggcagaagaagatgaagaagaagaggaagcaaaggaggctgaagatggcccaatggaggagtccaaaccaaagcccaggtcgttcatgcccaacttggtgcctcccaagatccccgatggagagagagtggactttgatgacatccaccggaagcgcatggagaaggacctgaatgagttgcaggcgctgatcgaggctcactttgagaacaggaagaaagaggaggaggagctcgtttctctcaaagacaggatcgagagacgtcgggcagagcgggccgagcagcagcgcatccggaatgagcgggagaaggagcggcagaaccgcctggctgaagagagggctcgacgagaggaggaggagaacaggaggaaggctgaggatgaggcccggaagaagaaggctttgtccaacatgatgcattttgggggttacatccagaagcaggcccagacagagcggaaaagtgggaagaggcagactgagcgggaaaagaagaagaagattctggctgagaggaggaaggtgctggccattgaccacctgaatgaagatcagctgagggagaaggccaaggagctgtggcagagcatctataacttggaggcagagaagttcgacctgcaggagaagttcaagcagcagaaatatgagatcaatgttctccgaaacaggatcaacgataaccagaaagtctccaagacccgcgggaaggctaaagtcaccgggcgctggaaatagagcctggcctccttcaccaaagatctgctcctcgctcgcacctgcctccggcctgcactcccccagttcccgggccctcctgggcaccccaggcagctcctgtttggaaatggggagctggcctaggtgggagccaccactcctgcctgcccccacacccactccacaccagtaat

SEQ ID NO: 195528 - DNA, 1210 bp, Homo sapiens
  Payload ID: 18598
  Gene Name: troponin T type 3 (skeletal, fast)
  Uniprot ID: P45378
  ENST ID: ENST00000278317
  CDS Start-End: 220-996
ttcctatacttggtaaggggcctgcacgggcatagccccccccagcaagactccgcacacaccccggccacccagtcactggccaatgggctcctaggaagatcaaatgtcactataacacgagggtgtgagccgggcgccagtgcctgcagccggtgctgtccacagggagctccagcccttctcacactcgacccgcagaaaccacccaccttcaccatgtctgacgaggaagttgaacaggtggaggagcagtacgaagaagaagaggaagcccaggaggaagaggaagttcaagaagacaccgcagaggaggacgcggaagaggagaaaccgagacccaaactcactgctcctaagatcccagaaggggagaaagtggacttcgatgacatccagaagaagcgtcagaacaaagacctaatggagctccaggccctcatcgacagccactttgaagcccggaagaaggaggaggaggagctggtcgctctcaaagagagaatcgagaagcgccgtgcagagagagcggagcagcagaggattcgtgcagagaaggagagggagcgccagaacagactggcggaggaaaaggccagaagggaggaggaggatgccaagaggagggcagaggacgacctgaagaagaagaaagctctgtcttccatgggagccaactacagcagctacctggccaaggctgaccagaagagaggcaagaagcagacagcccgggaaatgaagaagaagattctggctgagagacgcaagccgctcaacatcgatcaccttggtgaagacaaactgagggacaaggccaaggagctctgggagaccctgcaccagctggagattgacaagttcgagtttggggagaagctgaaacgccagaaatatgacatcaccacgctcaggagccgcattgaccaggcccagaagcacagcaagaaggctgggaccccagccaagggcaaagtcggcgggcgctggaagtagagaggccagaaaggcccctcgaggcagagaccctccgccctcttgcacaccagggccgctcgtgggactccacatcctccagcccccacaatcctgtcaggggctccctgacagtcctgggggtggagaggccatcccggggcgtcccccgcgtctgtgtccttgctgccttcatcccctggggcctgtgaataaagctgcagaacccccttca

SEQ ID NO: 195529 - DNA, 794 bp, Homo sapiens
  Payload ID: 18598
  Gene Name: troponin T type 3 (skeletal, fast)
  Uniprot ID: P45378
  ENST ID: ENST00000344578
  CDS Start-End: 57-794
cacagggagctccagcccttctcacactcgacccgcagaaaccacccaccttcaccatgtctgacgaggaagttgaacaggtggaggagcagtacgaagaagaagaggaagcccaggaggaagaggagaaaccgagacccaaactcactgctcctaagatcccagaaggggagaaagtggacttcgatgacatccagaagaagcgtcagaacaaagacctaatggagctccaggccctcatcgacagccactttgaagcccggaagaaggaggaggaggagctggtcgctctcaaagagagaatcgagaagcgccgtgcagagagagcggagcagcagaggattcgtgcagagaaggagagggagcgccagaacagactggcggaggaaaaggccagaagggaggaggaggatgccaagaggagggcagaggacgacctgaagaagaagaaagctctgtcttccatgggagccaactacagcagctacctggccaaggctgaccagaagagaggcaagaagcagacagcccgggaaatgaagaagaagattctggctgagagacgcaagccgctcaacatcgatcaccttggtgaagacaaactgagggacaaggccaaggagctctgggagaccctgcaccagctggagattgacaagttcgagtttggggagaagctgaaacgccagaaatatgacatcaccacgctcaggagccgcattgaccaggcccagaagcacagcaagaaggctgggaccccagccaagggcaaagtcggcgggcgctggaagtag

SEQ ID NO: 195530 - DNA, 1019 bp, Homo sapiens
  Payload ID: 18598
  Gene Name: troponin T type 3 (skeletal, fast)
  ENST ID: ENST00000381557
  CDS Start-End: 76-810
gcctgcagccggtgctgtccacagggagctccagcccttctcacactcgacccgcagaaaccacccaccttcaccatgtctgacgaggaagttgaacaggtggaggaggaagcccaggaggaagaggaagttcaagaagaggagaaaccgagacccaaactcactgctcctaagatcccagaaggggagaaagtggacttcgatgacatccagaagaagcgtcagaacaaagacctaatggagctccaggccctcatcgacagccactttgaagcccggaagaaggaggaggaggagctggtcgctctcaaagagagaatcgagaagcgccgtgcagagagagcggagcagcagaggattcgtgcagagaaggagagggagcgccagaacagactggcggaggaaaaggccagaagggaggaggaggatgccaagaggagggcagaggacgacctgaagaagaagaaagctctgtcttccatgggagccaactacagcagctacctggccaaggctgaccagaagagaggcaagaagcagacagcccgggaaatgaagaagaagattctggctgagagacgcaagccgctcaacatcgatcaccttggtgaagacaaactgagggacaaggccaaggagctctgggagaccctgcaccagctggagattgacaagttcgagtttggggagaagctgaaacgccagaaatatgacatcaccacgctcaggagccgcattgaccaggcccagaagcacagcaagaaggctgggaccccagccaagggcaaagtcggcgggcgctggaagtagagaggccagaaaggcccctcgaggcagagaccctccgccctcttgcacaccagggccgctcgtgggactccacatcctccagcccccacaatcctgtcaggggctccctgacagtcctgggggtggagaggccatcccggggcgtcccccgcgtctgtgtccttgctgccttcatcccctggggcctgtgaataaagctgcagaacccc

SEQ ID NO: 195531 - DNA, 1246 bp, Homo sapiens
  Payload ID: 18598
  Gene Name: troponin T type 3 (skeletal, fast)
  Uniprot ID: P45378
  ENST ID: ENST00000381558
  CDS Start-End: 280-1032
cagaggatggccctagaggagtctgtggcgtttggggcctgaaccagctgggaggacagcacgaggggctggtgggcagcctgggactgggtcacaccgggggcctggacaacactggctcgtggggctgaggactgaggagagcctggcccagccgtggcagttacaagaggcttaacctgaggggcagcagagtctcaggaagagattctgggataggaaaaagctacccccgttgcctggaagacagctatctgctggaaaccacccaccttcaccatgtctgacgaggaagttgaacaggtggaggagcagtacgaagaagaagaggaagcccaggaggaagaggaagttcaagaagaggagaaaccgagacccaaactcactgctcctaagatcccagaaggggagaaagtggacttcgatgacatccagaagaagcgtcagaacaaagacctaatggagctccaggccctcatcgacagccactttgaagcccggaagaaggaggaggaggagctggtcgctctcaaagagagaatcgagaagcgccgtgcagagagagcggagcagcagaggattcgtgcagagaaggagagggagcgccagaacagactggcggaggaaaaggccagaagggaggaggaggatgccaagaggagggcagaggacgacctgaagaagaagaaagctctgtcttccatgggagccaactacagcagctacctggccaaggctgaccagaagagaggcaagaagcagacagcccgggaaatgaagaagaagattctggctgagagacgcaagccgctcaacatcgatcaccttggtgaagacaaactgagggacaaggccaaggagctctgggagaccctgcaccagctggagattgacaagttcgagtttggggagaagctgaaacgccagaaatatgacatcaccacgctcaggagccgcattgaccaggcccagaagcacagcaagaaggctgggaccccagccaagggcaaagtcggcgggcgctggaagtagagaggccagaaaggcccctcgaggcagagaccctccgccctcttgcacaccagggccgctcgtgggactccacatcctccagcccccacaatcctgtcaggggctccctgacagtcctgggggtggagaggccatcccggggcgtcccccgcgtctgtgtccttgctgccttcatcccctggggcctgtgaataaagctgcagaacccccttca

SEQ ID NO: 195532 - DNA, 844 bp, Homo sapiens
  Payload ID: 18598
  Gene Name: troponin T type 3 (skeletal, fast)
  Uniprot ID: P45378
  ENST ID: ENST00000381563
  CDS Start-End: 59-844
tccacagggagctccagcccttctcacactcgacccgcagaaaccacccaccttcaccatgtctgacgaggaagttgaacaggtggaggagcagtacgaagaagaagaggaagcccaggaggaagctgcagaagtccatgaggaagttcatgaaccagaggaagttcaagaagaggagaaaccgagacccaaactcactgctcctaagatcccagaaggggagaaagtggacttcgatgacatccagaagaagcgtcagaacaaagacctaatggagctccaggccctcatcgacagccactttgaagcccggaagaaggaggaggaggagctggtcgctctcaaagagagaatcgagaagcgccgtgcagagagagcggagcagcagaggattcgtgcagagaaggagagggagcgccagaacagactggcggaggaaaaggccagaagggaggaggaggatgccaagaggagggcagaggacgacctgaagaagaagaaagctctgtcttccatgggagccaactacagcagctacctggccaaggctgaccagaagagaggcaagaagcagacagcccgggaaatgaagaagaagattctggctgagagacgcaagccgctcaacatcgatcaccttggtgaagacaaactgagggacaaggccaaggagctctgggagaccctgcaccagctggagattgacaagttcgagtttggggagaagctgaaacgccagaaatatgacatcaccacgctcaggagccgcattgaccaggcccagaagcacagcaagaaggctgggaccccagccaagggcaaagtcggcgggcgctggaagtag

SEQ ID NO: 195533 - DNA, 1042 bp, Homo sapiens
  Payload ID: 18598
  Gene Name: troponin T type 3 (skeletal, fast)
  Uniprot ID: P45378
  ENST ID: ENST00000381579
  CDS Start-End: 76-828
gcctgcagccggtgctgtccacagggagctccagcccttctcacactcgacccgcagaaaccacccaccttcaccatgtctgacgaggaagttgaacaggtggaggagcagtacgaagaagaagaggaagcccaggaggaagaggaagttcaagaagaggagaaaccgagacccaaactcactgctcctaagatcccagaaggggagaaagtggacttcgatgacatccagaagaagcgtcagaacaaagacctaatggagctccaggccctcatcgacagccactttgaagcccggaagaaggaggaggaggagctggtcgctctcaaagagagaatcgagaagcgccgtgcagagagagcggagcagcagaggattcgtgcagagaaggagagggagcgccagaacagactggcggaggaaaaggccagaagggaggaggaggatgccaagaggagggcagaggacgacctgaagaagaagaaagctctgtcttccatgggagccaactacagcagctacctggccaaggctgaccagaagagaggcaagaagcagacagcccgggaaatgaagaagaagattctggctgagagacgcaagccgctcaacatcgatcaccttggtgaagacaaactgagggacaaggccaaggagctctgggagaccctgcaccagctggagattgacaagttcgagtttggggagaagctgaaacgccagaaatatgacatcatgaatgtccgggccagagtgcagatgctggccaagttcagcaagaaggctgggaccccagccaagggcaaagtcggcgggcgctggaagtagagaggccagaaaggcccctcgaggcagagaccctccgccctcttgcacaccagggccgctcgtgggactccacatcctccagcccccacaatcctgtcaggggctccctgacagtcctgggggtggagaggccatcccggggcgtcccccgcgtctgtgtccttgctgccttcatcccctggggcctgtgaataaagctgcagaacccccttca

SEQ ID NO: 195534 - DNA, 1060 bp, Homo sapiens
  Payload ID: 18598
  Gene Name: troponin T type 3 (skeletal, fast)
  Uniprot ID: P45378
  ENST ID: ENST00000381589
  CDS Start-End: 76-846
gcctgcagccggtgctgtccacagggagctccagcccttctcacactcgacccgcagaaaccacccaccttcaccatgtctgacgaggaagttgaacaggtggaggagcagtacgaagaagaagaggaagcccaggaggaagctgcagaagtccatgaggaagttcatgaaccagaggagaaaccgagacccaaactcactgctcctaagatcccagaaggggagaaagtggacttcgatgacatccagaagaagcgtcagaacaaagacctaatggagctccaggccctcatcgacagccactttgaagcccggaagaaggaggaggaggagctggtcgctctcaaagagagaatcgagaagcgccgtgcagagagagcggagcagcagaggattcgtgcagagaaggagagggagcgccagaacagactggcggaggaaaaggccagaagggaggaggaggatgccaagaggagggcagaggacgacctgaagaagaagaaagctctgtcttccatgggagccaactacagcagctacctggccaaggctgaccagaagagaggcaagaagcagacagcccgggaaatgaagaagaagattctggctgagagacgcaagccgctcaacatcgatcaccttggtgaagacaaactgagggacaaggccaaggagctctgggagaccctgcaccagctggagattgacaagttcgagtttggggagaagctgaaacgccagaaatatgacatcaccacgctcaggagccgcattgaccaggcccagaagcacagcaagaaggctgggaccccagccaagggcaaagtcggcgggcgctggaagtagagaggccagaaaggcccctcgaggcagagaccctccgccctcttgcacaccagggccgctcgtgggactccacatcctccagcccccacaatcctgtcaggggctccctgacagtcctgggggtggagaggccatcccggggcgtcccccgcgtctgtgtccttgctgccttcatcccctggggcctgtgaataaagctgcagaacccccttca

SEQ ID NO: 195535 - DNA, 818 bp, Homo sapiens
  Payload ID: 18598
  Gene Name: troponin T type 3 (skeletal, fast)
  Uniprot ID: P45378
  ENST ID: ENST00000397301
  CDS Start-End: 9-818
ccttcaccatgtctgacgaggaagttgaacaggtggaggagcagtacgaagaagaagaggaagcccaggaggaagctgcagaagtccatgaggaagttcatgaaccagaggaagttcaagaagacaccgcagaggaggacgcggaagaggagaaaccgagacccaaactcactgctcctaagatcccagaaggggagaaagtggacttcgatgacatccagaagaagcgtcagaacaaagacctaatggagctccaggccctcatcgacagccactttgaagcccggaagaaggaggaggaggagctggtcgctctcaaagagagaatcgagaagcgccgtgcagagagagcggagcagcagaggattcgtgcagagaaggagagggagcgccagaacagactggcggaggaaaaggccagaagggaggaggaggatgccaagaggagggcagaggacgacctgaagaagaagaaagctctgtcttccatgggagccaactacagcagctacctggccaaggctgaccagaagagaggcaagaagcagacagcccgggaaatgaagaagaagattctggctgagagacgcaagccgctcaacatcgatcaccttggtgaagacaaactgagggacaaggccaaggagctctgggagaccctgcaccagctggagattgacaagttcgagtttggggagaagctgaaacgccagaaatatgacatcaccacgctcaggagccgcattgaccaggcccagaagcacagcaagaaggctgggaccccagccaagggcaaagtcggcgggcgctggaagtag

SEQ ID NO: 195536 - DNA, 720 bp, Homo sapiens
  Payload ID: 18598
  Gene Name: troponin T type 3 (skeletal, fast)
  ENST ID: ENST00000397304
  CDS Start-End: 1-720
atgtctgacgaggaagttgaacaggtggaggaggaagcccaggaggaagaggagaaaccgagacccaaactcactgctcctaagatcccagaaggggagaaagtggacttcgatgacatccagaagaagcgtcagaacaaagacctaatggagctccaggccctcatcgacagccactttgaagcccggaagaaggaggaggaggagctggtcgctctcaaagagagaatcgagaagcgccgtgcagagagagcggagcagcagaggattcgtgcagagaaggagagggagcgccagaacagactggcggaggaaaaggccagaagggaggaggaggatgccaagaggagggcagaggacgacctgaagaagaagaaagctctgtcttccatgggagccaactacagcagctacctggccaaggctgaccagaagagaggcaagaagcagacagcccgggaaatgaagaagaagattctggctgagagacgcaagccgctcaacatcgatcaccttggtgaagacaaactgagggacaaggccaaggagctctgggagaccctgcaccagctggagattgacaagttcgagtttggggagaagctgaaacgccagaaatatgacatcaccacgctcaggagccgcattgaccaggcccagaagcacagcaagaaggctgggaccccagccaagggcaaagtcggcgggcgctggaagtag

SEQ ID NO: 195537 - DNA, 720 bp, Homo sapiens
  Payload ID: 18598
  Gene Name: troponin T type 3 (skeletal, fast)
  ENST ID: ENST00000446240
  CDS Start-End: 1-720
atgtctgacgaggaagttgaacaggtggaggaggaagcccaggaggaagaggagaaaccgagacccaaactcactgctcctaagatcccagaaggggagaaagtggacttcgatgacatccagaagaagcgtcagaacaaagacctaatggagctccaggccctcatcgacagccactttgaagcccggaagaaggaggaggaggagctggtcgctctcaaagagagaatcgagaagcgccgtgcagagagagcggagcagcagaggattcgtgcagagaaggagagggagcgccagaacagactggcggaggaaaaggccagaagggaggaggaggatgccaagaggagggcagaggacgacctgaagaagaagaaagctctgtcttccatgggagccaactacagcagctacctggccaaggctgaccagaagagaggcaagaagcagacagcccgggaaatgaagaagaagattctggctgagagacgcaagccgctcaacatcgatcaccttggtgaagacaaactgagggacaaggccaaggagctctgggagaccctgcaccagctggagattgacaagttcgagtttggggagaagctgaaacgccagaaatatgacatcatgaatgtccgggccagagtgcagatgctggccaagttcagcaagaaggctgggaccccagccaagggcaaagtcggcgggcgctggaagtag

SEQ ID NO: 195538 - DNA, 699 bp, Homo sapiens
  Payload ID: 18598
  Gene Name: troponin T type 3 (skeletal, fast)
  ENST ID: ENST00000453458
  CDS Start-End: 76-699
gcctgcagccggtgctgtccacagggagctccagcccttctcacactcgacccgcagaaaccacccaccttcaccatgtctgacgaggaagttgaacaggtggaggagcagtacgaagaagaagaggagaaaccgagacccaaactcactgctcctaagatcccagaaggggagaaagtggacttcgatgacatccagaagaagcgtcagaacaaagacctaatggagctccaggccctcatcgacagccactttgaagcccggaagaaggaggaggaggagctggtcgctctcaaagagagaatcgagaagcgccgtgcagagagagcggagcagcagaggattcgtgcagagaaggagagggagcgccagaacagactggcggaggaaaaggccagaagggaggaggaggatgccaagaggagggcagaggacgacctgaagaagaagaaagctctgtcttccatgggagccaactacagcagctacctggccaaggctgaccagaagagaggcaagaagcagacagcccgggaaatgaagaagaagattctggctgagagacgcaagccgctcaacatcgatcaccttggtgaagacaaactgagggacaaggccaaggagctctgggagaccctgcaccagctggagattgacaagttcgagtttggggagaagctgaaacgccagaaatatgac

SEQ ID NO: 195539 - DNA, 1791 bp, Homo sapiens
  Payload ID: 18599
  Gene Name: TROVE domain family, member 2
  Uniprot ID: P10155
  ENST ID: ENST00000367441
  CDS Start-End: 40-1656
attttgcctttttgttaggtttcctaaagacaaaaaaaaatggaggaatctgtaaaccaaatgcagccactgaatgagaagcagatagccaattctcaggatggatatgtatggcaagtcactgacatgaatcgactacaccggttcttatgtttcggttctgaaggtgggacttattatatcaaagaacagaagttgggccttgaaaatgctgaagctttaattagattgattgaagatggcagaggatgtgaagtgatacaagaaataaagtcatttagtcaagaaggcagaaccacaaagcaagagcctatgctctttgcacttgccatttgttcccagtgctccgacataagcacaaaacaagcagcatttaaagctgtttctgaagtttgtcgcattcctacccatctctttacttttatccagtttaagaaagatctgaaggaaagcatgaaatgtggcatgtggggtcgtgccctccggaaggctatagcggactggtacaatgagaaaggtggcatggcccttgctctggcagttacaaaatataaacagagaaatggctggtctcacaaagatctattaagattgtcacatcttaaaccttccagtgaaggacttgcaattgtgaccaaatatattacaaagggctggaaagaagttcatgaattgtataaagaaaaagcactctctgtggagactgaaaaattattaaagtatctggaggctgtagagaaagtgaagcgcacaagagatgagctagaagtcattcatctaatagaagaacatagattagttagagaacatcttttaacaaatcacttaaagtctaaagaggtatggaaggctttgttacaagaaatgccgcttactgcattactaaggaatctaggaaagatgactgctaattcagtacttgaaccaggaaattcagaagtatctttagtatgtgaaaaactgtgtaatgaaaaactattaaaaaaggctcgtatacatccatttcatattttgatcgcattagaaacttacaagacaggtcatggtctcagagggaaactgaagtggcgccctgatgaagaaattttgaaagcattggatgctgctttttataaaacatttaagacagttgaaccaactggaaaacgtttcttactagctgttgatgtcagtgcttctatgaaccaaagagttttgggtagtatactcaacgctagtacagttgctgcagcaatgtgcatggttgtcacacgaacagaaaaagattcttatgtagttgctttttccgatgaaatggtaccatgtccagtgactacagatatgaccttacaacaggttttaatggctatgagtcagatcccagcaggtggaactgattgctctcttccaatgatctgggctcagaagacaaacacacctgctgatgtcttcattgtattcactgataatgagacctttgctggaggtgtccatcctgctattgctctgagggagtatcgaaagaaaatggatattccagctaaattgattgtttgtggaatgacatcaaatggtttcaccattgcagacccagatgatagaggcatgttggatatgtgcggctttgatactggagctctggatgtaattcgaaatttcacattagatatgatttaaccataagcagcagcacgatccagagatccattgccatcagtgatctcactaaaaatatacagctacttcccagctaatctccacccaatgaatgatgatggtatagtatgtgcataatggaaagttaccttactg

SEQ ID NO: 195540 - DNA, 1909 bp, Homo sapiens
  Payload ID: 18599
  Gene Name: TROVE domain family, member 2
  Uniprot ID: P10155
  ENST ID: ENST00000367443
  CDS Start-End: 188-1744
cacaggccgacgtcgagagggcctgctttactcctcctctttctcctccttctcccgcggcttctgcgcggagaggcgtcgcccgggatctgggttttggaagaaggatctttgtgggaagacagggtgaatttatcacagaggaataacgagggagaggagaaaggtttcctaaagacaaaaaaaaatggaggaatctgtaaaccaaatgcagccactgaatgagaagcagatagccaattctcaggatggatatgtatggcaagtcactgacatgaatcgactacaccggttcttatgtttcggttctgaaggtgggacttattatatcaaagaacagaagttgggccttgaaaatgctgaagctttaattagattgattgaagatggcagaggatgtgaagtgatacaagaaataaagtcatttagtcaagaaggcagaaccacaaagcaagagcctatgctctttgcacttgccatttgttcccagtgctccgacataagcacaaaacaagcagcatttaaagctgtttctgaagtttgtcgcattcctacccatctctttacttttatccagtttaagaaagatctgaaggaaagcatgaaatgtggcatgtggggtcgtgccctccggaaggctatagcggactggtacaatgagaaaggtggcatggcccttgctctggcagttacaaaatataaacagagaaatggctggtctcacaaagatctattaagattgtcacatcttaaaccttccagtgaaggacttgcaattgtgaccaaatatattacaaagggctggaaagaagttcatgaattgtataaagaaaaagcactctctgtggagactgaaaaattattaaagtatctggaggctgtagagaaagtgaagcgcacaagagatgagctagaagtcattcatctaatagaagaacatagattagttagagaacatcttttaacaaatcacttaaagtctaaagaggtatggaaggctttgttacaagaaatgccgcttactgcattactaaggaatctaggaaagatgactgctaattcagtacttgaaccaggaaattcagaagtatctttagtatgtgaaaaactgtgtaatgaaaaactattaaaaaaggctcgtatacatccatttcatattttgatcgcattagaaacttacaagacaggtcatggtctcagagggaaactgaagtggcgccctgatgaagaaattttgaaagcattggatgctgctttttataaaacatttaagacagttgaaccaactggaaaacgtttcttactagctgttgatgtcagtgcttctatgaaccaaagagttttgggtagtatactcaacgctagtacagttgctgcagcaatgtgcatggttgtcacacgaacagaaaaagattcttatgtagttgctttttccgatgaaatggtaccatgtccagtgactacagatatgaccttacaacaggttttaatggctatgagtcagatcccagcaggtggaactgattgctctcttccaatgatctgggctcagaagacaaacacacctgctgatgtcttcattgtattcactgataatgagacctttgctggaggtgtccatcctgctattgctctgagggagtatcgaaagaaaatggatattccagctaaattgattgtttgtggaatgacatcaaatggtttcaccattgcagacccagatgatagagacactgtaaaatagttttgctttgttgaataatacgtgtgtacctaaaagagccttgcaaaataccctactaaataaatcattttagacatggagtgcaggtggacactgtgtgaactgtttttggtcagttattgtagaaattgatagatgtaccaaataaactctatgcacattaaa

SEQ ID NO: 195541 - DNA, 1857 bp, Homo sapiens
  Payload ID: 18599
  Gene Name: TROVE domain family, member 2
  Uniprot ID: P10155
  ENST ID: ENST00000367444
  CDS Start-End: 188-1765
cacaggccgacgtcgagagggcctgctttactcctcctctttctcctccttctcccgcggcttctgcgcggagaggcgtcgcccgggatctgggttttggaagaaggatctttgtgggaagacagggtgaatttatcacagaggaataacgagggagaggagaaaggtttcctaaagacaaaaaaaaatggaggaatctgtaaaccaaatgcagccactgaatgagaagcagatagccaattctcaggatggatatgtatggcaagtcactgacatgaatcgactacaccggttcttatgtttcggttctgaaggtgggacttattatatcaaagaacagaagttgggccttgaaaatgctgaagctttaattagattgattgaagatggcagaggatgtgaagtgatacaagaaataaagtcatttagtcaagaaggcagaaccacaaagcaagagcctatgctctttgcacttgccatttgttcccagtgctccgacataagcacaaaacaagcagcatttaaagctgtttctgaagtttgtcgcattcctacccatctctttacttttatccagtttaagaaagatctgaaggaaagcatgaaatgtggcatgtggggtcgtgccctccggaaggctatagcggactggtacaatgagaaaggtggcatggcccttgctctggcagttacaaaatataaacagagaaatggctggtctcacaaagatctattaagattgtcacatcttaaaccttccagtgaaggacttgcaattgtgaccaaatatattacaaagggctggaaagaagttcatgaattgtataaagaaaaagcactctctgtggagactgaaaaattattaaagtatctggaggctgtagagaaagtgaagcgcacaagagatgagctagaagtcattcatctaatagaagaacatagattagttagagaacatcttttaacaaatcacttaaagtctaaagaggtatggaaggctttgttacaagaaatgccgcttactgcattactaaggaatctaggaaagatgactgctaattcagtacttgaaccaggaaattcagaagtatctttagtatgtgaaaaactgtgtaatgaaaaactattaaaaaaggctcgtatacatccatttcatattttgatcgcattagaaacttacaagacaggtcatggtctcagagggaaactgaagtggcgccctgatgaagaaattttgaaagcattggatgctgctttttataaaacatttaagacagttgaaccaactggaaaacgtttcttactagctgttgatgtcagtgcttctatgaaccaaagagttttgggtagtatactcaacgctagtacagttgctgcagcaatgtgcatggttgtcacacgaacagaaaaagattcttatgtagttgctttttccgatgaaatggtaccatgtccagtgactacagatatgaccttacaacaggttttaatggctatgagtcagatcccagcaggtggaactgattgctctcttccaatgatctgggctcagaagacaaacacacctgctgatgtcttcattgtattcactgataatgagacctttgctggaggtgtccatcctgctattgctctgagggagtatcgaaagaaaatggatattccagctaaattgattgtttgtggaatgacatcaaatggtttcaccattgcagacccagatgatagagccttgcaaaataccctactaaataaatcattttagacatggagtgcaggtggacactgtgtgaactgtttttggtcagttattgtagaaattgatagatgtaccaaataaactctatgcacattaaa

SEQ ID NO: 195542 - DNA, 1898 bp, Homo sapiens
  Payload ID: 18599
  Gene Name: TROVE domain family, member 2
  Uniprot ID: P10155
  ENST ID: ENST00000367445
  CDS Start-End: 188-1792
cacaggccgacgtcgagagggcctgctttactcctcctctttctcctccttctcccgcggcttctgcgcggagaggcgtcgcccgggatctgggttttggaagaaggatctttgtgggaagacagggtgaatttatcacagaggaataacgagggagaggagaaaggtttcctaaagacaaaaaaaaatggaggaatctgtaaaccaaatgcagccactgaatgagaagcagatagccaattctcaggatggatatgtatggcaagtcactgacatgaatcgactacaccggttcttatgtttcggttctgaaggtgggacttattatatcaaagaacagaagttgggccttgaaaatgctgaagctttaattagattgattgaagatggcagaggatgtgaagtgatacaagaaataaagtcatttagtcaagaaggcagaaccacaaagcaagagcctatgctctttgcacttgccatttgttcccagtgctccgacataagcacaaaacaagcagcatttaaagctgtttctgaagtttgtcgcattcctacccatctctttacttttatccagtttaagaaagatctgaaggaaagcatgaaatgtggcatgtggggtcgtgccctccggaaggctatagcggactggtacaatgagaaaggtggcatggcccttgctctggcagttacaaaatataaacagagaaatggctggtctcacaaagatctattaagattgtcacatcttaaaccttccagtgaaggacttgcaattgtgaccaaatatattacaaagggctggaaagaagttcatgaattgtataaagaaaaagcactctctgtggagactgaaaaattattaaagtatctggaggctgtagagaaagtgaagcgcacaagagatgagctagaagtcattcatctaatagaagaacatagattagttagagaacatcttttaacaaatcacttaaagtctaaagaggtatggaaggctttgttacaagaaatgccgcttactgcattactaaggaatctaggaaagatgactgctaattcagtacttgaaccaggaaattcagaagtatctttagtatgtgaaaaactgtgtaatgaaaaactattaaaaaaggctcgtatacatccatttcatattttgatcgcattagaaacttacaagacaggtcatggtctcagagggaaactgaagtggcgccctgatgaagaaattttgaaagcattggatgctgctttttataaaacatttaagacagttgaaccaactggaaaacgtttcttactagctgttgatgtcagtgcttctatgaaccaaagagttttgggtagtatactcaacgctagtacagttgctgcagcaatgtgcatggttgtcacacgaacagaaaaagattcttatgtagttgctttttccgatgaaatggtaccatgtccagtgactacagatatgaccttacaacaggttttaatggctatgagtcagatcccagcaggtggaactgattgctctcttccaatgatctgggctcagaagacaaacacacctgctgatgtcttcattgtattcactgataatgagacctttgctggaggtgtccatcctgctattgctctgagggagtatcgaaagaaaatggatattccagctaaattgattgtttgtggaatgacatcaaatggtttcaccattgcagacccagatgatagaggcatgttggatatgtgcggctttgatactggagctctggatccttgcaaaataccctactaaataaatcattttagacatggagtgcaggtggacactgtgtgaactgtttttggtcagttattgtagaaattgatagatgtaccaaataaactctatgcacattaaa

SEQ ID NO: 195543 - DNA, 3081 bp, Homo sapiens
  Payload ID: 18599
  Gene Name: TROVE domain family, member 2
  Uniprot ID: P10155
  ENST ID: ENST00000367446
  CDS Start-End: 211-1827
tcctgcttgtcggcatcgctccccacaggccgacgtcgagagggcctgctttactcctcctctttctcctccttctcccgcggcttctgcgcggagaggcgtcgcccgggatctgggttttggaagaaggatctttgtgggaagacagggtgaatttatcacagaggaataacgagggagaggagaaaggtttcctaaagacaaaaaaaaatggaggaatctgtaaaccaaatgcagccactgaatgagaagcagatagccaattctcaggatggatatgtatggcaagtcactgacatgaatcgactacaccggttcttatgtttcggttctgaaggtgggacttattatatcaaagaacagaagttgggccttgaaaatgctgaagctttaattagattgattgaagatggcagaggatgtgaagtgatacaagaaataaagtcatttagtcaagaaggcagaaccacaaagcaagagcctatgctctttgcacttgccatttgttcccagtgctccgacataagcacaaaacaagcagcatttaaagctgtttctgaagtttgtcgcattcctacccatctctttacttttatccagtttaagaaagatctgaaggaaagcatgaaatgtggcatgtggggtcgtgccctccggaaggctatagcggactggtacaatgagaaaggtggcatggcccttgctctggcagttacaaaatataaacagagaaatggctggtctcacaaagatctattaagattgtcacatcttaaaccttccagtgaaggacttgcaattgtgaccaaatatattacaaagggctggaaagaagttcatgaattgtataaagaaaaagcactctctgtggagactgaaaaattattaaagtatctggaggctgtagagaaagtgaagcgcacaagagatgagctagaagtcattcatctaatagaagaacatagattagttagagaacatcttttaacaaatcacttaaagtctaaagaggtatggaaggctttgttacaagaaatgccgcttactgcattactaaggaatctaggaaagatgactgctaattcagtacttgaaccaggaaattcagaagtatctttagtatgtgaaaaactgtgtaatgaaaaactattaaaaaaggctcgtatacatccatttcatattttgatcgcattagaaacttacaagacaggtcatggtctcagagggaaactgaagtggcgccctgatgaagaaattttgaaagcattggatgctgctttttataaaacatttaagacagttgaaccaactggaaaacgtttcttactagctgttgatgtcagtgcttctatgaaccaaagagttttgggtagtatactcaacgctagtacagttgctgcagcaatgtgcatggttgtcacacgaacagaaaaagattcttatgtagttgctttttccgatgaaatggtaccatgtccagtgactacagatatgaccttacaacaggttttaatggctatgagtcagatcccagcaggtggaactgattgctctcttccaatgatctgggctcagaagacaaacacacctgctgatgtcttcattgtattcactgataatgagacctttgctggaggtgtccatcctgctattgctctgagggagtatcgaaagaaaatggatattccagctaaattgattgtttgtggaatgacatcaaatggtttcaccattgcagacccagatgatagaggcatgttggatatgtgcggctttgatactggagctctggatgtaattcgaaatttcacattagatatgatttaaccataagcagcagcacgatccagagatccattgccatcagtgatctcactaaaaatatacagctacttcccagctaatctccacccaatgaatgatgatggtatagtatgtgcataatggaaagttaccttactgaaaaaaaaaaaagaaggaaaaataagatgggcccaaaggtctatctactaaactagctcttggggaaatagcttcaggatactgtagtttcctctatctaatagagaactttttgttaacagacactgtaaaatagttttgctttgttgaataatacgtgtgtacctaaaagaggtaagagcaaaaagtgtaattccacatcatgttacttgagaagtgcttaacgttttcttaaatgttttcattgggaaaggacagctttgataatgtccaaatactctgaaatgcactagaccatataactgtgatgaaatatgaaactcatctgtaaacttttataccaagggggtaaaaaaaaaaactaaggcatttgattaaattatgaatgagttttacaaattcctttcagagttttactaagatcacacaaataacagctttcttattcagtgaaaaagatattttatttctgatgttttatttgcacttgtggaatatgttaccattaatcagaaacatcatggcaacccctaagaatagactaagtttgtgttggctgagggattctatttggtttgcttttttttttttgctttgttatattttattgctacaaggggtgtgacttgataatgatttcctctgaattataataacatagccagatgtagtctcacactgtttttcatactcttaagtgtaaataatataaaatgtttcaagcgcttaactccccctcattcacaaagtataacaattaaaatctcaactataaccagtttagctttttccttacttttaaaataaaattttttacttttaactatttttttagttaatatttttaaaagtatacatgtcaatggcctctttgtccattattcattttgtggcaaaatattcttctttgatagtgtaaacaaataataaagcaatctaggtcctttaggtttgaaaggcaatttttgagtagcatattaccagctagccagtcactaggaatttttttcagtattatttgtatgtattaaacttttcattacactaaagtgcattattttattgagcaagtatccttcattgtgaggtttaacattaaagcaatctgttgaaatgcca

SEQ ID NO: 195544 - DNA, 2143 bp, Homo sapiens
  Payload ID: 18599
  Gene Name: TROVE domain family, member 2
  Uniprot ID: P10155
  ENST ID: ENST00000400968
  CDS Start-End: 377-1993
gactgagcgcgggaggacgctctagccaccctagagacatcgaaactcttcccaggccttgcagcacccgtagcggattcggaagggctggggcctgagaagaaagggcggtgattcacagcgccgaggaggcaacatccgggatcctcgcccctctggggcggaggcggggcaaaagaagaggggcaggactcgttcccgggaaccgaacctggaatccccggcggcagtggggctgttgctgttgctgtggctgtcgctgcccgtcaggctgccttcttttgtcgtttcccagcgctgcgcaggacttctcctggcggcgctgcggatccagggggtcggctgccaggtacaggtttcctaaagacaaaaaaaaatggaggaatctgtaaaccaaatgcagccactgaatgagaagcagatagccaattctcaggatggatatgtatggcaagtcactgacatgaatcgactacaccggttcttatgtttcggttctgaaggtgggacttattatatcaaagaacagaagttgggccttgaaaatgctgaagctttaattagattgattgaagatggcagaggatgtgaagtgatacaagaaataaagtcatttagtcaagaaggcagaaccacaaagcaagagcctatgctctttgcacttgccatttgttcccagtgctccgacataagcacaaaacaagcagcatttaaagctgtttctgaagtttgtcgcattcctacccatctctttacttttatccagtttaagaaagatctgaaggaaagcatgaaatgtggcatgtggggtcgtgccctccggaaggctatagcggactggtacaatgagaaaggtggcatggcccttgctctggcagttacaaaatataaacagagaaatggctggtctcacaaagatctattaagattgtcacatcttaaaccttccagtgaaggacttgcaattgtgaccaaatatattacaaagggctggaaagaagttcatgaattgtataaagaaaaagcactctctgtggagactgaaaaattattaaagtatctggaggctgtagagaaagtgaagcgcacaagagatgagctagaagtcattcatctaatagaagaacatagattagttagagaacatcttttaacaaatcacttaaagtctaaagaggtatggaaggctttgttacaagaaatgccgcttactgcattactaaggaatctaggaaagatgactgctaattcagtacttgaaccaggaaattcagaagtatctttagtatgtgaaaaactgtgtaatgaaaaactattaaaaaaggctcgtatacatccatttcatattttgatcgcattagaaacttacaagacaggtcatggtctcagagggaaactgaagtggcgccctgatgaagaaattttgaaagcattggatgctgctttttataaaacatttaagacagttgaaccaactggaaaacgtttcttactagctgttgatgtcagtgcttctatgaaccaaagagttttgggtagtatactcaacgctagtacagttgctgcagcaatgtgcatggttgtcacacgaacagaaaaagattcttatgtagttgctttttccgatgaaatggtaccatgtccagtgactacagatatgaccttacaacaggttttaatggctatgagtcagatcccagcaggtggaactgattgctctcttccaatgatctgggctcagaagacaaacacacctgctgatgtcttcattgtattcactgataatgagacctttgctggaggtgtccatcctgctattgctctgagggagtatcgaaagaaaatggatattccagctaaattgattgtttgtggaatgacatcaaatggtttcaccattgcagacccagatgatagaggcatgttggatatgtgcggctttgatactggagctctggatgtaattcgaaatttcacattagatatgatttaaccataagcagcagcacgatccagagatccattgccatcagtgatctcactaaaaatatacagctacttcccagctaatctccacccaatgaatgatgatggtatagtatgtgcataatggaaagttaccttactgaaaaaaaaaaaagaa

SEQ ID NO: 195545 - DNA, 377 bp, Homo sapiens
  Payload ID: 18599
  Gene Name: TROVE domain family, member 2
  ENST ID: ENST00000415442
  CDS Start-End: 180-377
cccgggaaccgaacctggaatccccggcggcagtggggctgttgctgttgctgtggctgtcgctgcccgtcaggctgccttcttttgtcgtttcccagcgctgcgcaggacttctcctggcggcgctgcggatccagggggtcggctgccaggtacaggtttcctaaagacaaaaaaaaatggaggaatctgtaaaccaaatgcagccactgaatgagaagcagatagccaattctcaggatggatatgtatggcaagtcactgacatgaatcgactacaccggttcttatgtttcggttctgaaggacttgcaattgtgaccaaatatattacaaagggctggaaagaagttcatgaattgtataaagaaaaagca

SEQ ID NO: 195546 - DNA, 581 bp, Homo sapiens
  Payload ID: 18599
  Gene Name: TROVE domain family, member 2
  ENST ID: ENST00000512587
  CDS Start-End: 1-581
gctttaattagattgattgaagatggcagaggatgtgaagtgatacaagaaataaagtcatttagtcaagaaggcagaaccacaaagcaagagcctatgctctttgcacttgccatttgttcccagtgctccgacataagcacaaaacaagcagcatttaaagctgtttctgaagtttgtcgcattcctacccatctctttacttttatccagtttaagaaagatctgaaggaaagcatgaaatgtggcatgtggggtcgtgccctccggaaggctatagcggactggtacaatgagaaaggtggcatggcccttgctctggcagttacaaaatataaacagagaaatggctggtctcacaaagatctattaagattgtcacatcttaaaccttccagtgaagtgaaacttgaaaagacagccactcagaagggtgggttcacatttcagttctgtggacttaagccaagacttgcaattgtgaccaaatatattacaaagggctggaaagaagttcatgaattgtataaagaaaaagcactctctgtggagactgaaaaattattaaagtatctggaggc

SEQ ID NO: 195547 - DNA, 613 bp, Homo sapiens
  Payload ID: 18599
  Gene Name: TROVE domain family, member 2
  ENST ID: ENST00000506303
  CDS Start-End: 489-613
gttgctgttgctgtggctgtcgctgcccgtcaggctgccttcttttgtcgtttcccagcgctgcgcaggacttctcctggcggcgctgcggatccagggggtcggctgccaggtacaggggttgaggctgggcaaacgccgcgaaactatcgctcttccccgtcccgcttccgcgcctgtccaccctgggtaacggaaccagcatcgcggtagggacatcctcgctaggcccggccggaccattcctcagggtgggccctttccgaagccgggaccgctcctgcttgtcggcatcgctccccacaggccgacgtcgagagggcctgctttactcctcctctttctcctccttctcccgcggcttctgcgcggagaggcgtcgcccgggatctgggttttggaagaaggatctttgtgggaagacagggtgaatttatcacagaggaataacgagggagaggagaaaggtttcctaaagacaaaaaaaaatggaggaatctgtaaaccaaatgcagccactgaatgagaagcagatagccaattctcaggatggatatgtatggcaagtcactgacatgaatcgactacaccggttcttatgtttcggttctga

SEQ ID NO: 195548 - DNA, 7848 bp, Homo sapiens
  Payload ID: 18599
  Gene Name: TROVE domain family, member 2
  ENST ID: ENST00000432079
  CDS Start-End: 569-1360
agagacatcgaaactcttcccaggccttgcagcacccgtagcggattcggaagggctggggcctgagaagaaagggcggtgattcacagcgccgaggaggcaacatccgggatcctcgcccctctggggcggaggcggggcaaaagaagaggggcaggactcgttcccgggaaccgaacctggaatccccggcggcagtggggctgttgctgttgctgtggctgtcgctgcccgtcaggctgccttcttttgtcgtttcccagcgctgcgcaggacttctcctggcggcgctgcggatccagggggtcggctgccaggtacaggacttgcaattgtgaccaaatatattacaaagggctggaaagaagttcatgaattgtataaagaaaaagcactctctgtggagactgaaaaattattaaagtatctggaggctgtagagaaagtgaagcgcacaagagatgagctagaagtcattcatctaatagaagaacatagattagttagagaacatcttttaacaaatcacttaaagtctaaagaggtatggaaggctttgttacaagaaatgccgcttactgcattactaaggaatctaggaaagatgactgctaattcagtacttgaaccaggaaattcagaagtatctttagtatgtgaaaaactgtgtaatgaaaaactattaaaaaaggctcgtatacatccatttcatattttgatcgcattagaaacttacaagacaggtcatggtctcagagggaaactgaagtggcgccctgatgaagaaattttgaaagcattggatgctgctttttataaaacatttaagacagttgaaccaactggaaaacgtttcttactagctgttgatgtcagtgcttctatgaaccaaagagttttgggtagtatactcaacgctagtacagttgctgcagcaatgtgcatggttgtcacacgaacagaaaaagattcttatgtagttgctttttccgatgaaatggtaccatgtccagtgactacagatatgaccttacaacaggttttaatggctatgagtcagatcccagcaggtggaactgattgctctcttccaatgatctgggctcagaagacaaacacacctgctgatgtcttcattgtattcactgataatgagacctttgctggaggtgtccatcctgctattgctctgagggagtatcgaaagaaaatggatattccagctaaattgattgtttgtggaatgacatcaaatggtttcaccattgcagacccagatgatagaggcatgttggatatgtgcggctttgatactggagctctggatgtaattcgaaatttcacattagatatgatttaaccataagcagcagcacgatccagagatccattgccatcagtgatctcactaaaaatatacagctacttcccagctaatctccacccaatgaatgatgatggtatagtatgtgcataatggaaagttaccttactgaaaaaaaaaaaagaaggaaaaataagatgggcccaaaggtctatctactaaactagctcttggggaaatagcttcaggatactgtagtttcctctatctaatagagaactttttgttaacagacactgtaaaatagttttgctttgttgaataatacgtgtgtacctaaaagaggtaagagcaaaaagtgtaattccacatcatgttacttgagaagtgcttaacgttttcttaaatgttttcattgggaaaggacagctttgataatgtccaaatactctgaaatgcactagaccatataactgtgatgaaatatgaaactcatctgtaaacttttataccaagggggtaaaaaaaaaaactaaggcatttgattaaattatgaatgagttttacaaattcctttcagagttttactaagatcacacaaataacagctttcttattcagtgaaaaagatattttatttctgatgttttatttgcacttgtggaatatgttaccattaatcagaaacatcatggcaacccctaagaatagactaagtttgtgttggctgagggattctatttggtttgcttttttttttttgctttgttatattttattgctacaaggggtgtgacttgataatgatttcctctgaattataataacatagccagatgtagtctcacactgtttttcatactcttaagtgtaaataatataaaatgtttcaagcgcttaactccccctcattcacaaagtataacaattaaaatctcaactataaccagtttagctttttccttacttttaaaataaaattttttacttttaactatttttttagttaatatttttaaaagtatacatgtcaatggcctctttgtccattattcattttgtggcaaaatattcttctttgatagtgtaaacaaataataaagcaatctaggtcctttaggtttgaaaggcaatttttgagtagcatattaccagctagccagtcactaggaatttttttcagtattatttgtatgtattaaacttttcattacactaaagtgcattattttattgagcaagtatccttcattgtgaggtttaacattaaagcaatctgttgaaatgccattatctttgctcataattttattatggccgtctaaggtagcttacacataaaacctgtttgcgtatctgttgttctctaaatattaattgaagatttactgaggatttgtaaggtccttctcgctgttatgtgaaaagtcaaactgtagttaatgtaaattatagccttttaggtgcttgggggttagagggtttatgttttttgggaaagggggactttagtagtctgaggatttctgtacatattttcttctgttttatgtgaaatttgggctctgggaataagaaaatattcctttcaaatttatttgacatattaatgctggttttgatatgtacccattccttcaaggcaactggtatcagtttttaagtgtgatttacctgagatatttttgttcagcaaagctcatagcaccctcacccccactccagacatgcattgcttctgatgttgttcacgtttttaaccctgtcaagcattgaactgaatatattagctacttttgacacattaaaatattacgttcagattgaatttaaagtttaaagaaactaatagaattacgtaatagttattgaattgtttaagtaaacccaagatcttaaaaattataacatgatcattttattcctaatagaaatgttaaatagaatatagtacaaaagtgcattaccttcagttgtgtactatttccataatacttttagacaaatatatctataagttaatattaaatccatcaaggatacaagattggatggatatgacctttctgaagtatttaggtaggtctaattaaatggactagggtaacatttaagaaagaaaggataagtaggagaagctaccacagaaggtaacttttcaaatcatggcatatttgagctggaagaaaccttagaaacctaaaagctaattttttaaatttttgttagagagctgaggtccaagacagagtgtgattttgaagtactataacctagaaatcttggtctcttcattcctgtgccagaatttatttccccacaacatgggaatacatggtctcagaagagtagaggataaaataaaattatttaagacttttaccttattgagttattaggaaataatgtatatacgattgctttaggagtagaaaaatagaatgggaacatgtataatcttgtaattcataggaatcctcaagcacaattaacctgtgttgctatatatatctacatatatagagaaaaaacaaaaactttacctcattatgaataaaatgtactgaagtgataagttttttatttcctgagttacttttaggattactgttaaattaatatttgggaaaatactgcttttaaaaacaatcctgcaagaataaacaaactttatttcctaggtagtatgtaaatagttccaggatatagttgtaattagtaaaacaaaaactaatcttataatcccaccctttattagttgaaagttcttggaaattccatttattaatacttatattatttagtaatctatcttatgagagtgttagtgaggcaagatgctagtgaatggaatttagtgttaccctttgacacctcctttgctttatctaacttactgtgtgactgtagacaaccagtttaacctaagtgatttgattatttttatccttaaaaagtaacatatctgtgcttggatcatagaagaatcagtgatttaatatttgtataaaaattgaaactgggaagagggcttgcaatacaagttagaattctttttttttttggttaaaaacattcttgttaataagatacgtatttcaaaagataaaatgttttagaaaaatagctcactcaataggcctaacagtgttttaaaacattcctgttcagagtagaaaaatttagaagaaaaattttcacagctaaagtattacccaaaaagtcactattctctactgaagagggagaaaaaatatactccaagatcttcttggacagacctagaaaaacaagcttatactctgaggaaatgctgttaacaaacttttttttttgagacaggctatccctctgtcacccaggctggagtggcatgatcacagctcactgcagccttgacctcccaagttcaagtgatcttcccaagtagccaggaacactggtgtgcactgcactaccacgcctgctttttttttttttttttttttttttttttttaagagacaacgtctcactgtgttgcccaggctggtgtcaaactcctgggctcaagggatcttcctgccttggcctcccgaagtgctggaattagaggcatgagccactgcacccagccagcaaacattctcttaatcttttaaagtaaccagtaaatctacaaatagtaaagtactattttcatcagggattttttttttcttattttctagattttacagaaacaatgtgaaattattttggaaagataaggtaggattcttgaataaatctgaaggtctcacaattaagtgagaaacacctttaaaagcatagtaaagctacacctaaataactaaagcctaaatcattgtaatgttttgttggacttactttaacttgacctgttgtagccacaaataacaaatttcttggtaactgatgctattacagtaggtaatcaaaaatgaaaaattctagtcttatatactgcaggtttggggtgattgttaaggcactatcccctctggagaaatgtcatatggcatcagtgtaaacatgcacaagaaagaatttgtaaaaaaaaatgacaggttaatcaatgaaattagttgtatttactgtttggattttatttagtgtttccttgatgtctgtttcctcatctcttatttgttggaagattacttttctacctcttttttttcttttaaaattcctttcttacatttctgttgtttctttttctagtccttctctatctggataataaaatgaatgacaggaaagtcacccacatagaggtttgggatgaaccttttgcagattgctttttgtttcatacaagtataagatcatattttctttttcaacttagtaataggcaggcttcttggaacaataagtagattgatacactcctccccaaatcaaattatattgtatatcttttatattagatgtttgcagaaattctgtggcctttaagatcagttattcagcctttgtaattatgttatctagctatgttgaaaagataagtgcttactatataagcactcttagaaaaataattaactgattactctttcagaaaatagcaggtgtctcaatgctttttttccataattataaagaccattgtcaaaatctttggtttactaaatatttcactgagcatatatagagatacgttgcttgtggcataaaaagtcttgtagataacttactcacatttggcttttttttaattggtgcattttttaatttgcttttttgaaaattatgaagttaaaatttaattctaaggtagtatttttcatgtataaaactaataatgtagttaagcatactgtttgaataaaattataataaatggcacaattccttaaaccctgaaaataccaagttatattggaaaatagtggaaagaaaaaactagtggagaacatcttagaaaattctattgtggaaattacgatgattattttcagtgagaatgaatttatatatacaacaaaaatatacaaaagctaaccttctcatcctaaaaagatttttccctttgcttctgttttatttagccctgccatgcaccacattaattttatgaacataaatgatatttaacttttctttttttttttttttttgagacagagtctcactccgtcaccaggctggagtgcggtggcgcgatctcagctcactgcaacctccatttcccaggttcaagcaattctcctgcctcagcctcccaagtagctgggattacaggcacgcgccaccacgcccacctaatttttgtatttttagtagagacggggtttcaccatgttggtcaggctggcctcgatctcgtgacctcgtgatctgtccgcctcggccttccaaagtgctaggattacaggcgtgagccaccgcacctggccaacttttcatcttaagttgtttaaatttatgcacttttagatatcagaatatatgcttgaacaaaggaaatagtaaattagctatatgtctgctggtttcacttcgatgtggatatggatatgtggataaagacagtaaatgaaattaaaaccctgctgttttaaatatcattaccagatataattgagggaatattatatcaacaaacatattgaaacttggctttatttgtaacgtaaactatatataatccatacgtagccaaattagatttaaaatatacaattaatgaatagtactcaaagtgtttttgttgcactgttactctgaatatggactctctatatctggtatggcgtgactgggcataacttctgtaatgtatttcagttatatgtttttccttttattgccagcttctgataatgaaattttccaaagggatgagatataagaatcatcttttataaaaaccagtggggagtggggtattataatctagttctaaactgtccatttgctttatataaaggctttgatttcaataactgaccatttgatgaatatttaaattacacagaataatgtctacatagaataaacttaagtattcaagagccttaaagtgaaaaaatgaaccttttgactgccttaaaatactacttgctctgtaattcaggcatactagttactttccttggggtctgtttaaataatgccttaatagtgttctaatgtttctgaaatacagaactcaaagggtcttttagagcttttaattttacatagtgaatggaaatttaagtattacattttaaaacctgattgtacattggtaatttaaacatccaataacaggaaaatctagatacagtgatgtgttatacatacatgactgttaacatcagtaatattttatgatagtttaaggttttttattgttttctataacaagttatccaacaggttggactttgtaacatgatatccaaggaccaagttgcatatttaacatcgaatgaaaatgtagttgtacagttccaaaaataattaattttttaagggaatttttcaagacaaaaggcaaatattttgtttcaaacctacaagcaaat

SEQ ID NO: 195549 - DNA, 3343 bp, Homo sapiens
  Payload ID: 18600
  Gene Name: TRPM8 channel-associated factor 1
  Uniprot ID: Q9Y4C2
  ENST ID: ENST00000355951
  CDS Start-End: 115-2874
ctgggcggagaagctgcttcctcctgggaacaaccgcctcccgctcctagcaggttgctactgccccgaacccgcgctgcagggaacagcggggcaaacaaaaccaatagagccatggcgactccctctgctgccttcgaggcccttatgaatggtgtgacaagctgggatgtacccgaagatgctgttccatgtgaactgcttcttattggagaggcttcatttcctgtgatggtgaatgacatgggccaggtcctcattgctgcctcctcctatggccgtggccgcctggtggtcgtgtcccatgaggactacttggtggaagcccagctcacgccctttctcctgaacgcagtggggtggctttgctcttcccctggggctcccattggtgtacacccatccctggcacctttggccaaaatcctcgagggctctggagtggatgcaaaggttgagccagaagtgaaagactccctgggggtttactgtattgatgcctacaatgaaaccatgacagaaaagctggtcaagttcatgaaatgtggtggcggcttgctcataggaggacaagcctgggattgggccaaccagggggaggatgaaagggttctgttcacgttccctgggaacctcgtgaccagtgtggctggcatttactttactgacaacaaaggggacacgagtttctttaaagtctccaagaagatgcccaagatcccagtgttggttagttgtgaagatgacctctccgacgacagagaagagcttctgcatgggatttcagagctggacatcagcaactcggattgtttcccatcccagctgctagtgcatggggctttagcctttcctctagggttagattcctaccatggctgtgttatagcggctgcccgctatggccggggccgggtggttgtgactggccataaggtattattcactgttggtaaactgggcccctttctgctcaatgctgtccgctggctggatgggggccgcagaggcaaggttgtggtgcagacagagctgagaaccctgagtggcctcctcgcagtggggggcatagacaccagcatcgagcccaatctgaccagtgatgcaagtgtctactgctttgaacccgtgagtgaagtgggggtcaaggaactgcaggagtttgtagcagagggtggcgggctatttgttggagcccaagcctggtggtgggccttcaagaaccccggagtgtcccctttggctcgattcccaggaaacctcctcctcaacccctttggcatcagcattacaagccaaagcctcaatccagggccctttcgtactcctaaagcagggataaggacctatcacttccgctccaccttggccgagttccaggttataatgggcaggaagagaggaaatgtggaaaagggctggttggcaaagctgggaccagatggtgcagctttcctgcagattcccgcagaagagatccctgcctacatgtctgtgcatcgactcctgaggaagctgctaagtcgatatcggcttccagtagcaacccgagagaaccctgttatcaatgactgctgcagaggtgctatgctttccctggccacagggctggcccactctggaagcgacctctctctgttagtcccagaaattgaagatatgtacagcagcccctatctgcgcccctcagaatctcctatcaccgtcgaggtcaactgcaccaatccaggcaccagatattgctggatgagtactgggctctacatacctggaaggcaaattatagaagtctcactgcctgaagctgctgcctctgccgacctgaagatacagattggctgccacacagatgacctgaccagggccagcaagcttttccgaggcccactcgtaattaaccggtgctgcttggacaaacccacaaaatcgatcacgtgcctctggggtggactcctctatataattgtgcctcagaacagcaaactgggttctgtgcctgtcaccgtgaagggggctgtgcatgctccatactacaagctgggggagaccaccctggaggagtggaagaggcgtatccaggagaatccagggccctggggagagctggccacggacaacatcattctgaccgtgccgaccgcaaatcttcgtactctggagaaccctgagccgctgctccgcctctgggatgaggtgatgcaggctgtggcgcgactgggagctgagcccttccctttgcgcctgcctcagaggattgttgccgacgtgcagatctcagtgggctggatgcatgcagggtaccccatcatgtgccatctggagtcagtgcaggagctcatcaacgagaagctcatcagaaccaaggggctgtggggccccgtccatgagctgggccgcaaccagcagcggcaggagtgggagttcccaccacacaccaccgaggccacctgcaacctgtggtgtgtgtatgtgcatgagacggtcttgggcattcctcgaagccgtgccaatattgctctgtggcccccagttcgggagaagagagtcagaatctacctgagcaagggtcccaatgtgaaaaactggaatgcatggaccgcactggaaacgtatttacagctccaggaagcctttggttgggagccattcatccgtctcttcaccgagtacaggaaccagaccaacttgcccacagaaaatgttgacaaaatgaatctgtgggtcaagatgttctcccaccaagtgcagaagaacctggctccgttctttgaggcctgggcctggcccatccagaaggaagtggctaccagcctggcctatctgcctgaatggaaggaaaatattatgaaattgtacctcctcacacagatgtaaggagtgcccatcgaggtggcaggccccactgaaattgaagtcaagaaatgcaaaaaggaactgacacatctcagcaaagaaaactgaagggatttggttataagtggagaggatctcagcatatttctggaagatagaaagtggatgaagcatgataatgaaagagtgaagaacctttcagataaaatgtaagctgatctgaacaacataaccccaaagagacttgcgcacctgaaaagcttgtctactgaagaattactccagttgtaagattgagccctctcctactctcccccaactcttatgcacagaacacaggcagtctccactattgataccagttaaaaatttcttgttattgttgctgttgttgtttgtataaaggaattgaacaggctgcttgcagagagataagagttggtgctccagaaaaaaatttctcttctagtggaaataagtgcccctaccc

SEQ ID NO: 195550 - DNA, 634 bp, Homo sapiens
  Payload ID: 18600
  Gene Name: TRPM8 channel-associated factor 1
  ENST ID: ENST00000491908
  CDS Start-End: 185-634
gactcccgtggaaacccctcctctcctccagctccagcctcctccccgctcccaaatcccggctcggtcgcccagtcactggtacagggaagcctcttccctgtgcattcctctctgcgccaggctctgcccgctcccacctgcccccgtggaaatcgcagggtgacctgaaaccaatagagccatggcgactccctctgctgccttcgaggcccttatgaatggtgtgacaagctgggatgtacccgaagatgctgttccatgtgaactgcttcttattggagaggcttcatttcctgtgatggtgaatgacatgggccaggtcctcattgctgcctcctcctatggccgtggccgcctggtggtcgtgtcccatgaggactacttggtggaagcccagctcacgccctttctcctgaacgcagtggggtggctttgctcttcccctggggctcccattggtgtacacccatccctggcacctttggccaaaatcctcgagggctctggagtggatgcaaaggttgagccagaagtgaaagactccctgggggtttactgtattgatgcctacaatgaaaccatgacagaaaagctggtcaagttcatgaaatgtggtggcggcttgctcata

SEQ ID NO: 195551 - DNA, 577 bp, Homo sapiens
  Payload ID: 18600
  Gene Name: TRPM8 channel-associated factor 1
  ENST ID: ENST00000485416
  CDS Start-End: 353-577
aaccgtctgcactgcagcccacctccccccacacgcctcctcctagccacttcactaccaatttgcaaattcccaaggcgtctgccccagcgccttcccacatctctgtggaagactccccactccaaagtagcctggtgtggaaattgctggacgaaaggactggctttgggcctgggaggaaagaagagagtggagccccgccagactccaagctgagtgctgacagcctctgggagtttagaacatcccttctcacacactgtgcatttgatagaatactccctgaggcacgcagatcaacagctggggggtaggcagcgcccacatttaaaaagaaaccaatagagccatggcgactccctctgctgccttcgaggcccttatgaatggtgtgacaagctgggatgtacccgaagatgctgttccatgtgaactgcttcttattggagaggcttcatttcctgtgatggtgaatgacatgggccaggtcctcattgctgcctcctcctatggccgtggccgcctggtggtcgtgtcccatgaggactacttggtggaagcccagctcacgccc

SEQ ID NO: 195552 - DNA, 5733 bp, Homo sapiens
  Payload ID: 18600
  Gene Name: TRPM8 channel-associated factor 1
  Uniprot ID: Q9Y4C2
  ENST ID: ENST00000479870
  CDS Start-End: 210-2975
gtagtttcgagcccgctgccctttgcctcctgggcggagaagctgcttcctcctgggaacaaccgcctcccgctcctagcaggttgctactgccccgaacccgcgctgcagggaacagcggggcaaacagtgagtggggttcagcgtagactctggaccaggagaggcccgcggtgaccgaggcctgggccccggaaaccaatagagccatggcgactccctctgctgccttcgaggcccttatgaatggtgtgacaagctgggatgtacccgaagatgctgttccatgtgaactgcttcttattggagaggcttcatttcctgtgatggtgaatgacatgggccaggtcctcattgctgcctcctcctatggccgtggccgcctggtggtcgtgtcccatgaggactacttggtggaagcccagctcacgccctttctcctgaacgcagtggggtggctttgctcttcccctggggctcccattggtgtacacccatccctggcacctttggccaaaatcctcgagggctctggagtggatgcaaaggttgagccagaagtgaaagactccctgggggtttactgtattgatgcctacaatgaaaccatgacagaaaagctggtcaagttcatgaaatgtggtggcggcttgctcataggaggacaagcctgggattgggccaaccagggggaggatgaaagggttctgttcacgttccctgggaacctcgtgaccagtgtggctggcatttactttactgacaacaaaggggacacgagtttctttaaagtctccaagaagatgcccaagatcccagtgttggttagttgtgaagatgacctctccgacgacagagaagagcttctgcatgggatttcagagctggacatcagcaactcggattgtttcccatcccagctgctagtgcatggggctttagcctttcctctagggttagattcctaccatggctgtgttatagcggctgcccgctatggccggggccgggtggttgtgactggccataaggtattattcactgttggtaaactgggcccctttctgctcaatgctgtccgctggctggatgggggccgcagaggcaaggttgtggtgcagacagagctgagaaccctgagtggcctcctcgcagtggggggcatagacaccagcatcgagcccaatctgaccagtgatgcaagtgtctactgctttgaacccgtgagtgaagtgggggtcaaggaactgcaggagtttgtagcagagggtggcgggctatttgttggagcccaagcctggtggtgggccttcaagaaccccggagtgtcccctttggctcgattcccaggaaacctcctcctcaacccctttggcatcagcattacaagccaaagcctcaatccagggccctttcgtactcctaaagcagggataaggacctatcacttccgctccaccttggccgagttccaggttataatgggcaggaagagaggaaatgtggaaaagggctggttggcaaagctgggaccagatggtgcagctttcctgcagattcccgcagaagagatccctgcctacatgtctgtgcatcgactcctgaggaagctgctaagtcgatatcggcttccagtagcaacccgagagaaccctgttatcaatgactgctgcagaggtgctatgctttccctggccacagggctggcccactctggaagcgacctctctctgttagtcccagaaattgaagatatgtacagcagcccctatctgcgcccctcagaatctcctatcaccgtcgaggtcaactgcaccaatccaggcaccagatattgctggatgagtactgggctctacatacctggaaggcaaattatagaagtctcactgcctgaagctgctgcctctgccgacctgaagatacagattggctgccacacagatgacctgaccagggccagcaagcttttccgaggcccactcgtaattaaccggtgctgcttggacaaacccacaaaatcgatcacgtgcctctggggtggactcctctatataattgtgcctcagaacagcaaactgggttctgtgcctgtcaccgtgaagggggctgtgcatgctccatactacaagctgggggagaccaccctggaggagtggaagaggcgtatccaggagaatccagggccctggggagagctggccacggacaacatcattctgaccgtgccgaccgcaaatcttcgtactctggagaaccctgagccgctgctccgcctctgggatgaggtgatgcaggctgtggcgcgactgggagctgagcccttccctttgcgcctgcctcagaggattgttgccgacgtgcagatctcagtgggctggatgcatgcagggtaccccatcatgtgccatctggagtcagtgcaggagctcatcaacgagaagctcatcagaaccaaggggctgtggggccccgtccatgagctgggccgcaaccagcagcggcaggagtgggagttcccaccacacaccaccgaggccacctgcaacctgtggtgtgtgtatgtgcatgagacggtcttgggcattcctcgaagccgtgccaatattgctctgtggcccccagttcgggagaagagagtcagaatctacctgagcaagggtcccaatgtgaaaaactggaatgcatggaccgcactggaaacgtatttacagctccaggaagcctttggttgggagccattcatccgtctcttcaccgagtacaggaaccagaccaacttgcccacagaaaatgttgacaaaatgaatctgtgggtcaagatgttctcccaccaagtgcagaagaacctggctccgttctttgaggcctgggcctggcccatccagaaggaagtggctaccagcctggcctatctgcctgaatggaaggaaaatattatgaaattgtacctcctcacacagatgccccactgaaattgaagtcaagaaatgcaaaaaggaactgacacatctcagcaaagaaaactgaagggatttggttataagtggagaggatctcagcatatttctggaagatagaaagtggatgaagcatgataatgaaagagtgaagaacctttcagataaaatgtaagctgatctgaacaacataaccccaaagagacttgcgcacctgaaaagcttgtctactgaagaattactccagttgtaagattgagccctctcctactctcccccaactcttatgcacagaacacaggcagtctccactattgataccagttaaaaatttcttgttattgttgctgttgttgtttgtataaaggaattgaacaggctgcttgcagagagataagagttggtgctccagaaaaaaatttctcttctagtggaaataagtgcccctacccccagccggtcagctaattctctactgacagctgagacctcctactcaagtgcctgttgccttcaggtatagaagaggtttcctgaagaaacagacctaactgtacaacagcagaggaaacccatgccaactgttatacaagttaacagttatgttgatttttaaatgggaatggtgagttagaaattcccagacatgggcgatggggagggaagaggaataagaaaagtcacgaggtagaattaggggccttgaaaatatgacaaactctgagggaaacaaagacaatgtggaaagaataacttaattttaattccatctccagagagatttgaggtgtatttaagatgaaaaacaggatactacaaagaaacggaaaactcaggagttcgagaccagcctaggcaagatggcaacatcccgtctctacaaaataatttttaaaaattagccaagcatggtggcatgtgcctgtggtcctagctacttgggaggctgaagtgggaagatcacttgagcccaggagttcaaggcttcagtgagccatgatggtgccactgcactccagcctgggggacagagtgagaccctgtctcttaaaaagcaagaaaagaaagagaagactgagaataagaagatctctttgaaaataaaataagactgctaaaagtatttggtatacagtctggaaaataaagttgagggaatctctccagataaagagcaaaaagaaatagatagaaaaatataaagaaagaaaaaagacatagacaatcaatatgtaatgttaggagttcctggaagagagaacagagacagtgtaggtgaagaaataaaaagaaaaagaattgaagaacagagcaagctaagtctccagattgagagggcccaatacaatctacatctagacacaatattgtaaaattttggaatattaaggatagaaggaagatattaaagtggccagggagaaaacaaatgaggtcatcacgattagctcaacacaaaaatggatgagaaatagactgctaacagatttgtcatcagcaacactgaatgccagaagtcaatggatcaacatcttcagagcttaaggaaaatttttgtacctagaatttcatagtaaggcagactgtcaagaagaacatcaaagtgaagacattttctgtcaggcaaattttcagaaagtctcctttgcacccttactgaggaagtatcttgaggaaattctccagcaaaatgaggatgaaaaccaggaaagaagaagaaatgggatccataaaacagtggaccttacttaggatgtctcattctagagtgacagccaaaagggtatctcaccctagagtgacagctatccagcagactaatttcagatgagagcatactgtctcgggctttctgggaagaatgtgcattcagtgccatagatagtatcattgaagagctgggatgcttgagaagattatttagtcaagaaaaaagaaagacaaatcaacaatatgtcaaaaaattcaggtccaattatagagcaaaataaaatgaggcatgattttgagttattcatgaagaataagaagaggcttgataggtacatttccttttctatggcacaggcatgatgatattgggtgtgtagggaagaaaatatcctagcttatactaggctcccagtaagaagtatttaaatagccaaaataatgtggatatcatttattagtattcaatgttcagatcagcctattaacaaagtgtgaaaggtttcattttttattcagaactgaagttgaaagtaattaatgctgacaaagggaaagaaagcagaaagagattgagaattagaggaagagaagtggaatcaaaggtagagatacttatatattcaaagtggggatgaaaagatcttcagttaatggaacaagaactagaggattagtgtattgttcaaagctataaaatcaaaccaatagatgtattaaaaagtgatgtaactatcagacatttggagagagatggacaaaggaaagtggcgatagtgtaagttaaatccttatcttttgtaatggggaattattaaagatgttgtaaagtcagtaagtcaagaaattattgctcaaacatattatttaaagttagaaagttaccagacgatctaaaataaatattgttaaaagcattacctctagggaatgggatttagatttaaaaagggtgggatgggaaactgtgtttttcattttaagtccttctgtactatttaattttttaccttgtgcatgtattactttgaaaaaatttttaataaacccaaataaaaatctt

SEQ ID NO: 195553 - DNA, 576 bp, Homo sapiens
  Payload ID: 18600
  Gene Name: TRPM8 channel-associated factor 1
  ENST ID: ENST00000478172
  CDS Start-End: 140-576
accccccacccccgcagtctccgcctaagactttccaagtcctgtagtttcgagcccgctgccctttgcctcctgggcggagaagctgcttcctcctgggaacaaccgcctcccgctcctagcagaaaccaatagagccatggcgactccctctgctgccttcgaggcccttatgaatggtgtgacaagctgggatgtacccgaagatgctgttccatgtgaactgcttcttattggagaggcttcatttcctgtgatggtgaatgacatgggccaggtcctcattgctgcctcctcctatggccgtggccgcctggtggtcgtgtcccatgaggactacttggtggaagcccagctcacgccctttctcctgaacgcagtggggtggctttgctcttcccctggggctcccattggtgtacacccatccctggcacctttggccaaaatcctcgagggctctggagtggatgcaaaggttgagccagaagtgaaagactccctgggggtttactgtattgatgcctacaatgaaaccatgacagaaaagctggtcaagttcatgaaatgtggtgg

SEQ ID NO: 195554 - DNA, 840 bp, Homo sapiens
  Payload ID: 18600
  Gene Name: TRPM8 channel-associated factor 1
  ENST ID: ENST00000460532
  CDS Start-End: 340-840
ctcctccagctccagcctcctccccgctcccaaatcccggctcggtcgcccagtcactggtacagggaagcctcttccctgtgcattcctctctgcgccaggctctgcccgctcccacctgcccccgtggaaatcgcagggtgacctgactggctttgggcctgggaggaaagaagagagtggagccccgccagactccaagctgagtgctgacagcctctgggagtttagaacatcccttctcacacactgtgcatttgatagaatactccctgaggcacgcagatcaacagctggggggtaggcagcgcccacatttaaaaagaaaccaatagagccatggcgactccctctgctgccttcgaggcccttatgaatggtgtgacaagctgggatgtacccgaagatgctgttccatgtgaactgcttcttattggagaggcttcatttcctgtgatggtgaatgacatgggccaggtcctcattgctgcctcctcctatggccgtggccgcctggtggtcgtgtcccatgaggactacttggtggaagcccagctcacgccctttctcctgaacgcagtggggtggctttgctcttcccctggggctcccattggtgtacacccatccctggcacctttggccaaaatcctcgagggctctggagtggatgcaaaggttgagccagaagtgaaagactccctgggggtttactgtattgatgcctacaatgaaaccatgacagaaaagctggtcaagttcatgaaatgtggtggcggcttgctcataggaggacaagcctgggattgggccaaccagggggaggatgaaagggttctg

SEQ ID NO: 195555 - DNA, 2958 bp, Homo sapiens
  Payload ID: 18601
  Gene Name: TRPM8 channel-associated factor 2
  Uniprot ID: A6NFQ2
  ENST ID: ENST00000357344
  CDS Start-End: 70-2607
tccggatctctctcggctgcttttttccactggtaacttctgaggctgagatcagcagctgatagaaccatggcgaccattgctgctgctgcgtttgaggccctcatggatggagtgacatgctgggatgtccccagaggccccatccccagtgaactccttcttattggagaagccgccttccccgtgatggtgaatgacaagggccaggtgctcattgctgcctcctcctacggccgaggccgcctcgtggttgtgtcccatgagggctacctgtcgcatactggcttggctccatttctcctcaatgcagtgagctggctctgtccctgtcctggggctcccgtgggagtgcatccatccctggcacctctagtaaacatcctacaggatgctgggcttgaggcacaggtcaagccagaaccaggagagcccctaggggtttactgtatcaatgcctacaatgacaccttgactgcaacgctgatccagtttgtgaaacatggagggggcttgttaatcgggggccaggcctggtactgggccagccagcacggccctgacaaggtgctctccaggttccctgggaacaaggtgacaagtgtagctggagtgtacttcactgacacctatggggacagagaccggttcaaggtctctaagaaggtgcccaagatcccactccatgtcaggtatggggaggatgtcaggcaggaccagcagcagctcctggaggggatctcagagctggacatcaggacagggggagtcccctcacagctgcttgtacatggagccctggccttccctctggggctggatgcctcactcaactgcttcctggcggctgctcactatggccggggccgggtggtcctggctgcccacgagtgcctgctctgtgctcccaagatggggcccttcttgctcaatgcggtgcgctggctggccagaggccagacaggcaaagttggggtgaacacaaatctaaaagatctgtgtcctctcctatcggagcatggcctgcaatgcagcctggagccccatctgaacagcgacttgtgtgtctactgctgcaaggcgtacagtgacaaggaggctaagcagctgcaggagtttgtggctgagggtggggggctgctgattgggggccaggcctggtggtgggcctcccagaaccctggccactgccccttggctggcttccctggtaacatcatcctcaactgctttggcctcagcatcctgcctcagactctcaaagcaggctgcttccccgttcccacccctgagatgagaagctaccacttccgcaaggcgctctctcaattccaggctatactgaaccacgagaatgggaacttggaaaagagctgtctggcaaagttgagagttgatggtgcagccttcctacagattcctgcggagggggtccctgcttacatatccctgcacaggctcctgaggaagatgctacgagggtctggcctcccagctgtgagccgggaaaatccagttgccagtgactcctatgaggctgcggtgctctccctggccactgggctggctcactctggaactgactgctcccagctggcccaggggcttggcacctggacctgctcctccagtttgtacccctcaaaacaccccatcaccgtggagatcaatggaatcaacccaggcaacaatgattgctgggtgagtaccgggctctacctcctggaaggacaaaatgcagaagtctcactgtctgaagctgctgcctctgctggcctgagggtacagataggctgccacaccgatgaccttaccaaggccaggaagctatctcgagcccccgtggtgactcaccaatgctggatggacaggactgagcggtcagtctcctgcctctggggcggcctcctctacgtcatcgtgcccaagggcagccaactaggccctgtgcctgtcactatcaggggagctgtgcctgccccatactacaagctgggtaagacatcgctggaggagtggaagaggcagatgcaggagaacctggctccctggggagagctggccacggacaacatcatcctgacagtgccaaccacaaaccttcaggccctgaaggaccccgagcctgtgctccgcctctgggatgagatgatgcaggctgtggccaggctggcggctgagcccttccctttccgccgtcctgagaggattgtggctgatgtgcagatctcagctggctggatgcattcaggataccccatcatgtgccacctggagtctgtgaaggagatcatcaatgagatggacatgaggagcaggggtgtgtggggccccatccatgagctgggccacaaccaacagcggcatggatgggagttccccccacacactactgaggccacctgtaacctttggtcagtctacgtgcatgaaacagtcctggggatccccagggctcaggcccacgaggctctgagccctccagagcgagagaggagaatcaaggcccacctgggaaagggagcccccctgtgtgactggaatgtatggacagccctggaaacatatctacaggtactgagcagaaattctgggagaaggggatgaccagacccctcagtcatgtagcgacctggatcccagtagccctccacctccttcgccactccaccagcctggacctccacctcccctggaaatgagagggactgggccgcagggtggtgcttcttgggttatacccctctaaggcagagagaatggcacctgtctcactcaccttctgattttgcaatgtaagaggaaatgaaaaatattatgaaaaaaatagaaatatagcatattattcaagggcagaaactctgttagacattcctgcagctgaatcacagctcttgccctcattggttttgttcttggtctcctaataagtgttccataaatggtcattgctttgtt

SEQ ID NO: 195556 - DNA, 2906 bp, Homo sapiens
  Payload ID: 18601
  Gene Name: TRPM8 channel-associated factor 2
  Uniprot ID: A6NFQ2
  ENST ID: ENST00000411935
  CDS Start-End: 128-2575
agtaattgagtgagagagttctggtgtgtagacaacggtggctttggaagcaagccagcctgggtttagtaaaaattaaagaaataggaaagaaatacaaaagttttcttttaagaaatgcctttttatgaaaatatttcaaaaggaattcaagtttattttgaaaaaatgcacaccaatacagaaatatagagaggaaaatggcaactcatcctcctcaccacaccaccagctccagtctcatgcctctggaccaaggtatggggaggatgtcaggcaggaccagcagcagctcctggaggggatctcagagctggacatcaggacagggggagtcccctcacagctgcttgtacatggagccctggccttccctctggggctggatgcctcactcaactgcttcctggcggctgctcactatggccggggccgggtggtcctggctgcccacgagtgcctgctctgtgctcccaagatggggcccttcttgctcaatgcggtgcgctggctggccagaggccagacaggcaaagttggggtgaacacaaatctaaaagatctgtgtcctctcctatcggagcatggcctgcaatgcagcctggagccccatctgaacagcgacttgtgtgtctactgctgcaaggcgtacagtgacaaggaggctaagcagctgcaggagtttgtggctgagggtggggggctgctgattgggggccaggcctggtggtgggcctcccagaaccctggccactgccccttggctggcttccctggtaacatcatcctcaactgctttggcctcagcatcctgcctcagactctcaaagcaggctgcttccccgttcccacccctgagatgagaagctaccacttccgcaaggcgctctctcaattccaggctatactgaaccacgagaatgggaacttggaaaagagctgtctggcaaagttgagagttgatggtgcagccttcctacagattcctgcggagggggtccctgcttacatatccctgcacaggctcctgaggaagatgctacgagggtctggcctcccagctgtgagccgggaaaatccagttgccagtgactcctatgaggctgcggtgctctccctggccactgggctggctcactctggaactgactgctcccagctggcccaggggcttggcacctggacctgctcctccagtttgtacccctcaaaacaccccatcaccgtggagatcaatggaatcaacccagagtctcactctgtcatccaggttggaatgcagtggcgcgatctcagctcatgcaacctccacctcctgggtttaagcaattcttctctctcagcctcctgtgttgctgggactacaggcacacgccaccatgcctggctaatttttgtatttttagtagagagggagtttcaccgtaaaggcaacaatgattgctgggtgagtaccgggctctacctcctggaaggacaaaatgcagaagtctcactgtctgaagctgctgcctctgctggcctgagggtacagataggctgccacaccgatgaccttaccaaggccaggaagctatctcgagcccccgtggtgactcaccaatgctggatggacaggactgagcggtcagtctcctgcctctggggcggcctcctctacgtcatcgtgcccaagggcagccaactaggccctgtgcctgtcactatcaggggagctgtgcctgccccatactacaagctgggtaagacatcgctggaggagtggaagaggcagatgcaggagaacctggctccctggggagagctggccacggacaacatcatcctgacagtgccaaccacaaaccttcaggccctgaaggaccccgagcctgtgctccgcctctgggatgagatgatgcaggctgtggccaggctggcggctgagcccttccctttccgccgtcctgagaggattgtggctgatgtgcagatctcagctggctggatgcattcaggataccccatcatgtgccacctggagtctgtgaaggagatcatcaatgagatggacatgaggagcaggggtgtgtggggccccatccatgagctgggccacaaccaacagcggcatggatgggagttccccccacacactactgaggccacctgtaacctttggtcagtctacgtgcatgaaacagtcctggggatccccagggctcaggcccacgaggctctgagccctccagagcgagagaggagaatcaaggcccacctgggaaagggagcccccctgtgtgactggaatgtatggacagccctggaaacatatctacagctccaagaggccttcgggtgggagccattcacccagctctttgctgagtaccagaccctctctcacctccccaaagacaacactggcaggatgaatctatgggtgaagaagttctctgaaaaagtgaagaagaatctggttcccttctttgaggcctggggctggcctatccagaaggaggtggctgacagcctggcctccctaccagagtggcaggaaaaccccatgcaagtgtacctccgtgccaggaagtaaaggatgccccacaaggcgggagagaaaaggcagggtcacgccatcaactccaccatggggctttggccgtgtgctcagtatctggagcctgaatcccgcttccaagcctgaccactagatggtggccacggtcataagaaaaaatggaacccctttctgtaaaaggtgccttgtgcttctttttattgtttttctgcctacgctattgctttccccaagagactcacttcacctcttagtcttccagagaggatctttcatcctgccatcctgaggcttctatttttgaccaatagctctaaagaccacgggttcccataacaacctgata

SEQ ID NO: 195557 - DNA, 5568 bp, Homo sapiens
  Payload ID: 18601
  Gene Name: TRPM8 channel-associated factor 2
  Uniprot ID: A6NFQ2
  ENST ID: ENST00000441159
  CDS Start-End: 67-2826
ggatctctctcggctgcttttttccactggtaacttctgaggctgagatcagcagctgatagaaccatggcgaccattgctgctgctgcgtttgaggccctcatggatggagtgacatgctgggatgtccccagaggccccatccccagtgaactccttcttattggagaagccgccttccccgtgatggtgaatgacaagggccaggtgctcattgctgcctcctcctacggccgaggccgcctcgtggttgtgtcccatgagggctacctgtcgcatactggcttggctccatttctcctcaatgcagtgagctggctctgtccctgtcctggggctcccgtgggagtgcatccatccctggcacctctagtaaacatcctacaggatgctgggcttgaggcacaggtcaagccagaaccaggagagcccctaggggtttactgtatcaatgcctacaatgacaccttgactgcaacgctgatccagtttgtgaaacatggagggggcttgttaatcgggggccaggcctggtactgggccagccagcacggccctgacaaggtgctctccaggttccctgggaacaaggtgacaagtgtagctggagtgtacttcactgacacctatggggacagagaccggttcaaggtctctaagaaggtgcccaagatcccactccatgtcaggtatggggaggatgtcaggcaggaccagcagcagctcctggaggggatctcagagctggacatcaggacagggggagtcccctcacagctgcttgtacatggagccctggccttccctctggggctggatgcctcactcaactgcttcctggcggctgctcactatggccggggccgggtggtcctggctgcccacgagtgcctgctctgtgctcccaagatggggcccttcttgctcaatgcggtgcgctggctggccagaggccagacaggcaaagttggggtgaacacaaatctaaaagatctgtgtcctctcctatcggagcatggcctgcaatgcagcctggagccccatctgaacagcgacttgtgtgtctactgctgcaaggcgtacagtgacaaggaggctaagcagctgcaggagtttgtggctgagggtggggggctgctgattgggggccaggcctggtggtgggcctcccagaaccctggccactgccccttggctggcttccctggtaacatcatcctcaactgctttggcctcagcatcctgcctcagactctcaaagcaggctgcttccccgttcccacccctgagatgagaagctaccacttccgcaaggcgctctctcaattccaggctatactgaaccacgagaatgggaacttggaaaagagctgtctggcaaagttgagagttgatggtgcagccttcctacagattcctgcggagggggtccctgcttacatatccctgcacaggctcctgaggaagatgctacgagggtctggcctcccagctgtgagccgggaaaatccagttgccagtgactcctatgaggctgcggtgctctccctggccactgggctggctcactctggaactgactgctcccagctggcccaggggcttggcacctggacctgctcctccagtttgtacccctcaaaacaccccatcaccgtggagatcaatggaatcaacccaggcaacaatgattgctgggtgagtaccgggctctacctcctggaaggacaaaatgcagaagtctcactgtctgaagctgctgcctctgctggcctgagggtacagataggctgccacaccgatgaccttaccaaggccaggaagctatctcgagcccccgtggtgactcaccaatgctggatggacaggactgagcggtcagtctcctgcctctggggcggcctcctctacgtcatcgtgcccaagggcagccaactaggccctgtgcctgtcactatcaggggagctgtgcctgccccatactacaagctgggtaagacatcgctggaggagtggaagaggcagatgcaggagaacctggctccctggggagagctggccacggacaacatcatcctgacagtgccaaccacaaaccttcaggccctgaaggaccccgagcctgtgctccgcctctgggatgagatgatgcaggctgtggccaggctggcggctgagcccttccctttccgccgtcctgagaggattgtggctgatgtgcagatctcagctggctggatgcattcaggataccccatcatgtgccacctggagtctgtgaaggagatcatcaatgagatggacatgaggagcaggggtgtgtggggccccatccatgagctgggccacaaccaacagcggcatggatgggagttccccccacacactactgaggccacctgtaacctttggtcagtctacgtgcatgaaacagtcctggggatccccagggctcaggcccacgaggctctgagccctccagagcgagagaggagaatcaaggcccacctgggaaagggagcccccctgtgtgactggaatgtatggacagccctggaaacatatctacagctccaagaggccttcgggtgggagccattcacccagctctttgctgagtaccagaccctctctcacctccccaaagacaacactggcaggatgaatctatgggtgaagaagttctctgaaaaagtgaagaagaatctggttcccttctttgaggcctggggctggcctatccagaaggaggtggctgacagcctggcctccctaccagagtggcaggaaaaccccatgcaagtgtacctccgtgccaggaagtaaaggatgccccacaaggcgggagagaaaaggcagggtcacgccatcaactccaccatggggctttggccgtgtgctcagtatctggagcctgaatcccgcttccaagcctgaccactagatggtggccacggtcataagaaaaaatggaacccctttctgtaaaaggtgccttgtgcttctttttattgtttttctgcctacgctattgctttccccaagagactcacttcacctcttagtcttccagagaggatctttcatcctgccatcctgaggcttctatttttgaccaatagctctaaagaccacgggttcccataacaacctgatatccctttctcatccctgccatccctgaataaggcttctaatttattatgctttaacaagttttcaaatagcaagcgagacacgctggaatagtggagagagccccaaaccagctttggttctatggaaaatcactccacctctctgtgtttctgtcttcacatccatgacatgaggatacaaatcttttcctcacaaagctgttgtttgatttctcctggtcccatagtggactgttaacggtgtccagtctagcgtgcacatcctgggtgctgaatctcacttcagtgttgacccccttggggttagcattcagtccttgtatatttagagaatgtcaatgttttcccagacatggtatcaataatggtagttgtcagcagtatcttagccctttctacattttttctcccacttctggaaggattcttgggtataacctaacccaaagaaaagtggcatgtgctgaaactgagtgtcacagagctgtgaggttgggtctttgggattagcttcattttccagggtttgccctttgcccttcaaccaaaggacaaagtcatgttaacagctgctactaagtctatatgcccattcgttcataccacaaaacaggcatctgactcctctggtcaccatggaatcaaggcactgtcaagtggtggggggtccacaggcacagtgggcttcactctggaacaggattactgggtgcagcggatgtaatcctcacttaatcaacccacaccccagcatcccctgagctttctcttaatctcattctagcccatcttgactcttcggttagagggagttctcattggagatttgtctctgggattaatgagtgtatgcctagctactttctccagtttacttttagaccatattgttgtttgttttgaatatcattccttaggctatgttgagagtagagtggcttcccattaggagaactaatttagggcatgtcttttgctgaatcccgtcagcatatttaacaaattcccaattctagataatttccttttatttctctagtaccctttgccaggggctctacacatcaaaggtgttcatgaagtatttgtcaaaggaaagaacagtaatgacacctaacacataatgagtgattagtatgttccaggcattgcgtgagctatttactgtgagtgatttaatgttatcttcccagcagacctctgaggtaggtactagtatgatccccatttcgtacatgaggaaactgacactaagggacataaaataagttttttgaagtcacaaagtgaataaaaggaagaaccagggtttaattgaagcccatagcaatgaaaacattgtggaacttattcttcatgaatggtttacaatttaaacaaaatgtcacctagaaaatagatgaaaatatgttcaaccaggtctggatttttccaatgtttactactgaattttcattcaataacaagtttaacttccaaaaaggtgttggtatctgattttctgcctgcctcagaatgtgatttgtctgcctttgggtcatccagccttgggtagagaaggaatttgaactcaggaaattcaactccagaactgatgttcttttttttttttcatttaagttctgggatacatgtgcagaacgtgcaggtttgttacataggtatacatgtgccatggtggtttgctgcacctatcaatccatcatctagattttaagctctgcatgcattagatatttgtcctaatgctctccctcccattgcccccaacctcccgacaggccccagtgtgatgtttccctccctgtgtccatttgttctcatttttcatctcccacttatgagtgagaacatgtgttgtttggttttctgttcctgtgttagtttgctgagaattatggcttccagcttcatccatgtccctgcaaaggacatgaactcattctttttcatggctgcatggtattcaatggtatatatgccatattttctttatccagtctatcattggtgggcatttgggttggttccaagtctttgctattgtaaataatgctgcaataaaagtatgtgtgcatgtgtctttatagtagaatggtttatagtcctttgggtgtatatccagtaatgggattgctgggtcaaatggtatttctggttctagatctttgaggaatcatcacattgtcttccacaatggttgaactaatttacactcccaacaacagtgtaaaagcattcctgtttctccacagcctcaccaacatctgttgtttcctgactttttaatgatcgccattctaactggcatgagatggtaccccattgtggttttgatttacatttccctaatgaccagtaatgatgagctttttttcatgtttattggccacataaatgtcttcttttg

SEQ ID NO: 195558 - DNA, 2976 bp, Homo sapiens
  Payload ID: 18601
  Gene Name: TRPM8 channel-associated factor 2
  Uniprot ID: A6NFQ2
  ENST ID: ENST00000444908
  CDS Start-End: 86-2623
cctccgacccgtcccccgcgcgccactgcagagcctgtccgtcagtccctaggtatccgcactgctcagggcagctgatagaaccatggcgaccattgctgctgctgcgtttgaggccctcatggatggagtgacatgctgggatgtccccagaggccccatccccagtgaactccttcttattggagaagccgccttccccgtgatggtgaatgacaagggccaggtgctcattgctgcctcctcctacggccgaggccgcctcgtggttgtgtcccatgagggctacctgtcgcatactggcttggctccatttctcctcaatgcagtgagctggctctgtccctgtcctggggctcccgtgggagtgcatccatccctggcacctctagtaaacatcctacaggatgctgggcttgaggcacaggtcaagccagaaccaggagagcccctaggggtttactgtatcaatgcctacaatgacaccttgactgcaacgctgatccagtttgtgaaacatggagggggcttgttaatcgggggccaggcctggtactgggccagccagcacggccctgacaaggtgctctccaggttccctgggaacaaggtgacaagtgtagctggagtgtacttcactgacacctatggggacagagaccggttcaaggtctctaagaaggtgcccaagatcccactccatgtcaggtatggggaggatgtcaggcaggaccagcagcagctcctggaggggatctcagagctggacatcaggacagggggagtcccctcacagctgcttgtacatggagccctggccttccctctggggctggatgcctcactcaactgcttcctggcggctgctcactatggccggggccgggtggtcctggctgcccacgagtgcctgctctgtgctcccaagatggggcccttcttgctcaatgcggtgcgctggctggccagaggccagacaggcaaagttggggtgaacacaaatctaaaagatctgtgtcctctcctatcggagcatggcctgcaatgcagcctggagccccatctgaacagcgacttgtgtgtctactgctgcaaggcgtacagtgacaaggaggctaagcagctgcaggagtttgtggctgagggtggggggctgctgattgggggccaggcctggtggtgggcctcccagaaccctggccactgccccttggctggcttccctggtaacatcatcctcaactgctttggcctcagcatcctgcctcagactctcaaagcaggctgcttccccgttcccacccctgagatgagaagctaccacttccgcaaggcgctctctcaattccaggctatactgaaccacgagaatgggaacttggaaaagagctgtctggcaaagttgagagttgatggtgcagccttcctacagattcctgcggagggggtccctgcttacatatccctgcacaggctcctgaggaagatgctacgagggtctggcctcccagctgtgagccgggaaaatccagttgccagtgactcctatgaggctgcggtgctctccctggccactgggctggctcactctggaactgactgctcccagctggcccaggggcttggcacctggacctgctcctccagtttgtacccctcaaaacaccccatcaccgtggagatcaatggaatcaacccaggcaacaatgattgctgggtgagtaccgggctctacctcctggaaggacaaaatgcagaagtctcactgtctgaagctgctgcctctgctggcctgagggtacagataggctgccacaccgatgaccttaccaaggccaggaagctatctcgagcccccgtggtgactcaccaatgctggatggacaggactgagcggtcagtctcctgcctctggggcggcctcctctacgtcatcgtgcccaagggcagccaactaggccctgtgcctgtcactatcaggggagctgtgcctgccccatactacaagctgggtaagacatcgctggaggagtggaagaggcagatgcaggagaacctggctccctggggagagctggccacggacaacatcatcctgacagtgccaaccacaaaccttcaggccctgaaggaccccgagcctgtgctccgcctctgggatgagatgatgcaggctgtggccaggctggcggctgagcccttccctttccgccgtcctgagaggattgtggctgatgtgcagatctcagctggctggatgcattcaggataccccatcatgtgccacctggagtctgtgaaggagatcatcaatgagatggacatgaggagcaggggtgtgtggggccccatccatgagctgggccacaaccaacagcggcatggatgggagttccccccacacactactgaggccacctgtaacctttggtcagtctacgtgcatgaaacagtcctggggatccccagggctcaggcccacgaggctctgagccctccagagcgagagaggagaatcaaggcccacctgggaaagggagcccccctgtgtgactggaatgtatggacagccctggaaacatatctacaggtactgagcagaaattctgggagaaggggatgaccagacccctcagtcatgtagcgacctggatcccagtagccctccacctccttcgccactccaccagcctggacctccacctcccctggaaatgagagggactgggccgcagggtggtgcttcttgggttatacccctctaaggcagagagaatggcacctgtctcactcaccttctgattttgcaatgtaagaggaaatgaaaaatattatgaaaaaaatagaaatatagcatattattcaagggcagaaactctgttagacattcctgcagctgaatcacagctcttgccctcattggttttgttcttggtctcctaataagtgttccataaatggtcattgctttgttta

SEQ ID NO: 195559 - DNA, 2332 bp, Homo sapiens
  Payload ID: 18601
  Gene Name: TRPM8 channel-associated factor 2
  ENST ID: ENST00000518791
  CDS Start-End: 1-1981
gacccgtcccccgcgcgccactgcagagcctgtccgtcagtccctaggtatccgcactgctcaggggtatggggaggatgtcaggcaggaccagcagcagctcctggaggggatctcagagctggacatcaggacagggggagtcccctcacagctgcttgtacatggagccctggccttccctctggggctggatgcctcactcaactgcttcctggcggctgctcactatggccggggccgggtggtcctggctgcccacgagtgcctgctctgtgctcccaagatggggcccttcttgctcaatgcggtgcgctggctggccagaggccagacaggcaaagttggggtgaacacaaatctaaaagatctgtgtcctctcctatcggagcatggcctgcaatgcagcctggagccccatctgaacagcgacttgtgtgtctactgctgcaaggcgtacagtgacaaggaggctaagcagctgcaggagtttgtggctgagggtggggggctgctgattgggggccaggcctggtggtgggcctcccagaaccctggccactgccccttggctggcttccctggtaacatcatcctcaactgctttggcctcagcatcctgcctcagactctcaaagcaggctgcttccccgttcccacccctgagatgagaagctaccacttccgcaaggcgctctctcaattccaggctatactgaaccacgagaatgggaacttggaaaagagctgtctggcaaagttgagagttgatggtgcagccttcctacagattcctgcggagggggtccctgcttacatatccctgcacaggctcctgaggaagatgctacgagggtctggcctcccagctgtgagccgggaaaatccagttgccagtgactcctatgaggctgcggtgctctccctggccactgggctggctcactctggaactgactgctcccagctggcccaggggcttggcacctggacctgctcctccagtttgtacccctcaaaacaccccatcaccgtggagatcaatggaatcaacccaggcaacaatgattgctgggtgagtaccgggctctacctcctggaaggacaaaatgcagaagtctcactgtctgaagctgctgcctctgctggcctgagggtacagataggctgccacaccgatgaccttaccaaggccaggaagctatctcgagcccccgtggtgactcaccaatgctggatggacaggactgagcggtcagtctcctgcctctggggcggcctcctctacgtcatcgtgcccaagggcagccaactaggccctgtgcctgtcactatcaggggagctgtgcctgccccatactacaagctgggtaagacatcgctggaggagtggaagaggcagatgcaggagaacctggctccctggggagagctggccacggacaacatcatcctgacagtgccaaccacaaaccttcaggccctgaaggaccccgagcctgtgctccgcctctgggatgagatgatgcaggctgtggccaggctggcggctgagcccttccctttccgccgtcctgagaggattgtggctgatgtgcagatctcagctggctggatgcattcaggataccccatcatgtgccacctggagtctgtgaaggagatcatcaatgagatggacatgaggagcaggggtgtgtggggccccatccatgagctgggccacaaccaacagcggcatggatgggagttccccccacacactactgaggccacctgtaacctttggtcagtctacgtgcatgaaacagtcctggggatccccagggctcaggcccacgaggctctgagccctccagagcgagagaggagaatcaaggcccacctgggaaagggagcccccctgtgtgactggaatgtatggacagccctggaaacatatctacaggtactgagcagaaattctgggagaaggggatgaccagacccctcagtcatgtagcgacctggatcccagtagccctccacctccttcgccactccaccagcctggacctccacctcccctggaaatgagagggactgggccgcagggtggtgcttcttgggttatacccctctaaggcagagagaatggcacctgtctcactcaccttctgattttgcaatgtaagaggaaatgaaaaatattatgaaaaaaatagaaatatagcatattattcaagggcagaaactctgttagacattcctgcagctgaatcacagctcttgccctcattggttttgttcttggtctcctaataagtgttccataaatggtcattgctttgtt

SEQ ID NO: 195560 - DNA, 2448 bp, Homo sapiens
  Payload ID: 18601
  Gene Name: TRPM8 channel-associated factor 2
  Uniprot ID: A6NFQ2
  ENST ID: ENST00000425618
  CDS Start-End: 1-2448
atgaaaatatttcaaaaggaattcaagtttattttgaaaaaatgcacaccaatacagaaatatagagaggaaaatggcaactcatcctcctcaccacaccaccagctccagtctcatgcctctggaccaaggtatggggaggatgtcaggcaggaccagcagcagctcctggaggggatctcagagctggacatcaggacagggggagtcccctcacagctgcttgtacatggagccctggccttccctctggggctggatgcctcactcaactgcttcctggcggctgctcactatggccggggccgggtggtcctggctgcccacgagtgcctgctctgtgctcccaagatggggcccttcttgctcaatgcggtgcgctggctggccagaggccagacaggcaaagttggggtgaacacaaatctaaaagatctgtgtcctctcctatcggagcatggcctgcaatgcagcctggagccccatctgaacagcgacttgtgtgtctactgctgcaaggcgtacagtgacaaggaggctaagcagctgcaggagtttgtggctgagggtggggggctgctgattgggggccaggcctggtggtgggcctcccagaaccctggccactgccccttggctggcttccctggtaacatcatcctcaactgctttggcctcagcatcctgcctcagactctcaaagcaggctgcttccccgttcccacccctgagatgagaagctaccacttccgcaaggcgctctctcaattccaggctatactgaaccacgagaatgggaacttggaaaagagctgtctggcaaagttgagagttgatggtgcagccttcctacagattcctgcggagggggtccctgcttacatatccctgcacaggctcctgaggaagatgctacgagggtctggcctcccagctgtgagccgggaaaatccagttgccagtgactcctatgaggctgcggtgctctccctggccactgggctggctcactctggaactgactgctcccagctggcccaggggcttggcacctggacctgctcctccagtttgtacccctcaaaacaccccatcaccgtggagatcaatggaatcaacccagagtctcactctgtcatccaggttggaatgcagtggcgcgatctcagctcatgcaacctccacctcctgggtttaagcaattcttctctctcagcctcctgtgttgctgggactacaggcacacgccaccatgcctggctaatttttgtatttttagtagagagggagtttcaccgtaaaggcaacaatgattgctgggtgagtaccgggctctacctcctggaaggacaaaatgcagaagtctcactgtctgaagctgctgcctctgctggcctgagggtacagataggctgccacaccgatgaccttaccaaggccaggaagctatctcgagcccccgtggtgactcaccaatgctggatggacaggactgagcggtcagtctcctgcctctggggcggcctcctctacgtcatcgtgcccaagggcagccaactaggccctgtgcctgtcactatcaggggagctgtgcctgccccatactacaagctgggtaagacatcgctggaggagtggaagaggcagatgcaggagaacctggctccctggggagagctggccacggacaacatcatcctgacagtgccaaccacaaaccttcaggccctgaaggaccccgagcctgtgctccgcctctgggatgagatgatgcaggctgtggccaggctggcggctgagcccttccctttccgccgtcctgagaggattgtggctgatgtgcagatctcagctggctggatgcattcaggataccccatcatgtgccacctggagtctgtgaaggagatcatcaatgagatggacatgaggagcaggggtgtgtggggccccatccatgagctgggccacaaccaacagcggcatggatgggagttccccccacacactactgaggccacctgtaacctttggtcagtctacgtgcatgaaacagtcctggggatccccagggctcaggcccacgaggctctgagccctccagagcgagagaggagaatcaaggcccacctgggaaagggagcccccctgtgtgactggaatgtatggacagccctggaaacatatctacagctccaagaggccttcgggtgggagccattcacccagctctttgctgagtaccagaccctctctcacctccccaaagacaacactggcaggatgaatctatgggtgaagaagttctctgaaaaagtgaagaagaatctggttcccttctttgaggcctggggctggcctatccagaaggaggtggctgacagcctggcctccctaccagagtggcaggaaaaccccatgcaagtgtacctccgtgccaggaagtaa

SEQ ID NO: 195561 - DNA, 3408 bp, Homo sapiens
  Payload ID: 18602
  Gene Name: TruB pseudouridine (psi) synthase family member 1
  Uniprot ID: Q8WWH5
  ENST ID: ENST00000298746
  CDS Start-End: 62-1111
gcactcttgttgcatcatcagcgtgcacctccacgatgaaacaggtctgggctacaaaagtatggccgcttctgaggcggcggtggtgtcttcgccgtctttgaaaacagacacatcccctgtccttgaaactgcaggaacggtcgcagcaatggctgcgaccccgtcagcaagggctgcagccgcggtggttgcggccgcggccaggaccggatccgaagccagggtctccaaggccgctttggctaccaagctgctgtccttgagcggcgtgttcgccgtgcacaagcccaaagggcccacttcagccgagctgctgaatcggttgaaggagaagctgctggcagaagctggaatgccttctccagaatggaccaagaggaaaaagcagactttgaaaattgggcatggagggactctagacagcgcagcccgaggagttctggttgttggaattggaagcggaacaaaaatgttgaccagtatgttgtcagggtccaagagatatactgccattggagaactggggaaagctactgatacactagattctacggggagggtaacagaagaaaaaccttacgataaaataacacaagaagatattgaaggcattctacagaaatttactggaaatataatgcaagtgccccccctctattctgcattaaagaaagatggacaaagactttcgactttgatgaagagaggtgaagtcgtagaagcaaaacctgccaggccagtgactgtatacagtatctcccttcaaaaattccagccaccatttttcacattagatgttgaatgtggaggaggtttttatatcagaagcttggtcagtgacattggaaaagaactatcttcctgtgccaatgtgctagagctgacccgaaccaaacagggaccatttacgctagaagaacatgcccttcctgaagacaaatggacaattgatgacattgcacagtctcttgagcattgctcatctcttttcccagcagagttggcacttaaaaaatcaaaacctgagtctaatgaacaggttttgagctgtgaatatataactctaaatgagccaaagagagaagatgatgtaattaagacgtgttgagattggcctgggaatatcatcattttctagttgacatttgaatcctgtgtgcagatgcagaatgacaagctgcattcaaaagacaaacaatatgtcttttttttttttgcatgaagaaaaatgtctatcatttacagtttcaatagcacataatttattttctatgcattataaatggccttgcagttggctcagttgtttgttgtgttgtgaaatgttttaggattttttgtattgtgaaaatatgaatatgattggattcagaaaaattaactttctgaatttgatctgtcttcagtcttgtgaaaaagttgaacaaatttcctaatcaaagaaaaaagtatgagctccatgtttctttagtttcacaaaaatgaccataatttagtgttatttttactttatttaggcttcctggtggcttcattttattgaaattctttaaattgtttaaagtggccattattgatctctttcttctgttttggagagtttattattaaaaacatttctttgataaaatggccatcatctagtaatacctgtgtttgtttagatcttggaaatgaataagctttgataatatttgtaaatgaaccaaattattactgctaccactaacaggttgtaaatagaagactaatacttaattaaagtcaccttcctaccattagagcagaagacagctcctatagttttgtattttggcagctatgagatattttcatggtaatgtcaacatggtcaagcactttgtaccaagttattaagtaacataatttttaaaatttaaagaatgtgtcttcaactaaaaactttattctttagcatttatttatatttctctgtagggtgttccctgtgacattgtctctttagtttgctctttcaagagatacttacagatgttgagatggctgccctgcatttccagctaatctcttctgctctaaatatttaaaaacagttcttctcaaacattttcattcagatagctttctgaaagttccctatccctctttaccataattttttaaatgtagccacattgtaatagtaaacttcatatataatgagtgcttcatatttttgttatgggaaagcaatatattatgcagccagtctgtagaaacattcagatccctcttcctttactcaaatacagtttcaaaaggaagactcatgagaaatttcataaaatacaagtttttagatgtttatgctttgcctttctttttaaaggtgttttcctgctttgtagtctctaactctgaaatttaaaatatgtaaactaaagtggttttatttgtgcttaacccaatttaaactcaatgtaaaatgttatatatgcatcagtacagcattttcaacatattggcaacatattttaaatgaaaacactaaaacaattcttagtatgagacaaaactgtaaggaaaaagagtgttaataccatgatgcattaacataaaatatcaaacacacaaagtcataaaatgaaaatttacagttttacctgttcatatctagtgccccacagtgtgtgtcaaccaaaggtggcagtggctacatctgcctgttggactggtacaggttacaatatgtcctcttccattgcaaattaaagtccaaatagagaaatacttaggttttagaacacatcagaggtatttctgctgtatttttcaccttaaaaattgacacagagtttactaatagaggagtagagattgttgaccatttttaaaaaacgatagccactctttttcttttatgtttaaaactgaagttttgccaaatgggaaaattactgttacctctaccatcttaatgtagtaactttagaatttaaatttttatattactattttcctttttgttgttcacatagtcttaaggcacctatacttttaaattgactttttcatttgatattatctatatgtatgtagttgtgataatgattattttaattatattactttatactcttaatttatttagagtatttctctattgctgaatacttaagtagttttaaattttattatgataaattcctgggagggggattatttagtgaaataatatgaagaactttatgacttatgtttgccttattgcattcccaaagagttgtaacattttacagtgttaccatttgagtaggggttttatatgttgttgctaatttagtaaacataggagagaaatcaaagtttttctgatttgcttttatgtgatttatctgtatactttgttcatttatataaataaatgtcttaatggtttctata

SEQ ID NO: 195562 - DNA, 5719 bp, Homo sapiens
  Payload ID: 18603
  Gene Name: TruB pseudouridine (psi) synthase family member 2
  Uniprot ID: O95900
  ENST ID: ENST00000372890
  CDS Start-End: 335-1330
cggcctttcgaggggaaacatcgcttcacgggcagaaggcatgtaggccaagtaggcgaaggaaacgcacgcgaactgtctaccgtctacgtccaccgatccaagactctcgccatgtcacctcgccccagaaagtgtctgcaaaggacacgcaaccacgctcactcagcgccgggccctatttccttctccacagccggttttccccgaagactataaaatgcgaacctcttccggctgtggaacatggcggcgcccgtggaaaggaccacatttgggggcggggcctggcggtacttccgtccaggtccagcgggtgctgtgatcttcaagtatggggtctgctggcttgtcgcggctgcatgggcttttcgcggtctataagcccccggggctaaaatggaagcacctgcgggatacagtggagctacaacttctgaagggtctcaatgccaggaagcctcccgctcctaaacagcgtgttcgcttcttgctgggccccatggaaggcagcgaagagaaggagctgaccctcacagccaccagcgtaccctctttcatcaaccatccactggtatgtggaccagcattcgcccatctcaaggttggcgtgggacatcggttggatgcccaggcttctggagtacttgtgctcggcgtgggacatggatgcaggctcctcaccgatatgtacaatgctcatcttaccaaggattacacagtgcgtggcctcctgggcaaagctacagatgacttccgtgaggacgggaggctggtagagaagacaacctatgaccacgtgaccagagagaagctggaccgcattctggccgttatccaaggctcccatcagaaggccctggtgatgtactccaacctcgacctgaagacccaggaggcctatgagatggccgtgagaggcctgatccggcccatgaacaagtccccgatgctgataactggcatccgatgcctctactttgcacctccggaattcctcttagaggtgcagtgcatgcatgagacgcagaaagagctgcggaagttggttcatgaaatcggcctggaactaaagaccactgctgtctgcacccaagtgcggcgcacgcgcgacggcttcttcacgctagacagtgccctcctgaggacccagtgggacctaaccaacatccaggatgctatccgggctgctacccctcaggtagctgcagagctggagaagagcttgagcccggggctggacaccaagcagctccccagtccgggatggtcctgggactcccagggcccgagctctaccttggggctggagaggggtgcggggcagtgaatgcccaggcagctcctggggcagtggatggataaatagaagaactgctatgagctggacctgatagctgtgcagaaagtgagagcaggggcaccttttctacgtaagacacaaaactcaagctgtaacagaaaggtcaatggacttgacccaactgagaaggaaaaacttctgtatggaggaaaagacagtaaacatgacagactgatagaaagtattggcagaccaggcgtggtggcgggcacttgtaatcccagctactcccaaggctgaggcaggagaattgcttgagcccaggagtttaaggttgtagtgcgctagacggcgcctgtgaatagccactgcactctagtctggggaacatatgagacccctgccatctcaaaaaaaaaaaaattctcaataaactatgtgcccacgaaaattaaaaattaaaaaaaattgtaagtatttgcagtgtcattaaccaaggactaatatccatagtatacagagagcccttagaaagcaataagaagacaacgacaaaattaggcaaatgagatgaagtgtgtatcagaagaaatccaaatggctagtaagccagaaatgacactcaacctctttaatactggaagacacagatgaaaatgagatgatttttgttgtttttctgttgttgcccaggctggagtgcagtggcgccatctttgctcactgcagcctccgcctcccaggttcaagtgattctcctgcctcagcctcccaagtagctggggtcacaggcgcccgccaccacacctggctaattttttgtatccgagatgaggtttcaccatgttggcctggctcagcctcccaaagtgctgggattacaggcgtgagccaccgcacctggccgggacctcagtcttttctcttaaaggtcttcagtttattgaatgagctccgcccacaattgtggtggataatcagcgtgactcaaagtctacccattgactgattgaaatgttaatcatttttttgtttttgtttttgtttttgagacttgctttgtggcccaggctggagtgcagtggtgcgatctaggctcactgcaacctccgcttcccaggttcacgccattctcctgcctcagcctcccgagtagctgggactacaggtgcccaccaccacgcccagctaatttttttgtatttttagtagagacggtgttgcaccgtgttagccaggatggtctcaatctcctgacctcgtgatccgcctggcttggcctcccaaagtactgggattacagccgtgagccaccacacccggcctgttttggttttttttttttctgagacggagtctcactccgtcatccaggttggagtgcagtggcacaatctcagctcactgcaacctctgcctcccaggttcaagcgattctcctgcctcagcttctcaagtagctgggattacagatgtgtaccaccatgcctggctaatttttgtatttttagtagagacagggtttcaccatgttggccaggctggtctggaactcctgacctcaggtgatccgcccacctcagcctcccagagcgctgggattatgccaacctctgcctcccaaagcactgggatggcaggcatgagccaccacacccggcctgtttttgttttttagacagggtcttgctctgtcacccaggctggagtgcagtgatgcaaacatgactcactgcagctttgtcctctcaggcttaaccatcttcccacctcagcttccagaatagctgggactgcaggcgtgcacacagtatctggctaatttatttattttattttatttttgagacagggcctcgcactgtcgcccaggctagagtgcagtggcgcggtttcaactcattgcagcctcgaccctcctgggtcaagcgattcttcctgccttagtctccagagttgctgggattaccggtgtgcaccaccaagcctggctaatttttgtatttttagtagagacagggtttcactatgttggccaggctggtctggaactcctgacctgaggtgatccgcctacctcggccttccaaagtactgggaatataggcatgagccactgtttccggcctgttttttttagacagagtcttgctctgtcacccaggctggagtgcaatggtgcaaacatgactcactgcaccgtcatcctcccaggctcaaccatcttcccacctcaccctccagaatagctgggactacaggcgtgcaccacgatgcctggctaaatatttttttccagctaattttattatttttttttgagatggagtcttgctctgtcacccaggctggagtgcaatggcacaatcttggctcactgcaacctccgcctcccagggtcaagtgattctcctgcctcagccacccaagtagctgggattataggcgttcaccaccacgcccagctaacttttgtatttttagtagagacggggtttcaccatgttggacatgctggtctcaaagtcctgacctcaggtgatctgcccgcttcagcctcccaaagtgctgggattacaggcgtgagccaccatacctggcccacctgagatcaggagttcaagaccagcctggccaacatagtgaaaccctgtctctactaaaaatacaaaaattagccagctatggtgacgcacttctgtaatcctagctacttgggaggctgaggcacaagaatcgctgaagcccaggaggtggagattgccattagctgagattgtgcccctgcactccagtctggacgagagagtgagactctgtctcagaaaagaaaaaaaaaaaggctgggcacggtggctcacgcctgtaatcccagcactttgggaggccagggtgggcggatcacgaggtcaggagttcaagaccagcctgaccaacatggtgaaacctgtctctactaaaaatacaaaattagccgggcgtgcttgcacgtgcctgtagtcctggctacccgggaggctgatgcagaataactggaactcgggaggcggagcttgcagtgagtggagattgcgccactgcactccagcctaggtgacagagtgagactctgtctcaaaaaaaaaaaaaaaagagaaaaatcagaacaaaatcagcaatatttagacaagcagaatccaatgaaatggtgaggaaagctgggtgggagtggagggtatcagcaaaactcagttctttggaaaaattaggtaacttgaacgtagggcacatgggctgtcacaccaccccatttagagcccttattggcatagagatgataaaagtggactctgtgatggcctctcatgatctcaggatagcaggataggggaactctgagtcatggccaaaataattggtcaatgtacagcctcagacagctgggaataccaccccaaatcacttggataaggagatgttttccttatcctgtgtctttaactctgagacggatggagttgaacaatcaacgattgttaaaaatgtaccaaatgtgtaagcatcatgaggtgtttaagctgagcttttaaattaaaattctgctgggtgtggcggctcatgcctgtaatcccagcactttgcgatccccacacaggaggattgcttgagcccagaagtttgagaccagcctgggcaacacaaggagaccctgtctctacaaaaaacaaacaaacaaacaaaaaagccgggggtgttggtgtgtgcctgtagtcccagctactagggaggctgagatgggaggatcgcttgaacctagcaagtcaaggcggcagtaaatggagatctgtactccagcctgggcaacagagcgagaccctatgtcagaaaaaaagaaaaagccacccagcaggctgagcgtggtggctcacgcctgtaatccctgcactttgggaagccaaagcaggtgaatcacttgaggtcaggagttcgagaccagcctggccaatatggtgaaaccctgtctctaccaaaaatacaaaaattagccgggcatggtggcgcttgtctgtagtccagctacagctactccagatctgggctgaggtgggagaatcatttgaacccaggaggtggaggttgcagtgagctgaaatcacacgactgtactctagcctgggtgacagggtgagaccctatctcaaaacaaacaaacaaaaaccccaccagcaaccttgctgacaaatccacaggcccccacgtctgccaattgcctgcctgtatgaactgggcacctgggggaggggcgtggcccccaggctactcatcttggctttcacagccaaagggcctgggtggaacctcagcttactgtgtttactgactgggtaatgtggcctctgaagctgtcacctatctataaaatggggattaaaacga

SEQ ID NO: 195563 - DNA, 3644 bp, Homo sapiens
  Payload ID: 18604
  Gene Name: trypsin domain containing 1
  Uniprot ID: Q2T9J0
  ENST ID: ENST00000287078
  CDS Start-End: 1-1701
atgagaaggcagtgggggtctgccatgagggcggccgagcaggcgggctgcatggtgagcgcctcccgggccggacagcccgaggcgggcccgtggagctgcagcggggtaatcctgagccgtagcccgggcctggtgctttgccacgggggcatcttcgtccccttcctgcgagctggcagcgaagtcctgaccgcggccggcgccgtcttcctgcctggcgacagttgcagggacgacctgcgcctgcacgtgcagtgggccccaacggccgcgggtcccgggggcggcgcggagcggggccgcccagggctgtgcacgccccagtgcgcgagcctcgagcccggcccacctgccccgtcccgcgggcgtcccctgcagccccggcttcctgctgagctgctgctgctgctgagctgcccggccttctgggcccacttcgcgcgcctcttcggggacgaggcagcggaacagtggcgcttctcgagcgcggcgcgggatgacgaagtgtcggaggacgaggaggcggatcaactgagagcgctgggctggtttgcgctgctgggcgtgcggctaggccaggaggaggtggaggaggagcgcgggccagccatggcggtgtcgcctctcggggccgtgcccaagggtgcgccattgctggtctgcggctcccctttcggcgccttctgccccgacatctttctcaacacgctgagctgcggggtgctcagcaacgtggccggcccactgctgcttaccgacgcacgctgcctgcccggcaccgagggcggcggcgtgttcaccgcgcggcccgcgggggcgctggtggcgctggtggtggcgccgctctgttggaaggccggcgaatgggtgggcttcacgctgctctgcgccgccgccccccttttccgcgccgcccgcgacgcgcttcaccgcctgccgcacagcaccgctgccctggccgcccttctgccgccagaggtgggcgtcccgtggggtctgcccctccgagactccgggcccctgtgggcagccgcggcagtgttggtggagtgcggcaccgtatggggctccggagtggctgtggcaccccgccttgtagtgacctgtcggcacgtgtcccctcgggaagcagccagggtcctggtgcgctccaccacccccaagagtgtggccatctggggccgtgtggtatttgccactcaggagacatgtccctatgacatagcagtggtgagcctggaggaggacctggatgatgtccccatccctgtgcccgctgagcacttccatgaaggcgaggctgtgagtgtggtgggctttggcgtctttggccagtcttgcgggccctcggtgacctcaggcatcctttcggctgtggtgcaggtgaatggcacgcccgtaatgctgcagaccacgtgtgctgtgcacagcggctccagtgggggacccctcttctccaaccactcaggaaacctccttggcataatcaccagcaacacccgggacaataatacgggggccacctacccccacctgaacttcagcattcccatcacggtgctccagccggccctgcagcagtacagccagacccaagacctaggtggcctccgtgagctggaccgcgctgctgagccagtcagggtggtgtggcggttgcagcggcccctggcagaggccccgcggagcaagctctgaggctgtgttaccacctttggaaagaagagtgacctttttctgctgtaggaagtgatgttgaggtgacggtggcctcaggattcagggcccagcccctgcaggggcccaggctgcctctcatctccacccactgactgcagactgggctttgggctctggggcaaacttctcttcagccccatggatccttaacctggcagcccgttttggggtgctttcttgagcccccagttctctgtcccctagcactagactcagctgtattgtttttccttctggggagcccactccaactgcacagaagttctgggcctgacaggtagattccagctggaaggcaggcccgtgcctggttttgcgtctgttcccctgagggccatcgtcatcctggagcttcaatggggccttggctcctgtctgcctctcagtcagagtcagggctgacaaaggactcagcttccttagcatctcagcagaaaccttgctctgaagaccagagacagaagggacagaaacaggagtgcctcctgctgtgccaggcccatgggcagtgcaggcagatccctgaaggtcagcactcctgggtcttcatatgccaacaggggcgctcttgacactgtgccttcattttccagcccacagcctgggtctcagggatcttgaggggtagaacatgtctggttggggcttgggaataaacatgatctattgaaaaacctctgtatttatatatcaaattgtttctttttttcaggagttgaactgggaataggcaagtaccaggcaaagaaacacaccctttccttttttttttttttttttctttagagctgtggtcttgctctctcacccaggctggagtgcagtgttgcgatcacagctcactgcagcctcaaactcctgggctccaggagacctcctgcctcagcctcctgaatagctgggactacagtcgcgcaccaccacgcctggctaattttttatttttgtagaaatggggtattgctttgttgcccgtgctggcttcagccttctggtttcaagcagtcctcctgcctcagcttcccaaagtgctgggattacaggtgtgagccactgtgcccaacccagaaatacaccctttctgtgctgttttctcagcagggtgtgagctcacgggatacggtcctgccagactggccctcatagctggtcatgtgccagtcagagctgggtggggcttgcaggtcccggaaggtggtggtcttgacctggcagcagatgcttaaagaatgcctaaggtgggtggcagttggggagttcaagggtgaatgaggccagggcagcccccaggagctgaggccaactctttgagtcaggactgtgccgtgtgcccagggccttgcatgtgtgggccctcgagtgatttctactggcaggctgaaagccctgtgaggggcggctgtgggcggaggccacgcaggaagagtgcttaggagtaacttgtttctaacacctgtgtgctgagtgccaatgctgggtgtggtgttatgatatatattggttttcatccagcattcctgactcgtaactctcatagtccttgttccagtctttgttagaatactgggtatgttagggcttgggacaggcctctgacctctgggtatcctttcactaatgttcgcccacctttttcacagtgggtcctaaagaccttcccatgagagggtctcaatcctaggggaaggaatgttgatgtcatgaaccttccataaaaacccaagaggacagggttcagagagcttctggatagctgaacacctggcacttcctggagtgtggcgtgcccagggagggcacggaagctctgcactccttccccttccctcattccttgctctatgtgcatctcttcatctgtatcctttgcgatatcctttataataaaccggtaaacataa

SEQ ID NO: 195564 - DNA, 3397 bp, Homo sapiens
  Payload ID: 18604
  Gene Name: trypsin domain containing 1
  Uniprot ID: Q2T9J0
  ENST ID: ENST00000335494
  CDS Start-End: 71-1267
ccgggtaggggtcctcgctcgctagcttgctgtttctcggagaagctcccgagtgtccggcctagaggccatgagaaggcagtgggggtctgccatgagggcggccgagcaggcgggctgcatggtgagcgcctcccgggccggacagcccgaggcgggcccgtggagctgcagcggggtaatcctgagccgtagcccgggcctggtgctttgccacgggggcatcttcgtccccttcctgcgagctggcagcgaagtcctgaccgcggccggcgccgtcttcctgcctggcgacagttgcagggacgacctgcgcctgcacgtgcagtgggccccaacggccgcgggtcccgggggcggcgcggagcggggccgcccagggctgtgcacgccccagtgcgcgagcctcgagcccggcccacctgccccgtcccgcgggcgtcccctgcagccccggcttcctgctgagctgctgctgctgctgagctgcccggccttctgggcccacttcgcgcgcctcttcggggacgaggcagcggaacagtggcgcttctcgagcgcggcgcgggatgacgaagtgtcggaggacgaggaggcggatcaactgagagcgctgggctggtttgcgctgctgggcgtgcggctaggccaggaggaggtggaggaggagcgcgggccagccatggcggtgtcgcctctcggggccgtgcccaagggtgcgccattgctggtctgcggctcccctttcggcgccttctgccccgacatctttctcaacacgctgagctgcggggtgctcagcaacgtggccggcccactgctgcttaccgacgcacgctgcctgcccggcaccgagggcggcggcgtgttcaccgcgcggcccgcgggggcgctggtggcgctggtggtggcgccgctctgttggaaggccggcgaatgggtgggcttcacgctgctctgcgccgccgccccccttttccgcgccgcccgcgacgcgcttcaccgcctgccgcacagcaccgctgccctggccgcccttctgccgccagaggtgggcgtcccgtggggtctgcccctccgagactccgggcccctgtgggcagccgcggcagtgttggtggagtgcggcaccgtatggggctccggagtggctgtggcaccccgccttgtagtgacctgtcggcacgtgtcccctcgggaagcagccagggtcctggtgcgctccaccacccccaagcataatcaccagcaacacccgggacaataatacgggggccacctacccccacctgaacttcagcattcccatcacggtgctccagccggccctgcagcagtacagccagacccaagacctaggtggcctccgtgagctggaccgcgctgctgagccagtcagggtggtgtggcggttgcagcggcccctggcagaggccccgcggagcaagctctgaggctgtgttaccacctttggaaagaagagtgacctttttctgctgtaggaagtgatgttgaggtgacggtggcctcaggattcagggcccagcccctgcaggggcccaggctgcctctcatctccacccactgactgcagactgggctttgggctctggggcaaacttctcttcagccccatggatccttaacctggcagcccgttttggggtgctttcttgagcccccagttctctgtcccctagcactagactcagctgtattgtttttccttctggggagcccactccaactgcacagaagttctgggcctgacaggtagattccagctggaaggcaggcccgtgcctggttttgcgtctgttcccctgagggccatcgtcatcctggagcttcaatggggccttggctcctgtctgcctctcagtcagagtcagggctgacaaaggactcagcttccttagcatctcagcagaaaccttgctctgaagaccagagacagaagggacagaaacaggagtgcctcctgctgtgccaggcccatgggcagtgcaggcagatccctgaaggtcagcactcctgggtcttcatatgccaacaggggcgctcttgacactgtgccttcattttccagcccacagcctgggtctcagggatcttgaggggtagaacatgtctggttggggcttgggaataaacatgatctattgaaaaacctctgtatttatatatcaaattgtttctttttttcaggagttgaactgggaataggcaagtaccaggcaaagaaacacaccctttccttttttttttttttttttctttagagctgtggtcttgctctctcacccaggctggagtgcagtgttgcgatcacagctcactgcagcctcaaactcctgggctccaggagacctcctgcctcagcctcctgaatagctgggactacagtcgcgcaccaccacgcctggctaattttttatttttgtagaaatggggtattgctttgttgcccgtgctggcttcagccttctggtttcaagcagtcctcctgcctcagcttcccaaagtgctgggattacaggtgtgagccactgtgcccaacccagaaatacaccctttctgtgctgttttctcagcagggtgtgagctcacgggatacggtcctgccagactggccctcatagctggtcatgtgccagtcagagctgggtggggcttgcaggtcccggaaggtggtggtcttgacctggcagcagatgcttaaagaatgcctaaggtgggtggcagttggggagttcaagggtgaatgaggccagggcagcccccaggagctgaggccaactctttgagtcaggactgtgccgtgtgcccagggccttgcatgtgtgggccctcgagtgatttctactggcaggctgaaagccctgtgaggggcggctgtgggcggaggccacgcaggaagagtgcttaggagtaacttgtttctaacacctgtgtgctgagtgccaatgctgggtgtggtgttatgatatatattggttttcatccagcattcctgactcgtaactctcatagtccttgttccagtctttgttagaatactgggtatgttagggcttgggacaggcctctgacctctgggtatcctttcactaatgttcgcccacctttttcacagtgggtcctaaagaccttcccatgagagggtctcaatcctaggggaaggaatgttgatgtcatgaaccttccataaaaacccaagaggacagggttcagagagcttctggatagctgaacacctggcacttcctggagtgtggcgtgcccagggagggcacggaagctctgcactccttccccttccctcattccttgctctatgtgcatctcttcatctgtatcctttgcgatatcctttataataaaccggtaaacataa

SEQ ID NO: 195565 - DNA, 1175 bp, Homo sapiens
  Payload ID: 18605
  Gene Name: tryptase alpha/beta 1
  Uniprot ID: Q15661
  ENST ID: ENST00000338844
  CDS Start-End: 34-861
cccactgggtagaaggaacagggagcggccaggatgctgaatctgctgctgctggcgctgcccgtcctggcgagccgcgcctacgcggcccctgccccaggccaggccctgcagcgagtgggcatcgtcgggggtcaggaggcccccaggagcaagtggccctggcaggtgagcctgagagtccacggcccatactggatgcacttctgcgggggctccctcatccacccccagtgggtgctgaccgcagcgcactgcgtgggaccggacgtcaaggatctggccgccctcagggtgcaactgcgggagcagcacctctactaccaggaccagctgctgccggtcagcaggatcatcgtgcacccacagttctacaccgcccagatcggagcggacatcgccctgctggagctggaggagccggtgaacgtctccagccacgtccacacggtcaccctgccccctgcctcagagaccttccccccggggatgccgtgctgggtcactggctggggcgatgtggacaatgatgagcgcctcccaccgccatttcctctgaagcaggtgaaggtccccataatggaaaaccacatttgtgacgcaaaataccaccttggcgcctacacgggagacgacgtccgcatcgtccgtgacgacatgctgtgtgccgggaacacccggagggactcatgccagggcgactccggagggcccctggtgtgcaaggtgaatggcacctggctgcaggcgggcgtggtcagctggggcgagggctgtgcccagcccaaccggcctggcatctacacccgtgtcacctactacttggactggatccaccactatgtccccaaaaagccgtgagtcaggcctgggttggccacctgggtcactggaggaccaacccctgctgtccaaaacaccactgcttcctacccaggtggcgactgccccccacaccttccctgccccgtcctgagtgccccttcctgtcctaagccccctgctctcttctgagccccttcccctgtcctgaggacccttccctatcctgagcccccttccctgtcctaagcctgacgcctgcaccgggccctccagccctcccctgcccagatagctggtggtgggcgctaatcctcctgagtgctggacctcattaaagtgcatggaaatca

SEQ ID NO: 195566 - DNA, 1357 bp, Homo sapiens
  Payload ID: 18605
  Gene Name: tryptase alpha/beta 1
  ENST ID: ENST00000461509
  CDS Start-End: 195-1043
ccagggtaagtccccactctcagagaccctgacatcagcgtcacctggagcagagtggcccagcctcagactcagagcaccaagacccaggcccgcaggcctggacccaccccggtccccccgtcccagctccattcttcaccccacaatctgtagcccccagccctgccctgtgaggcccggccaggcccacgatgctcctccttgctccccagatgctgaatctgctgctgctggcgctgcccgtcctggcgagccgcgcctacgcggcccctgccccaggccaggccctgcagcgagtgggcatcgtcgggggtcaggaggcccccaggagcaagtggccctggcaggtgagcctgagagtccacggcccatactggatgcacttctgcgggggctccctcatccacccccagtgggtgctgaccgcagcgcactgcgtgggaccggacgtcaaggatctggccgccctcagggtgcaactgcgggagcagcacctctactaccaggaccagctgctgccggtcagcaggatcatcgtgcacccacagttctacaccgcccagatcggagcggacatcgccctgctggagctggaggagccggtgaacgtctccagccacgtccacacggtcaccctgccccctgcctcagagaccttccccccggggatgccgtgctgggtcactggctggggcgatgtggacaatgatgagcgcctcccaccgccatttcctctgaagcaggtgaaggtccccataatggaaaaccacatttgtgacgcaaaataccaccttggcgcctacacgggagacgacgtccgcatcgtccgtgacgacatgctgtgtgccgggaacacccggagggactcatgccagggcgactccggagggcccctggtgtgcaaggtgaatggcacctggctgcaggcgggcgtggtcagctggggcgagggctgtgcccagcccaaccggcctggcatctacacccgtgtcacctactacttggactggatccaccactatgtccccaaaaagccgtgagtcaggcctgggttggccacctgggtcactggaggaccaacccctgctgtccaaaacaccactgcttcctacccaggtggcgactgccccccacaccttccctgccccgtcctgagtgccccttcctgtcctaagccccctgctctcttctgagccccttcccctgtcctgaggacccttccctatcctgagcccccttccctgtcctaagcctgacgcctgcaccgggccctccagccctcccctgcccagatagctggtggtgggcgctaatcctcctgagtgctggacctcattaaagtgcatggaaatca

SEQ ID NO: 195567 - DNA, 918 bp, Homo sapiens
  Payload ID: 18605
  Gene Name: tryptase alpha/beta 1
  ENST ID: ENST00000561736
  CDS Start-End: 1-642
tactggatgcacttctgcgggggctccctcatccacccccagtgggtgctgaccgcagcgcactgcgtgggaccggtgcaactgcgggagcagcacctctactaccaggaccagctgctgccggtcagcaggatcatcgtgcacccacagttctacaccgcccagatcggagcggacatcgccctgctggagctggaggagccggtgaacgtctccagccacgtccacacggtcaccctgccccctgcctcagagaccttccccccggggatgccgtgctgggtcactggctggggcgatgtggacaatgatgagcgcctcccaccgccatttcctctgaagcaggtgaaggtccccataatggaaaaccacatttgtgacgcaaaataccaccttggcgcctacacgggagacgacgtccgcatcgtccgtgacgacatgctgtgtgccgggaacacccggagggactcatgccagggcgactccggagggcccctggtgtgcaaggtgaatggcacctggctgcaggcgggcgtggtcagctggggcgagggctgtgcccagcccaaccggcctggcatctacacccgtgtcacctactacttggactggatccaccactatgtccccaaaaagccgtgagtcaggcctgggttggccacctgggtcactggaggaccaacccctgctgtccaaaacaccactgcttcctacccaggtggcgactgccccccacaccttccctgccccgtcctgagtgccccttcctgtcctaagccccctgctctcttctgagccccttcccctgtcctgaggacccttccctatcctgagcccccttccctgtcctaagcctgacgcctgcaccgggccctccagccctcccctgcccagatagctggtggtgggcgctaatcc

SEQ ID NO: 195568 - DNA, 1352 bp, Homo sapiens
  Payload ID: 18606
  Gene Name: tryptase beta 2 (gene/pseudogene)
  ENST ID: ENST00000612142
  CDS Start-End: 191-1039
ggtaagtccccactctcagagaccctgacatcagcgtcacctggagcagagtggcccagcctcagactcagagcaccaagacccaggcctgcaggcctggacccaccccggtccccccgtcccagctccattcttcaccccacaatctgtagcccccagccctgccctgtgaggcccggccaggcccacgatgctcctccttgctccccagatgctgaatctgctgctgctggcgctgcccgtcctggcgagccgcgcctacgcggcccctgccccaggccaggccctgcagcgagtgggcatcgttgggggtcaggaggcccccaggagcaagtggccctggcaggtgagcctgagagtccgcgaccgatactggatgcacttctgcgggggctccctcatccacccccagtgggtgctgaccgcagcgcactgcgtgggaccggacgtcaaggatctggccgccctcagggtgcaactgcgggagcagcacctctactaccaggaccagctgctgccggtcagcaggatcatcgtgcacccacagttctacaccgcccagatcggagcggacatcgccctgctggagctggaggagccggtgaacgtctccagccacgtccacacggtcaccctgccccctgcctcagagaccttccccccggggatgccgtgctgggtcactggctggggcgatgtggacaatgatgagcgcctcccaccgccatttcctctgaagcaggtgaaggtccccataatggaaaaccacatttgtgacgcaaaataccaccttggcgcctacacgggagacgacgtccgcatcgtccgtgacgacatgctgtgtgccgggaacacccggagggactcatgccagggcgactccggagggcccctggtgtgcaaggtgaatggcacctggctgcaggcgggcgtggtcagctggggcgagggctgtgcccagcccaaccggcctggcatctacacccgtgtcacctactacttggactggatccaccactatgtccccaaaaagccgtgagtcaggcctggggtgtccacctgggtcactggagagccagcccctcctgttcaaaacaccactgcttcctacccaggtggcgactgccccccacaccttccctgccccgtcctgagtgccccttcctgtcctaagccccctgctctcttctgagccccttcccctgtcctgaggacccttccccatcctgagcccccttccctgtcctaagcctgacgcctgcaccgggccctccggccctcccctgcccaggcagctggtggtgggcgctaatcctcctgagtgctggacctcattaaagtgcatggaaatc

SEQ ID NO: 195569 - DNA, 1165 bp, Homo sapiens
  Payload ID: 18606
  Gene Name: tryptase beta 2 (gene/pseudogene)
  Uniprot ID: P20231
  ENST ID: ENST00000606293
  CDS Start-End: 24-851
agaaggaacagggagcggccaggatgctgaatctgctgctgctggcgctgcccgtcctggcgagccgcgcctacgcggcccctgccccaggccaggccctgcagcgagtgggcatcgttgggggtcaggaggcccccaggagcaagtggccctggcaggtgagcctgagagtccgcgaccgatactggatgcacttctgcgggggctccctcatccacccccagtgggtgctgaccgcagcgcactgcgtgggaccggacgtcaaggatctggccgccctcagggtgcaactgcgggagcagcacctctactaccaggaccagctgctgccggtcagcaggatcatcgtgcacccacagttctacaccgcccagatcggagcggacatcgccctgctggagctggaggagccggtgaacgtctccagccacgtccacacggtcaccctgccccctgcctcagagaccttccccccggggatgccgtgctgggtcactggctggggcgatgtggacaatgatgagcgcctcccaccgccatttcctctgaagcaggtgaaggtccccataatggaaaaccacatttgtgacgcaaaataccaccttggcgcctacacgggagacgacgtccgcatcgtccgtgacgacatgctgtgtgccgggaacacccggagggactcatgccagggcgactccggagggcccctggtgtgcaaggtgaatggcacctggctgcaggcgggcgtggtcagctggggcgagggctgtgcccagcccaaccggcctggcatctacacccgtgtcacctactacttggactggatccaccactatgtccccaaaaagccgtgagtcaggcctggggtgtccacctgggtcactggagagccagcccctcctgttcaaaacaccactgcttcctacccaggtggcgactgccccccacaccttccctgccccgtcctgagtgccccttcctgtcctaagccccctgctctcttctgagccccttcccctgtcctgaggacccttccccatcctgagcccccttccctgtcctaagcctgacgcctgcaccgggccctccggccctcccctgcccaggcagctggtggtgggcgctaatcctcctgagtgctggacctcattaaagtgcatggaaatca

SEQ ID NO: 195570 - DNA, 1210 bp, Homo sapiens
  Payload ID: 18606
  Gene Name: tryptase beta 2 (gene/pseudogene)
  ENST ID: ENST00000611196
  CDS Start-End: 24-902
agaaggaacagggagcggccaggatgctgaatctgctgctgctggcgctgcccgtcctggcgagccgcgcctacgcggcccctgccccaggccaggccctgcagcgagtgggcatcgttgggggtcaggaggcccccaggagcaagtggccctggcaggtgagcctgagagtccgcgaccgatactggatgcacttctgcgggggctccctcatccacccccagtgggtgctgaccgcagcgcactgcgtgggaccggacgtcaaggatctggccgccctcagggtgcaactgcgggagcagcacctctactaccaggaccagctgctgccggtcagcaggatcatcgtgcacccacagttctacaccgcccagatcggagcggacatcgccctgctggagctggaggagccggtgaacgtctccagccacgtccacacggtcaccctgccccctgcctcagagaccttccccccggggatgccgtgctgggtcactggctggggcgatgtggacaatgatgagcgcctcccaccgccatttcctctgaagcaggtgaaggtccccataatggaaaaccacatttgtgacgcaaaataccaccttggcgcctacacgggagacgacgtccgcatcgtccgtgacgacatgctgtgtgccgggaacacccggagggactcatgccagggcgactccggagggcccctggtgtgcaaggtgaatggcacctggctgcaggcgggcgtggtcagctggggcgagggctgtgcccagcccaaccggcctggcatctacacccgtgtcacctactacttggactggatccaccactatgtccccaaaaagccagatggggtttcgccatgttggccagtctggtctcgaactcctgacctcaagtgatccgcccgcctcggcctcccaaagtgctgggatgacaggcgtgagccaccgcacccggcctgagtttgacattttcaaattcattttgaggtctttctctacatcaatagatgcagagatgtgcatttagtctcccgaatctctgcaaatgacctctgtcctcacaaggggtggactcaactcccagtgccctctccagccccacgtgacctctgcctctgcagcccctgaaggcccatccctcggctcctgttctgcaggcccagcgtcttgttaatgaagatggacctggaactcgggcccttctt

SEQ ID NO: 195571 - DNA, 1499 bp, Homo sapiens
  Payload ID: 18607
  Gene Name: tryptase delta 1
  Uniprot ID: Q9BZJ3
  ENST ID: ENST00000211076
  CDS Start-End: 149-877
ggagcagagtggcccagcctcagactcagagcaccaagacccaggcccgcaggcctggacccaccccggtccccccgtcccagctccattcttcaccccacaatctgtagcccccagccctgccctgtgaggcccggccaggcccacgatgctcctccttgctccccagatgctgagcctgctgctgctggcgctgcccgtcctggcgagcccggcctacgtggcccctgccccaggccaggccctgcagcaaacgggcattgttggggggcaggaggcccccaggagcaagtggccctggcaggtgagcctgagagtccgcggcccatactggatgcacttctgcgggggctccctcatccacccccagtgggtgctaaccgcggcgcactgcgtggaaccggacatcaaggatctggccgccctcagggtgcaactgcgggagcagcacctctactaccaggaccagctgctgccggtcagcaggatcatcgtgcacccacagttctacatcatccagaccggggcggacatcgccctgctggagctggaggagcccgtgaacatctccagccacatccacacggtcacgctgccccctgcctcggagaccttccccccggggatgccgtgctgggtcactggctggggcgacgtggacaataatgtgcacctgccgccgccatacccgctgaaggaggtggaagtccccgtagtggaaaaccacctttgcaacgcggaatatcacaccggcctccatacgggccacagctttcaaatcgtccgcgatgacatgctgtgtgcggggagcgaaaatcacgactcctgccagggtgactctggagggcccctggtctgcaaggtgaatggcacctaactgcaggcgggcgtggtcagctgggaggagagctgtgcccagcccaaccggcctggcatctacacccgtgtcacctactacttggactggatccaccactatgtccccaagaagccctgagccaggcctggggtgtccacccgggtcactggagggccagcccctcctgtccaaaccaccactgcttcctacccaggtggtgactgccccccacaccttcccccatcctgagtcccctctcccatcctgagccctgtcccctgtcctgagccccctcccctttcttgatcccctcccccatcctgagcccctcccccaccctgagccccttcccctttcttgagccccctcccccaccctgagccccctcccctttcttgagtccctcctccatcctgagccccctcccctttcttgagtccctcctccatcctgagccccctcccctttcttgagcccctcctccatcctgagccccctcctccatcctgccccctcctccatcctgagcctcctccccaaccctgaatccgcccctcccggcccctccggccctcccctgcccaggcagctggtggtggacgcccatcctctctagtgctgactctcattaaagtgcatg

SEQ ID NO: 195572 - DNA, 896 bp, Homo sapiens
  Payload ID: 18607
  Gene Name: tryptase delta 1
  ENST ID: ENST00000397534
  CDS Start-End: 34-741
cccgctgggtagaaggaacagggagtggccaggatgctgagcctgctgctgctggcgctgcccgtcctggcgagcccggcctacgtggcccctgccccaggccaggccctgcagcaaacgggcattgttggggggcaggaggcccccaggagcaagtggccctggcaggtgagcctgagagtccgcggcccatactggatgcacttctgcgggggctccctcatccacccccagtgggtgctaaccgcggcgcactgcgtggaaccggacatcaaggatctggccgccctcagggtgcaactgcgggagcagcacctctactaccaggaccagctgctgccggtcagcaggatcatcgtgcacccacagttctacatcatccagaccggggcggacatcgccctgctggagctggaggagcccgtgaacatctccagccacatccacacggtcacgctgccccctgcctcggagaccttccccccggggatgccgtgctgggtcactggctggggcgacgtggacaataatgtgcacctgccgccgccatacccgctgaaggaggtggaagtccccgtagtggaaaaccacctttgcaacgcggaatatcacaccggcctccatacgggccacagctttcaaatcgtccgcgatgacatgctgtgtgcggggagcgaaaatcacgactcctgccagggtgactctggagggcccctggtctgcaaggtgaatggcacctaactgcaggcgggcgtggtcagctgggaggagagctgtgcccagcccaaccggcctggcatctacacccgtgtcacctactacttggactggatccaccactatgtccccaagaagccctgagccaggcctggggtgtccacccgggtcactggagg

SEQ ID NO: 195573 - DNA, 1108 bp, Homo sapiens
  Payload ID: 18608
  Gene Name: tryptase gamma 1
  Uniprot ID: Q9NRR2
  ENST ID: ENST00000234798
  CDS Start-End: 6-971
acaccatggcccttggggcctgtggcctcctgctgctcctggctgtgcccggtgtgtccctcaggactttgcagccagggtgtggccggccgcaggtttcggatgcaggcggccggatcgtggggggtcacgctgccccggccggcgcatggccatggcaggccagcctccgcctgcggagggtgcacgtgtgcggcgggtcactgctcagcccccagtgggtgctcacagctgcccactgcttctccgggtccctgaactcatccgactaccaggtgcacctgggggaactggagatcactctgtctccccacttctccaccgtgaggcagatcatcctgcactccagcccctcaggacagccggggaccagcggggacatcgccctggtggagctcagtgtccccgtgaccctctccagccggatcctgcccgtctgcctcccggaggcctcagatgacttctgccctgggatccggtgctgggtgaccggctggggctatacgcgggagggagagcctctgccacccccgtacagcctgcgggaggtgaaagtctccgtggtggacacagagacctgccgccgggactatcccggccccgggggcagcatccttcagcccgacatgctgtgtgcccggggccccggggatgcctgccaggacgactccggggggcctctggtctgccaggtgaacggtgcctgggtgcaggctggcactgtgagctggggtgagggctgcggccgccccaacaggccgggagtctacactcgtgtccctgcctacgtgaactggatccgccgccacatcacagcatcagggggctcagagtctgggtaccccaggctccccctcctggctggcttcttcctccccggcctcttccttctgctagtctcctgtgtcctgctggccaagtgcctgctgcacccatctgcggatggtactcccttccccgcccctgactgatggcaggaatccaagtgcatttcttaaataagttactatttattccgctccgccccctccctctcccttgagaagctgagtcttctgcatcagattattgcaacatttaacctgaatttaaaagcacacgaaacaaa

SEQ ID NO: 195574 - DNA, 665 bp, Homo sapiens
  Payload ID: 18609
  Gene Name: tryptophan 2,3-dioxygenase
  ENST ID: ENST00000506072
  CDS Start-End: 470-665
ccatctgctgactcaacttgctagtatcgggcagcagccaggaccacagctcctccagctcctttgtgaccttttccttcagcttcttcaaatactgggttagacacctgcctggaatatagtgagtgttaggataaagtaaacatagaccagaggaagaagtcaaatacgcatttgcctcagatatacttttaaaaaactccccgtagaaggcagcgaagaagacaaatcacaaactggtgtgaatagagccagcaaaggaggtcttatctatgggaactacctgcatttggaaaaagttttgaatgcacaagaactgcaaagtgaaacaaaaggaaataaaatccatgatgaacatctttttatcataactcatcaagcttatgaactctggtttaagcaaatcctctgggagttggattctgttcgagagatctttcagaatggccatgtcagagatgaaaggaacatgcttaaggttgtttctcggatgcaccgagtgtcagtgatcctgaaactgctggtgcagcagttttccattctggagacgatgacagccttggacttcaatgacttcagagagtacttatctccagcatcaggcttccagagtttgcaattccgactattagaaaacaagataggtgttcttcagaacatgagag

SEQ ID NO: 195575 - DNA, 557 bp, Homo sapiens
  Payload ID: 18609
  Gene Name: tryptophan 2,3-dioxygenase
  ENST ID: ENST00000507590
  CDS Start-End: 410-557
gactcaacttgctagtatcgggcagcagccaggaccacagctcctccagctcctttgtgaccttttccttcagcttcttcaaatactgggttagacacctgcctggaatatagtgagtgttagatatacttttaaaaaactccccgtagaaggcagcgaagaagacaaatcacaaactggtgtgaatagagccagcaaaggaggtcttatctatgggaactacctgcatttggaaaaagttttgaatgcacaagaactgcaaagtgaaacaaaaggaaataaaatccatgatgaacatctttttatcataactcatcaagcttatgaactctggtttaagcaaatcctctgggagttggattctgttcgagagatctttcagaatggccatgtcagagatgaaaggaacatgcttaaggttgtttctcggatgcaccgagtgtcagtgatcctgaaactgctggtgcagcagttttccattctggagacgatgacagccttggacttcaatgacttcagagagtacttatctccagcatcaggcttccagagtttgc

SEQ ID NO: 195576 - DNA, 1701 bp, Homo sapiens
  Payload ID: 18609
  Gene Name: tryptophan 2,3-dioxygenase
  Uniprot ID: P48775
  ENST ID: ENST00000536354
  CDS Start-End: 65-1285
aaggtcaatgatagcatctgcctagagtcaaacctccgtgcttctcagacagtgccttttcaccatgagtgggtgcccatttttaggaaacaactttggatatacttttaaaaaactccccgtagaaggcagcgaagaagacaaatcacaaactggtgtgaatagagccagcaaaggaggtcttatctatgggaactacctgcatttggaaaaagttttgaatgcacaagaactgcaaagtgaaacaaaaggaaataaaatccatgatgaacatctttttatcataactcatcaagcttatgaactctggtttaagcaaatcctctgggagttggattctgttcgagagatctttcagaatggccatgtcagagatgaaaggaacatgcttaaggttgtttctcggatgcaccgagtgtcagtgatcctgaaactgctggtgcagcagttttccattctggagacgatgacagccttggacttcaatgacttcagagagtacttatctccagcatcaggcttccagagtttgcaattccgactattagaaaacaagataggtgttcttcagaacatgagagtcccttataacagaagacattatcgtgataacttcaaaggagaagaaaatgaactgctacttaaatctgagcaggaaaagacacttctggaattagtggaggcatggctggaaagaactccaggtttagagccacatggatttaacttctggggaaagcttgaaaaaaatatcaccagaggcctggaagaggaattcataaggattcaggctaaagaagagtctgaagaaaaagaggaacaggtggctgaatttcagaagcaaaaagaggtgctactgtccttatttgatgagaaacgtcatgaacatctccttagtaaaggtgaaagacggctgtcatacagagcacttcagggagcattgatgatatatttttacagggaagagcctaggttccaggtgccttttcagttgctgacttctcttatggacatagattcactgatgaccaaatggagatataaccatgtgtgcatggtgcacagaatgctgggcagcaaagctggcaccggtggttcctcaggctatcactacctgcgatcaactgtgagtgataggtacaaggtatttgtagatttatttaatctttcaacatacctgattccccgacactggataccgaagatgaacccaaccattcacaaatttctatatacagcagaatactgtgatagctcctacttcagcagtgatgaatcagattaaaatcgtctgcaaaatctatgaagaatactggtttcacagcctattttttattttctatggattttcataaatacagtttgaatatatgtatgcatatattgttcagcaccacgatgctctgatttaattctagaaacaatttgattacctcttgtttgtgacaagactaagcattaagatgagaaagaatacatttaaatagtaacattgtacatagggtgttttcctattaaaaattcagtttcccctgagacttaatgtaaccacttaatgtaatcactatctcattgtttcatctttataaacttgtaaacttcatctatttcaaatattttatgcagtacattatattattctgtacaaaggctttcaaacaaaatttttaaaataataaagtattaatctttctccctgta

SEQ ID NO: 195577 - DNA, 1701 bp, Homo sapiens; identical to SEQ ID NO: 195576
  Payload ID: 18609
  Gene Name: tryptophan 2,3-dioxygenase
  Uniprot ID: P48775
  ENST ID: ENST00000573403
  CDS Start-End: 65-1285

SEQ ID NO: 195578 - DNA, 557 bp, Homo sapiens; identical to SEQ ID NO: 195575
  Payload ID: 18609
  Gene Name: tryptophan 2,3-dioxygenase
  ENST ID: ENST00000573644
  CDS Start-End: 410-557

SEQ ID NO: 195579 - DNA, 665 bp, Homo sapiens; identical to SEQ ID NO: 195574
  Payload ID: 18609
  Gene Name: tryptophan 2,3-dioxygenase
  ENST ID: ENST00000574434
  CDS Start-End: 470-665

SEQ ID NO: 195580 - DNA, 5325 bp, Homo sapiens
  Payload ID: 18610
  Gene Name: tryptophan hydroxylase 1
  Uniprot ID: P17752
  ENST ID: ENST00000250018
  CDS Start-End: 564-1898
aattctcctggctagcagttatccatctagtgcatatgtatctagagctggccaggcctttagtttacaaaataaatagaaagccttgtccccactctggaggagcttgctgccttgttagaaggtgagatatgttcgaatagaacatttggggaaaccatttgagacctggtataatgaagtgctaagattgtgggcaaggtggggaggaggtaggccttcctgactagtttaggctacaatagttgggaagactgcaagaagccagcaggcttcagtcatgccctaaaagagcgattggtttagaaaaaaaacaaaagggaactactaacatgtattctattctaggcaggtgtcaggcaaagttgtatcttattttggtctcactagattcttgcaaagcttatctgcatatccaggttttataaaaggttaagaaactgaagctcctagaagtaaatgagcccttagttatcaaatattgtctgcattgtgcaacttcttttttagcccgtagtctttgttttcatactttagttttagagaattactccaaattcatcatgattgaagacaataaggagaacaaagaccattccttagaaaggggaagagcaagtctcattttttccttaaagaatgaagttggaggacttataaaagccctgaaaatctttcaggagaagcatgtgaatctgttacatatcgagtcccgaaaatcaaaaagaagaaactcagaatttgagatttttgttgactgtgacatcaacagagaacaattgaatgatatttttcatctgctgaagtctcataccaatgttctctctgtgaatctaccagataattttactttgaaggaagatggtatggaaactgttccttggtttccaaagaagatttctgacctggaccattgtgccaacagagttctgatgtatggatctgaactagatgcagaccatcctggcttcaaagacaatgtctaccgtaaacgtcgaaagtattttgcggacttggctatgaactataaacatggagaccccattccaaaggttgaattcactgaagaggagattaagacctggggaaccgtattccaagagctcaacaaactctacccaacccatgcttgcagagagtatctcaaaaacttacctttgctttctaaatattgtggatatcgggaggataatatcccacaattggaagatgtctccaactttttaaaagagcgtacaggtttttccatccgtcctgtggctggttacttatcaccaagagatttcttatcaggtttagcctttcgagtttttcactgcactcaatatgtgagacacagttcagatcccttctataccccagagccagatacctgccatgaactcttaggtcatgtcccgcttttggctgaacctagttttgcccaattctcccaagaaattggcttggcttctcttggcgcttcagaggaggctgttcaaaaactggcaacgtgctactttttcactgtggagtttggtctatgtaaacaagatggacagctaagagtctttggtgctggcttactttcttctatcagtgaactcaaacatgcactttctggacatgccaaagtaaagccctttgatcccaagattacctgcaaacaggaatgtcttatcacaacttttcaagatgtctactttgtatctgaaagttttgaagatgcaaaggagaagatgagagaatttaccaaaacaattaagcgtccatttggagtgaagtataatccatatacacggagtattcagatcctgaaagacaccaagagcataaccagtgccatgaatgagctgcagcatgatctcgatgttgtcagtgatgcccttgctaaggtcagcaggaagccgagtatctaacagtagccagtcatccaggaacatttgagcatcaattcggaggtctgggccatctcttgctttccttgaacacctgatcctggagggacagcatcttctggccaaacaatattatcgaattccactacttaaggaatcactagtctttgaaaatttgtacctggatattctatttaccacttatttttttgtttagttttatttctttttttttttggtagcagctttaatgagacaatttatataccatacaagccactgaccacccatttttaatagagaagttgtttgacccaatagatagatctaatctcagcctaactctattttccccaatcctccttgagtaaaatgaccctttaggatcgcttagaataacttgaggagtattatggcgctgactcatattgttacctaagatccccttatttctaaagtatctgttacttattgctgaatttgtgccaagctcaatcacattcacactaaaatttaacaggagaccctgctgtctttgttgctagcatgagcaaaagtatagaggcctttgcacatggaggatacctagtaaagagcaagtagtctagtttcaagtgtagtatcttgtagggaaatgggagtagctaagcctggaaaggttgaatggggcataatcattaagactaggctaaaaattcgagactttattttttaggcattagggagccccttcccaagtgactatcttccttgaaactttgttttctttcaatgacatcacacgatactggttttattctggactatctatcctactcatgggtccaagggaaacttagtagagatgcgacttgcatggggctgtactcagacatgtggtcctaggtattataatgggattgtccccagattaacaggaagcattgttatcaaaggaagagttcaaactgagatagataagagaagcacaaagtaaaagatagaaaaaacagtgctgagtactttatttctaaggtataaggtgaggccataaacagaaaggtatgcaatgagagtagaggctgcagaaaaggggaggaaatagaatgtcagaaaggtcaagaagagtggtttaggactgagactgtaagtaatgtaaggattgccaaggaatggtttttatgcagagtcagctgtgtagcacagggagtaagcagtcctgttataaatgggtgaagctgaactccaaaatacaaacttatgtctctttaatttgcccctttcctccctctagtcactaaatgaagatgttcttcaagtttctgtctttgcacttctactctttttgccatctcttcatggggaatgtcacccagatacatgacttcagttcttattttgaatgactcctctatttgcagttataaccctgacatctttcttgaatttttttgccccttaattccaacgaactcctggatgtctatgtagatgtctcataatttaggccaatgctgtacaacttcatgtggcatcatccacatagaatgaataggggttgttcaatatgacagccctgccaagcatctcaaattgaacaggtctataaaggaactcagaatcacttgaatatcacagtccatcagcttcctttcccagtaatttaatttccattaatggtatattaaacatcgtattttcaatcatttttaggtttagtcagctacttaaaaataggctttttcttcacataaataaattgtataccatttaatgtgttttatttcaacagactaatagatcttttaacacttcttagtcctcaaaataaattattaaaaactttgtatttcatgtcatattatataaggaaatagaattttgaagaataattcatgctgttttaaatttttacattgtacattttaatagctaatcaactcttaagtatacatttgatggtaaatagatgctagctaatctagaatcatttgaaatattgattatctgatttatagtttggttgcaaggaaatctactgtaagcaaatcataatagatagcaaatcttagaacatgtagaaaaaaagaaattaaaaaaagcaaatcttagaacatgtagaaaaaggaaattaaaaaatagatagcaaataacacaaattatgcatactatatgtggttattttcatacaactttgataacggtgaagaatcatacttattgaattttaaaatgatgatgtttaaaatcactctatgactaaagcacatgagaataaatgttaaaggcacagccttataatccacaacttcagaacaatggaatttttttttttttttttttttttttttttttttttttttttttgagacggagtcttgctctgtcgcccaggctggagtgcagtggtgcgatcttggctcactgcaagctccacctcccaggttcacggcattctcctgcctctgtctcctgagtagctgggactacaggcgcccgccaccacgtccggctcattttttgtatttttagtagagacaaggtttcaccgtgttagccaggatggtttcaatctcctgacattgtgatctgcccacctcggcctcccaaagtgctgggattacaggcgtgagccactgcacccggccaaacattggaaatttttaatgatggatttcagttcttctcacctctgggtatttgtaatatttggtaaatcaggagtcctgagagtcttagaattttcatgcattttaaatatatgtcttcaaagcacctaggaatatgtaaatagttacccaaatgtgagaacagaattgaactaaaagcttcgtttataatttttttttttttttgagacagagtctcactctgttgcccaggctggagcgcagttgcgtgatttcagctcgctgcaacctgggactgcaggcgtgcttcaccatgccccgctaatttttgtttttttagtagagatggggtttcgccatgttggccaggctggtctcgaacttctgaccgcaggtgatccatccgcctcggcctcccaaagtgctgggattacaagcatgagccaccatgcccagccggttaataattcttaatcagtaaatcattattcaaagacatagttaatatcttcatgacttcttaaggatgctcaaaagctggtcttcagaatacctacatttctttatctacatattctgtcatttggagttatacaagtagtaatgacacaccaaaatgtaaataattattgttagcttttaagttggcttccaaattcaaaaaagaaaaaaatcctgaattctctaaaggaacatatgatagagtccatatgttaattcataggaagtgtttaaggtactatggtctattttggtctaatctttgttttactatgtaatatatatttatgatttacaagtttgttattcagtgggataataaatgaacacaaaattta

SEQ ID NO: 195581 - DNA, 1138 bp, Homo sapiens
  Payload ID: 18610
  Gene Name: tryptophan hydroxylase 1
  ENST ID: ENST00000417164
  CDS Start-End: 1-621
atgattgaagacaataaggagaacaaagaccattccttagaaaggggaagagcaagtctcattttttccttaaagaatgaagttggaggacttataaaagccctgaaaatctttcaggagaagcatgtgaatctgttacatatcgagtcccgaaaatcaaaaagaagaaactcagaatttgagatttttgttgactgtgacatcaacagagaacaattgaatgatatttttcatctgctgaagtctcataccaatgttctctctgtgaatctaccagataattttactttgaaggaagatggtatggaaactgttccttggtttccaaagaagatttctgacctggaccattgtgccaacagagttctgatgtatggatctgaactagatgcagaccatcctggcttcaaagacaatgtctaccgtaaacgtcgaaagtattttgcggacttggctatgaactataaacaagcgtacaggtttttccatccgtcctgtggctggttacttatcaccaagagatttcttatcaggtttagcctttcgagtttttcactgcactcaatatgtgagacacagttcagatcccttctataccccagagccagatacctgccatgaactcttaggtcatgtcccgcttttggctgaacctagttttgcccaattctcccaagaaattggcttggcttctcttggcgcttcagaggaggctgttcaaaaactggcaacgtgctactttttcactgtggagtttggtctatgtaaacaagatggacagctaagagtctttggtgctggcttactttcttctatcagtgaactcaaacatgcactttctggacatgccaaagtaaagccctttgatcccaagattacctgcaaacaggaatgtcttatcacaacttttcaagatgtctactttgtatctgaaagttttgaagatgcaaaggagaagatgagagaatttaccaaaacaattaagcgtccatttggagtgaagtataatccatatacacggagtattcagatcctgaaagacaccaagagcataaccagtgccatgaatgagctgcagcatgatctcgatgttgtcagtgatgcccttgctaaggtcagcaggaagccgagtatctaa

SEQ ID NO: 195582 - DNA, 556 bp, Homo sapiens
  Payload ID: 18610
  Gene Name: tryptophan hydroxylase 1
  ENST ID: ENST00000528338
  CDS Start-End: 60-556
gacaacgtcgcccatactctgtgtttgataagaaaagtcaatctttgagtggtaattgaatggttttagagaattactccaaattcatcatgattgaagacaataaggagaacaaagaccattccttagaaaggggaagagcaagtctcattttttccttaaagaatgaagttggaggacttataaaagccctgaaaatctttcaggagaagcatgtgaatctgttacatatcgagtcccgaaaatcaaaaagaagaaactcagaatttgagatttttgttgactgtgacatcaacagagaacaattgaatgatatttttcatctgctgaagtctcataccaatgttctctctgtgaatctaccagataattttactttgaaggaagatggtatggaaactgttccttggtttccaaagaagatttctgacctggaccattgtgccaacagagttctgatgtatggatctgaactagatgcagaccatcctggcttcaaagacaatgtctaccgtaaacgtcgaaagtattttgcggacttggctatgaactataa

SEQ ID NO: 195583 - DNA, 2360 bp, Homo sapiens
  Payload ID: 18611
  Gene Name: tryptophan hydroxylase 2
  Uniprot ID: Q8IWU9
  ENST ID: ENST00000333850
  CDS Start-End: 142-1614
cattgctcttcagcaccagggttctggacagcgccccaagcaggcagctgatcgcacgccccttcctctcaatctccgccagcgctgctactgcccctctagtaccccctgctgcagagaaagaatattacaccgggatccatgcagccagcaatgatgatgttttccagtaaatactgggcacggagagggttttccctggattcagcagtgcccgaagagcatcagctacttggcagctcaacactaaataaacctaactctggcaaaaatgacgacaaaggcaacaagggaagcagcaaacgtgaagctgctaccgaaagtggcaagacagcagttgttttctccttgaagaatgaagttggtggattggtaaaagcactgaggctctttcaggaaaaacgtgtcaacatggttcatattgaatccaggaaatctcggcgaagaagttctgaggttgaaatctttgtggactgtgagtgtgggaaaacagaattcaatgagctcattcagttgctgaaatttcaaaccactattgtgacgctgaatcctccagagaacatttggacagaggaagaagagctagaggatgtgccctggttccctcggaagatctctgagttagacaaatgctctcacagagttctcatgtatggttctgagcttgatgctgaccacccaggatttaaggacaatgtctatcgacagagaagaaagtattttgtggatgtggccatgggttataaatatggtcagcccattcccagggtggagtatactgaagaagaaactaaaacttggggtgttgtattccgggagctctccaaactctatcccactcatgcttgccgagagtatttgaaaaacttccctctgctgactaaatactgtggctacagagaggacaatgtgcctcaactcgaagatgtctccatgtttctgaaagaaaggtctggcttcacggtgaggccggtggctggatacctgagcccacgagactttctggcaggactggcctacagagtgttccactgtacccagtacatccggcatggctcagatcccctctacaccccagaaccagacacatgccatgaactcttgggacatgttccactacttgcggatcctaagtttgctcagttttcacaagaaataggtctggcgtctctgggagcatcagatgaagatgttcagaaactagccacgtgctatttcttcacaatcgagtttggcctttgcaagcaagaagggcaactgcgggcatatggagcaggactcctttcctccattggagaattaaagcacgccctttctgacaaggcatgtgtgaaagcctttgacccaaagacaacttgcttacaggaatgccttatcaccaccttccaggaagcctactttgtttcagaaagttttgaagaagccaaagaaaagatgagggactttgcaaagtcaattacccgtcccttctcagtatacttcaatccctacacacagagtattgaaattctgaaagacaccagaagtattgaaaatgtggtgcaggaccttcgcagcgacttgaatacagtgtgtgatgctttaaacaaaatgaaccaatatctggggatttgatgcctggaactatgttgttgccagcatgatctttttggggcttagcagcagttcagtcaatgtcatataacgcaaataaccttctgtgtcatggcttggctaataagcatgcaattccatatatctataccatcttgtaactcactgtgttagtatataaagcaccataagaaatccaatggcagataaccactcattgtatgaaataacgtattatgtttaaacatcttaaaaagatttgacattcctgcttagtgtccttaaccaaactgcatctagttaaaatttgtaacaaatagccctcttatgagtctcatttatgcccttttctttttcagatctaagcctttcctctgtgttcattagataaaatgaaaaaaagcagtgaagctgtttccattttcaatagtatcagtgttttcacgcattatttgagataaacccagaattgtaggaaacttcccatcacaataacaaaggttcaatattctatttcaaaaattgttgaggtaacacagcagttggaatgatttttaggttgagtatttacacaatgcaagaaaacacctttttacaaatggaattatgtaggttgcgttgaccttgtagaacctgagttatgacaagcttcctgaagtattttggaagatagtacttccggaaaggacattaggaaagactaaacagtggacaatcaatcttgggactatgaattttatgctggaataaagtaaattatcatgttc

SEQ ID NO: 195584 - DNA, 1616 bp, Homo sapiens
  Payload ID: 18612
  Gene Name: tryptophan rich basic protein
  Uniprot ID: O00258
  ENST ID: ENST00000333781
  CDS Start-End: 142-666
cgcgagggcgacgcagttcgcaggcgcgtcggcgcgcctgttctggggcgcttggcttcaccgcgcaggcgcggtcgccgctgttgttgtggtccccatggagctgccgtagcggacccagcacagccaggagcgtccgggatgagctcagccgcggccgaccactgggcgtggttgctggtgctcagcttcgtgtttggatgcaatgttcttaggatcctcctcccgtccttctcatccttcatgtccagggtgctgcagaaggacgcggagcaggagtcacagatgagagcggagatccaggacatgaagcaggagctctccacagtcaacatgatggacgagtttgccagatatgccaggctggaaagaaagatcaacaagatgacggataagctcaaaacccatgtgaaagctcggacagctcaattagccaagataaaatgggtgataagtgtcgctttctacgtattgcaggctgccctgatgatctcactcatttggaagtattattctgtccctgtggctgtcgtgccgagtaaatggataacccctctagaccgcctggtagcctttcctactagagtagcaggtggtgttggaattacctgttggattttagtctgtaacaaagttgtcgctattgtgcttcatccgttcagctgaacaggaggatggatacagccgcgaggctaaaaaacggatttcctcttcctagcttaaaatctgatttacactgttttgttttttaagaaacaaaagtgcatagtttagattttttttttgttgaatatgtttgttcttggactttatgagagagtcttataagaatcacgattttctacacctgtcattgagccaagaaagtccagtttatgacacgtatgtactagtgaacaccgtcctcgatctgtacgaaatgtgaaatgtttagggacatctccatgctgtcacttgtgatttgccctcttatgtattttggtcatattgccaactggaaagtcaaaattttctaacaactttaagtaagttctttgaagacttagtgctgtttttaatccagtttagaaagtaacttaattttaataccactactaaaaattcgaaaatttcttctttaatcacattcaatatggttaaaagaacaacactaattgacattgcgtgggctttttctccctttgtttaaaatgtcatttgttgagcaagagttgtatagtattatctacttacttgaggctgttaatttttcattacagtgttttgtaaatgtatccacgagaccatgatgcattgttttgtgctcaacttgtgttttgtatttaaagcattttgaatgaagtgtattttataagcatttaatatttatgctctttagaatggaacacagaaaacaaaccttataagtcctgattaatctgaaccaataacctgtgtggcctacaaagtataattctattaaatgttccttaaaacacttttttctaattaaaatctttgcaaatgcttgtgtaacttcctgccttacagctacttgtttgctgtgagccacccgcaactgacaagtggctgttaactgagtcaccatatcccagtaaagctgaattttctcacta

SEQ ID NO: 195585 - DNA, 1464 bp, Homo sapiens
  Payload ID: 18612
  Gene Name: tryptophan rich basic protein
  Uniprot ID: O00258
  ENST ID: ENST00000380708
  CDS Start-End: 92-514
atgcgcagacaccctcaggcgactggcgggtcgcggcttccaagctctaaatggagagttgtccctactgtgcggcaggcggaggagacctatgtccagggtgctgcagaaggacgcggagcaggagtcacagatgagagcggagatccaggacatgaagcaggagctctccacagtcaacatgatggacgagtttgccagatatgccaggctggaaagaaagatcaacaagatgacggataagctcaaaacccatgtgaaagctcggacagctcaattagccaagataaaatgggtgataagtgtcgctttctacgtattgcaggctgccctgatgatctcactcatttggaagtattattctgtccctgtggctgtcgtgccgagtaaatggataacccctctagaccgcctggtagcctttcctactagagtagcaggtggtgttggaattacctgttggattttagtctgtaacaaagttgtcgctattgtgcttcatccgttcagctgaacaggaggatggatacagccgcgaggctaaaaaacggatttcctcttcctagcttaaaatctgatttacactgttttgttttttaagaaacaaaagtgcatagtttagattttttttttgttgaatatgtttgttcttggactttatgagagagtcttataagaatcacgattttctacacctgtcattgagccaagaaagtccagtttatgacacgtatgtactagtgaacaccgtcctcgatctgtacgaaatgtgaaatgtttagggacatctccatgctgtcacttgtgatttgccctcttatgtattttggtcatattgccaactggaaagtcaaaattttctaacaactttaagtaagttctttgaagacttagtgctgtttttaatccagtttagaaagtaacttaattttaataccactactaaaaattcgaaaatttcttctttaatcacattcaatatggttaaaagaacaacactaattgacattgcgtgggctttttctccctttgtttaaaatgtcatttgttgagcaagagttgtatagtattatctacttacttgaggctgttaatttttcattacagtgttttgtaaatgtatccacgagaccatgatgcattgttttgtgctcaacttgtgttttgtatttaaagcattttgaatgaagtgtattttataagcatttaatatttatgctctttagaatggaacacagaaaacaaaccttataagtcctgattaatctgaaccaataacctgtgtggcctacaaagtataattctattaaatgttccttaaaacacttttttctaattaaaatctttgcaaatgcttgtgtaacttcctgccttacagctacttgtttgctgtgagccacccgcaactgacaagtggctgttaactgagtcaccatatcccagtaaagctgaattttctcacta

SEQ ID NO: 195586 - DNA, 768 bp, Homo sapiens
  Payload ID: 18612
  Gene Name: tryptophan rich basic protein
  ENST ID: ENST00000380713
  CDS Start-End: 420-768
gggcttacgggccgagtgccctttgagattcaactttttctaaattatccttcactttctgctgtaaagagtggccacctcctttttcctctaggggactgaagcgagaggaggatattgcagggtttgcctctgtggtcatcttcttagagagcaccccctccgcccccacacccttttcctcagagccgttgcttagtgagtccctgccatggaccaggcttgggaatggtccccaagtattagtttaggaggacgactctctgcttcacaggacctaccccagaatcctgtgactcagaagcgcgcttgtgaagtgcgcatgtgcgggcagggcctccagtggggctctcgtgggggcagcagccaaggactggggctggtggcctggagagctgcccgcttctccgcccttgccgatgtccagggtgctgcagaaggacgcggagcaggagtcacagatgagagcggagatccaggacatgaagcaggagctctccacagtcaacatgatggacgagtttgccagatatgccaggctggaaagaaagatcaacaagatgacggataagctcaaaacccatgtgaaagctcggacagctcaattagccaagataaaatgggtgataagtgtcgctttctacgtattgcaggctgccctgatgatctcactcatttggaagtattattctgtccctgtggctgtcgtgccgagtaaatggataacccctctagaccgcctggtagcctttcctactagagtagcag

SEQ ID NO: 195587 - DNA, 699 bp, Homo sapiens
  Payload ID: 18612
  Gene Name: tryptophan rich basic protein
  Uniprot ID: O00258
  ENST ID: ENST00000398753
  CDS Start-End: 100-522
ggatcctcctcccgtccttctcatccttcgtaagtggctgcctggcctcccaagggccggtggggatgccgccccagtcccccggcgggtctggcgtagatgtccagggtgctgcagaaggacgcggagcaggagtcacagatgagagcggagatccaggacatgaagcaggagctctccacagtcaacatgatggacgagtttgccagatatgccaggctggaaagaaagatcaacaagatgacggataagctcaaaacccatgtgaaagctcggacagctcaattagccaagataaaatgggtgataagtgtcgctttctacgtattgcaggctgccctgatgatctcactcatttggaagtattattctgtccctgtggctgtcgtgccgagtaaatggataacccctctagaccgcctggtagcctttcctactagagtagcaggtggtgttggaattacctgttggattttagtctgtaacaaagttgtcgctattgtgcttcatccgttcagctgaacaggaggatggatacagccgcgaggctaaaaaacggatttcctcttcctagcttaaaatctgatttacactgttttgttttttaagaaacaaaagtgcatagtttagattttttttttgttgaatatgtttgttcttggactttatgagagagtcttataagaatcacgattttct

SEQ ID NO: 195588 - DNA, 541 bp, Homo sapiens
  Payload ID: 18612
  Gene Name: tryptophan rich basic protein
  ENST ID: ENST00000442773
  CDS Start-End: 436-541
gtaagtggctgcctggcctcccaagggccggtggggatgccgccccagtcccccggcgggtctggcgtaggtacaggggtctcaactgggcgactgaaggccgtagtagcgtcttggttggtccgtaagcttttttgagatagttgttagcgtctaaaaggtacgacgctttaccccaaaatcagactttctgggttctagggggttgggagaaacaccgggcaaccctggactcttctggctgtgggtggcggcggcgaacctcacactgggagttcctagtgccccgctgtcagcctcgtttccgttaatcctggttcctagaggcattcgagcagccctcggccagggtttcccagaggcctggcgggcgaagtcagctgttccaggtcccggagagatggatcctcgcgtccaggagcccacattcttgggatgtccagggtgctgcagaaggacgcggagcaggagtcacagatgagagcggagatccaggacatgaagcaggagctctccacagtcaacatgatggacgagtttg

SEQ ID NO: 195589 - DNA, 707 bp, Homo sapiens
  Payload ID: 18612
  Gene Name: tryptophan rich basic protein
  ENST ID: ENST00000415847
  CDS Start-End: 1-245
ggacagctcaattagccaagataaaatgggtgataagtgtcgctttctacgtattgcaggctgccctgatgatctcactcatttggaagtattattctgtccctgtggctgtcgtgccgagtaaatggataacccctctagaccgcctggtagcctttcctactagagtagcaggtgacgatggcttaatagaatttaccacagttactttagagtctccgaaagcatggctggtggaggcctgactgggaggcaggggatgcgactccttactttgcaaaggctcctctgagccttttgcaacaccaggacttgattggtcagttttcaagacatagcctgatccaaagagttcttccatgagactgcttttcttatctctgaaagttgtatccttcacttttattctggaagacttaccaaatgagggctcatacccactgtcagaatgctctagctccatttcctctctgttactgagatgcttgcctgtactatgactgtacctcatgttgccggcattggctggcccccctgaagcaggaagcccatgatgcaggttttcagttgcttctgtgaatgagtaatgtcttctttgtctgagggggcctttcgtgtagggagcagtgcctttgccaagtgtgtcatccacaccatttctctgcatgcttcttttaaacttttctcttactagaacatcttcttga

SEQ ID NO: 195590 - DNA, 366 bp, Homo sapiens
  Payload ID: 18612
  Gene Name: tryptophan rich basic protein
  ENST ID: ENST00000478273
  CDS Start-End: 1-46
caggcaaggaaatttgaggttgttgcatctggaagtaaacatgtagctacttcttctaataaaacagaggctgctttaaataatttctattaatagccttttctgaacaatcacagagaaagtcttctgaataatcatactgagaacttaaacttccacaggagcactgagatctgctataatcaacactcttattggaagcattactgttccgtgaaaaatcgcctgtgcctgggcttctcttgcatgctgcagacctcctattgttttctaatgccacgccgaagaaatgctcatctatatttgtttttgttagatcagccaaagacatagcaaacaacctaataaaagaaaagtaaaacctaa

SEQ ID NO: 195591 - DNA, 1416 bp, Homo sapiens
  Payload ID: 18612
  Gene Name: tryptophan rich basic protein
  ENST ID: ENST00000466787
  CDS Start-End: 66-275
cgggtcgcggcttccaagctctaaatggagagttgtccctactgtgcggcaggcggaggagacctatgtccagggtgctgcagaaggacgcggagcaggagtcacagatgagagcggagatccaggacatgaagcaggagctctccacagtcaacatgatggacgagtttgccagatatgccaggctggaaagaaagatcaacaagatgacggataagctcaaaacccatggtactgtgtcccttgcagcctggaggcttcatgagagcggatgaatagagaagtctgtatgtgaagattagtagaatacatactttgcttcttggatgttctgaatattgatggaaacttaagttatctggaggaaactcagtaataagtattactttcctcttatttgctggtgaacctttgctttctaagcacagaaatatctaagatcctctcagattttcctcagagccaactctttaaaattttaagctaactcttaaaaattgtaggttttcatttttaaattcatcacttttctgagagaagcccagaaaaaaagtctcacagtggattcccagaggcttttgttccactctctagaaaaatgcccagcagtgtcctcttctgagtgtcacctcccgggtccagtgtcctgtgatgaagagcgctttctcagggcagcccgtgtgctgagggaccccggtcacagtgtgtgcacagtcagagagctgtctctgtggctaggaaaacagacagaggggcctgtccaggcccaggacaagctggactcccaccaggggttcgtgtactgtgcacactgggaaataaggaggaaaatttagtcctgttgtgaaagctcggacagctcaattagccaagataaaatgggtgataagtgtcgctttctacgtattgcaggctgccctgatgatctcactcatttggaagtattattctgtccctgtggctgtcgtgccgagtaaatggataacccctctagaccgcctggtagcctttcctactagagtagcaggtggtgttggaattacctgttggattttagtctgtaacaaagttgtcgctattgtgcttcatccgttcagctgaacaggaggatggatacagccgcgaggctaaaaaacggatttcctcttcctagcttaaaatctgatttacactgttttgttttttaagaaacaaaagtgcatagtttagattttttttttgttgaatatgtttgttcttggactttatgagagagtcttataagaatcacgattttctacacctgtcattgagccaagaaagtccagtttatgacacgtatgtactagtgaacaccgtcctcgatctgtacgaaatgtgaaatgtttagggacatctccatgctgtcacttgtgatttgccctcttatgtattttg

SEQ ID NO: 195592 - DNA, 1392 bp, Homo sapiens
  Payload ID: 18612
  Gene Name: tryptophan rich basic protein
  ENST ID: ENST00000623703
  CDS Start-End: 32-550
agcggacccagcacagccaggagcgtccgggatgagctcagccgcggccgaccactgggcgtggttgctggtgctcagcttcgtgtttggatgcaatgttcttaggatcctcctcccgtccttctcatccttcatgtccagggtgctgcagaaggacgcggagcaggagtcacagatgagagcggagatccaggacatgaagcaggagctctccacagtcaacatgatggacgagtttgccagatatgccaggctggaaagaaagatcaacaagatgacggataagctcaaaacccatgtgaaagctcggacagctcaattagccaagataaaatgggtgataagtgtcgctttctacgtattgcaggctgccctgatgatctcactcatttggaagtattattctgtccctgtggctgtcgtgccgagtaaatggataacccctctagaccgcctggtagcctttcctactagagtagcagtattctccagcagtatttggacttccaaatgtttctcttcccctgataaatctatattagaaaaataggcaatttagtgctgtttaaaatgaatggatctctatttcaagatggcatgtctagtacacttacgtgcaccgcctcacaagcacactgaaatgacagaaaaggacactatgaattaggacaatggactgaaaaataagcagaaaatttaaacacaccagtgaccacagtgcaactgcaactgacgatcagtttccaccaaactgcaacagagagagtggctttgccgtctgggccagctgaggactctccttggaacccaaagaagcagtttgtttccacctactcccaagagctgaagattataagccagaagcaaacaaaggcaggcaaggaaatttgaggttgttgcatctggaagtaaacatgtagctacttcttctaataaaacagagttctatcttttgatttggtctggacacctggaggtcagcaaccgagagcaggaaggaggcacagcaacaacagaacaacaacaagaggctgcgacaggggcggcgtgggtcaaaaggaagcaacctggaggacggtcctccttgcggcttggagcagagcttcaggttgggcaccacgacagagctgggccagaagtctaacacagcctgtttggaacacaacccgggatacttgtgtggttgggttcagtcagtcaagggaaacaagaagctaacccgtggctgggagtgttcatgcaatgctcgtggaatactcagcgcaaagcctgcccgcaagcacaaagggtatcaaggaagagttaaatgggaagttgggtcatggtgtggaatcatattaaggtcagcattgatggcttccggaacttagatagaaagcagtgtcttaatgc

SEQ ID NO: 195593 - DNA, 2800 bp, Homo sapiens
  Payload ID: 18613
  Gene Name: tryptophanyl tRNA synthetase 2, mitochondrial
  Uniprot ID: Q9UGM6
  ENST ID: ENST00000235521
  CDS Start-End: 28-1110
aaacaagacggctccgcccttctcaagatggcgctgcactcaatgcggaaagcgcgtgagcgctggagcttcatccgggcacttcataagggatccgcagctgctcccgctctccagaaagacagcaagaagcgagtattttccggcattcaacctacaggaatcctccacctgggcaattacctgggagccattgagagctgggtgaggttacaggatgaatatgactctgtattatacagcattgttgacctccactccattactgtcccccaagacccagctgtccttcggcagagcatcctggacatgactgctgttcttcttgcctgtggcataaacccggaaaaaagcatccttttccaacaatctcaggtgtctgaacacacacaattaagttggatcctttcctgcatggtcagactacctcgattacaacatttacatcagtggaaggcaaagactaccaagcagaagcacgatggcacggtgggcctgctcacatacccagtactccaggcagccgacattctgttgtacaagtccacacacgttcctgttggggaggatcaagtccagcacatggaactagttcaggatctagcacaaggtttcaacaagaagtatggggagttctttccagtgcccgagtccattctcacatccatgaagaaggtaaaatccctacgtgatccttctgccaaaatgtcgaaatcagaccctgacaaactggccaccgtccgaataacagacagcccagaggagatagtgcagaaattccgcaaggctgtgacagacttcacctcggaggtcacctatgacccggctggccgcgctggcgtgtccaacatagtggcggtgcatgccgcggtgacggggctctccgtggaggaagtggtgcgccgcagcgcgggcatgaacactgctcgctacaagctggccgtggcagatgctgtgattgagaagtttgccccaattaagcgtgaaattgaaaaactgaagctggacaaggaccatttagagaaggttttacaaattggatcagcaaaagccaaagaattagcatacactgtgtgccaggaggtgaagaaattggtgggttttctataggaagtttcaacgaatcacagcaaggcttttgtgccttgcactccatgcattctgataacggcagctttcctaaaaagaaaaagttatagttttgggacatttaatttggtatagctgattattggctttatttgatgaatattgctttgtagctttgaaatacgacagtgttccaaatcccatcaacaaaatgctgtgaacaacaacaacaaaaaataaatcaagaaggcatagctgtctgaatccccaattattgaggcacactccttggcctgcagaaatgtgattgaagtaaggagtaatttgggaaatggagtatcatttgtgcttctctctggagtacttactgtaacagatgcacacgttatctacttcaacccttttataaagcaatatatagaggtcttagatgtataatccttgagatgccatttgatcagatgccaatttgtattcagagctcataaaaacaagtccattcttatagtttgtttgtcactgagacggtgcctgatttaatatatttaagctgcttaacttgttttccaagagataacaccaactgttccagcaataatttgttttttaattcagagatatgggatatgatcttctaaggaggttgcattattttgacctgatttatttattgtacaagagcccaagtccctgaattatattcttaataagtgctttcttgcattcatttcagtttagtctcaccaaccccctatgaattaggagaattattgtcattttacacatgaggaaagtgaggctgagagaatccaattagcttgtacgatatcactccataagagaagcaaatctgagagtaaaacccttaccccttattcttaagaatagtgcttgtttattcagtacaaaaaaaatgctgaaaggcagcgttttttagactctaaacattctgattttgaaggtgggtgttggaacgactgatgatgttttttatatcatcaattcagccaatggatgcgaacttaaaatctggattcacagaaccgtggtcacatttccccatcaaaatccccaaggcgggtcccaagttctctcctctacgctcattgcagaaatactttgaaataggttctgccagtctacaatagcagtgaagactgacaaatcagatattcccaatgactgacagcttctcatcttgcctctacctcagttaagtaatgtcaccctgaaacctagcttttctgcacttccatttctgacacctgaaaatgaaaatgataatcctaacttatacaccaagacctgttagcaagatcgattttgtaacagaaattgcttataagttttttatcagtaaggaccatgatcaccatttgtacatacataactaggttgttgagcaaagcatttttgctcatgtttcttaaggaagtagagtagtccttgtgtcagaacacatgttaatccacaaaacgccccatcccagattccaaattaaaacatcgtttttaggattcttggagctagcctggatcatgggtaaaggaaacattttgccttttgtatcttatactggaatgggatgtctgtaagtcctagaacctctttgagcatatttcttacaagcctctgttttttcccctttaaaggaaactttgaaaggattgtgaatactggaaaatgacaaaactaaaggtagatctatcaa

SEQ ID NO: 195594 - DNA, 2811 bp, Homo sapiens
  Payload ID: 18613
  Gene Name: tryptophanyl tRNA synthetase 2, mitochondrial
  Uniprot ID: Q9UGM6
  ENST ID: ENST00000369426
  CDS Start-End: 5-667
caagatggcgctgcactcaatgcggaaagcgcgtgagcgctggagcttcatccgggcacttcataagggatccgcagctgctcccgctctccagaaagacagcaagaagcgagtattttccggcattcaacctacaggaatcctccacctgggcaattacctgggagccattgagagctgggtgaggttacaggatgaatatgactctgtattatacagcattgttgacctccactccattactgtcccccaagacccagctgtccttcggcagagcatcctggacatgactgctgttcttcttgcctgtggcataaacccggaaaaaagcatccttttccaacaatctcaggtgtctgaacacacacaattaagttggatcctttcctgcatggtcagactacctcgattacaacatttacatcagtggaaggcaaagactaccaagcagaagcacgatggcacggtgggcctgctcacatacccagtactccaggcagccgacattctgttgtacaagtccacacacgttcctgttggggaggatcaagtccagcacatggaactagttcaggatctagcacaaggtttcaacaagaagtatggggagttctttccagtgcccgagtccattctcagtatgtgtgtgttggtgtttttaacctagcatccatgaagaaggtaaaatccctacgtgatccttctgccaaaatgtcgaaatcagaccctgacaaactggccaccgtccgaataacagacagcccagaggagatagtgcagaaattccgcaaggctgtgacagacttcacctcggaggtcacctatgacccggctggccgcgctggcgtgtccaacatagtggcggtgcatgccgcggtgacggggctctccgtggaggaagtggtgcgccgcagcgcgggcatgaacactgctcgctacaagctggccgtggcagatgctgtgattgagaagtttgccccaattaagcgtgaaattgaaaaactgaagctggacaaggaccatttagagaaggttttacaaattggatcagcaaaagccaaagaattagcatacactgtgtgccaggaggtgaagaaattggtgggttttctataggaagtttcaacgaatcacagcaaggcttttgtgccttgcactccatgcattctgataacggcagctttcctaaaaagaaaaagttatagttttgggacatttaatttggtatagctgattattggctttatttgatgaatattgctttgtagctttgaaatacgacagtgttccaaatcccatcaacaaaatgctgtgaacaacaacaacaaaaaataaatcaagaaggcatagctgtctgaatccccaattattgaggcacactccttggcctgcagaaatgtgattgaagtaaggagtaatttgggaaatggagtatcatttgtgcttctctctggagtacttactgtaacagatgcacacgttatctacttcaacccttttataaagcaatatatagaggtcttagatgtataatccttgagatgccatttgatcagatgccaatttgtattcagagctcataaaaacaagtccattcttatagtttgtttgtcactgagacggtgcctgatttaatatatttaagctgcttaacttgttttccaagagataacaccaactgttccagcaataatttgttttttaattcagagatatgggatatgatcttctaaggaggttgcattattttgacctgatttatttattgtacaagagcccaagtccctgaattatattcttaataagtgctttcttgcattcatttcagtttagtctcaccaaccccctatgaattaggagaattattgtcattttacacatgaggaaagtgaggctgagagaatccaattagcttgtacgatatcactccataagagaagcaaatctgagagtaaaacccttaccccttattcttaagaatagtgcttgtttattcagtacaaaaaaaatgctgaaaggcagcgttttttagactctaaacattctgattttgaaggtgggtgttggaacgactgatgatgttttttatatcatcaattcagccaatggatgcgaacttaaaatctggattcacagaaccgtggtcacatttccccatcaaaatccccaaggcgggtcccaagttctctcctctacgctcattgcagaaatactttgaaataggttctgccagtctacaatagcagtgaagactgacaaatcagatattcccaatgactgacagcttctcatcttgcctctacctcagttaagtaatgtcaccctgaaacctagcttttctgcacttccatttctgacacctgaaaatgaaaatgataatcctaacttatacaccaagacctgttagcaagatcgattttgtaacagaaattgcttataagttttttatcagtaaggaccatgatcaccatttgtacatacataactaggttgttgagcaaagcatttttgctcatgtttcttaaggaagtagagtagtccttgtgtcagaacacatgttaatccacaaaacgccccatcccagattccaaattaaaacatcgtttttaggattcttggagctagcctggatcatgggtaaaggaaacattttgccttttgtatcttatactggaatgggatgtctgtaagtcctagaacctctttgagcatatttcttacaagcctctgttttttcccctttaaaggaaactttgaaaggattgtgaatactggaaaatgacaaaactaaaggtagatctatcaagccaa

SEQ ID NO: 195595 - DNA, 2690 bp, Homo sapiens
  Payload ID: 18614
  Gene Name: tryptophanyl-tRNA synthetase
  Uniprot ID: P23381
  ENST ID: ENST00000344102
  CDS Start-End: 351-1643
caatgaccagctaatggctcgattctcaagagggtttcattggtctcaacctggccccccaggcaacccacccctgattggacagtctcatcaagaaggttggtcaagagctcaagtgtttctgagaatctgggtgatttataagaaacccttagctgaatgcagggtggggagaacgaaagacaaaagcatcttttttcagaagggaaactgaaagaaagaggggaagagtattaaagaccatttctggctgggcagggcactctcagcagctcaactgcccagcgtgaccagtggccacctctgcagtgtcttccacaacctgggatgaaattgattctgcagtaaagatgttggtgtcattaaaaatgagctacaaagctgccgcgggggaggattacaaggctgactgtcctccagggaacccagcacctaccagtaatcatggcccagatgccacagaagctgaagaggattttgtggacccatggacagtacagacaagcagtgcaaaaggcatagactacgataagctcattgttcggtttggaagtagtaaaattgacaaagagctaataaaccgaatagagagagccaccggccaaagaccacaccacttcctgcgcagaggcatcttcttctcacacagagatatgaatcaggttcttgatgcctatgaaaataagaagccattttatctgtacacgggccggggcccctcttctgaagcaatgcatgtaggtcacctcattccatttattttcacaaagtggctccaggatgtatttaacgtgcccttggtcatccagatgacggatgacgagaagtatctgtggaaggacctgaccctggaccaggcctatagctatgctgtggagaatgccaaggacatcatcgcctgtggctttgacatcaacaagactttcatattctctgacctggactacatggggatgagctcaggtttctacaaaaatgtggtgaagattcaaaagcatgttaccttcaaccaagtgaaaggcattttcggcttcactgacagcgactgcattgggaagatcagttttcctgccatccaggctgctccctccttcagcaactcattcccacagatcttccgagacaggacggatatccagtgccttatcccatgtgccattgaccaggatccttactttagaatgacaagggacgtcgcccccaggatcggctatcctaaaccagccctgctgcactccaccttcttcccagccctgcagggcgcccagaccaaaatgagtgccagcgaccccaactcctccatcttcctcaccgacacggccaagcagatcaaaaccaaggtcaataagcatgcgttttctggagggagagacaccatcgaggagcacaggcagtttgggggcaactgtgatgtggacgtgtctttcatgtacctgaccttcttcctcgaggacgacgacaagctcgagcagatcaggaaggattacaccagcggagccatgctcaccggtgagctcaagaaggcactcatagaggttctgcagcccttgatcgcagagcaccaggcccggcgcaaggaggtcacggatgagatagtgaaagagttcatgactccccggaagctgtccttcgactttcagtagcactcgttttacatatgcttataaaagaagtgatgtatcagtaatgtatcaataatcccagcccagtcaaagcaccgccacctgtaggcttctgtctcatggtaattactgggcctggcctctgtaagcctgtgtatgttatcaatactgtttcttcctgtgagttccattatttctatctcttatgggcaaagcattgtgggtaattggtgctggctaacattgcatggtcggatagagaagtccagctgtgagtctctccccaaagcagccccacagtggagcctttggctggaagtccatgggccaccctgttcttgtccatggaggactccgagggttccaagtatactcttaagacccactctgtttaaaaatatatattctatgtatgcgtatatggaattgaaatgtcattattgtaacctagaaagtgctttgaaatattgatgtggggaggtttattgagcacaagatgtatttcagcccatgccccctcccaaaaagaaattgataagtaaaagcttcgttatacatttgactaagaaatcacccagctttaaagctgcttttaacaatgaagattgaacagagttcagcaattttgattaaattaagacttgggggtgaaactttccagtttactgaactccagaccatgcatgtagtccactccagaaatcatgctcgcttcccttggcacaccagtgttctcctgccaaatgaccctagaccctctgtcctgcagagtcagggtggcttttcccctgactgtgtccgatgccaaggagtcctggcctccgcagatgcttcattttgacccttggctgcagtggaagtcagcacagagcagtgccctggctgtgtccctggacgggtggacttagctagggagaaagtcgaggcagcagccctcgaggccctcacagatgtctaggcaggcctcatttcatcacgcagcatgtgcaggcctggaagagcaaagccaaatctcagggaagtccttggttgatgtatctgggtctcctctggagcactctgccctcc

SEQ ID NO: 195596 - DNA, 3092 bp, Homo sapiens
  Payload ID: 18614
  Gene Name: tryptophanyl-tRNA synthetase
  Uniprot ID: P23381
  ENST ID: ENST00000355338
  CDS Start-End: 620-2035
tgtcaagccctatgctgggtctggtgtgggtggaaatcaaacacaaaacacagatccccccggaggccccagagcgatgaaagcaacaaacaagatacgaccagagatgggttttgaaggatgaataggagttagctgagctgtcaatagtaagaagtaaggttggtccaaggcacagcgctttctgaaggaacaggaagtgaaaggaaggcgagcggctatgagagaccgcgttaagcggcacggggcgctttaggcgctgcccagtcccggcccctccagcccggggcccgccgctcaccacacgcaccggaagcgctcggttctcccggaggcagaccggccagcacactaccatccagtcacgttccgacgcgacgccgcggccgccagccaatcagtggcggcctctgccccgcccccgcgcgaacagccaatgacggcgccgtcgggccggaagttgttccgtccggacggcgtttccacggacgcccaggagacagccggttgctgagccgggagcgctgactggcccggctgggcaggtcttgactcgtctgctgaacaaatcctctgacctcaggccggctgtgaacgtagttcctgagagatagcaaacatgcccaacagtgagcccgcatctctgctggagctgttcaacagcatcgccacacaaggggagctcgtaaggtccctcaaagcgggaaatgcgtcaaaggatgaaattgattctgcagtaaagatgttggtgtcattaaaaatgagctacaaagctgccgcgggggaggattacaaggctgactgtcctccagggaacccagcacctaccagtaatcatggcccagatgccacagaagctgaagaggattttgtggacccatggacagtacagacaagcagtgcaaaaggcatagactacgataagctcattgttcggtttggaagtagtaaaattgacaaagagctaataaaccgaatagagagagccaccggccaaagaccacaccacttcctgcgcagaggcatcttcttctcacacagagatatgaatcaggttcttgatgcctatgaaaataagaagccattttatctgtacacgggccggggcccctcttctgaagcaatgcatgtaggtcacctcattccatttattttcacaaagtggctccaggatgtatttaacgtgcccttggtcatccagatgacggatgacgagaagtatctgtggaaggacctgaccctggaccaggcctatagctatgctgtggagaatgccaaggacatcatcgcctgtggctttgacatcaacaagactttcatattctctgacctggactacatggggatgagctcaggtttctacaaaaatgtggtgaagattcaaaagcatgttaccttcaaccaagtgaaaggcattttcggcttcactgacagcgactgcattgggaagatcagttttcctgccatccaggctgctccctccttcagcaactcattcccacagatcttccgagacaggacggatatccagtgccttatcccatgtgccattgaccaggatccttactttagaatgacaagggacgtcgcccccaggatcggctatcctaaaccagccctgctgcactccaccttcttcccagccctgcagggcgcccagaccaaaatgagtgccagcgaccccaactcctccatcttcctcaccgacacggccaagcagatcaaaaccaaggtcaataagcatgcgttttctggagggagagacaccatcgaggagcacaggcagtttgggggcaactgtgatgtggacgtgtctttcatgtacctgaccttcttcctcgaggacgacgacaagctcgagcagatcaggaaggattacaccagcggagccatgctcaccggtgagctcaagaaggcactcatagaggttctgcagcccttgatcgcagagcaccaggcccggcgcaaggaggtcacggatgagatagtgaaagagttcatgactccccggaagctgtccttcgactttcagtagcactcgttttacatatgcttataaaagaagtgatgtatcagtaatgtatcaataatcccagcccagtcaaagcaccgccacctgtaggcttctgtctcatggtaattactgggcctggcctctgtaagcctgtgtatgttatcaatactgtttcttcctgtgagttccattatttctatctcttatgggcaaagcattgtgggtaattggtgctggctaacattgcatggtcggatagagaagtccagctgtgagtctctccccaaagcagccccacagtggagcctttggctggaagtccatgggccaccctgttcttgtccatggaggactccgagggttccaagtatactcttaagacccactctgtttaaaaatatatattctatgtatgcgtatatggaattgaaatgtcattattgtaacctagaaagtgctttgaaatattgatgtggggaggtttattgagcacaagatgtatttcagcccatgccccctcccaaaaagaaattgataagtaaaagcttcgttatacatttgactaagaaatcacccagctttaaagctgcttttaacaatgaagattgaacagagttcagcaattttgattaaattaagacttgggggtgaaactttccagtttactgaactccagaccatgcatgtagtccactccagaaatcatgctcgcttcccttggcacaccagtgttctcctgccaaatgaccctagaccctctgtcctgcagagtcagggtggcttttcccctgactgtgtccgatgccaaggagtcctggcctccgcagatgcttcattttgacccttggctgcagtggaagtcagcacagagcagtgccctggctgtgtccctggacgggtggacttagctagggagaaagtcgaggcagcagccctcgaggccctcacagatgtctaggcaggcctcatttcatcacgcagcatgtgcaggcctggaagagcaaagccaaatctcagggaagtccttggttgatgtatctgggtctcctctggagcactctgccctcctgtcacccag

SEQ ID NO: 195597 - DNA, 2466 bp, Homo sapiens
  Payload ID: 18614
  Gene Name: tryptophanyl-tRNA synthetase
  Uniprot ID: P23381
  ENST ID: ENST00000358655
  CDS Start-End: 101-1393
cggacggcgtttccacggacgcccaggagacagccggttgctgagccgggagcgctgactggcccggctgggcagggatgaaattgattctgcagtaaagatgttggtgtcattaaaaatgagctacaaagctgccgcgggggaggattacaaggctgactgtcctccagggaacccagcacctaccagtaatcatggcccagatgccacagaagctgaagaggattttgtggacccatggacagtacagacaagcagtgcaaaaggcatagactacgataagctcattgttcggtttggaagtagtaaaattgacaaagagctaataaaccgaatagagagagccaccggccaaagaccacaccacttcctgcgcagaggcatcttcttctcacacagagatatgaatcaggttcttgatgcctatgaaaataagaagccattttatctgtacacgggccggggcccctcttctgaagcaatgcatgtaggtcacctcattccatttattttcacaaagtggctccaggatgtatttaacgtgcccttggtcatccagatgacggatgacgagaagtatctgtggaaggacctgaccctggaccaggcctatagctatgctgtggagaatgccaaggacatcatcgcctgtggctttgacatcaacaagactttcatattctctgacctggactacatggggatgagctcaggtttctacaaaaatgtggtgaagattcaaaagcatgttaccttcaaccaagtgaaaggcattttcggcttcactgacagcgactgcattgggaagatcagttttcctgccatccaggctgctccctccttcagcaactcattcccacagatcttccgagacaggacggatatccagtgccttatcccatgtgccattgaccaggatccttactttagaatgacaagggacgtcgcccccaggatcggctatcctaaaccagccctgctgcactccaccttcttcccagccctgcagggcgcccagaccaaaatgagtgccagcgaccccaactcctccatcttcctcaccgacacggccaagcagatcaaaaccaaggtcaataagcatgcgttttctggagggagagacaccatcgaggagcacaggcagtttgggggcaactgtgatgtggacgtgtctttcatgtacctgaccttcttcctcgaggacgacgacaagctcgagcagatcaggaaggattacaccagcggagccatgctcaccggtgagctcaagaaggcactcatagaggttctgcagcccttgatcgcagagcaccaggcccggcgcaaggaggtcacggatgagatagtgaaagagttcatgactccccggaagctgtccttcgactttcagtagcactcgttttacatatgcttataaaagaagtgatgtatcagtaatgtatcaataatcccagcccagtcaaagcaccgccacctgtaggcttctgtctcatggtaattactgggcctggcctctgtaagcctgtgtatgttatcaatactgtttcttcctgtgagttccattatttctatctcttatgggcaaagcattgtgggtaattggtgctggctaacattgcatggtcggatagagaagtccagctgtgagtctctccccaaagcagccccacagtggagcctttggctggaagtccatgggccaccctgttcttgtccatggaggactccgagggttccaagtatactcttaagacccactctgtttaaaaatatatattctatgtatgcgtatatggaattgaaatgtcattattgtaacctagaaagtgctttgaaatattgatgtggggaggtttattgagcacaagatgtatttcagcccatgccccctcccaaaaagaaattgataagtaaaagcttcgttatacatttgactaagaaatcacccagctttaaagctgcttttaacaatgaagattgaacagagttcagcaattttgattaaattaagacttgggggtgaaactttccagtttactgaactccagaccatgcatgtagtccactccagaaatcatgctcgcttcccttggcacaccagtgttctcctgccaaatgaccctagaccctctgtcctgcagagtcagggtggcttttcccctgactgtgtccgatgccaaggagtcctggcctccgcagatgcttcattttgacccttggctgcagtggaagtcagcacagagcagtgccctggctgtgtccctggacgggtggacttagctagggagaaagtcgaggcagcagccctcgaggccctcacagatgtctaggcaggcctcatttcatcacgcagcatgtgcaggcctggaagagcaaagccaaatctcagggaagtccttggttgatgtatctgggtctcctctggagcactctgccctcctgtcacccagtagagtaaataaactt

SEQ ID NO: 195598 - DNA, 2938 bp, Homo sapiens
  Payload ID: 18614
  Gene Name: tryptophanyl-tRNA synthetase
  Uniprot ID: P23381
  ENST ID: ENST00000392882
  CDS Start-End: 436-1851
atttggaggccagcggggggtgaggggtggctgatgcaatgaccagctaatggctcgattctcaagagggtttcattggtctcaacctggccccccaggcaacccacccctgattggacagtctcatcaagaaggttggtcaagagctcaagtgtttctgagaatctgggtgatttataagaaacccttagctgaatgcagggtggggagaacgaaagacaaaagcatcttttttcagaagggaaactgaaagaaagaggggaagagtattaaagaccatttctggctgggcagggcactctcagcagctcaactgcccagcgtgaccagtggccacctctgcagtgtcttccacaacctggtcttgactcgtctgctgaacaaatcctctgacctcaggccggctgtgaacgtagttcctgagagatagcaaacatgcccaacagtgagcccgcatctctgctggagctgttcaacagcatcgccacacaaggggagctcgtaaggtccctcaaagcgggaaatgcgtcaaaggatgaaattgattctgcagtaaagatgttggtgtcattaaaaatgagctacaaagctgccgcgggggaggattacaaggctgactgtcctccagggaacccagcacctaccagtaatcatggcccagatgccacagaagctgaagaggattttgtggacccatggacagtacagacaagcagtgcaaaaggcatagactacgataagctcattgttcggtttggaagtagtaaaattgacaaagagctaataaaccgaatagagagagccaccggccaaagaccacaccacttcctgcgcagaggcatcttcttctcacacagagatatgaatcaggttcttgatgcctatgaaaataagaagccattttatctgtacacgggccggggcccctcttctgaagcaatgcatgtaggtcacctcattccatttattttcacaaagtggctccaggatgtatttaacgtgcccttggtcatccagatgacggatgacgagaagtatctgtggaaggacctgaccctggaccaggcctatagctatgctgtggagaatgccaaggacatcatcgcctgtggctttgacatcaacaagactttcatattctctgacctggactacatggggatgagctcaggtttctacaaaaatgtggtgaagattcaaaagcatgttaccttcaaccaagtgaaaggcattttcggcttcactgacagcgactgcattgggaagatcagttttcctgccatccaggctgctccctccttcagcaactcattcccacagatcttccgagacaggacggatatccagtgccttatcccatgtgccattgaccaggatccttactttagaatgacaagggacgtcgcccccaggatcggctatcctaaaccagccctgctgcactccaccttcttcccagccctgcagggcgcccagaccaaaatgagtgccagcgaccccaactcctccatcttcctcaccgacacggccaagcagatcaaaaccaaggtcaataagcatgcgttttctggagggagagacaccatcgaggagcacaggcagtttgggggcaactgtgatgtggacgtgtctttcatgtacctgaccttcttcctcgaggacgacgacaagctcgagcagatcaggaaggattacaccagcggagccatgctcaccggtgagctcaagaaggcactcatagaggttctgcagcccttgatcgcagagcaccaggcccggcgcaaggaggtcacggatgagatagtgaaagagttcatgactccccggaagctgtccttcgactttcagtagcactcgttttacatatgcttataaaagaagtgatgtatcagtaatgtatcaataatcccagcccagtcaaagcaccgccacctgtaggcttctgtctcatggtaattactgggcctggcctctgtaagcctgtgtatgttatcaatactgtttcttcctgtgagttccattatttctatctcttatgggcaaagcattgtgggtaattggtgctggctaacattgcatggtcggatagagaagtccagctgtgagtctctccccaaagcagccccacagtggagcctttggctggaagtccatgggccaccctgttcttgtccatggaggactccgagggttccaagtatactcttaagacccactctgtttaaaaatatatattctatgtatgcgtatatggaattgaaatgtcattattgtaacctagaaagtgctttgaaatattgatgtggggaggtttattgagcacaagatgtatttcagcccatgccccctcccaaaaagaaattgataagtaaaagcttcgttatacatttgactaagaaatcacccagctttaaagctgcttttaacaatgaagattgaacagagttcagcaattttgattaaattaagacttgggggtgaaactttccagtttactgaactccagaccatgcatgtagtccactccagaaatcatgctcgcttcccttggcacaccagtgttctcctgccaaatgaccctagaccctctgtcctgcagagtcagggtggcttttcccctgactgtgtccgatgccaaggagtcctggcctccgcagatgcttcattttgacccttggctgcagtggaagtcagcacagagcagtgccctggctgtgtccctggacgggtggacttagctagggagaaagtcgaggcagcagccctcgaggccctcacagatgtctaggcaggcctcatttcatcacgcagcatgtgcaggcctggaagagcaaagccaaatctcagggaagtccttggttgatgtatctgggtctcctctggagcactctgccctcctgtcacccagtagagtaaataaacttccttggctcctgct

SEQ ID NO: 195599 - DNA, 640 bp, Homo sapiens
  Payload ID: 18614
  Gene Name: tryptophanyl-tRNA synthetase
  ENST ID: ENST00000556698
  CDS Start-End: 183-640
actctcagcagctcaactgcccagcgtgaccagtggccacctctgcagtgtcttccacaacctggacaatggtccttaaccttttggcatctcagcctcctttcgaaagtcttgactcgtctgctgaacaaatcctctgacctcaggccggctgtgaacgtagttcctgagagatagcaaacatgcccaacagtgagcccgcatctctgctggagctgttcaacagcatcgccacacaaggggagctcgtaaggtccctcaaagcgggaaatgcgtcaaaggatgaaattgattctgcagtaaagatgttggtgtcattaaaaatgagctacaaagctgccgcgggggaggattacaaggctgactgtcctccagggaacccagcacctaccagtaatcatggcccagatgccacagaagctgaagaggattttgtggacccatggacagtacagacaagcagtgcaaaaggcatagactacgataagctcattgttcggtttggaagtagtaaaattgacaaagagctaataaaccgaatagagagagccaccggccaaagaccacaccacttcctgcgcagaggcatcttcttctcacacagagatatgaatcaggttcttgatgcctatgaaaataa

SEQ ID NO: 195600 - DNA, 848 bp, Homo sapiens
  Payload ID: 18614
  Gene Name: tryptophanyl-tRNA synthetase
  ENST ID: ENST00000557722
  CDS Start-End: 211-848
aggagacagccggttgctgagccgggagcgctgactggcccggctgggcaggatgttcctgaactccaagttgaaaaacctctgaagttcaactcaattctgaaagtcaacaaagaaataaaggaggatgtcaatagtcttgactcgtctgctgaacaaatcctctgacctcaggccggctgtgaacgtagttcctgagagatagcaaacatgcccaacagtgagcccgcatctctgctggagctgttcaacagcatcgccacacaaggggagctcgtaaggtccctcaaagcgggaaatgcgtcaaaggatgaaattgattctgcagtaaagatgttggtgtcattaaaaatgagctacaaagctgccgcgggggaggattacaaggctgactgtcctccagggaacccagcacctaccagtaatcatggcccagatgccacagaagctgaagaggattttgtggacccatggacagtacagacaagcagtgcaaaaggcatagactacgataagctcattgttcggtttggaagtagtaaaattgacaaagagctaataaaccgaatagagagagccaccggccaaagaccacaccacttcctgcgcagaggcatcttcttctcacacagagatatgaatcaggttcttgatgcctatgaaaataagaagccattttatctgtacacgggccggggcccctcttctgaagcaatgcatgtaggtcacctcattccatttattttcacaaagtggctccaggatgtatttaacgtgcccttggtcatccagatgacggatgacgagaagtatctgtggaaggacctgaccctggaccaggcctatag

SEQ ID NO: 195601 - DNA, 538 bp, Homo sapiens
  Payload ID: 18614
  Gene Name: tryptophanyl-tRNA synthetase
  ENST ID: ENST00000554820
  CDS Start-End: 281-538
gtgatttataagaaacccttagctgaatgcagggtggggagaacgaaagacaaaagcatcttttttcagaagggaaactgaaagaaagaggggaagagtattaaagaccatttctggctgggcagggcactctcagcagctcaactgcccagcgtgaccagtggccacctctgcagtgtcttccacaacctggcctcctttcgaaagtcttgactcgtctgctgaacaaatcctctgacctcaggccggctgtgaacgtagttcctgagagatagcaaacatgcccaacagtgagcccgcatctctgctggagctgttcaacagcatcgccacacaaggggagctcgtaaggtccctcaaagcgggaaatgcgtcaaaggatgaaattgattctgcagtaaagatgttggtgtcattaaaaatgagctacaaagctgccgcgggggaggattacaaggctgactgtcctccagggaacccagcacctaccagtaatcatggcccagatgccacagaagctgaagaggattttgtggac

SEQ ID NO: 195602 - DNA, 658 bp, Homo sapiens
  Payload ID: 18614
  Gene Name: tryptophanyl-tRNA synthetase
  ENST ID: ENST00000555031
  CDS Start-End: 494-658
ggctcgattctcaagagggtttcattggtctcaacctggccccccaggcaacccacccctgattggacagtctcatcaagaaggttggtcaagagctcaagtgtttctgagaatctgggtgatttataagaaacccttagctgaatgcagggtggggagaacgaaagacaaaagcatcttttttcagaagggaaactgaaagaaagaggggaagagtattaaagaccatttctggctgggcagggcactctcagcagctcaactgcccagcgtgaccagtggccacctctgcagtgtcttccacaacctgggtgaatctacttctcttaacaaagtctcaatgtcctatttgcaatttatgtggtaaacactgaagacaatggtccttaaccttttggcatctcagcctcctttcgaaagtcttgactcgtctgctgaacaaatcctctgacctcaggccggctgtgaacgtagttcctgagagatagcaaacatgcccaacagtgagcccgcatctctgctggagctgttcaacagcatcgccacacaaggggagctcgtaaggtccctcaaagcgggaaatgcgtcaaaggatgaaattgattctgcagtaaagatgttggtgtcattaaaaatgagctacaaagctgccgcgggg

SEQ ID NO: 195603 - DNA, 677 bp, Homo sapiens
  Payload ID: 18614
  Gene Name: tryptophanyl-tRNA synthetase
  ENST ID: ENST00000555410
  CDS Start-End: 147-677
ggcagggcactctcagcagctcaactgcccagcgtgaccagtggccacctctgcagtgtcttccacaacctggtcttgactcgtctgctgaacaaatcctctgacctcaggccggctgtgaacgtagttcctgagagatagcaaacatgcccaacagtgagcccgcatctctgctggagctgttcaacagcatcgccacacaaggggagctcgtaaggtccctcaaagcgggaaatgcgtcaaaggctgagtctcactctgtcgcccaggctggagtgcactggcacagtcttggctcactacaacctctgcctcctgagttcgagcgattctcctgccctggcctcgatgaaattgattctgcagtaaagatgttggtgtcattaaaaatgagctacaaagctgccgcgggggaggattacaaggctgactgtcctccagggaacccagcacctaccagtaatcatggcccagatgccacagaagctgaagaggattttgtggacccatggacagtacagacaagcagtgcaaaaggcatagactacgataagctcattgttcggtttggaagtagtaaaattgacaaagagctaataaaccgaatagagagagccaccggccaaagaccacaccacttcctgcgcagaggcatcttcttctcacacagagatatg

SEQ ID NO: 195604 - DNA, 560 bp, Homo sapiens
  Payload ID: 18614
  Gene Name: tryptophanyl-tRNA synthetase
  ENST ID: ENST00000554605
  CDS Start-End: 357-560
gagacagccggttgctgagccgggagcgctgactggcccggctgggcaggaagggaaactgaaagaaagaggggaagagtattaaagaccatttctggctgggcagggcactctcagcagctcaactgcccagcgtgaccagtggccacctctgcagtgtcttccacaacctgggtgaatctacttctcttaacaaagtctcaatgtcctatttgcaatttatgtggtaaacactgaagacaatggtccttaaccttttggcatctcagcctcctttcgaaagtcttgactcgtctgctgaacaaatcctctgacctcaggccggctgtgaacgtagttcctgagagatagcaaacatgcccaacagtgagcccgcatctctgctggagctgttcaacagcatcgccacacaaggggagctcgtaaggtccctcaaagcgggaaatgcgtcaaaggatgaaattgattctgcagtaaagatgttggtgtcattaaaaatgagctacaaagctgccgcgggggaggattacaaggctgactgtcctccagggaacccagca

SEQ ID NO: 195605 - DNA, 564 bp, Homo sapiens
  Payload ID: 18614
  Gene Name: tryptophanyl-tRNA synthetase
  ENST ID: ENST00000556209
  CDS Start-End: 354-564
agcgctgactggcccggctgggcaggaagggaaactgaaagaaagaggggaagagtattaaagaccatttctggctgggcagggcactctcagcagctcaactgcccagcgtgaccagtggccacctctgcagtgtcttccacaacctggagtgtactatttgttaaacaggtgaatctacttctcttaacaaagtctcaatgtcctatttgcaatttatgtggtaaacactgaagacaatggtccttaaccttttggcatctcagcctcctttcgaaagtcttgactcgtctgctgaacaaatcctctgacctcaggccggctgtgaacgtagttcctgagagatagcaaacatgcccaacagtgagcccgcatctctgctggagctgttcaacagcatcgccacacaaggggagctcgtaaggtccctcaaagcgggaaatgcgtcaaaggatgaaattgattctgcagtaaagatgttggtgtcattaaaaatgagctacaaagctgccgcgggggaggattacaaggctgactgtcctccagggaacccagcacctacca

SEQ ID NO: 195606 - DNA, 847 bp, Homo sapiens
  Payload ID: 18614
  Gene Name: tryptophanyl-tRNA synthetase
  ENST ID: ENST00000556504
  CDS Start-End: 177-847
ggagcgctgactggcccggctgggcaggaagggaaactgaaagaaagaggggaagagtattaaagaccatttctggctgggcagggcactctcagcagctcaactgcccagcgtgaccagtggccacctctgcagtgtcttccacaacctgggatgaaattgattctgcagtaaagatgttggtgtcattaaaaatgagctacaaagctgccgcgggggaggattacaaggctgactgtcctccagggaacccagcacctaccagtaatcatggcccagatgccacagaagctgaagaggattttgtggacccatggacagtacagacaagcagtgcaaaaggcatagactacgataagctcattgttcggtttggaagtagtaaaattgacaaagagctaataaaccgaatagagagagccaccggccaaagaccacaccacttcctgcgcagaggcatcttcttctcacacagagatatgaatcaggttcttgatgcctatgaaaataagaagccattttatctgtacacgggccggggcccctcttctgaagcaatgcatgtaggtcacctcattccatttattttcacaaagtggctccaggatgtatttaacgtgcccttggtcatccagatgacggatgacgagaagtatctgtggaaggacctgaccctggaccaggcctatagctatgctgtggagaatgccaaggacatcatcgcctgtggctttgacatcaacaagactttcatattctctgacctggactacatggggatgagctcaggtttctacaaaaatgtggtgaagattcaaaagcatgttaccttcaaccaagtgaaagg

SEQ ID NO: 195607 - DNA, 707 bp, Homo sapiens
  Payload ID: 18614
  Gene Name: tryptophanyl-tRNA synthetase
  ENST ID: ENST00000553524
  CDS Start-End: 258-707
ggacggcgtttccacggacgcccaggagacagccggttgctgagccgggagcgctgactggcccggctgggcagggtgaatctacttctcttaacaaagtctcaatgtcctatttgcaatttatgtggtaaacactgaagacaatggtccttaaccttttggcatctcagcctcctttcgaaagtcttgactcgtctgctgaacaaatcctctgacctcaggccggctgtgaacgtagttcctgagagatagcaaacatgcccaacagtgagcccgcatctctgctggagctgttcaacagcatcgccacacaaggggagctcgtaaggtccctcaaagcgggaaatgcgtcaaaggatgaaattgattctgcagtaaagatgttggtgtcattaaaaatgagctacaaagctgccgcgggggaggattacaaggctgactgtcctccagggaacccagcacctaccagtaatcatggcccagatgccacagaagctgaagaggattttgtggacccatggacagtacagacaagcagtgcaaaaggcatagactacgataagctcattgttcggtttggaagtagtaaaattgacaaagagctaataaaccgaatagagagagccaccggccaaagaccacaccacttcctgcgcagaggcatcttcttctcacacagagatatgaatcaggttcttgatgcctat

SEQ ID NO: 195608 - DNA, 517 bp, Homo sapiens
  Payload ID: 18614
  Gene Name: tryptophanyl-tRNA synthetase
  ENST ID: ENST00000556295
  CDS Start-End: 344-517
taagaaacccttagctgaatgcagggtggggagaacgaaagacaaaagcatcttttttcagaagggaaactgaaagaaagaggggaagagtattaaagaccatttctggctgggcagggcactctcagcagctcaactgcccagcgtgaccagtggccacctctgcagtgtcttccacaacctggatgttcctgaactccaagttgaaaaacctctgaagttcaactcaattctgaaagtcaacaaagaaataaaggaggatgtcaatagtcttgactcgtctgctgaacaaatcctctgacctcaggccggctgtgaacgtagttcctgagagatagcaaacatgcccaacagtgagcccgcatctctgctggagctgttcaacagcatcgccacacaaggggagctcgtaaggtccctcaaagcgggaaatgcgtcaaaggatgaaattgattctgcagtaaagatgttggtgtcattaaaaatgagctacaaagctgccgcgggggaggattac

SEQ ID NO: 195609 - DNA, 584 bp, Homo sapiens
  Payload ID: 18614
  Gene Name: tryptophanyl-tRNA synthetase
  ENST ID: ENST00000556660
  CDS Start-End: 241-584
aatgtctttgccttttaagataatgttcatgctgttatttggcggggaaagcaatctttcttttagtgtttaaaaaaaatggaacatgatgggtcccaaaaggtgtcaagaaatccttgctctaaagaagtcattttcttgtcctctgggaacttgccagtccaaagtcttgactcgtctgctgaacaaatcctctgacctcaggccggctgtgaacgtagttcctgagagatagcaaacatgcccaacagtgagcccgcatctctgctggagctgttcaacagcatcgccacacaaggggagctcgtaaggtccctcaaagcgggaaatgcgtcaaaggatgaaattgattctgcagtaaagatgttggtgtcattaaaaatgagctacaaagctgccgcgggggaggattacaaggctgactgtcctccagggaacccagcacctaccagtaatcatggcccagatgccacagaagctgaagaggattttgtggacccatggacagtacagacaagcagtgcaaaaggcatagactacgataagctcattgttcggtttggaagtagtaaaattgacaaaga

SEQ ID NO: 195610 - DNA, 2080 bp, Homo sapiens
  Payload ID: 18614
  Gene Name: tryptophanyl-tRNA synthetase
  Uniprot ID: P23381
  ENST ID: ENST00000557135
  CDS Start-End: 269-1684
actctcagcagctcaactgcccagcgtgaccagtggccacctctgcagtgtcttccacaacctggagtgtactatttgttaaacaggtgaatctacttctcttaacaaagtctcaatgtcctatttgcaatttatgtggtaaacactgaagacaatggtccttaaccttttggcatctcagcctcctttcgaaagtcttgactcgtctgctgaacaaatcctctgacctcaggccggctgtgaacgtagttcctgagagatagcaaacatgcccaacagtgagcccgcatctctgctggagctgttcaacagcatcgccacacaaggggagctcgtaaggtccctcaaagcgggaaatgcgtcaaaggatgaaattgattctgcagtaaagatgttggtgtcattaaaaatgagctacaaagctgccgcgggggaggattacaaggctgactgtcctccagggaacccagcacctaccagtaatcatggcccagatgccacagaagctgaagaggattttgtggacccatggacagtacagacaagcagtgcaaaaggcatagactacgataagctcattgttcggtttggaagtagtaaaattgacaaagagctaataaaccgaatagagagagccaccggccaaagaccacaccacttcctgcgcagaggcatcttcttctcacacagagatatgaatcaggttcttgatgcctatgaaaataagaagccattttatctgtacacgggccggggcccctcttctgaagcaatgcatgtaggtcacctcattccatttattttcacaaagtggctccaggatgtatttaacgtgcccttggtcatccagatgacggatgacgagaagtatctgtggaaggacctgaccctggaccaggcctatagctatgctgtggagaatgccaaggacatcatcgcctgtggctttgacatcaacaagactttcatattctctgacctggactacatggggatgagctcaggtttctacaaaaatgtggtgaagattcaaaagcatgttaccttcaaccaagtgaaaggcattttcggcttcactgacagcgactgcattgggaagatcagttttcctgccatccaggctgctccctccttcagcaactcattcccacagatcttccgagacaggacggatatccagtgccttatcccatgtgccattgaccaggatccttactttagaatgacaagggacgtcgcccccaggatcggctatcctaaaccagccctgctgcactccaccttcttcccagccctgcagggcgcccagaccaaaatgagtgccagcgaccccaactcctccatcttcctcaccgacacggccaagcagatcaaaaccaaggtcaataagcatgcgttttctggagggagagacaccatcgaggagcacaggcagtttgggggcaactgtgatgtggacgtgtctttcatgtacctgaccttcttcctcgaggacgacgacaagctcgagcagatcaggaaggattacaccagcggagccatgctcaccggtgagctcaagaaggcactcatagaggttctgcagcccttgatcgcagagcaccaggcccggcgcaaggaggtcacggatgagatagtgaaagagttcatgactccccggaagctgtccttcgactttcagtagcactcgttttacatatgcttataaaagaagtgatgtatcagtaatgtatcaataatcccagcccagtcaaagcaccgccacctgtaggcttctgtctcatggtaattactgggcctggcctctgtaagcctgtgtatgttatcaatactgtttcttcctgtgagttccattatttctatctcttatgggcaaagcattgtgggtaattggtgctggctaacattgcatggtcggatagagaagtccagctgtgagtctctccccaaagcagccccacagtggagcctttggctggaagtccatgggccaccctgttcttgtccatggaggactccgagggttccaagtatactcttaagacccactctgtttaaaaatatatattctatgtatgcg

SEQ ID NO: 195611 - DNA, 562 bp, Homo sapiens
  Payload ID: 18614
  Gene Name: tryptophanyl-tRNA synthetase
  ENST ID: ENST00000554772
  CDS Start-End: 190-562
gacagccggttgctgagccgggagcgctgactggcccggctgggcaggggcactctcagcagctcaactgcccagcgtgaccagtggccacctctgcagtgtcttccacaacctggtcttgactcgtctgctgaacaaatcctctgacctcaggccggctgtgaacgtagttcctgagagatagcaaacatgcccaacagtgagcccgcatctctgctggagctgttcaacagcatcgccacacaaggggagctcgtaaggtccctcaaagcgggaaatgcgtcaaaggatgaaattgattctgcagtaaagatgttggtgtcattaaaaatgagctacaaagctgccgcgggggaggattacaaggctgactgtcctccagggaacccagcacctaccagtaatcatggcccagatgccacagaagctgaagaggattttgtggacccatggacagtacagacaagcagtgcaaaaggcatagactacgataagctcattgttcggtttggaagtagtaaaattgacaaagagctaataaaccgaatagagagagccaccg

SEQ ID NO: 195612 - DNA, 801 bp, Homo sapiens
  Payload ID: 18614
  Gene Name: tryptophanyl-tRNA synthetase
  ENST ID: ENST00000553395
  CDS Start-End: 122-801
aatgaccagctaatggctcgattctcaagagggtttcattggtctcaacctggccccccaggcaacccacccctgattggacagtctcatcaagaaggatgaaattgattctgcagtaaagatgttggtgtcattaaaaatgagctacaaagctgccgcgggggaggattacaaggctgactgtcctccagggaacccagcacctaccagtaatcatggcccagatgccacagaagctgaagaggattttgtggacccatggacagtacagacaagcagtgcaaaaggcatagactacgataagctcattgttcggtttggaagtagtaaaattgacaaagagctaataaaccgaatagagagagccaccggccaaagaccacaccacttcctgcgcagaggcatcttcttctcacacagagatatgaatcaggttcttgatgcctatgaaaataagaagccattttatctgtacacgggccggggcccctcttctgaagcaatgcatgtaggtcacctcattccatttattttcacaaagtggctccaggatgtatttaacgtgcccttggtcatccagatgacggatgacgagaagtatctgtggaaggacctgaccctggaccaggcctatagctatgctgtggagaatgccaaggacatcatcgcctgtggctttgacatcaacaagactttcatattctctgacctggactacatggggatgagctcaggtttctacaaaaatgtggtgaagattcaaaagcatgttaccttcaaccaagtgaaaggcattttcgg

SEQ ID NO: 195613 - DNA, 547 bp, Homo sapiens
  Payload ID: 18614
  Gene Name: tryptophanyl-tRNA synthetase
  ENST ID: ENST00000556338
  CDS Start-End: 127-547
gatgcaatgaccagctaatggctcgattctcaagagggtttcattggtctcaacctggccccccaggcaacccacccctgattggacagtctcatcaagaaggatgaaattgattctgcagtaaagatgttggtgtcattaaaaatgagctacaaagctgccgcgggggaggattacaaggctgactgtcctccagggaacccagcacctaccagtaatcatggcccagatgccacagaagctgaagaggattttgtggacccatggacagtacagacaagcagtgcaaaaggcatagactacgataagctcattgttcggtttggaagtagtaaaattgacaaagagctaataaaccgaatagagagagccaccggccaaagaccacaccacttcctgcgcagaggcatcttcttctcacacagagatatgaatcaggttcttgatgcctatgaaaataagaagccattttatctgtacacgggccggggcccctcttctgaagcaatgcatgtaggtcacctcattccatttattttcacaaagt

SEQ ID NO: 195614 - DNA, 821 bp, Homo sapiens
  Payload ID: 18614
  Gene Name: tryptophanyl-tRNA synthetase
  ENST ID: ENST00000557297
  CDS Start-End: 359-821
aactgcccagcgtgaccagtggccacctctgcagtgtcttccacaacctggagtgtactatttgttaaacaggtgaatctacttctcttaacaaagtctcaatgtcctatttgcaatttatgtggtaaacactgaagacaatggtccttaaccttttggcatctcagcctcctttcgaaagtcttgactcgtctgctgaacaaatcctctgacctcaggccggctgtgaacgtagttcctgagagatagcaaacatgcccaacagtgagcccgcatctctgctggagctgttcaacagcatcgccacacaaggggagctcgtaaggtccctcaaagcgggaaatgcgtcaaagtaaagatgttggtgtcattaaaaatgagctacaaagctgccgcgggggaggattacaaggctgactgtcctccagggaacccagcacctaccagtaatcatggcccagatgccacagaagctgaagaggattttgtggacccatggacagtacagacaagcagtgcaaaaggcatagactacgataagctcattgttcggtttggaagtagtaaaattgacaaagagctaataaaccgaatagagagagccaccggccaaagaccacaccacttcctgcgcagaggcatcttcttctcacacagagatatgaatcaggttcttgatgcctatgaaaataagaagccattttatctgtacacgggccggggcccctcttctgaagcaatgcatgtaggtcacctcattccatttattttcacaaagtggctccaggatgtatttaacgtgcccttggtcatccagatga

SEQ ID NO: 195615 - DNA, 567 bp, Homo sapiens
  Payload ID: 18614
  Gene Name: tryptophanyl-tRNA synthetase
  ENST ID: ENST00000556783
  CDS Start-End: 120-230
cagccggttgctgagccgggagcgctgactggcccggctgggcaggtcttgactcgtctgctgaacaaatcctctgacctcaggccggctgtgaacgtagttcctgagagatagcaaacatgcccaacagtgagcccgcatctctgctggagctgttcaacagcatcgccacacaaggggagctcgtaaggtccctcaaagcgggaaatgcgtcaaaggggaaactgtgacactcccttggccgaggggagagggattctcaataactgcttcttgaagagacttcaaccagcgctcctgttttcataacccgctttcctgcccccactcctgatgaaattgattctgcagtaaagatgttggtgtcattaaaaatgagctacaaagctgccgcgggggaggattacaaggctgactgtcctccagggaacccagcacctaccagtaatcatggcccagatgccacagaagctgaagaggattttgtggacccatggacagtacagacaagcagtgcaaaaggcatagactacgataagctcattgttcggtttggaagtagtaaaa

SEQ ID NO: 195616 - DNA, 591 bp, Homo sapiens
  Payload ID: 18614
  Gene Name: tryptophanyl-tRNA synthetase
  ENST ID: ENST00000553545
  CDS Start-End: 301-591
aatgaccagctaatggctcgattctcaagagggtttcattggtctcaacctggccccccaggcaacccacccctgattggacagtctcatcaagaagagtgtactatttgttaaacaggtgaatctacttctcttaacaaagtctcaatgtcctatttgcaatttatgtggtaaacactgaagacaatggtccttaaccttttggcatctcagcctcctttcgaaagtcttgactcgtctgctgaacaaatcctctgacctcaggccggctgtgaacgtagttcctgagagatagcaaacatgcccaacagtgagcccgcatctctgctggagctgttcaacagcatcgccacacaaggggagctcgtaaggtccctcaaagcgggaaatgcgtcaaaggatgaaattgattctgcagtaaagatgttggtgtcattaaaaatgagctacaaagctgccgcgggggaggattacaaggctgactgtcctccagggaacccagcacctaccagtaatcatggcccagatgccacagaagctgaagaggattttgtggacccatggacagtacagacaagcagtgcaaaaggc

SEQ ID NO: 195617 - DNA, 553 bp, Homo sapiens
  Payload ID: 18614
  Gene Name: tryptophanyl-tRNA synthetase
  ENST ID: ENST00000556695
  CDS Start-End: 378-553
agaaattaatgtctttgccttttaagataatgttcatgctgttatttggcggggaaagcaatctttcttttagtgtttaaaaaaaatggaacatgatgggtcccaaaaggtgtcaagaaatccttgctctaaagaagtcattttcttgtcctctgggaacttgccagtccaaagagtgtactatttgttaaacaggtgaatctacttctcttaacaaagtctcaatgtcctatttgcaatttatgtggtaaacactgaagacaatggtccttaaccttttggcatctcagcctcctttcgaaagtcttgactcgtctgctgaacaaatcctctgacctcaggccggctgtgaacgtagttcctgagagatagcaaacatgcccaacagtgagcccgcatctctgctggagctgttcaacagcatcgccacacaaggggagctcgtaaggtccctcaaagcgggaaatgcgtcaaaggatgaaattgattctgcagtaaagatgttggtgtcattaaaaatgagctacaaagctgccgcgggggaggattacaa

SEQ ID NO: 195618 - DNA, 2508 bp, Homo sapiens
  Payload ID: 18614
  Gene Name: tryptophanyl-tRNA synthetase
  Uniprot ID: P23381
  ENST ID: ENST00000556645
  CDS Start-End: 834-2126
ggggagtaaggccggggcggagtgaggaaacaagggagggagtgatggagggacgctggcgcggcgcccagtggcctggccctcccgggagtatccttagagcccggcttgctgcccgccgcgttctggcactgtgaggcgcggagcctgccaccgacccctcgcccctttcctctgagcgccgccgacccaccccgtctccctttcccactggcacccttcatcgtctccgcctgttcgcttttcccgaggagagaggcccccatttttatttagcgcctgccatgtgccagaggctttgcgtagtgttgcacttagtcccctcaacggtaatgttagcaggcttctccatgcccattccacagatgaggaaaccgaaggggaagcagaaaagtaatgcgacccttgcccaaggtttcgaataagtccaagctgggattgaaacccaggcgtctgtgaccccagaactcctgatctttccactgcactgtgccgcctcggtgaacagatgcggggaatttacagtttctctttccaccgcccacgactacacaaaatcagtcacactgacgctgagggtggggaacgggaagagggtggggaggttatttggaggccagcggggggtgaggggtggctgatgcaatgaccagctaatggctcgattctcaagagggtttcattggtctcaacctggccccccaggcaacccacccctgattggacagtctcatcaagaagggcactctcagcagctcaactgcccagcgtgaccagtggccacctctgcagtgtcttccacaacctgggatgaaattgattctgcagtaaagatgttggtgtcattaaaaatgagctacaaagctgccgcgggggaggattacaaggctgactgtcctccagggaacccagcacctaccagtaatcatggcccagatgccacagaagctgaagaggattttgtggacccatggacagtacagacaagcagtgcaaaaggcatagactacgataagctcattgttcggtttggaagtagtaaaattgacaaagagctaataaaccgaatagagagagccaccggccaaagaccacaccacttcctgcgcagaggcatcttcttctcacacagagatatgaatcaggttcttgatgcctatgaaaataagaagccattttatctgtacacgggccggggcccctcttctgaagcaatgcatgtaggtcacctcattccatttattttcacaaagtggctccaggatgtatttaacgtgcccttggtcatccagatgacggatgacgagaagtatctgtggaaggacctgaccctggaccaggcctatagctatgctgtggagaatgccaaggacatcatcgcctgtggctttgacatcaacaagactttcatattctctgacctggactacatggggatgagctcaggtttctacaaaaatgtggtgaagattcaaaagcatgttaccttcaaccaagtgaaaggcattttcggcttcactgacagcgactgcattgggaagatcagttttcctgccatccaggctgctccctccttcagcaactcattcccacagatcttccgagacaggacggatatccagtgccttatcccatgtgccattgaccaggatccttactttagaatgacaagggacgtcgcccccaggatcggctatcctaaaccagccctgctgcactccaccttcttcccagccctgcagggcgcccagaccaaaatgagtgccagcgaccccaactcctccatcttcctcaccgacacggccaagcagatcaaaaccaaggtcaataagcatgcgttttctggagggagagacaccatcgaggagcacaggcagtttgggggcaactgtgatgtggacgtgtctttcatgtacctgaccttcttcctcgaggacgacgacaagctcgagcagatcaggaaggattacaccagcggagccatgctcaccggtgagctcaagaaggcactcatagaggttctgcagcccttgatcgcagagcaccaggcccggcgcaaggaggtcacggatgagatagtgaaagagttcatgactccccggaagctgtccttcgactttcagtagcactcgttttacatatgcttataaaagaagtgatgtatcagtaatgtatcaataatcccagcccagtcaaagcaccgccacctgtaggcttctgtctcatggtaattactgggcctggcctctgtaagcctgtgtatgttatcaatactgtttcttcctgtgagttccattatttctatctcttatgggcaaagcattgtgggtaattggtgctggctaacattgcatggtcggatagagaagtccagctgtgagtctctccccaaagcagccccacagtggagcctttggctggaagtccatgggccaccctgttcttgtccatggaggactccgagggttccaagtatactcttaagacccactctgtttaaaaatatat

SEQ ID NO: 195619 - DNA, 719 bp, Homo sapiens
  Payload ID: 18614
  Gene Name: tryptophanyl-tRNA synthetase
  ENST ID: ENST00000554601
  CDS Start-End: 1-557
acaaaaatgtggtgaagattcaaaagcatgttaccttcaaccaagtgaaaggcattttcggcttcactgacagcgactgcattgggaagatcagttttcctgccatccaggctgctccctccttcagcaactcattcccacagatcttccgagacaggacggatatccagtgccttatcccatgtgccattgaccaggatccttactttagaatgacaagggacgtcgcccccaggatcggctatcctaaaccagccctgctgcactccaccttcttcccagccctgcagggcgcccagaccaaaatgagtgccagcgaccccaactcctccatcttcctcaccgacacggccaagcagatcaaaaccaaggtgagcagtggcccaggcagagggcagccagcgggatcagaaacatgccctggggggcacacgcacacacacaccactgcgcagtgctttgggcctcagccacccagccaccgtagcaatgctgaactccaggattgccaactttgctccctgcagaactcaaggcagcctgtccttcccacatgaatcaggtgaatttgttttgtgtcctttcatttaggtaaaattttgaattttttttctttttttccttttctgcttttcttatcagcactgttctgcaggcaaagtcatggcaatttccttaaagttataattagtgtggatgttattaaataatggaaaaga

SEQ ID NO: 195620 - DNA, 563 bp, Homo sapiens
  Payload ID: 18614
  Gene Name: tryptophanyl-tRNA synthetase
  ENST ID: ENST00000554509
  CDS Start-End: 248-563
actctcagcagctcaactgcccagcgtgaccagtggccacctctgcagtgtcttccacaacctgggtgaatctacttctcttaacaaagtctcaatgtcctatttgcaatttatgtggtaaacactgaagacaatggtccttaaccttttggcatctcagcctcctttcgaaagtcttgactcgtctgctgaacaaatcctctgacctcaggccggctgtgaacgtagttcctgagagatagcaaacatgcccaacagtgagcccgcatctctgctggagctgttcaacagcatcgccacacaaggggagctcgtaaggtccctcaaagcgggaaatgcgtcaaaggctgagtctcactctgtcgcccaggctggagtgcactggcacagtcttggctcactacaacctctgcctcctgagttcgagcgattctcctgccctggcctcgatgaaattgattctgcagtaaagatgttggtgtcattaaaaatgagctacaaagctgccgcgggggaggattacaaggctgactgtcctccagggaacccagcacctaccagta

SEQ ID NO: 195621 - DNA, 560 bp, Homo sapiens
  Payload ID: 18614
  Gene Name: tryptophanyl-tRNA synthetase
  ENST ID: ENST00000553769
  CDS Start-End: 248-560
gagacagccggttgctgagccgggagcgctgactggcccggctgggcaggaagggaaactgaaagaaagaggggaagagtattaaagaccatttctggctgggcagggcactctcagcagctcaactgcccagcgtgaccagtggccacctctgcagtgtcttccacaacctggtcttgactcgtctgctgaacaaatcctctgacctcaggccggctgtgaacgtagttcctgagagatagcaaacatgcccaacagtgagcccgcatctctgctggagctgttcaacagcatcgccacacaaggggagctcgtaaggtccctcaaagcgggaaatgcgtcaaaggatgaaattgattctgcagtaaagatgttggtgtcattaaaaatgagctacaaagctgccgcgggggaggattacaaggctgactgtcctccagggaacccagcacctaccagtaatcatggcccagatgccacagaagctgaagaggattttgtggacccatggacagtacagacaagcagtgcaaaaggcatagactacgataagctcattg

SEQ ID NO: 195622 - DNA, 577 bp, Homo sapiens
  Payload ID: 18614
  Gene Name: tryptophanyl-tRNA synthetase
  ENST ID: ENST00000557347
  CDS Start-End: 267-389
gtgatttataagaaacccttagctgaatgcagggtggggagaacgaaagacaaaagcatcttttttcagaagggaaactgaaagaaagaggggaagagtattaaagaccatttctggctgggcagggcactctcagcagctcaactgcccagcgtgaccagtggccacctctgcagtgtcttccacaacctggtcttgactcgtctgctgaacaaatcctctgacctcaggccggctgtgaacgtagttcctgagagatagcaaacatgcccaacagtgagcccgcatctctgctggagctgttcaacagcatcgccacacaaggggagctcgtaaggtccctcaaagcgggaaatgcgtcaaagttggggtctttcaggtggaaatgaagcattcgtaccttcacaaccacttcccgtccaggcagtctccccatctgtattgcagttgtagttaggatgaaattgattctgcagtaaagatgttggtgtcattaaaaatgagctacaaagctgccgcgggggaggattacaaggctgactgtcctccagggaacccagcacctaccagtaatcat

SEQ ID NO: 195623 - DNA, 410 bp, Homo sapiens
  Payload ID: 18614
  Gene Name: tryptophanyl-tRNA synthetase
  ENST ID: ENST00000555813
  CDS Start-End: 221-410
ctcagcagctcaactgcccagcgtgaccagtggccacctctgcagtgtcttccacaacctggtctcaatgtcctatttgcaatttatgtggtaaacactgaagacaatggtccttaaccttttggcatctcagcctcctttcgaaagtcttgactcgtctgctgaacaaatcctctgacctcaggccggctgtgaacgtagttcctgagagatagcaaacatgcccaacagtgagcccgcatctctgctggagctgttcaacagcatcgccacacaaggggagctcgtaaggtccctcaaagcgggaaatgcgtcaaaggatgaaattgattctgcagtaaagatgttggtgtcattaaaaatgagctacaaagctgccgcgggggaggattacaaggctgactgtcctc

SEQ ID NO: 195624 - DNA, 572 bp, Homo sapiens
  Payload ID: 18614
  Gene Name: tryptophanyl-tRNA synthetase
  ENST ID: ENST00000553581
  CDS Start-End: 496-572
agacagccggttgctgagccgggagcgctgactggcccggctgggcagggcaacccacccctgattggacagtctcatcaagaaggttggtcaagagctcaagtgtttctgagaatctgggtgatttataagaaacccttagctgaatgcagggtggggagaacgaaagacaaaagcatcttttttcagaagggaaactgaaagaaagaggggaagagtattaaagaccatttctggctgggcagggcactctcagcagctcaactgcccagcgtgaccagtggccacctctgcagtgtcttccacaacctgggtgaatctacttctcttaacaaagtctcaatgtcctatttgcaatttatgtggtaaacactgaagacaatggtccttaaccttttggcatctcagcctcctttcgaaagtcttgactcgtctgctgaacaaatcctctgacctcaggccggctgtgaacgtagttcctgagagatagcaaacatgcccaacagtgagcccgcatctctgctggagctgttcaacagcatcgccacacaaggggagctcgtaaggtccct

SEQ ID NO: 195625 - DNA, 530 bp, Homo sapiens
  Payload ID: 18614
  Gene Name: tryptophanyl-tRNA synthetase
  ENST ID: ENST00000553934
  CDS Start-End: 432-530
gatgcggggaatttacagtttctctttccaccgcccacgactacacaaaatcagtcacactgacgctgagggtggggaacgggaagagggtggggaggttatttggaggccagcggggggtgaggggtggctgatgcaatgaccagctaatggctcgattctcaagagggtttcattggtctcaacctggccccccaggcaacccacccctgattggacagtctcatcaagaagaagggaaactgaaagaaagaggggaagagtattaaagaccatttctggctgggcagggcactctcagcagctcaactgcccagcgtgaccagtggccacctctgcagtgtcttccacaacctggtcttgactcgtctgctgaacaaatcctctgacctcaggccggctgtgaacgtagttcctgagagatagcaaacatgcccaacagtgagcccgcatctctgctggagctgttcaacagcatcgccacacaaggggagctcgtaaggtccctcaaagcgggaaatgcgtcaaag

SEQ ID NO: 195626 - DNA, 528 bp, Homo sapiens
  Payload ID: 18614
  Gene Name: tryptophanyl-tRNA synthetase
  ENST ID: ENST00000556435
  CDS Start-End: 68-528
ccggttgctgagccgggagcgctgactggcccggctgggcagggatgaaattgattctgcagtaaagatgttggtgtcattaaaaatgagctacaaagctgccgcgggggaggattacaaggctgactgtcctccagggaacccagcacctaccagtaatcatggcccagatgccacagaagctgaagaggattttgtggacccatggacagtacagacaagcagtgcaaaaggcatagactacgataagctcattgttcggtttggaagtagtaaaattgacaaagagctaataaaccgaatagagagagccaccggccaaagaccacaccacttcctgcgcagaggcatcttcttctcacacagagatatgaatcaggttcttgatgcctatgaaaataagaagccattttatctgtacacgggccggggcccctcttctgaagcaatgcatgtaggtcacctcattccatttattttcacaaagtggctccaggatgtatttaacgtgcccttggtcatccagat

SEQ ID NO: 195627 - DNA, 568 bp, Homo sapiens
  Payload ID: 18614
  Gene Name: tryptophanyl-tRNA synthetase
  ENST ID: ENST00000553413
  CDS Start-End: 247-568
aggagacagccggttgctgagccgggagcgctgactggcccggctgggcaggggaaactgaaagaaagaggggaagagtattaaagaccatttctggctgggcagggcactctcagcagctcaactgcccagcgtgaccagtggccacctctgcagtgtcttccacaacctggtcttgactcgtctgctgaacaaatcctctgacctcaggccggctgtgaacgtagttcctgagagatagcaaacatgcccaacagtgagcccgcatctctgctggagctgttcaacagcatcgccacacaaggggagctcgtaaggtccctcaaagcgggaaatgcgtcaaaggatgaaattgattctgcagtaaagatgttggtgtcattaaaaatgagctacaaagctgccgcgggggaggattacaaggctgactgtcctccagggaacccagcacctaccagtaatcatggcccagatgccacagaagctgaagaggattttgtggacccatggacagtacagacaagcagtgcaaaaggcatagactacgataagctcattgttcggtttg

SEQ ID NO: 195628 - DNA, 123 bp, Homo sapiens
  Payload ID: 18614
  Gene Name: tryptophanyl-tRNA synthetase
  ENST ID: ENST00000627608
  CDS Start-End: 1-123
atgcccaacagtgagcccgcatctctgctggagctgttcaacagcatcgccacacaaggggagctcgtaaggtccctcaaagcgggaaatgcgtcaaagttggggtctttcaggtggaaatga

SEQ ID NO: 195629 - DNA, 1218 bp, Homo sapiens
  Payload ID: 18615
  Gene Name: Ts translation elongation factor, mitochondrial
  Uniprot ID: P43897
  ENST ID: ENST00000323833
  CDS Start-End: 27-1067
ggagggtgtttatcgcggctagagagatgtcgctgctgcggtcgctgcgcgtgtttctggtcgcgcggaccgggagctacccggctgggtctcttctgcgtcagtcgccccagccaaggcacacattttatgctgggccccgtctgtctgcctcggcctccagcaaggagctcctcatgaagctgcggcggaaaacaggctactcctttgtaaattgcaagaaagctctggagacttgtggcggggacctcaaacaggcagagatctggctccacaaggaggcccagaaggagggctggagcaaagctgccaagctccaagggaggaagaccaaagaaggcctgattgggctgttgcaggaaggaaacacaactgtattagtagaggtaaactgtgagacagattttgtttctagaaatttaaaatttcaactgttggtccagcaagtagcccttggaaccatgatgcattgtcagaccctaaaggatcaaccctctgcatacagtaaagtgcagtggctcacgcctgtaaacctagcactttgggaggctgaagcaggtggatcacttgagggtttcttgaattcctctgagctttctggacttccagctgggcctgacagagaaggctcactcaaggatcagttggctttagcaattggaaaactgggagaaaacatgattcttaaacgagctgcatgggtgaaggtgccatctgggttctacgttggctcttatgtccacggagcaatgcagagtccctcacttcacaagctggtgctggggaagtatggggccctggtcatctgtgagacgtctgaacagaaaacaaaccttgaagacgttggccgccgccttgggcagcatgtggtgggcatggcccccctctctgttggctccctggacgatgagcctgggggagaggcagagactaagatgctgtcccagccgtatttgctggatccctccattaccttggggcagtatgtgcagcctcagggggtgtcggtagtagactttgtgcggtttgaatgtggagaaggtgaagaggcagcagaaactgaataggttccagagacttttggcccaggaggaatatttacttttagctctggacatcattacaaaaaggaatatttcccaaacctcttcagaccgagaatgcatgggtaaaattattaaatagttgtataataaaaataattttttccttgtttgc

SEQ ID NO: 195630 - DNA, 2192 bp, Homo sapiens
  Payload ID: 18615
  Gene Name: Ts translation elongation factor, mitochondrial
  Uniprot ID: P43897
  ENST ID: ENST00000454289
  CDS Start-End: 214-1191
attttacctggggtgggaggtggggggtaattcccgtatgaaatgtgtcgtctcaagaaatcaagtagaggcgaggactgtgttcctccggccagcaggtggcaccatactcgtttggtgcgttccgctggagaattctggcccttccgccgcgccgtaggtttgttgcctcaccagtgcgcccgccggagggtgtttatcgcggctagagagatgtcgctgctgcggtcgctgcgcgtgtttctggtcgcgcggaccgggagctacccggctgggtctcttctgcgtcagtcgccccagccaaggcacacattttatgctgggccccgtctgtctgcctcggcctccagcaaggagctcctcatgaagctgcggcggaaaacaggctactcctttgtaaattgcaagaaagctctggagacttgtggcggggacctcaaacaggcagagatctggctccacaaggaggcccagaaggagggctggagcaaagctgccaagctccaagggaggaagaccaaagaaggcctgattgggctgttgcaggaaggaaacacaactgtattagtagaggtaaactgtgagacagattttgtttctagaaatttaaaatttcaactgttggtccagcaagtagcccttggaaccatgatgcattgtcagaccctaaaggatcaaccctctgcatacagtaaaggtttcttgaattcctctgagctttctggacttccagctgggcctgacagagaaggctcactcaaggatcagttggctttagcaattggaaaactgggagaaaacatgattcttaaacgagctgcatgggtgaaggtgccatctgggttctacgttggctcttatgtccacggagcaatgcagagtccctcacttcacaagctggtgctggggaagtatggggccctggtcatctgtgagacgtctgaacagaaaacaaaccttgaagacgttggccgccgccttgggcagcatgtggtgggcatggcccccctctctgttggctccctggacgatgagcctgggggagaggcagagactaagatgctgtcccagccgtatttgctggatccctccattaccttggggcagtatgtgcagcctcagggggtgtcggtagtagactttgtgcggtttgaatgtggagaaggtgaagaggcagcagaaactgaataggttccagagacttttggcccaggaggaatatttacttttagctctggacatcattacaaaaaggaatatttcccaaacctcttcagaccgagaatgcatgggtaaaattattaaatagttgtataataaaaataattttttccttgtttgcgtaatactggatttagcttttctgtgcctttcaaaaacaacaggtgggccttattgacgtgatagtgtcgtggagaacaggcatcaacaatactgctgctcccttcaacatagatttattatggtatttctgaaatttctaacttatatgttctgtcttacaccttttatgacatagaactcttttgttctgtttttgctttgcgacactgtgaaccgtgcttctgcctcggaacctccctagttatattacttgtgccacatggatttctttaggattattgattcaaacctagagttgtctggaaaatgtgggttctcttctttgtgattgtctgtagtatgctttgaaggtgctctgcagtggtagacacactggttctggcctcatttaatgaaattaataacacatgcccctatttctcttttggatgatgtgtgggtgggtgggtactgaggtttcctggccagctgtaaggcagattttgacattcttgtgccagaaacagaaattagagtagtccagttacccagagagctcacttaacattgcctctttacttccccagtactgaaacatttcttcaagtataacataaaattaccgtaacaagcagacccagaatactgaaaataactccatttgttcattataggtatctttatttgaaaagtgaaaaatgctttgacacattacagatctgggtatttggattttgcctatggagtgcatatatgatttcaatgatttacaggctaaatagattttagaaataatcatcttaaaattgaaaacaaaggtaggtcctggtataatattaaacataaagttattaaacattttaagcatt

SEQ ID NO: 195631 - DNA, 689 bp, Homo sapiens
  Payload ID: 18615
  Gene Name: Ts translation elongation factor, mitochondrial
  ENST ID: ENST00000457189
  CDS Start-End: 184-689
cgctgcgcgtgtttctggtcgcgcggaccgggagctacccggtgagaagtcctggtgctggtaccgacctgctgtccctgcagctctcctgctgggtctcttctgcgtcagtcgccccagccaaggcacacattttatgctgggccccgtctgtctgcctcggcctccagcaaggagctcctcatgaagctgcggcggaaaacaggctactcctttgtaaattgcaagaaagctctggagacttgtggcggggacctcaaacaggcagagatctggctccacaaggaggcccagaaggagggctggagcaaagctgccaagctccaagggaggaagaccaaagaaggcctgattgggctgttgcaggaaggaaacacaactgtattagtagaggtaaactgtgagacagattttgtttctagaaatttaaaatttcaactgttggtccagcaagtagcccttggaaccatgatgcattgtcagaccctaaaggatcaaccctctgcatacagtaaaggtttcttgaattcctctgagctttctggacttccagctgggcctgacagagaaggctcactcaaggatcagttggctttagcaattggaaaactgggagaaaacatgattcttaaacgagctgcatgggtgaaggtgccatctgggttctacgttggctcttatgtccacgg

SEQ ID NO: 195632 - DNA, 589 bp, Homo sapiens
  Payload ID: 18615
  Gene Name: Ts translation elongation factor, mitochondrial
  ENST ID: ENST00000434359
  CDS Start-End: 169-589
tgtcgctgctgcggtcgctgcgcgtgtttctggtcgcgcggaccgggagctacccggtgagaagtcctggtgctggctgggtctcttctgcgtcagtcgccccagccaaggcacacattttatgctgggccccgtctgtctgcctcggcctccagcaaggagctcctcatgaagctgcggcggaaaacaggctactcctttgtaaattgcaagaaagctctggagacttgtggcggggacctcaaacaggcagagatctggctccacaaggaggcccagaaggagggctggagcaaagctgccaagctccaagggaggaagaccaaagaaggcctgattgggctgttgcaggaaggaaacacaactgtattagtagaggtaaactgtgagacagattttgtttctagaaatttaaaatttcaactgttggtccagcaagtagcccttggaaccatgatgcattgtcagaccctaaaggatcaaccctctgcatacagtaaaggtttcttgaattcctctgagctttctggacttccagctgggcctgacagagaaggctcactcaaggatcagttggctttagcaattg

SEQ ID NO: 195633 - DNA, 558 bp, Homo sapiens
  Payload ID: 18615
  Gene Name: Ts translation elongation factor, mitochondrial
  ENST ID: ENST00000417094
  CDS Start-End: 22-291
gtgtttatcgcggctagagagatgtcgctgctgcggtcgctgcgcgtgtttctggtcgcgcggaccgggagctacccggctgggtctcttctgcgtcagtcgccccagccaaggcacacattttatgctgggccccgtctgtctgcctcggcctccagcaaggagctcctcatgaagctgcggcggaaaacaggctactcctttgtaaattgcaagaaagctctggagacttgtggcggggacctcaaacagacggagtcttgctctgtggcccaggccggcgtgcaatgagttgtgtagtttttgcctgtacggtcatgcgtctcttaataggaagatacattctgagaaatggcgtcgttaggagattttggcttatgcacatcatagagtacctacacaaacctagatggtatattgtactacaacctgggctatatggaattgccagctgctcctaggctacaaaccgttacaaaatgttactggactgaatactgtaggcagttgtaacacagtggcagagatctggctccacaaggaggcccagaaggaggg

SEQ ID NO: 195634 - DNA, 651 bp, Homo sapiens
  Payload ID: 18615
  Gene Name: Ts translation elongation factor, mitochondrial
  Uniprot ID: P43897
  ENST ID: ENST00000543727
  CDS Start-End: 4-651
gagatgtcgctgctgcggtcgctgcgcgtgtttctggtcgcgcggaccgggagctacccggctgggtctcttctgcgtcagtcgccccagccaaggcacacattttatgctgggccccgtctgtctgcctcggcctccagcaaggagctcctcatgaagctgcggcggaaaacaggctactcctttgtaaattgcaagaaagctctggagacttgtggcggggacctcaaacaggcagagatctggctccacaaggaggcccagaaggagggctggagcaaagctgccaagctccaagggaggaagaccaaagaaggcctgattgggctgttgcaggaaggaaacacaactgtattagtagaggtaaactgtgagacagattttgtttctagaaatttaaaatttcaactgttggtccagcaagtagcccttggaaccatgatgcattgtcagaccctaaaggatcaaccctctgcatacagtaaaggtttcttgaattcctctgagctttctggacttccagctgggcctgacagagaaggctcactcaaggatcagttggctttagcaattggtctgcctttccaaattggagctgtctctgaacttcagcttcctgaatccaacttcttgcagaacacctcctcttga

SEQ ID NO: 195635 - DNA, 1935 bp, Homo sapiens
  Payload ID: 18615
  Gene Name: Ts translation elongation factor, mitochondrial
  Uniprot ID: P43897
  ENST ID: ENST00000540550
  CDS Start-End: 42-545
accagtgcgcccgccggagggtgtttatcgcggctagagagatgtcgctgctgcggtcgctgcgcgtgtttctggtcgcgcggaccgggagctacccggctgggtctcttctgcgtcagtcgccccagccaaggcacacattttatgctgggccccgtctgtctgcctcggcctccagcaaggagctcctcatgaagctgcggcggaaaacaggctactcctttgtaaattgcaagaaagctctggagacttgtggcggggacctcaaacaggcagagatctggctccacaaggaggcccagaaggagggctggagcaaagctgccaagctccaagggaggaagaccaaagaaggcctgattgggctgttgcaggaaggaaacacaactgtattagtagaggtaaactgtgagacagattttgtttctagaaatttaaaatttcaactgttggtccagcaagtagcccttggaaccatgatgcattgtcagaccctaaaggatcaaccctctgcatacagtaaagaaaactgggagaaaacatgattcttaaacgagctgcatgggtgaaggtgccatctgggttctacgttggctcttatgtccacggagcaatgcagagtccctcacttcacaagctggtgctggggaagtatggggccctggtcatctgtgagacgtctgaacagaaaacaaaccttgaagacgttggccgccgccttgggcagcatgtggtgggcatggcccccctctctgttggctccctggacgatgagcctgggggagaggcagagactaagatgctgtcccagccgtatttgctggatccctccattaccttggggcagtatgtgcagcctcagggggtgtcggtagtagactttgtgcggtttgaatgtggagaaggtgaagaggcagcagaaactgaataggttccagagacttttggcccaggaggaatatttacttttagctctggacatcattacaaaaaggaatatttcccaaacctcttcagaccgagaatgcatgggtaaaattattaaatagttgtataataaaaataattttttccttgtttgcgtaatactggatttagcttttctgtgcctttcaaaaacaacaggtgggccttattgacgtgatagtgtcgtggagaacaggcatcaacaatactgctgctcccttcaacatagatttattatggtatttctgaaatttctaacttatatgttctgtcttacaccttttatgacatagaactcttttgttctgtttttgctttgcgacactgtgaaccgtgcttctgcctcggaacctccctagttatattacttgtgccacatggatttctttaggattattgattcaaacctagagttgtctggaaaatgtgggttctcttctttgtgattgtctgtagtatgctttgaaggtgctctgcagtggtagacacactggttctggcctcatttaatgaaattaataacacatgcccctatttctcttttggatgatgtgtgggtgggtgggtactgaggtttcctggccagctgtaaggcagattttgacattcttgtgccagaaacagaaattagagtagtccagttacccagagagctcacttaacattgcctctttacttccccagtactgaaacatttcttcaagtataacataaaattaccgtaacaagcagacccagaatactgaaaataactccatttgttcattataggtatctttatttgaaaagtgaaaaatgctttgacacattacagatctgggtatttggattttgcctatggagtgcatatatgatttcaatgatttacaggctaaatagattttagaaataatcatcttaaaattgaaaacaaaggtaggtcctggtataatattaaacataaagttattaaacattttaagcattgtt

SEQ ID NO: 195636 - DNA, 897 bp, Homo sapiens
  Payload ID: 18615
  Gene Name: Ts translation elongation factor, mitochondrial
  ENST ID: ENST00000550559
  CDS Start-End: 16-708
atcgcggctagagagatgtcgctgctgcggtcgctgcgcgtgtttctggtcgcgcggaccgggagctacccggctgggtctcttctgcgtcagtcgccccagccaaggcacacattttatgctgggccccgtctgtctgcctcggcctccagcaaggagctcctcatgaagctgcggcggaaaacaggctactcctttgtaaattgcaagaaagctctggagacttgtggcggggacctcaaacaggcagagatctggctccacaaggaggcccagaaggagggctggagcaaagctgccaagctccaagggaggaagaccaaagaaggcctgattgggctgttgcaggaaggaaacacaactgtattagtagaggtaaactgtgagacagattttgtttctagaaatttaaaatttcaactgttggtccagcaagtagcccttggaaccatgatgcattgtcagaccctaaaggatcaaccctctgcatacagtaaaggtttcttgaattcctctgagctttctggacttccagctgggcctgacagagaaggctcactcaaggatcagttggctttagcaattgggtcccaggctaggaaccagcctgtgaagatgggaggctcaaacccctgcttaatgatcaggattggtgtgtcgggatctcggccgctggggtctgcctttccaaattggagctgtctctgaacttcagcttcctgaatccaacttcttgcagaacacctcctcttgactgctctaagcaccttaaaaataacaccttcaggatgtagctcttctttactaaacttgtatctgagtctccacttttgataggtggtatctatctagtcacctaaggcagaagcctgagagtttcctagaaaccccccatat

SEQ ID NO: 195637 - DNA, 794 bp, Homo sapiens
  Payload ID: 18615
  Gene Name: Ts translation elongation factor, mitochondrial
  ENST ID: ENST00000548851
  CDS Start-End: 16-618
atcgcggctagagagatgtcgctgctgcggtcgctgcgcgtgtttctggtcgcgcggaccgggagctacccggctgggtctcttctgcgtcagtcgccccagccaaggcacacattttatgctgggccccgtctgtctgcctcggcctccagcaaggagctcctcatgaagctgcggcggaaaacaggctactcctttgtaaattgcaagaaagctctggagacttgtggcggggacctcaaacaggcagagatctggctccacaaggaggcccagaaggagggctggagcaaagctgccaagctccaagggaggaagaccaaagaaggcctgattgggctgttgcaggaaggaaacacaactgtattagtagaggtaaactgtgagacagattttgtttctagaaatttaaaatttcaactgttggtccagcaagtagcccttggaaccatgatgcattgtcagaccctaaaggatcaaccctctgcatacagtaaaggtttcttgaattcctctgagctttctggacttccagctgggcctgacagagaaggctcactcaaggatcagttggctttagcaattgtgctgaggactcatcacatttgcatgatttgaatcgtgagatgaactgggccatcctgttcaggagcatcccatcatggctcggtctttgcaaggctgagcaatgatttgaatatatcttccaggtgagatattgatagcacatttgaggatgtgcctttcactaccctgaaaactctacagactcacaagactcttaaagaagactc

SEQ ID NO: 195638 - DNA, 3135 bp, Homo sapiens
  Payload ID: 18616
  Gene Name: TSC22 domain family, member 1
  Uniprot ID: Q15714
  ENST ID: ENST00000261489
  CDS Start-End: 218-652
tggagcccggctgcggatctgggaagcgcctcttcacggcactgggatccgcatctgcctgggatcatcaagccctagaagctgggtttctttaaattagggctgccgttttctgtttctccctgggctgcggaaagccagaagattttatctagcttatacaaggctgctggtgttccctctttttttccacgagggtgtttttggctgcaattgcatgaaatcccaatggtgtagaccagtggcgatggatctaggagtttaccaactgagacatttttcaatttctttcttgtcatccttgctggggactgaaaacgcttctgtgagacttgataatagctcctctggtgcaagtgtggtagctattgacaacaaaatcgagcaagctatggatctagtgaaaagccatttgatgtatgcggtcagagaagaagtggaggtcctcaaagagcaaatcaaagaactaatagagaaaaattcccagctggagcaggagaacaatctgctgaagacactggccagtcctgagcagcttgcccagtttcaggcccagctgcagactggctccccccctgccaccacccagccacagggcaccacacagccccccgcccagccagcatcgcagggctcaggaccaaccgcatagctgcctatgcccccgcagaactggctgctgcgtgtgaactgaacagacggagaagatgtgctagggagaatctgcctccacagtcacccatttcattgctcgctgcgaaagagacgtgagactgacatatgccattatctcttttccagtattaaacactcatatgcttatggcttggagaaatttcttagttgggtgaattaaaggttaatccgagaattagcatggatataccgggacctcatgcagcttggcagatatctgagaaatggtttaattcatgctcaggagctgtgtgcctttccatcccttccggctccctacccctcacttccaagggttctctctcctgcttgcgcttagtgtcctacatggggttgtgaagcgatggagctcctcactggactcgcctctctcctctcctccccccaggaggaacttgaaaggagggtaaaaagactaaaatgagggggaacagagttcactgtacaaatttgacaactgtcaccaaaattcataaaaaacaatagtactgtgcctctttcttctcaaacaatggatgacacaaaactatgagagtgacaaaatggtgacaggtagctgggacctaggctatcttaccatgaaggttgttttgcttattgtatatttgtgtatgtagtgtaactattttgtacaatagaggactgtaactactatttaggttgtacagattgaaatttagttgtttcattggctgtctgaggaggtgtggacttttatatatagatctacataaaaactgctacatgacaaaaaccacacctaaagaaattttaagaatttggcacagttactcactttgtgtaatctgaaatctagctgctgaatacgctgaagtaaatccttgttcactgaagtctttcaattgagctggttgaatactttgaaaaatgctcagttctaactaatgaaatggatttcccagtaggggtttctgcatatcacctgtatagtagttatatgcatatgtttctgtgcatgttctctacacaattgtaaggtgtcactgtatttaactgttgcacttgtcaactttcaataaagcatataaatgttgataaacaagtgtttttcatatgaccctgttaacataatggcagtcatttccacaactgtttccaggtaaagttaacaatttgactagtaaaatcctgaagggcagtggaatgattggaaaagtaggggcgtgatttgactgcatgaagtaaaaggaaattgacacattgagttgttcagcaggtaagagaagagacagtggaggagtccagctcaattctaactactgtgtgacttggacaggttgcttcactcctggacggatgtaggggtttgaaagagatgatctcttacattcccctttggctttaaaattctaggagtccttgaaaatcttaattttttactgaactgagaggaagaaggagccttattctgtgtataattggaataagcagatctaggatcaaaagacggaagttggagaagctgatttccactttaagaaccctgtcaccctgggttgggatgtttctcctagtgtaggatgagtttctagctcctgggataattcgttttgtctaagcaaaagatgatttgaggtgggaccagatgagcaaggatgtccttgcagttgattctgcatgactataaaacaggccaaaattaaaaccacgaaggaatcctgaggcagattggcccctggcacctgaggagtgagcctgagggatcccactctgcagtaggagtaacgtgagcgagcaagtgaatggggtgggtttaccggctctgtaatctatcaacctagggcctcagcagtggccccctgcccagtaggaattggaccaatcccaagttctaaggcttgtcttaagtccttgcagaacaaggacaaactttctgaatcattcatttctctcatctagagctggtgggagattgagaggtgaatgggacatccaagatccctaaaaagaattgttcgatagcgtgcatgtgttataaagtggtgacacgggcatcctgttgaaatgatggatggctcactgccataggctgatagcagttgtcataaagatattttgggggaatttgaaaaggacgtaaagaaaaatctttcatattggcttgttggttatataacttcaaatttaataaaggaatacttacgtagtaattacatttccttgaaaaaactatagtgaatagaaatccctagccatttcattttttatgtttttaatgaagatctttaaaataccataggtggtaatcgtggaaaatttgaaaaatctcatgtcagtgtattaagatggtggagaagtttttttctccattatttaatggaactttgggtctttttattaaaaatgtgagactcatgaaattttggcagctgaatatttgtgaaataagaatgaattattaaaagatgtctttccata

SEQ ID NO: 195639 - DNA, 4820 bp, Homo sapiens
  Payload ID: 18616
  Gene Name: TSC22 domain family, member 1
  Uniprot ID: Q15714
  ENST ID: ENST00000458659
  CDS Start-End: 492-3713
ccgggggtggcgaggggaaggcgacatttgcttggcgctgcctccgtgcagagcggccgggagggctttgcagcggccgccgacgcggcgggaggagggggctgaggcggcttcggagttggccggagaaggtgggcatttctcgcttttcctccccttcctgcgctctccccctccctcctgccccgcaccccacgtgaagcagaatataaaggggggtgtgaggctagaggggaaagtgaatggcgaaggactgaagggatccccccttcgggtccccggccgccctgttcaccctcgttcatcctcctttccgaagctcgctctcgaaggcaggagcgaccggcgcctttggctgaggaggaggagaaggaggaatcgcgccaggcggagcgtcaggtcccgttttcctctccggcgtctccaatacaaagattacggtgcagaaggaaattgcactcgtctcctccgcgcccccggtacccaacacaatgcaccagccgcctgagtccaccgccgcggccgccgccgctgcagacattagcgctaggaagatggcgcacccggcaatgttccctcgaaggggcagcggtagtggcagcgcctctgctctcaatgcagcaggtaccggcgtcggtagtaatgccacatcttccgaggattttccgcctccgtcgctgcttcagccgccgccccctgcagcatcttctacgtcgggaccacagcctccgcctccacaaagcctgaacctcctttcgcaggctcagctgcaggcacagcctcttgcgccaggcggaactcaaatgaaaaagaaaagtggcttccagataactagcgttactcctgctcagatctccgctagtatcagctctaacaacagtatagcagaggacactgagagctatgatgatctggatgaatctcacacggaagatctctcttcttcggagatccttgatgtgtcactttccagggctactgacttaggggagcccgaacgcagctcctcagaagagaccctaaataacttccaggaagccgagacacctggggcagtctctcccaaccagccccaccttcctcagcctcatttgcctcaccttccacaacagaatgttgtgatcaatgggaatgctcatccacaccacctccatcaccaccatcagattcatcatgggcaccacctccaacatggtcaccaccatccatctcatgttgctgtggccagtgcatccattactggtgggccaccctcaagcccagtatctagaaaactctctacaactggaagctctgacagtatcacaccagttgcaccaacttctgctgtatcatccagtggttcacctgcatctgtaatgactaatatgcgtgctccaagtactacaggtggaataggtataaattctgttactggcactagtacagtaaataatgttaacattactgctgtgggtagttttaatcctaatgtgacaagcagcatgcttggtaatgttaatataagtacaagcaatattcctagtgctgctggtgtgagtgttgggcctggagttaccagtggtgttaatgtgaatatcttgagtggcatgggcaatggtactatttcttcctctgctgctgttagcagtgttcctaatgcagctgcagggatgactgggggatcggtttcaagtcagcagcaacaaccaacagttaacacttcgaggttcagagttgtgaagttagattctagttctgagccctttaaaaaaggtagatggacttgcactgagttctatgaaaaagaaaatgctgtacctgctacagaaggtgtgctgataaataaagtggtggagactgtaaagcaaaatccgatagaagtgacttctgaaagggagagcactagtgggagttcagtgagcagtagtgtcagcacactgagtcactatacagagagtgtgggaagtggagagatgggagcccctactgtggtggtgcagcagcagcagcagcaacaacaacaacaacagcaacaaccagctctccaaggtgtgaccctccaacagatggattttggtagcactggtccacagagtattccagcagttagtataccacagagtatttctcagtcacagatctcacaagtacaattacagtctcaagaactgagctatcagcaaaagcaaggtcttcagccagtacctctgcaagccactatgagtgctgcaactggtatccagccatcgcctgtaaatgtggttggtgtaacttcagctttaggtcagcagccttccatttccagtttggctcaaccccagctaccatattctcaggcggctcctccagtgcaaactccccttccaggggcaccaccaccccaacagttacagtatggacaacagcaaccaatggtttctacacagatggccccaggccatgtcaaatcagtgactcaaaatcctgcttcagagtatgtacaacagcagccaattcttcaaacagcaatgtcctccggacagcccagttctgcaggagtaggagcaggaacaacagtgattcctgtggctcagccacagggtatccagctgccagtgcagcccacagcagtcccagcacaacctgcaggggcatctgtccagcctgttggccaggctccggcagcagtgtctgctgtacctactggcagtcagattgcaaatattggtcagcaagcaaacatacctactgcagtgcagcagccctctacccaggttccaccttcagttattcagcagggtgctcctccatcttcgcaagtggttccacctgctcaaactgggattattcatcagggagttcaaactagtgctccaagccttcctcaacaattggttattgcatcccaaagttccttgttaactgtgcctccccagccacaaggagtagaaccagtagctcaaggaattgtttcacagcagttgcctgcagttagttctttgccctctgctagtagtatttctgttacaagtcaggttagttcaactggtccttctggaatgccttctgccccaacaaacttggttccaccacaaaatatagcacaaacccctgctacccaaaatggtaatttggttcaaagtgttagtcaacctcccttgatagcaactaatacaaatttgcctttggcacaacagataccactaagttctacccagttctccgcacaatcattagctcaggcaattggaagccaaattgaagatgccaggcgtgcagcggagccctccttagttggcttacctcagactatcagtggtgacagtgggggaatgtcagcagtttcagatgggagtagcagcagcctagcagcctctgcttctcttttcccgttgaaggtgctaccgctgacgacacccctggtggatggcgaggatgagagctcctctggtgcaagtgtggtagctattgacaacaaaatcgagcaagctatggatctagtgaaaagccatttgatgtatgcggtcagagaagaagtggaggtcctcaaagagcaaatcaaagaactaatagagaaaaattcccagctggagcaggagaacaatctgctgaagacactggccagtcctgagcagcttgcccagtttcaggcccagctgcagactggctccccccctgccaccacccagccacagggcaccacacagccccccgcccagccagcatcgcagggctcaggaccaaccgcatagctgcctatgcccccgcagaactggctgctgcgtgtgaactgaacagacggagaagatgtgctagggagaatctgcctccacagtcacccatttcattgctcgctgcgaaagagacgtgagactgacatatgccattatctcttttccagtattaaacactcatatgcttatggcttggagaaatttcttagttgggtgaattaaaggttaatccgagaattagcatggatataccgggacctcatgcagcttggcagatatctgagaaatggtttaattcatgctcaggagctgtgtgcctttccatcccttccggctccctacccctcacttccaagggttctctctcctgcttgcgcttagtgtcctacatggggttgtgaagcgatggagctcctcactggactcgcctctctcctctcctccccccaggaggaacttgaaaggagggtaaaaagactaaaatgagggggaacagagttcactgtacaaatttgacaactgtcaccaaaattcataaaaaacaatagtactgtgcctctttcttctcaaacaatggatgacacaaaactatgagagtgacaaaatggtgacaggtagctgggacctaggctatcttaccatgaaggttgttttgcttattgtatatttgtgtatgtagtgtaactattttgtacaatagaggactgtaactactatttaggttgtacagattgaaatttagttgtttcattggctgtctgaggaggtgtggacttttatatatagatctacataaaaactgctacatgacaaaaaccacacctaaagaaattttaagaatttggcacagttactcactttgtgtaatctgaaatctagctgctgaatacgctgaagtaaatccttgttcactgaagtctttcaattgagctggttgaatactttgaaaaatgctcagttctaactaatgaaatggatttcccagtaggggtttctgcatatcacctgtatagtagttatatgcatatgtttctgtgcatgttctctacacaattgtaaggtgtcactgtatttaactgttgcacttgtcaactttcaataaagcatataaatgttgataaacaa

SEQ ID NO: 195640 - DNA, 1093 bp, Homo sapiens
  Payload ID: 18616
  Gene Name: TSC22 domain family, member 1
  ENST ID: ENST00000486464
  CDS Start-End: 1-448
ggttccaccacaaaatatagcacaaacccctgctacccaaaatggtaatttggttcaaagtgttagtcaacctcccttgatagcaactaatacaaatttgcctttggcacaacagataccactaagttctacccagttctccgcacaatcattagctcaggcaattggaagccaaattgaagatgccaggcgtgcagcggagccctccttagttggcttacctcagactatcagtggtgacagtgggggaatgtcagcagtttcagatgggagtagcagcagcctagcagcctctgcttctcttttcccgttgaaggtgctaccgctgacgacacccctggtggatggcgaggatgagagctctctatttcagtgcttctctcctaccagaggtgcaaggagtgatcctagaaccacagatacagccaagaccacggagagcttttgacgtcaggggtccactttctccactgaacccttggagacagaatatccagcttctggagagagtgggaaaggataataaacaaatttctttcaactggtaaaacatcatacttcttcagcaaaaggaattcttctagcagagccttcatggatgatatctgtcacacatgccagcacctgcagtttggaaggcagtggtgaatggatccatgcaatatgtctagaagacacaaggatgagccagccacctgatcttgtcatttataaacttttaagaattactctggtttacttttggtctgaaaatggaaaggcccaaataatgaaataatcttttcagattggaattttacatggccatgaaaatatttctttctattcagaagactgaaatagaggaagcttgagagactcctttcttttaaaagcggctctctgtatctgtttcatttaaaacatttgtgggattgaaaatcaccttaatgaagtaggcaaacatttttttaagtagtagaggaagtccagaaaacttaatgaaatggttttttttgttgcctgacactgaaagtaactagtaaataaagggtgaacttcttaattattcgaaaactgcttttaatattaggatatactcttttagctcatc

SEQ ID NO: 195641 - DNA, 690 bp, Homo sapiens
  Payload ID: 18616
  Gene Name: TSC22 domain family, member 1
  ENST ID: ENST00000493016
  CDS Start-End: 264-690
cgctgcaccagcccgtctggccaccaacgccgcggagaaaggagccgccgccgcctgcggccctctcccgcccggtcgcgggagcagcgggctcgctctcgaaggcaggagcgaccggcgcctttggctgaggaggaggagaaggaggaatcgcgccaggcggagcgtcaggtcccgttttcctctccggcgtctccaatacaaagattacggtgcagaaggaaattgcactcgtctcctccgcgcccccggtacccaacacaatgcaccagccgcctgagtccaccgccgcggccgccgccgctgcagacattagcgctaggaagatggcgcacccggcaatgttccctcgaaggggcagcggtagtggcagcgcctctgctctcaatgcagcaggtaccggcgtcggtagtaatgccacatcttccgaggattttccgcctccgtcgctgcttcagccgccgccccctgcagcatcttctacgtcgggaccacagcctccgcctccacaaagcctgaacctcctttcgcaggctcagctgcaggcacagcctcttgcgccaggcggaactcaaatgaaaaagaaaagtggcttccagataactagcgttactcctgctcagatctccgctagtatcagctctaacaacagtatagcagaggacactgagagctatgatgatctggatg

SEQ ID NO: 195642 - DNA, 349 bp, Homo sapiens
  Payload ID: 18616
  Gene Name: TSC22 domain family, member 1
  ENST ID: ENST00000472477
  CDS Start-End: 225-349
aagcttttcctatagtctagtgataatcctgcttaccgctgccggtaagaactagataattgaaatcaagacactcgaagtcttacagtggtgggactgggcatgcccagtagctcagacggttcgggttacaaataggaagctttcgccgttaagcagccgcgggacacagctccggggaccggggtctgactcccttaaacggtgtttttggctgcaattgcatgaaatcccaatggtgtagaccagtggcgatggatctaggagtttaccaactgagacatttttcaatttctttcttgtcatccttgctggggactgaaaacgcttctgtgagacttgataatag

SEQ ID NO: 195643 - DNA, 4026 bp, Homo sapiens
  Payload ID: 18616
  Gene Name: TSC22 domain family, member 1
  Uniprot ID: Q15714
  ENST ID: ENST00000501704
  CDS Start-End: 492-2204
ccgggggtggcgaggggaaggcgacatttgcttggcgctgcctccgtgcagagcggccgggagggctttgcagcggccgccgacgcggcgggaggagggggctgaggcggcttcggagttggccggagaaggtgggcatttctcgcttttcctccccttcctgcgctctccccctccctcctgccccgcaccccacgtgaagcagaatataaaggggggtgtgaggctagaggggaaagtgaatggcgaaggactgaagggatccccccttcgggtccccggccgccctgttcaccctcgttcatcctcctttccgaagctcgctctcgaaggcaggagcgaccggcgcctttggctgaggaggaggagaaggaggaatcgcgccaggcggagcgtcaggtcccgttttcctctccggcgtctccaatacaaagattacggtgcagaaggaaattgcactcgtctcctccgcgcccccggtacccaacacaatgcaccagccgcctgagtccaccgccgcggccgccgccgctgcagacattagcgctaggaagatggcgcacccggcaatgttccctcgaaggggcagcggtagtggcagcgcctctgctctcaatgcagcaggtaccggcgtcggtagtaatgccacatcttccgaggattttccgcctccgtcgctgcttcagccgccgccccctgcagcatcttctacgtcgggaccacagcctccgcctccacaaagcctgaacctcctttcgcaggctcagctgcaggcacagcctcttgcgccaggcggaactcaaatgaaaaagaaaagtggcttccagataactagcgttactcctgctcagatctccgctagtatcagctctaacaacagtatagcagaggacactgagagctatgatgatctggatgaatctcacacggaagatctctcttcttcggagatccttgatgtgtcactttccagggctactgacttaggggagcccgaacgcagctcctcagaagagaccctaaataacttccaggaagccgagacacctggggcagtctctcccaaccagccccaccttcctcagcctcatttgcctcaccttccacaacagaatgttgtgatcaatgggaatgctcatccacaccacctccatcaccaccatcagattcatcatgggcaccacctccaacatggtcaccaccatccatctcatgttgctgtggccagtgcatccattactggtgggccaccctcaagcccagtatctagaaaactctctacaactggaagctctgacagtatcacaccagttgcaccaacttctgctgtatcatccagtggttcacctgcatctgtaatgactaatatgcgtgctccaagtactacaggtggaataggtataaattctgttactggcactagtacagtaaataatgttaacattactgctgtgggtagttttaatcctaatgtgacaagcagcatgcttggtaatgttaatataagtacaagcaatattcctagtgctgctggtgtgagtgttgggcctggagttaccagtggtgttaatgtgaatatcttgagtggcatgggcaatggtactatttcttcctctgctgctgttagcagtgttcctaatgcagctgcagggatgactgggggatcggtttcaagtcagcagcaacaaccaacagttaacacttcgaggttcagagttgtgaagttagattctagttctgagccctttaaaaaaggtagatggacttgcactgagttctatgaaaaagaaaatgctgtacctgctacagaaggtgtgctgataaataaagtggtggagactgtaaagcaaaatccgatagaagtgacttctgaaagggagagcactagtgggagttcagtgagcagtagtgtcagcacactgagtcactatacagagagtgtgggaagtggagagatgggagcccctactgtggtggtgcagcagcagcagcagcaacaacaacaacaacagcaacaaccagctctccaaggtgtgaccctccaacagatggattttggtagcactggtccacagagtattccagcagttagtataccacagagtatttctcagtcacagatctcacaagtacaattacagtctcaagaactgagctatcttaccatgaaggttgttttgcttattgtatatttgtgtatgtagtgtaactattttgtacaatagaggactgtaactactatttaggttgtacagattgaaatttagttgtttcattggctgtctgaggaggtgtggacttttatatatagatctacataaaaactgctacatgacaaaaaccacacctaaagaaattttaagaatttggcacagttactcactttgtgtaatctgaaatctagctgctgaatacgctgaagtaaatccttgttcactgaagtctttcaattgagctggttgaatactttgaaaaatgctcagttctaactaatgaaatggatttcccagtaggggtttctgcatatcacctgtatagtagttatatgcatatgtttctgtgcatgttctctacacaattgtaaggtgtcactgtatttaactgttgcacttgtcaactttcaataaagcatataaatgttgataaacaagtgtttttcatatgaccctgttaacataatggcagtcatttccacaactgtttccaggtaaagttaacaatttgactagtaaaatcctgaagggcagtggaatgattggaaaagtaggggcgtgatttgactgcatgaagtaaaaggaaattgacacattgagttgttcagcaggtaagagaagagacagtggaggagtccagctcaattctaactactgtgtgacttggacaggttgcttcactcctggacggatgtaggggtttgaaagagatgatctcttacattcccctttggctttaaaattctaggagtccttgaaaatcttaattttttactgaactgagaggaagaaggagccttattctgtgtataattggaataagcagatctaggatcaaaagacggaagttggagaagctgatttccactttaagaaccctgtcaccctgggttgggatgtttctcctagtgtaggatgagtttctagctcctgggataattcgttttgtctaagcaaaagatgatttgaggtgggaccagatgagcaaggatgtccttgcagttgattctgcatgactataaaacaggccaaaattaaaaccacgaaggaatcctgaggcagattggcccctggcacctgaggagtgagcctgagggatcccactctgcagtaggagtaacgtgagcgagcaagtgaatggggtgggtttaccggctctgtaatctatcaacctagggcctcagcagtggccccctgcccagtaggaattggaccaatcccaagttctaaggcttgtcttaagtccttgcagaacaaggacaaactttctgaatcattcatttctctcatctagagctggtgggagattgagaggtgaatgggacatccaagatccctaaaaagaattgttcgatagcgtgcatgtgttataaagtggtgacacgggcatcctgttgaaatgatggatggctcactgccataggctgatagcagttgtcataaagatattttgggggaatttgaaaaggacgtaaagaaaaatctttcatattggcttgttggttatataacttcaaatttaataaaggaatacttacgtagtaattacatttccttgaaaaaactatagtgaatagaaatccctagccatttcattttttatgtttttaatgaagatctttaaaataccataggtggtaatcgtggaaaatttgaaaaatctcatgtcagtgtattaagatggtggagaagtttttttctccattatttaatggaactttgggtctttttattaaaaatgtgagactcatgaaattttggcagctgaatatttgtgaaataagaatgaattattaaaagatgtctttccata

SEQ ID NO: 195644 - DNA, 2877 bp, Homo sapiens
  Payload ID: 18616
  Gene Name: TSC22 domain family, member 1
  ENST ID: ENST00000611198
  CDS Start-End: 134-394
gggcctgggtgggaagagaggcccaagaaagccaccatagtctgtagcgtgaagcttttcctatagtctagtgataatcctgctctcctctggtgcaagtgtggtagctattgacaacaaaatcgagcaagctatggatctagtgaaaagccatttgatgtatgcggtcagagaagaagtggaggtcctcaaagagcaaatcaaagaactaatagagaaaaattcccagctggagcaggagaacaatctgctgaagacactggccagtcctgagcagcttgcccagtttcaggcccagctgcagactggctccccccctgccaccacccagccacagggcaccacacagccccccgcccagccagcatcgcagggctcaggaccaaccgcatagctgcctatgcccccgcagaactggctgctgcgtgtgaactgaacagacggagaagatgtgctagggagaatctgcctccacagtcacccatttcattgctcgctgcgaaagagacgtgagactgacatatgccattatctcttttccagtattaaacactcatatgcttatggcttggagaaatttcttagttgggtgaattaaaggttaatccgagaattagcatggatataccgggacctcatgcagcttggcagatatctgagaaatggtttaattcatgctcaggagctgtgtgcctttccatcccttccggctccctacccctcacttccaagggttctctctcctgcttgcgcttagtgtcctacatggggttgtgaagcgatggagctcctcactggactcgcctctctcctctcctccccccaggaggaacttgaaaggagggtaaaaagactaaaatgagggggaacagagttcactgtacaaatttgacaactgtcaccaaaattcataaaaaacaatagtactgtgcctctttcttctcaaacaatggatgacacaaaactatgagagtgacaaaatggtgacaggtagctgggacctaggctatcttaccatgaaggttgttttgcttattgtatatttgtgtatgtagtgtaactattttgtacaatagaggactgtaactactatttaggttgtacagattgaaatttagttgtttcattggctgtctgaggaggtgtggacttttatatatagatctacataaaaactgctacatgacaaaaaccacacctaaagaaattttaagaatttggcacagttactcactttgtgtaatctgaaatctagctgctgaatacgctgaagtaaatccttgttcactgaagtctttcaattgagctggttgaatactttgaaaaatgctcagttctaactaatgaaatggatttcccagtaggggtttctgcatatcacctgtatagtagttatatgcatatgtttctgtgcatgttctctacacaattgtaaggtgtcactgtatttaactgttgcacttgtcaactttcaataaagcatataaatgttgataaacaagtgtttttcatatgaccctgttaacataatggcagtcatttccacaactgtttccaggtaaagttaacaatttgactagtaaaatcctgaagggcagtggaatgattggaaaagtaggggcgtgatttgactgcatgaagtaaaaggaaattgacacattgagttgttcagcaggtaagagaagagacagtggaggagtccagctcaattctaactactgtgtgacttggacaggttgcttcactcctggacggatgtaggggtttgaaagagatgatctcttacattcccctttggctttaaaattctaggagtccttgaaaatcttaattttttactgaactgagaggaagaaggagccttattctgtgtataattggaataagcagatctaggatcaaaagacggaagttggagaagctgatttccactttaagaaccctgtcaccctgggttgggatgtttctcctagtgtaggatgagtttctagctcctgggataattcgttttgtctaagcaaaagatgatttgaggtgggaccagatgagcaaggatgtccttgcagttgattctgcatgactataaaacaggccaaaattaaaaccacgaaggaatcctgaggcagattggcccctggcacctgaggagtgagcctgagggatcccactctgcagtaggagtaacgtgagcgagcaagtgaatggggtgggtttaccggctctgtaatctatcaacctagggcctcagcagtggccccctgcccagtaggaattggaccaatcccaagttctaaggcttgtcttaagtccttgcagaacaaggacaaactttctgaatcattcatttctctcatctagagctggtgggagattgagaggtgaatgggacatccaagatccctaaaaagaattgttcgatagcgtgcatgtgttataaagtggtgacacgggcatcctgttgaaatgatggatggctcactgccataggctgatagcagttgtcataaagatattttgggggaatttgaaaaggacgtaaagaaaaatctttcatattggcttgttggttatataacttcaaatttaataaaggaatacttacgtagtaattacatttccttgaaaaaactatagtgaatagaaatccctagccatttcattttttatgtttttaatgaagatctttaaaataccataggtggtaatcgtggaaaatttgaaaaatctcatgtcagtgtattaagatggtggagaagtttttttctccattatttaatggaactttgggtctttttattaaaaatgtgagactcatgaaattttggcagctgaatatttgtgaaataagaatgaattattaaaagatgtctttccata

SEQ ID NO: 195645 - DNA, 2872 bp, Homo sapiens
  Payload ID: 18616
  Gene Name: TSC22 domain family, member 1
  ENST ID: ENST00000622051
  CDS Start-End: 129-389
cgggttacaaataggaagctttcgccgttaagcagccgcgggacacagctccggggaccggggtctgactcccttaaacctcctctggtgcaagtgtggtagctattgacaacaaaatcgagcaagctatggatctagtgaaaagccatttgatgtatgcggtcagagaagaagtggaggtcctcaaagagcaaatcaaagaactaatagagaaaaattcccagctggagcaggagaacaatctgctgaagacactggccagtcctgagcagcttgcccagtttcaggcccagctgcagactggctccccccctgccaccacccagccacagggcaccacacagccccccgcccagccagcatcgcagggctcaggaccaaccgcatagctgcctatgcccccgcagaactggctgctgcgtgtgaactgaacagacggagaagatgtgctagggagaatctgcctccacagtcacccatttcattgctcgctgcgaaagagacgtgagactgacatatgccattatctcttttccagtattaaacactcatatgcttatggcttggagaaatttcttagttgggtgaattaaaggttaatccgagaattagcatggatataccgggacctcatgcagcttggcagatatctgagaaatggtttaattcatgctcaggagctgtgtgcctttccatcccttccggctccctacccctcacttccaagggttctctctcctgcttgcgcttagtgtcctacatggggttgtgaagcgatggagctcctcactggactcgcctctctcctctcctccccccaggaggaacttgaaaggagggtaaaaagactaaaatgagggggaacagagttcactgtacaaatttgacaactgtcaccaaaattcataaaaaacaatagtactgtgcctctttcttctcaaacaatggatgacacaaaactatgagagtgacaaaatggtgacaggtagctgggacctaggctatcttaccatgaaggttgttttgcttattgtatatttgtgtatgtagtgtaactattttgtacaatagaggactgtaactactatttaggttgtacagattgaaatttagttgtttcattggctgtctgaggaggtgtggacttttatatatagatctacataaaaactgctacatgacaaaaaccacacctaaagaaattttaagaatttggcacagttactcactttgtgtaatctgaaatctagctgctgaatacgctgaagtaaatccttgttcactgaagtctttcaattgagctggttgaatactttgaaaaatgctcagttctaactaatgaaatggatttcccagtaggggtttctgcatatcacctgtatagtagttatatgcatatgtttctgtgcatgttctctacacaattgtaaggtgtcactgtatttaactgttgcacttgtcaactttcaataaagcatataaatgttgataaacaagtgtttttcatatgaccctgttaacataatggcagtcatttccacaactgtttccaggtaaagttaacaatttgactagtaaaatcctgaagggcagtggaatgattggaaaagtaggggcgtgatttgactgcatgaagtaaaaggaaattgacacattgagttgttcagcaggtaagagaagagacagtggaggagtccagctcaattctaactactgtgtgacttggacaggttgcttcactcctggacggatgtaggggtttgaaagagatgatctcttacattcccctttggctttaaaattctaggagtccttgaaaatcttaattttttactgaactgagaggaagaaggagccttattctgtgtataattggaataagcagatctaggatcaaaagacggaagttggagaagctgatttccactttaagaaccctgtcaccctgggttgggatgtttctcctagtgtaggatgagtttctagctcctgggataattcgttttgtctaagcaaaagatgatttgaggtgggaccagatgagcaaggatgtccttgcagttgattctgcatgactataaaacaggccaaaattaaaaccacgaaggaatcctgaggcagattggcccctggcacctgaggagtgagcctgagggatcccactctgcagtaggagtaacgtgagcgagcaagtgaatggggtgggtttaccggctctgtaatctatcaacctagggcctcagcagtggccccctgcccagtaggaattggaccaatcccaagttctaaggcttgtcttaagtccttgcagaacaaggacaaactttctgaatcattcatttctctcatctagagctggtgggagattgagaggtgaatgggacatccaagatccctaaaaagaattgttcgatagcgtgcatgtgttataaagtggtgacacgggcatcctgttgaaatgatggatggctcactgccataggctgatagcagttgtcataaagatattttgggggaatttgaaaaggacgtaaagaaaaatctttcatattggcttgttggttatataacttcaaatttaataaaggaatacttacgtagtaattacatttccttgaaaaaactatagtgaatagaaatccctagccatttcattttttatgtttttaatgaagatctttaaaataccataggtggtaatcgtggaaaatttgaaaaatctcatgtcagtgtattaagatggtggagaagtttttttctccattatttaatggaactttgggtctttttattaaaaatgtgagactcatgaaattttggcagctgaatatttgtgaaataagaatgaattattaaaagatgtctttccata

SEQ ID NO: 195646 - DNA, 11154 bp, Homo sapiens
  Payload ID: 18617
  Gene Name: TSC22 domain family, member 2
  Uniprot ID: O75157
  ENST ID: ENST00000361875
  CDS Start-End: 1017-3359
cccagcatccctggcgcggccatttcagccccatcttggcccagcggagggagctgcagccgccgcttcagcagtttgaatttcagtttcttcggggtttaggaattgggcgcaccgaggaggagccggagaagccaccaccgctacctcacacagccggggcgcctccggtcccgtgccagcggtctgccgccgccgcccctctctgagagaagccgcgaggggaggccgagaccgccgtcgccgcccgcccgcaggggtggttccccctgtaaggggaggaccgagccggctttcccctcccccagagcgggtttccgcctgaggcagtcgacatgtccctggggctgagctccggctagagccggggagggagggccgcctgcccgcgccacagccccaccgcccgcccgcggaccttcagccagctccggcccgcggctcccggctgaattaggcatctccgactccggactcgccgctccttccctcagtcagagagcccagcgctgacgccggcaccggcctgaggagcccgagcggggcagcaccgcccctcacgccgccgccaccgcctcctcctcctcctcttcgccctcccactcccacccccagccaaggcctgctgaccgcgccgagcgccgagctggactgaccacggctgcccggagacgagagaggaagcagccggcccgcccctgggttcgcgctctcgccgcctctgagggaattgaattgaggcgccgcggctgcgagagctaaaaaggaaggaggagccgccgcgggactgagacgggggcagagccgaagagaccgacacagagaaggaaacgaggaggaggatgtctcaccgggcggccagcgcctggatcagcccgtgactcttaacagcggcgggcctcagaccccagcgcagactcggactttgtctttgggggcccgtgctctgccctccccggtttccgacaggacccagaggagccggcgtgcctctctgccctccagccttcttcaccatgtccaagatgccggccaagaagaagagctgcttccagatcaccagtgtcaccacggcccaggtggccactagcatcaccgaggacaccgagagcttggacgacccggacgagtcacgcacagaggacgtctcctccgagattttcgacgtctctcgggccacggattatggccctgaggaggtctgcgagcgcagctcttccgaagagacgcttaacaatgttggggatgcggagactcccgggaccgtctccccaaacctcctcctagatgggcagctggcagcggcggctgctgctcccgccaacggaggaggagtcgtttcggcccggagcgtgtctggggcgctcgccagtaccctggcggcggctgccacttcggcccccgcccccggagcacccggcggcccccagctcgcgggctcatccgccgggccagtgactgcagccccatctcagcctcccaccacatgtagttcccgttttcgcgtgatcaagctggaccacgggagcggagagccctatagacgcggccgatggacgtgtatggaatactatgagagggattcagacagcagcgtcctgactagatccggggattgcattagacacagcagtacttttgaccagactgcggagcgggacagcggcctgggcgccaccggagggtcggtggtggtagtagtggcctccatgcagggggcgcacgggcccgagtcgggaactgacagctccttgactgctgtgtcacagctacccccgtcggagaaaatgagccagcccactccggcccagccgcagagttttagcgttgggcagccacagccgccgccgccacccgtaggtggggctgtggctcaaagctcggctccgctgccgccgttcccgggagccgcgaccgggccgcagccaatgatggcagccgcgcagcccagccagccccagggagcggggcccgggggacagactctgccgccgacgaatgtaaccctggcgcagccggctatgtccctgcctccgcagccgggccctgcagtgggcgcccccgcggcgcagcagccccagcagttcgcgtatcctcagcctcagataccgcccggacatttgctgcccgtccagccctccggccagagtgagtacctgcagcagcacgtggccggcctgcagccgccaagccccgcgcagccctcgtccaccggcgccgcagcgagccccgccacggcggccacccttcccgtgggcaccggccagaatgcttcctcggtgggcgcgcagctcatgggcgcgtcttcccagcccagcgaagccatggccccccggacgggaccagcgcaaggcgggcaggtcgcgccttgtcagccgactggagtgcccccggctactgtgggaggcgtggtgcagccgtgcctcggtcctgccggggctgggcagccccagtccgtgcctccgccgcagatgggtggcagtggtccgctgtcagccgtacctggtggccctcacgccgtggtgcccggagttccaaacgtgcctgcagccgtgcccgctccaagcgtgcctagtgtgtctaccacttctgttactatgccaaatgtacccgcgcctctggcccagtcgcaacagctgagcagccatacgccagtcagcaggagcagcagcataatccagcatgttgggctgcccttagcgccaggcacacacagcgcaccaacaagtctaccacagtctgacctaagccagtttcaaactcagacccagcctttagtcgggcaagtcgacgatactagaagaaaatcagaacccctacctcaaccaccactttctctcattgctgaaaataagcctgttgtgaagccgcctgttgcagattccctggcaaacccccttcagttaacacctatgaacagtctggccacctctgtattcagcatagctattcctgttgatggtgatgaagacaggaatccttcaactgctttctaccaagcgttccatttgaacacgttaaaggaatcaaagagcctctgggatagtgcatctgggggaggtgttgtagccattgacaacaaaatagaacaagcaatggatctggtgaaaagccatttgatgtatgcagtaagagaagaagtggaagttttaaaggaacaaataaaagaattagttgaaagaaactctttacttgaacgagaaaatgcactgttaaaatctctttcaagcaatgatcaattatcccaactcccaacccaacaggccaatcctggtagcacttctcaacagcaagcagtgatagcacagcctccgcagccaacgcaacctccacagcagccgaatgtctcctcagcataaagctttcttaagcctcattaagaaaaaaactgaaagcaatctatccttgtgtgccactggtgttctttccactttatacgaaagcaagtagccatgctttggttgtgtgtttggccttttcagtattagacaatcattctacaagagcttttcctctctctgagatgtcatgcagcgctgttgatgtccagttctatgtcatcagtacacaaggagaataatagatggggtttattaaagcgagcaaagtctgcattttacctggtgcgcatgagtggggtctttaagagttttggtggctctcccatgtttcctattacccatggatttaccctgagccttcctatcacattataaataacagttcatctaaagagccacttttctttctgattcagtaacatttgcctacataagttttcatttatttgtgttttatttattacagggctgctattttcataatgtacatgaacaatgtcacagaacttttttaatttttttgaataattataagtatcagtaaaggaagtgaaagacaggattgcatttaatagataaaacgtttaggcaataattgaacaaaagaatcctggcatatttctaacactaatggcaatttacttatggtatttattttcagtagtaaagacccagcttgaatgtaaattttgtatagtgtaagtatgaagaacatagtgcaactgtacaggtagtcaccagttattgtgatatgataaataattgggctattttgatgaagaaaactttgttcatttgtttctactttctaagagaaattgccacgattcctctgcttttcaacatttcgtatgacttttttttcgggtgggaataaaaagctgtgaaattgttcaacctactttgtaaccaaagaagcaaagctgtgtaatggagtttggtttttttttgttgtttttttttttttgtctttttttttttttataatgcacattctttatgtatttttatttagtgttttctcagtcacaattttctttactgtctagcatgatctgcatgacctataatctttgaaccactttcgtacctcatgtttttatccagcactcttattgtaatatgtactagtctgtgaacaatgtcaaataaaagagaacgaacaggtagtttggtggagctgagctagtgtacaatacactagttgtaaaaaaaaaaaaaaaaaaaagtgagccatcttttgttcatttaaaatggtgttttgaatttcgtatgcagaaaacgttttgttacattgcagattttaatgtatttaataaatgcaacatgcagattaagtgcagtgtatactgagtatttaaattaaaatgtacatttcataaatacagtttcaaaagaaagcatcattttgtgtatactaacacattaagtgtatgtcagaaattgatgtataaatatatattttaacattttctgaaattaaactgcagttttgttgaaatatttggctctatatgtgttcaaaatttgactagatttgtattttcacagttcaaaatactccttaaagacctgttaataatgacttactgatagttcttaaattttcaaagtaaaacaatttaaagaatgcaaaaatagtgagcaatatttgtactcaatattcatattatgttagtgatacttaagtaggaaatccttgtctaccaaaacttttacttgaattcagaaaggtgcctgtagaaattaacatgcactgcatctgtagccagctagctaatcagagttaatgagaaccagtagttagttctccgtgttaaaagacttatttgaagtaaaaatttaatcagattagccacaaacaaacaaggcataaaattgggatgtacatgagattgccaaatattttctattctagttgtgctgcaagacattgaacaaaatgttaatgaataacattataaatcaaggaactaagtacataggcttgagtaagcaaccctaaggatgtgtagtaagattccaagtagagctgctacaggtgagatacttaatggaatgtgaaacttcactgttggactgttaaccgaaaaggtttgctggctgtgcccctccagtgctaactgtgacatgtgatatttaatacaggtggagaaaaactagtcttagaaatgggatttttgtgaaaatagattccattttgattctggggctggaaaaacacttcataaacaaagtaatagtctccaaggaaatgaataataaggtttaaaatggtaacagcagttattactacttttatattaagaaaaacagtagaaaaggagagaaaatatgggtagttcacagaagagataaatggcagtttctaaaggttcaacctctagtaacctaagaaatgcaaattaatgtttttggcgaattgtaataagtgtcctaagtagcaggacttaacatagaaagaaagacaggctttcctgtgtacttttagaaagtaatttggcagtatgtatctagagccttaaataataagctttccagtgtaacgacaggagaagatactcaactcatggtccattgttcaaaaatgcagaattattgtggtgtctgccctctgctttcccatcatcccctcccctcaaaatccaaactatccctactgtcaacccttcccccagctgattgtttaggatcttaagtaacttccaattcagctttggagatttagtctcctgctccaaatagttgtaaatattaactgattgagatcccaatttggaggcacagtcttacaggaatgccatctatctaattctgtcagtgtaatgcccatagagcaaggtcccacataagcttttctgttttaatttagccggtaaatcataagtagaaatttttctgatacggtaattgtctacaattcaaacctaactttccccaaataaaatttagtttgttccgatgtgatctcacagcttgccacaccaaaaacaaatagtaggggttaggaggcattaaataaacagtttccttaactcctgattgtccaaaatagctgaatttttccaattctatttataatatcctatgctaattagaagtattgagataacgttttataatcaagcctccagtgactggggatcacagctgccattattcacaagaattttcacaggtgaatgattatatttctccaagttgcaaactccagtaattcatggacctttttttaaaaaaaaaaaaagtcttaatagaaccagaatatctctgttcttgaaaatttatctttgcagaaccagaaatagctaattgtctggaaacaatttttaagatttgaagtcacatttttaaaagaagctttatggctcagtggcaagcactttgtgacatttctttaataatcctatgaaaaggacaaaacccagccctcaaaattgacaatttgaggacataataagccaactgataatgcagtgaggaatacttgttactatgtacagtcagggatggttttgtcagggtaggtttcctcaaaaacatgacacctgagtcttgaaggtcataagagccagagggaagggtgttccaagcacaagaaaagagaactcaatggcttaaaagtataaacaaggctcctagggcagccacagaattgcattggagacaggcaggcagtgacttccccactgacctagtattttggcatctattcagaaagcaagaatgatttattgaatggttttaagcaatgggatactatgctcaaattatgctggatgtgcacaattccagtggcagatgggaggtaggttagagtagctgaaactggaagctgagaaataatttaggagggatgacaatccggaaaataaatgaaagggcaaaattacataggcaattttgtgaaggtcatgaaggaagtttgtcttgggtctttctgtaccattttcctctccacaatgaacatcccattcccagtgtcaggtatcaggtgcctattttctttttttcttttttctttttttttttttttgagacagagtcttgctgtgctcaggctggagtgcagtggcaagatctcggctcactgcaacctccgcctcccaggttcaagcgattctcctgcctcagcctcctgagtagctgggattacaggcgtgtgccaccatgccaggctaatttttgtatttttagtagagacagggtttcaccatgttggccaggttggtcttgaactcctgacctcaagtcatctcccccgcccgcctgggcctcccaaagtgttgggattacaggcgtgagccaccgcacccagctgcctattttcttgtccctccaaaaaaagattaaagagtcccaactcatacttgaaagtttgactcggtcttttccttccaacagttataaatctgtgaaatgaaagtctttgtttccttaaagggatttcaagaatttaacaaaagggttggggaatggaacctttgctgtcactatgcctgtctctcaattctaccctaaaggtaaactaaatggaatccttttatggtgactaggattaggatgttgattccaaagcctttccctaaaatctattccttgctccctggaaaggataatacaggttctggcccccactgtaggtactgacagcccaaggcagaataggttttgctaggctttagccttttattctttgacataggtcagtcctgcaggcttcttttttctaagtctcctgcctatccaaaaccagaccttttctcccacctccttctgcttcaagcctcttaataatccatatttctattttctagcaatagtaatagtttattatttagtgatgtatacttgcaccccatttactccttttcaatatttcaggatacatctttgtcctgtatttctgtaccagttcacagaatttctacagcaagatccctttaaatgtatggctttccttcataggttgcaaggattactttatacaagtgctactgtaactatatcttttgtggagtacaattggtatgacatgctgtgttcatagatgaaaatgctaagtgaggcactctgaagcaagttaaagttcacagacattcttgcttgcccaccacccccccgaaccccgccatggaatcatcaaataagaaaaataagacagattttcagattggtgatggcaaagtaagacgctggtattttgcactggcgcagtccatttagttgttgaatttgttcagcatacctggatggtgagtgagttagctttatttttcattctcagcagggaaactgatagactaggcagtttggggaattttcccattgtctactgtcatgggtccatagtatttaagtttacagactacaacattgtccacagaagccatatttatccccttggagggaagggaaaggtgtgctaacttagatcataaaaacaactgaattttaaaacaaggcaaatgccacagttcaacttctccataaaaaagttaagttcatctctccattcttttgcatgcctacaatatttccatataacaactgtaaaatactcttgcctgctgcaatccaaatgttatccggatcacagttcttgctgtcatttcacaggcatgcaatgtatctatagataggtcatatcatacctgaggaagatcagagacagcaagggaacattttccccacacttgagatggaaataataacaggtcagtggctaataaaaagaaacatgtatgactttgtaaaaccctaaaagtgatgttttcaagaaatttaggtttcttttttttattttataaaaaaaatgttgacatgcaatttaattctatttcaatttaggtgctgcaacctgtactggatgtttggggatagaaagatgaatgggacatgatttgtgtgctccaatgagctcagtccagtgtaagtgtaaaagttaaagtgccatattgtttattcagagtatatgttatagtttgtgaaccttatatcatttgttaaatgaaaggtttttataaatcaacagtaatattgccatcccatgtaaaaatcctttgatattgccaggaaacaactttaaatcaccagaaagctttaacatcaaataatacttttagaaggaggggaaaagccttccacctcgacatcgagcctatgaagtattccctaaaaaagaggaactaatctgagaaaagtttacacatttttaatactctaagttgtagataatgaaattgatttaaatcaaagttaactagaataggattcatgtgtcatgaattatattgtctattgtctcataagcaacaagtgacacttattatcttggctgacaaaatcagctaccatttaatgaaccaagttaagaataactcaggtgactgataccaaaaataaatctctaatacagctgagaatccagaaacacaaataatatgttgagtaagtaataaaagtgacatttcaaattagtaaggaaaaaatggattattcaacaaatagtatgggatagcataacaatttagaagaaatataaagttagatctttcacaaaaattaattctagctagactagcagttagtcttctactttttggttactcccttttagaaattggaagctatgaagctatataccctgtccatttgaaaatgcacataagcaaagaactttacaaataggttataaagagaagctcaatctcagcaaaataagggaagtgcacattaaaacacaagaaaccatctcagatccaactaatatttagcgtgcatacaaatcaaaagctggaaagggtgtggaaaaacaggaatacattgctagtgagcatacaaattggcacagcctcttttaaagacaattgtgtatcacccattaaattttaaaagtcacataccctgtgacctaacaattccaacttttaatgtcctaaagaaacatacatgtgttcacaagatagcctgtacaatgatgtcaattgcacctttgcttgtacagtagacccccttatctgcattttcactttttgaggtttcagtcatccaaggtcaaccacaatacaaaaatattaaatggaaaattccagaaacgaacataagttttaaacttcaaacctttctgcatagtataataaaaatctctcactatccctctccatcctgcctgggacaggaatcatccctttgtccagtgtatccacaatgtatacactcattatatacccattttataatgcccattagtcatttctattatcagatcataaaaaaacatagtacatagagggtttggtattattcatggtttcaggcattcagtgagggtcttggaaaatatcctccatgatgggggagctactgtaatactatgaaattggaaaaaccaaaatactcatcaagaggatggactatggtacacatgatgaagtattaagtatcaatgaaaaagagagagtcctacatgtccggcatggaaggatctccaggagacaatgttaaaagtttgggggaaaaattgaaagacaatacctgtaatacatatgatactagtgatgttaaatcacatcacacacacacacacacacacacacacacacacacaaatactgtatagtgtacttctacaagtacatatttgtgtattatatagagagaaggtctggaaggatactaaccaaactgtcaacagtagtttggtagcgtgcattagctttaactgtaatgtttgatgtttttgaatatgcatttatgtattgtttgtgtaatgacaaattaataaattagaaataaaataaaataatgtgtt

SEQ ID NO: 195647 - DNA, 2093 bp, Homo sapiens
  Payload ID: 18617
  Gene Name: TSC22 domain family, member 2
  ENST ID: ENST00000466814
  CDS Start-End: 1-613
aatccagcatgttgggctgcccttagcgccaggcacacacagcgcaccaacaagtctaccacagtctgacctaagccagtttcaaactcagacccagcctttagtcgggcaagtcgacgatactagaagaaaatcagaacccctacctcaaccaccactttctctcattgctgaaaataagcctgttgtgaagccgcctgttgcagattccctggcaaacccccttcagttaacacctatgaacagtctggccacctctgtattcagcatagctattcctgttgatggtgatgaagacagtgcatctgggggaggtgttgtagccattgacaacaaaatagaacaagcaatggatctggtgaaaagccatttgatgtatgcagtaagagaagaagtggaagttttaaaggaacaaataaaagaattagttgaaagaaactctttacttgaacgagaaaatgcactgttaaaatctctttcaagcaatgatcaattatcccaactcccaacccaacaggccaatcctggtagcacttctcaacagcaagcagtgatagcacagcctccgcagccaacgcaacctccacagcagccgaatgtctcctcagcataaagctttcttaagcctcattaagaaaaaaactgaaagcaatctatccttgtgtgccactggtgttctttccactttatacgaaagcaagtagccatgctttggttgtgtgtttggccttttcagtattagacaatcattctacaagagcttttcctctctctgagatgtcatgcagcgctgttgatgtccagttctatgtcatcagtacacaaggagaataatagatggggtttattaaagcgagcaaagtctgcattttacctggtgcgcatgagtggggtctttaagagttttggtggctctcccatgtttcctattacccatggatttaccctgagccttcctatcacattataaataacagttcatctaaagagccacttttctttctgattcagtaacatttgcctacataagttttcatttatttgtgttttatttattacagggctgctattttcataatgtacatgaacaatgtcacagaacttttttaatttttttgaataattataagtatcagtaaaggaagtgaaagacaggattgcatttaatagataaaacgtttaggcaataattgaacaaaagaatcctggcatatttctaacactaatggcaatttacttatggtatttattttcagtagtaaagacccagcttgaatgtaaattttgtatagtgtaagtatgaagaacatagtgcaactgtacaggtagtcaccagttattgtgatatgataaataattgggctattttgatgaagaaaactttgttcatttgtttctactttctaagagaaattgccacgattcctctgcttttcaacatttcgtatgacttttttttcgggtgggaataaaaagctgtgaaattgttcaacctactttgtaaccaaagaagcaaagctgtgtaatggagtttggtttttttttgttgtttttttttttttgtctttttttttttttataatgcacattctttatgtatttttatttagtgttttctcagtcacaattttctttactgtctagcatgatctgcatgacctataatctttgaaccactttcgtacctcatgtttttatccagcactcttattgtaatatgtactagtctgtgaacaatgtcaaataaaagagaacgaacaggtagtttggtggagctgagctagtgtacaatacactagttgtaaaaaaaaaaaaaaaaaaaagtgagccatcttttgttcatttaaaatggtgttttgaatttcgtatgcagaaaacgttttgttacattgcagattttaatgtatttaataaatgcaacatgcagattaagtgcagtgtatactgagtatttaaattaaaatgtacatttcataaatacagtttcaaaagaaagcatcattttgtgtatactaacacattaagtgtatgtcagaaattgatgtataaatatatattttaacattttctgaaattaaactgcagttttgttg

SEQ ID NO: 195648 - DNA, 826 bp, Homo sapiens
  Payload ID: 18617
  Gene Name: TSC22 domain family, member 2
  ENST ID: ENST00000480589
  CDS Start-End: 1-350
agctgagcagccatacgccagtcagcaggagcagcagcataatccagcatgttgggctgcccttagcgccaggcacacacagcgcaccaacaagtctaccacagtctgacctaagccagtttcaaactcagacccagcctttagtcgggcaagtcgacgatactagaagaaaatcagaacccctacctcaaccaccactttctctcattgctgaaaataagcctgttgtgaagccgcctgttgcagattccctggcaaacccccttcagttaacacctatgaacagtctggccacctctgtattcagcatagctattcctgttgatggtgatgaagacaggatctggtgaaaagccatttgatgtatgcagtaagagaagaagtggaagttttaaaggaacaaataaaagaattagttgaaagaaactctttacttgaacgagaaaatgcactgttaaaatctctttcaagcaatgatcaattatcccaactcccaacccaacaggccaatcctggtagcacttctcaacagcaagcagtgatagcacagcctccgcagccaacgcaacctccacagcagccgaatgtctcctcagcataaagctttcttaagcctcattaagaaaaaaactgaaagcaatctatccttgtgtgccactggtgttctttccactttatacgaaagcaagtagccatgctttggttgtgtgtttggccttttcagtattagacaatcattctacaagagcttttcctctctctgagatgtcatgcagcgctgttgatgtccagttctatgtcatcagtacacaaggagaataataga

SEQ ID NO: 195649 - DNA, 715 bp, Homo sapiens
  Payload ID: 18617
  Gene Name: TSC22 domain family, member 2
  ENST ID: ENST00000485421
  CDS Start-End: 1-245
ctgaaaataagcctgttgtgaagccgcctgttgcagattccctggcaaacccccttcagttaacacctatgaacagtctggccacctctgtattcagcatagctattcctgttgatggtgatgaagacaggaatccttcaactgctttctaccaagcgttccatttgaacacgttaaaggaatcaaagagcctctgggatagaattttttttagaattcagcatcggaggaggaatgtgacataataatgatcgaaagccgaaagtttaaaagttgtgatgccctcacatggttggagggttattctagcttctaaggactgaatgttgtccacaagagtgtcatcaggtcataaattgtgcatctgggggaggtgttgtagccattgacaacaaaatagaacaagcaatggatctggtgaaaagccatttgatgtatgcagtaagagaagaagtggaagttttaaaggaacaaataaaagaattagttgaaagaaactctttacttgaacgagaaaatgcactgttaaaatctctttcaagcaatgatcaattatcccaactcccaacccaacaggccaatcctggtagcacttctcaacagcaagcagtgatagcacagcctccgcagccaacgcaacctccacagcagccgaatgtctcctcagcataaagctttcttaagcctcattaagaaaaaaactgaaagcaatcta

SEQ ID NO: 195650 - DNA, 2213 bp, Homo sapiens
  Payload ID: 18618
  Gene Name: TSC22 domain family, member 3
  Uniprot ID: Q99576
  ENST ID: ENST00000315660
  CDS Start-End: 313-915
atatcccagtgctgactcccgggcgtgcagaccgctaactagctcactcgctctcagctcctgccaccgctcagccgtcacagcccaggggagcccgagagcctgagagcctgcaaaccggggagggagggagcaaaggagggagggagcaagggcgcgccctggctctccctctgccctgctgcccgcccttcctgcctccacagcttgtcttttccaggcaccctggagtcccctcaggccagctcggtgggcgcgcacctgccagccgcccctgacctcgcaggccaggcgacctccgagcctgagaagatggcccagtccaagctcgattgccgctcacctgtcggcctcgactgctgcaactgctgcctggacctggcccatcggagtgggctccagcgaggcagcagcggggagaacaacaacccgggcagccctacagtgagcaactttcggcagctgcaggaaaagctggtctttgagaacctcaataccgacaagctcaacagcataatgcggcaggattcgctagagccggtgctgcgggacccctgctacctgatcaacgagggcatctgcaaccgcaacatcgaccagaccatgctctccatcctgctcttcttccacagtgcctccggagccagcgtggtggccatagacaacaagatcgaacaggccatggatctggtgaagaatcatctgatgtatgctgtgagagaggaggtggagatcctgaaggagcagatccgagagctggtggagaagaactcccagctagagcgtgagaacaccctgttgaagaccctggcaagcccagagcagctggagaagttccagtcctgtctgagccctgaagagccagctcccgaatccccacaagtgcccgaggcccctggtggttctgcggtgtaagtggctctgtcctcagggtgggcagagccactaaacttgttttacctagttctttccagtttgtttttggctccccaagcatcatctcacgaggagaactttacacctagcacagctggtgccaagagatgtcctaaggacatggccacctgggtccactccagcgacagacccctgacaagagcaggtctctggaggctgagttgcatggggcctagtaacaccaagccagtgagcctctaatgctactgcgccctgggggctcccagggcctgggcaacttagctgcaactggcaaaggagaagggtagtttgaggtgtgacaccagtttgctccagaaagtttaaggggtctgtttctcatctccatggacatcttcaacagcttcacctgacaacgactgttcctatgaagaagccacttgtgttttaagcagaggcaacctctctcttctcctctgtttcgtgaaggcaggggacacagatgggagagattgagccaagtcagccttctgttggttaatatggtataatgcatggctttgtgcacagcccagtgtgggattacagctttgggatgaccgcttacaaagttctgtttggttagtattggcatagtttttctatatagccataaatgcgtatatatacccatagggctagatctgtatcttagtgtagcgatgtatacatatacacatccacctacatgttgaagggcctaaccagccttgggagtattgactggtcccttacctcttatggctaagtctttgactgtgttcatttaccaagttgacccagtttgtcttttaggttaagtaagactcgagagtaaaggcaaggaggggggccagcctctgaatgcggccacggatgccttgctgctgcaaccctttccccagctgtccactgaaacgtgaagtcctgttttgaatgccaaacccaccattcactggtgctgactacatagaatggggttgagagaagatcagtttgggcttcacagtgtcatttgaaaacgttttttgttttgttttgtaattattgtggaaaactttcaagtgaacagaaggatggtgtcctactgtggatgagggatgaacaaggggatggctttgatccaatggagcctgggaggtgtgcccagaaagcttgtctgtagcgggttttgtgagagtgaacactttccactttttgacaccttatcctgatgtatggttccaggatttggattttgattttccaaatgtagcttgaaatttcaataaactttgctctgtttttctaaaaataaa

SEQ ID NO: 195651 - DNA, 1216 bp, Homo sapiens
  Payload ID: 18618
  Gene Name: TSC22 domain family, member 3
  ENST ID: ENST00000372382
  CDS Start-End: 365-697
aattgctagagctgcttttccaagacagtgtccatctctccaccaagattctccttgggctccctcccactcatcatcgccttctgcatctgcatctgcattctcctccccattttcctgcccctgaaattcggagctctgggccctggccatgcagggcagttcacatgatccacagagaacaaggcactttctctttctctgtctttccttcttgcttccctccttctggactttggggattttccatgaaaccaaagtaactatgtaagtggcagtggccttcctgtctatagtctcccacactggagtggaaccagaagggaagagagaagataagcgagaagcaaggacaaattaaaccatggcatttcagcctccttattcctccagcctcttcagaaaaagggacaatgcctccggagccagcgtggtggccatagacaacaagatcgaacaggccatggatctggtgaagaatcatctgatgtatgctgtgagagaggaggtggagatcctgaaggagcagatccgagagctggtggagaagaactcccagctagagcgtgagaacaccctgttgaagaccctggcaagcccagagcagctggagaagttccagtcctgtctgagccctgaagagccagctcccgaatccccacaagtgcccgaggcccctggtggttctgcggtgtaagtggctctgtcctcagggtgggcagagccactaaacttgttttacctagttctttccagtttgtttttggctccccaagcatcatctcacgaggagaactttacacctagcacagctggtgccaagagatgtcctaaggacatggccacctgggtccactccagcgacagacccctgacaagagcaggtctctggaggctgagttgcatggggcctagtaacaccaagccagtgagcctctaatgctactgcgccctgggggctcccagggcctgggcaacttagctgcaactggcaaaggagaagggtagtttgaggtgtgacaccagtttgctccagaaagtttaaggggtctgtttctcatctccatggacatcttcaacagcttcacctgacaacgactgttcctatgaagaagccacttgtgttttaagcagaggcaacctctctcttctcctctgtttcgtgaaggcaggggacacagatgggagagattgagccaagtcagccttctgttgg

SEQ ID NO: 195652 - DNA, 2266 bp, Homo sapiens
  Payload ID: 18618
  Gene Name: TSC22 domain family, member 3
  Uniprot ID: Q99576
  ENST ID: ENST00000372383
  CDS Start-End: 369-971
ctccacaggtccgccccaatccccgctcacacttgggaaacttgggactgcgctggggccgcgtgtggcacctcaggggggcggcccccggcctcaagaggagggggaggagaaggaggaagaggaggaagtgagcccgaaggatccgctcggagctgtttgtccagctgtttctattcgcacccggagcagtacagccagaagggggccgagccgaaggtggctggctttaggcgctaatttccaactcttttcctcacagcttgtcttttccaggcaccctggagtcccctcaggccagctcggtgggcgcgcacctgccagccgcccctgacctcgcaggccaggcgacctccgagcctgagaagatggcccagtccaagctcgattgccgctcacctgtcggcctcgactgctgcaactgctgcctggacctggcccatcggagtgggctccagcgaggcagcagcggggagaacaacaacccgggcagccctacagtgagcaactttcggcagctgcaggaaaagctggtctttgagaacctcaataccgacaagctcaacagcataatgcggcaggattcgctagagccggtgctgcgggacccctgctacctgatcaacgagggcatctgcaaccgcaacatcgaccagaccatgctctccatcctgctcttcttccacagtgcctccggagccagcgtggtggccatagacaacaagatcgaacaggccatggatctggtgaagaatcatctgatgtatgctgtgagagaggaggtggagatcctgaaggagcagatccgagagctggtggagaagaactcccagctagagcgtgagaacaccctgttgaagaccctggcaagcccagagcagctggagaagttccagtcctgtctgagccctgaagagccagctcccgaatccccacaagtgcccgaggcccctggtggttctgcggtgtaagtggctctgtcctcagggtgggcagagccactaaacttgttttacctagttctttccagtttgtttttggctccccaagcatcatctcacgaggagaactttacacctagcacagctggtgccaagagatgtcctaaggacatggccacctgggtccactccagcgacagacccctgacaagagcaggtctctggaggctgagttgcatggggcctagtaacaccaagccagtgagcctctaatgctactgcgccctgggggctcccagggcctgggcaacttagctgcaactggcaaaggagaagggtagtttgaggtgtgacaccagtttgctccagaaagtttaaggggtctgtttctcatctccatggacatcttcaacagcttcacctgacaacgactgttcctatgaagaagccacttgtgttttaagcagaggcaacctctctcttctcctctgtttcgtgaaggcaggggacacagatgggagagattgagccaagtcagccttctgttggttaatatggtataatgcatggctttgtgcacagcccagtgtgggattacagctttgggatgaccgcttacaaagttctgtttggttagtattggcatagtttttctatatagccataaatgcgtatatatacccatagggctagatctgtatcttagtgtagcgatgtatacatatacacatccacctacatgttgaagggcctaaccagccttgggagtattgactggtcccttacctcttatggctaagtctttgactgtgttcatttaccaagttgacccagtttgtcttttaggttaagtaagactcgagagtaaaggcaaggaggggggccagcctctgaatgcggccacggatgccttgctgctgcaaccctttccccagctgtccactgaaacgtgaagtcctgttttgaatgccaaacccaccattcactggtgctgactacatagaatggggttgagagaagatcagtttgggcttcacagtgtcatttgaaaacgttttttgttttgttttgtaattattgtggaaaactttcaagtgaacagaaggatggtgtcctactgtggatgagggatgaacaaggggatggctttgatccaatggagcctgggaggtgtgcccagaaagcttgtctgtagcgggttttgtgagagtgaacactttccactttttgacaccttatcctgatgtatggttccaggatttggattttgattttccaaatgtagcttgaaatttcaataaactttgctctgtttttctaaaaat

SEQ ID NO: 195653 - DNA, 2199 bp, Homo sapiens
  Payload ID: 18618
  Gene Name: TSC22 domain family, member 3
  Uniprot ID: Q99576
  ENST ID: ENST00000372384
  CDS Start-End: 302-904
gtcatatcccagtgctgactcccgggcgtgcagaccgctaactagctcactcgctctcagctcctgccaccgctcagccgtcacagcccaggggagcccgagagcctgagagcctgcaaaccggggagggagggagcaaaggagggagggagcaagggcgcgccctggctctccctctgccctgctgcccgcccttcctgcctccacaggcaccctggagtcccctcaggccagctcggtgggcgcgcacctgccagccgcccctgacctcgcaggccaggcgacctccgagcctgagaagatggcccagtccaagctcgattgccgctcacctgtcggcctcgactgctgcaactgctgcctggacctggcccatcggagtgggctccagcgaggcagcagcggggagaacaacaacccgggcagccctacagtgagcaactttcggcagctgcaggaaaagctggtctttgagaacctcaataccgacaagctcaacagcataatgcggcaggattcgctagagccggtgctgcgggacccctgctacctgatcaacgagggcatctgcaaccgcaacatcgaccagaccatgctctccatcctgctcttcttccacagtgcctccggagccagcgtggtggccatagacaacaagatcgaacaggccatggatctggtgaagaatcatctgatgtatgctgtgagagaggaggtggagatcctgaaggagcagatccgagagctggtggagaagaactcccagctagagcgtgagaacaccctgttgaagaccctggcaagcccagagcagctggagaagttccagtcctgtctgagccctgaagagccagctcccgaatccccacaagtgcccgaggcccctggtggttctgcggtgtaagtggctctgtcctcagggtgggcagagccactaaacttgttttacctagttctttccagtttgtttttggctccccaagcatcatctcacgaggagaactttacacctagcacagctggtgccaagagatgtcctaaggacatggccacctgggtccactccagcgacagacccctgacaagagcaggtctctggaggctgagttgcatggggcctagtaacaccaagccagtgagcctctaatgctactgcgccctgggggctcccagggcctgggcaacttagctgcaactggcaaaggagaagggtagtttgaggtgtgacaccagtttgctccagaaagtttaaggggtctgtttctcatctccatggacatcttcaacagcttcacctgacaacgactgttcctatgaagaagccacttgtgttttaagcagaggcaacctctctcttctcctctgtttcgtgaaggcaggggacacagatgggagagattgagccaagtcagccttctgttggttaatatggtataatgcatggctttgtgcacagcccagtgtgggattacagctttgggatgaccgcttacaaagttctgtttggttagtattggcatagtttttctatatagccataaatgcgtatatatacccatagggctagatctgtatcttagtgtagcgatgtatacatatacacatccacctacatgttgaagggcctaaccagccttgggagtattgactggtcccttacctcttatggctaagtctttgactgtgttcatttaccaagttgacccagtttgtcttttaggttaagtaagactcgagagtaaaggcaaggaggggggccagcctctgaatgcggccacggatgccttgctgctgcaaccctttccccagctgtccactgaaacgtgaagtcctgttttgaatgccaaacccaccattcactggtgctgactacatagaatggggttgagagaagatcagtttgggcttcacagtgtcatttgaaaacgttttttgttttgttttgtaattattgtggaaaactttcaagtgaacagaaggatggtgtcctactgtggatgagggatgaacaaggggatggctttgatccaatggagcctgggaggtgtgcccagaaagcttgtctgtagcgggttttgtgagagtgaacactttccactttttgacaccttatcctgatgtatggttccaggatttggattttgattttccaaatgtagcttgaaatttcaataaactttgctctgtttttctaaaaat

SEQ ID NO: 195654 - DNA, 1812 bp, Homo sapiens
  Payload ID: 18618
  Gene Name: TSC22 domain family, member 3
  ENST ID: ENST00000372390
  CDS Start-End: 281-514
acgcaggaaggggggggtcaccgccgctctgggatccgtcatcgaagcgtccctgcggccgctgcgccgtgaaaaccagctgctgcagccgcagaggcagccggaggcagaggggcggcgggcaggaccagacagggctgggcagggggctggccgagcgccgtgcgccgcttgggagaaggccggaagcttaccagccgagaaggaattcctagctagcttcagagccggtgcctccggagccagcgtggtggccatagacaacaagatcgaacaggccatggatctggtgaagaatcatctgatgtatgctgtgagagaggaggtggagatcctgaaggagcagatccgagagctggtggagaagaactcccagctagagcgtgagaacaccctgttgaagaccctggcaagcccagagcagctggagaagttccagtcctgtctgagccctgaagagccagctcccgaatccccacaagtgcccgaggcccctggtggttctgcggtgtaagtggctctgtcctcagggtgggcagagccactaaacttgttttacctagttctttccagtttgtttttggctccccaagcatcatctcacgaggagaactttacacctagcacagctggtgccaagagatgtcctaaggacatggccacctgggtccactccagcgacagacccctgacaagagcaggtctctggaggctgagttgcatggggcctagtaacaccaagccagtgagcctctaatgctactgcgccctgggggctcccagggcctgggcaacttagctgcaactggcaaaggagaagggtagtttgaggtgtgacaccagtttgctccagaaagtttaaggggtctgtttctcatctccatggacatcttcaacagcttcacctgacaacgactgttcctatgaagaagccacttgtgttttaagcagaggcaacctctctcttctcctctgtttcgtgaaggcaggggacacagatgggagagattgagccaagtcagccttctgttggttaatatggtataatgcatggctttgtgcacagcccagtgtgggattacagctttgggatgaccgcttacaaagttctgtttggttagtattggcatagtttttctatatagccataaatgcgtatatatacccatagggctagatctgtatcttagtgtagcgatgtatacatatacacatccacctacatgttgaagggcctaaccagccttgggagtattgactggtcccttacctcttatggctaagtctttgactgtgttcatttaccaagttgacccagtttgtcttttaggttaagtaagactcgagagtaaaggcaaggaggggggccagcctctgaatgcggccacggatgccttgctgctgcaaccctttccccagctgtccactgaaacgtgaagtcctgttttgaatgccaaacccaccattcactggtgctgactacatagaatggggttgagagaagatcagtttgggcttcacagtgtcatttgaaaacgttttttgttttgttttgtaattattgtggaaaactttcaagtgaacagaaggatggtgtcctactgtggatgagggatgaacaaggggatggctttgatccaatggagcctgggaggtgtgcccagaaagcttgtctgtagcgggttttgtgagagtgaacactttccactttttgacaccttatcctgatgtatggttccaggatttggattttgattttccaaatgtagcttgaaatttcaataaactttgctctgtttttctaaaaataaa

SEQ ID NO: 195655 - DNA, 2027 bp, Homo sapiens
  Payload ID: 18618
  Gene Name: TSC22 domain family, member 3
  Uniprot ID: Q99576
  ENST ID: ENST00000372397
  CDS Start-End: 325-729
tttgcatggcccctgacgccatgtgacgcagccggctcctcctatataaagaagcaggagccaaaatatctccgagtctgggttggactggcggccgtggagtttgtgacatacgaggtgacacccctcgagtcacttcccttcaactccagctggagcgcctgcttggctttgggttcgttctgcagccttcgccccgctcctagcctcagggccggactccagcgcagagcccagcccagcgcagcctgccagcagccacccagccgcccagccgcccagccccgcacgaaacccggccagagcttcctagcagcccgagccatgaacaccgaaatgtatcagacccccatggaggtggcggtctaccagctgcacaatttctccatctccttcttctcttctctgcttggaggggatgtggtttccgttaagctggacaacagtgcctccggagccagcgtggtggccatagacaacaagatcgaacaggccatggatctggtgaagaatcatctgatgtatgctgtgagagaggaggtggagatcctgaaggagcagatccgagagctggtggagaagaactcccagctagagcgtgagaacaccctgttgaagaccctggcaagcccagagcagctggagaagttccagtcctgtctgagccctgaagagccagctcccgaatccccacaagtgcccgaggcccctggtggttctgcggtgtaagtggctctgtcctcagggtgggcagagccactaaacttgttttacctagttctttccagtttgtttttggctccccaagcatcatctcacgaggagaactttacacctagcacagctggtgccaagagatgtcctaaggacatggccacctgggtccactccagcgacagacccctgacaagagcaggtctctggaggctgagttgcatggggcctagtaacaccaagccagtgagcctctaatgctactgcgccctgggggctcccagggcctgggcaacttagctgcaactggcaaaggagaagggtagtttgaggtgtgacaccagtttgctccagaaagtttaaggggtctgtttctcatctccatggacatcttcaacagcttcacctgacaacgactgttcctatgaagaagccacttgtgttttaagcagaggcaacctctctcttctcctctgtttcgtgaaggcaggggacacagatgggagagattgagccaagtcagccttctgttggttaatatggtataatgcatggctttgtgcacagcccagtgtgggattacagctttgggatgaccgcttacaaagttctgtttggttagtattggcatagtttttctatatagccataaatgcgtatatatacccatagggctagatctgtatcttagtgtagcgatgtatacatatacacatccacctacatgttgaagggcctaaccagccttgggagtattgactggtcccttacctcttatggctaagtctttgactgtgttcatttaccaagttgacccagtttgtcttttaggttaagtaagactcgagagtaaaggcaaggaggggggccagcctctgaatgcggccacggatgccttgctgctgcaaccctttccccagctgtccactgaaacgtgaagtcctgttttgaatgccaaacccaccattcactggtgctgactacatagaatggggttgagagaagatcagtttgggcttcacagtgtcatttgaaaacgttttttgttttgttttgtaattattgtggaaaactttcaagtgaacagaaggatggtgtcctactgtggatgagggatgaacaaggggatggctttgatccaatggagcctgggaggtgtgcccagaaagcttgtctgtagcgggttttgtgagagtgaacactttccactttttgacaccttatcctgatgtatggttccaggatttggattttgattttccaaatgtagcttgaaatttcaataaactttgctctgtttttctaaaaataaa

SEQ ID NO: 195656 - DNA, 569 bp, Homo sapiens
  Payload ID: 18618
  Gene Name: TSC22 domain family, member 3
  ENST ID: ENST00000514426
  CDS Start-End: 139-537
atgcaatcgctacatctattgaaagggtaacgacagacggagatcaactaaggtggcagccctacagtgagcaactttcggcagctgcaggaaaagctggtctttgagaacctcaataccgacaagctcaacagcataatgcggcaggattcgctagagccggtgctgcgggacccctgctacctgatcaacgagggcatctgcaaccgcaacatcgaccagaccatgctctccatcctgctcttcttccacagtgcctccggagccagcgtggtggccatagacaacaagatcgaacaggccatggatctggtgaagaatcatctgatgtatgctgtgagagaggaggtggagatcctgaaggagcagatccgagagctggtggagaagaactcccagctagagcgtgagaacaccctgttgaagaccctggcaagcccagagcagctggagaagttccagtcctgtctgagccctgaagagccagctcccgaatccccacaagtgcccgaggcccctggtggttctgcggtgtaagtggctctgtcctcagggtgggcagagccact

SEQ ID NO: 195657 - DNA, 551 bp, Homo sapiens
  Payload ID: 18618
  Gene Name: TSC22 domain family, member 3
  ENST ID: ENST00000503515
  CDS Start-End: 252-551
gagtctgggttggactggcggccgtggagtttgtgacatacgaggtgacacccctcgagtcacttcccttcaactccagctggagcgcctgcttggctttgggttcgttctgcagccttcgccccgctcctagcctcagggccggactccagcgcagagcccagcccagcgcagcctgccagcagccacccagccgcccagccgcccagccccgcacgaaacccggccagagcttcctagcagcccgagccatgaacaccgaaatgtatcagacccccatggaggtggcggtctaccagctgcacaatttctccatctccttcttctcttctctgcttggaggggatgtggtttccgttaagctggacaacagtgcctccggagccagcgtggtggccatagacaacaagatcgaacaggccatggtgagtggcatcactgcgtcattctcatcccctgacttagctgctgcttatgtaactctgggcaggattgagggaatgggtgaaaaagcccttagccaaaaccctgaggaagccgacagcctgcct

SEQ ID NO: 195658 - DNA, 503 bp, Homo sapiens
  Payload ID: 18618
  Gene Name: TSC22 domain family, member 3
  ENST ID: ENST00000502961
  CDS Start-End: 330-503
aaaggccagacttgtgaatgaaggagccgatgcgggggtggggagtactgactgaaattattccaagtctctgagtcctgagaaaccctggaaacccaccacttgcccacccagaacatccctccatcttacagagctggggcacgcccctcaggcctgtgaacatgcaatcgctacatctattgaaagggtaacgacagacggagatcaactaaggtggcagcttgtcttttccaggcaccctggagtcccctcaggccagctcggtgggcgcgcacctgccagccgcccctgacctcgcaggccaggcgacctccgagcctgagaagatggcccagtccaagctcgattgccgctcacctgtcggcctcgactgctgcaactgctgcctggacctggcccatcggagtgggctccagcgaggcagcagcggggagaacaacaacccgggcagccctacagtgagcaactttcggcagctgcaggaaaagctggtctttgag

SEQ ID NO: 195659 - DNA, 581 bp, Homo sapiens
  Payload ID: 18618
  Gene Name: TSC22 domain family, member 3
  ENST ID: ENST00000510887
  CDS Start-End: 223-581
agagagaaggaaggggaggactgaggagagacggcgaaggggcagagggaaaccgggacagagactgcctctgaggggttcagggaagagaggacacagcgagctggggaaaggagcttgtcttttccaggcaccctggagtcccctcaggccagctcggtgggcgcgcacctgccagccgcccctgacctcgcaggccaggcgacctccgagcctgagaagatggcccagtccaagctcgattgccgctcacctgtcggcctcgactgctgcaactgctgcctggacctggcccatcggagtgggctccagcgaggcagcagcggggagaacaacaacccgggcagccctacagtgagcaactttcggcagctgcaggaaaagctggtctttgagaacctcaataccgacaagctcaacagcataatgcggcaggattcgctagagccggtgctgcgggacccctgctacctgatcaacgagggcatctgcaaccgcaacatcgaccagaccatgctctccatcctgctcttcttccacagtgcctccggagccagcgtggtggccatagacaacaagat

SEQ ID NO: 195660 - DNA, 567 bp, Homo sapiens
  Payload ID: 18618
  Gene Name: TSC22 domain family, member 3
  ENST ID: ENST00000502650
  CDS Start-End: 220-567
aagggtgcgggcggggtggggcgaggggtggagggacaggatccagccgctcggggcccccgcccgccagccggagaagtggcggaggaccgttctccgccgtcccctctaggcttgtcttttccaggcaccctggagtcccctcaggccagctcggtgggcgcgcacctgccagccgcccctgacctcgcaggccaggcgacctccgagcctgagaagatggcccagtccaagctcgattgccgctcacctgtcggcctcgactgctgcaactgctgcctggacctggcccatcggagtgggctccagcgaggcagcagcggggagaacaacaacccgggcagccctacagtgagcaactttcggcagctgcaggaaaagctggtctttgagaacctcaataccgacaagctcaacagcataatgcggcaggattcgctagagccggtgctgcgggacccctgctacctgatcaacgagggcatctgcaaccgcaacatcgaccagaccatgctctccatcctgctcttcttccacagtgcctccggagccagcgtggtggccata

SEQ ID NO: 195661 - DNA, 546 bp, Homo sapiens
  Payload ID: 18618
  Gene Name: TSC22 domain family, member 3
  ENST ID: ENST00000480691
  CDS Start-End: 179-546
agggtaacgacagacggagatcaactaaggtggcaggtaaggttcagaaaaggagaaggacaacaaatttggagaaataggagaaggcaccctggagtcccctcaggccagctcggtgggcgcgcacctgccagccgcccctgacctcgcaggccaggcgacctccgagcctgagaagatggcccagtccaagctcgattgccgctcacctgtcggcctcgactgctgcaactgctgcctggacctggcccatcggagtgggctccagcgaggcagcagcggggagaacaacaacccgggcagccctacagtgagcaactttcggcagctgcaggaaaagctggtctttgagaacctcaataccgacaagctcaacagcataatgcggcaggattcgctagagccggtgctgcgggacccctgctacctgatcaacgagggcatctgcaaccgcaacatcgaccagaccatgctctccatcctgctcttcttccacagtgcctccggagccagcgtggtggccatagacaacaagatcgaacaggc

SEQ ID NO: 195662 - DNA, 425 bp, Homo sapiens
  Payload ID: 18618
  Gene Name: TSC22 domain family, member 3
  ENST ID: ENST00000505965
  CDS Start-End: 173-425
tctatttcaaaggccagacttgtgaatgaaggagccgatgcgggggtggggagtactgactgaaatcttgtcttttccaggcaccctggagtcccctcaggccagctcggtgggcgcgcacctgccagccgcccctgacctcgcaggccaggcgacctccgagcctgagaagatggcccagtccaagctcgattgccgctcacctgtcggcctcgactgctgcaactgctgcctggacctggcccatcggagtgggctccagcgaggcagcagcggggagaacaacaacccgggcagccctacagtgagcaactttcggcagctgcaggaaaagctggtctttgagaacctcaataccgacaagctcaacagcataatgcggcaggattcgctagagccggtgctgcgggacccctgctacctga

SEQ ID NO: 195663 - DNA, 576 bp, Homo sapiens
  Payload ID: 18618
  Gene Name: TSC22 domain family, member 3
  ENST ID: ENST00000486554
  CDS Start-End: 501-576
gggggctggccgagcgccgtgcgccgcttgggagaaggccggaagcttaccagccgagaaggaattcctagctagcttcagagccgggtaggtttgcctgggaccttgtaggccggctgtgggggactccccgggtcgcacagccccattgtttgcatattgcccgagcaggccacggtggcctgcgcgccccaggactcgcaagcagctccgatcggttggaactcggggcggcggcagcagcgctgagccggcctggatgaggagatgcagcttcctgcaggggccaaggaaggatctggggacaaactgtccggaactctgggccagggaggcgagaaggagagagagaggaagagccgaggcagatggaggactttggccacaactgccatgtactcaagagtagaaccgagtgggtaatgggtcgctttgctttttgtcttggcagtgcctccggagccagcgtggtggccatagacaacaagatcgaacaggccatggatctggtgaagaatcatctgatgtatgctgtgagagaggaggtggagatcctgaaggagcagatccgagagc

SEQ ID NO: 195664 - DNA, 521 bp, Homo sapiens
  Payload ID: 18618
  Gene Name: TSC22 domain family, member 3
  ENST ID: ENST00000506724
  CDS Start-End: 220-521
gcgtgcgtatttctggcggaggatgcgccatgagcgctgaaagagcctgaaccgaagcgtccggctcgccgagagagtgagagccgggccggctcccaggagcgcgggcgaggcttgtcttttccaggcaccctggagtcccctcaggccagctcggtgggcgcgcacctgccagccgcccctgacctcgcaggccaggcgacctccgagcctgagaagatggcccagtccaagctcgattgccgctcacctgtcggcctcgactgctgcaactgctgcctggacctggcccatcggagtgggctccagcgaggcagcagcggggagaacaacaacccgggcagccctacagtgagcaactttcggcagctgcaggaaaagctggtctttgagaacctcaataccgacaagctcaacagcataatgcggcaggattcgctagagccggtgctgcgggacccctgctacctgatcaacgagggcatctgcaaccgcaacatcgaccagaccatgctctccat

SEQ ID NO: 195665 - DNA, 802 bp, Homo sapiens
  Payload ID: 18618
  Gene Name: TSC22 domain family, member 3
  ENST ID: ENST00000514897
  CDS Start-End: 430-802
gctgctctatttcaaaggccagacttgtgaatgaaggagccgatgcgggggtggggagtactgactgaaatgtaagtcagttttacgtgaaaactgaacgtcatgaaaagtttagttttttcagacactaatcgttatttaatcctacacatttaaagtattccaagtctctgagtcctgagaaaccctggaaacccaccacttgcccacccagaacatccctccatcttacagagctggggcacgcccctcaggcctgtgaacatgcaatcgctacatctattgaaagggtaacgacagacggagatcaactaaggtggcagcttgtcttttccaggcaccctggagtcccctcaggccagctcggtgggcgcgcacctgccagccgcccctgacctcgcaggccaggcgacctccgagcctgagaagatggcccagtccaagctcgattgccgctcacctgtcggcctcgactgctgcaactgctgcctggacctggcccatcggagtgggctccagcgaggcagcagcggggagaacaacaacccgggcagccctacagtgagcaactttcggcagctgcaggaaaagctggtctttgagaacctcaataccgacaagctcaacagcataatgcggcaggattcgctagagccggtgctgcgggacccctgctacctgatcaacgagggcatctgcaaccgcaacatcgaccagaccatgctctccatcctgctcttcttccacagtgcctccggagccagcgtggtggccatagacaacaagatcgaacaggccatgg

SEQ ID NO: 195666 - DNA, 956 bp, Homo sapiens
  Payload ID: 18618
  Gene Name: TSC22 domain family, member 3
  Uniprot ID: Q99576
  ENST ID: ENST00000506081
  CDS Start-End: 205-807
acatctattgaaagggtaacgacagacggagatcaactaaggtggcaggtaaggttcagaaaaggagaaggacaacaaatttggagaaataggagaagcttgtcttttccaggcaccctggagtcccctcaggccagctcggtgggcgcgcacctgccagccgcccctgacctcgcaggccaggcgacctccgagcctgagaagatggcccagtccaagctcgattgccgctcacctgtcggcctcgactgctgcaactgctgcctggacctggcccatcggagtgggctccagcgaggcagcagcggggagaacaacaacccgggcagccctacagtgagcaactttcggcagctgcaggaaaagctggtctttgagaacctcaataccgacaagctcaacagcataatgcggcaggattcgctagagccggtgctgcgggacccctgctacctgatcaacgagggcatctgcaaccgcaacatcgaccagaccatgctctccatcctgctcttcttccacagtgcctccggagccagcgtggtggccatagacaacaagatcgaacaggccatggatctggtgaagaatcatctgatgtatgctgtgagagaggaggtggagatcctgaaggagcagatccgagagctggtggagaagaactcccagctagagcgtgagaacaccctgttgaagaccctggcaagcccagagcagctggagaagttccagtcctgtctgagccctgaagagccagctcccgaatccccacaagtgcccgaggcccctggtggttctgcggtgtaagtggctctgtcctcagggtgggcagagccactaaacttgttttacctagttctttccagtttgtttttggctccccaagcatcatctcacgaggagaactttacacctagcacagctggtgccaagagatgtcctaaggacatggccac

SEQ ID NO: 195667 - DNA, 2383 bp, Homo sapiens
  Payload ID: 18619
  Gene Name: TSC22 domain family, member 4
  Uniprot ID: Q9Y3Q8
  ENST ID: ENST00000300181
  CDS Start-End: 756-1943
ggaggaggaggaggaggagaggagcagtcagcaggcccgaggaggcaggacttcctggtgtgggggttgtcaacagcccagaaagagaaagacggagaggcagagacccaggggagccgaggagcggagacacggacccagcagggtcacgcgggaggagactcgggacacccactcgctggctgccaccgggagcagaggggggctcggccgccccctcccacatcagtctccagacccttggggcttcagaggccgctcctaggctcctcggaggaggcgcgggtttcttcttttccggagagcaaactttcctcggagatgcctggcaggatgagccgcggcccccggagaggacgggacagcctctgatcgccgcctgcgtgccccgccactgcccatggccaggaggccccagggaacggacagcccgacctcttaggcgccgggaccctcaggctcagatcagtggccgaggccccagagtttgcaaactcagctctggagttcagcagcaacagcagcaggaaaaacctgcccctgctcccccctcccgccacctcccctctcctcttctcccctcacccagcaggcacccccggttcccgccaggccctcctgccatgtcggacccagacgtccccaggggctcggatgtccccgccatgtggcccccttgttccaggggtgcctgagccccttcaaggagccccaacccacccccaaccttggcccagccctgagccccagggaccatgagcgggggcaagaagaagagtagtttccaaatcaccagcgtcaccacggactatgagggccctgggagcccaggggcttcggatccccctaccccacagcccccaaccgggcccccgccccgcctgcccaatggggagcccagccccgatccggggggcaagggcaccccccggaatggctccccaccacctggggccccttcctcccgtttccgggtggtgaagctgccccacggcctgggagagccttatcgccgcggtcgctggacgtgtgtggatgtttatgagcgagacctggagccccacagcttcggcggactcctggagggaattcgaggggcctcagggggcgccgggggcagatctttggattccaggttggagctggccagcctcggcctgggcgcccccaccccaccgtcaggcctgtctcagggccccacctcctggctccgtccaccccccacctctcctggacctcaggcccgctccttcactgggggactgggccagctggtggtgcccagcaaagccaaggcagagaaacccccactgtcggcctcctcaccccagcagcgccccccagagcctgagaccggtgagagtgcgggcacatcccgggctgccacgcccctgccctctctgagggtggaagcggaggctgggggctcaggggccaggacccctccactgtcccggaggaaagctgtagacatgcggctgcggatggagttgggtgctccagaagagatggggcaggtgcccccacttgactctcgccccagctccccagccctctacttcacccacgatgccagcctggttcacaaatctccagaccccttcggagcagtagcagctcagaagttcagcctggcccactccatgttggccatcagtggtcacctagacagcgacgatgatagtggctccggaagcctggttggcattgacaacaaaatcgagcaagccatggacttggtgaagtcccacctcatgtttgcggtccgggaggaggtggaggtgctgaaggagcagatccgggaattggcggagcggaacgctgcgctggagcaggagaatgggctgctgcgcgccctggccagcccggagcagctggctcagctgccctcctcgggggtcccacggcttgggccccctgcgcccaatgggccctccgtctgagcctcccttcccttacaatgtgcctttggggctgcccggccttgcgtcagccgcctgccccctcttcctatgcagctttaatgtccccgtgtccccggggtgggagttcaaggctcagtaatggcctggtcccccggcccctgccccatctcctcatcatccccagccttgatggaggagggagggcttcaggacggggcgtcagagggagccccctctgggagggaaccaacccccaccctccctcctgggaccccccagcagtagacggcttgggggagtcggaggctccccggcagacaccccacccccatcttgttcccttgaggtgcctcctctcctctgcccaggggagggagtgtggacagtatctggaagttctgggattcaggttgttattaaaataataataataattaaaaactctgaagaaacttgaa

SEQ ID NO: 195668 - DNA, 1469 bp, Homo sapiens
  Payload ID: 18619
  Gene Name: TSC22 domain family, member 4
  Uniprot ID: Q9Y3Q8
  ENST ID: ENST00000393991
  CDS Start-End: 578-1048
ggacttcctggtgtgggggttgtcaacagcccagaaagagaaagacggagaggcagagacccaggggagccgaggagcggagacacggacccagcagggtcacgcgggaggagactcgggacacccactcgctggctgccaccgggagcagaggggggctcggccgccccctcccacatcagtctccagacccttggggcttcagaggccgctcctaggctcctcggaggaggcgcgggtttcttcttttccggagagcaaactttcctcggagatgcctggcaggatgagccgcggcccccggagaggacgggacagcctctgatcgccgcctgcgtgccccgccactgcccatggccaggaggccccagggaacggacagcccgacctcttaggcgccgggaccctcaggctcagatcagtggccgaggccccagagcgccccccagagcctgagaccggtgagagtgcgggcacatcccgggctgccacgcccctgccctctctgagggtggaagcggaggctgggggctcaggggccaggacccctccactgtcccggaggaaagctgtagacatgcggctgcggatggagttgggtgctccagaagagatggggcaggtgcccccacttgactctcgccccagctccccagccctctacttcacccacgatgccagcctggttcacaaatctccagaccccttcggagcagtagcagctcagaagttcagcctggcccactccatgttggccatcagtggtcacctagacagcgacgatgatagtggctccggaagcctggttggcattgacaacaaaatcgagcaagccatggacttggtgaagtcccacctcatgtttgcggtccgggaggaggtggaggtgctgaaggagcagatccgggaattggcggagcggaacgctgcgctggagcaggagaatgggctgctgcgcgccctggccagcccggagcagctggctcagctgccctcctcgggggtcccacggcttgggccccctgcgcccaatgggccctccgtctgagcctcccttcccttacaatgtgcctttggggctgcccggccttgcgtcagccgcctgccccctcttcctatgcagctttaatgtccccgtgtccccggggtgggagttcaaggctcagtaatggcctggtcccccggcccctgccccatctcctcatcatccccagccttgatggaggagggagggcttcaggacggggcgtcagagggagccccctctgggagggaaccaacccccaccctccctcctgggaccccccagcagtagacggcttgggggagtcggaggctccccggcagacaccccacccccatcttgttcccttgaggtgcctcctctcctctgcccaggggagggagtgtggacagtatctggaagttctgggattcaggttgttattaaaataataataataattaaa

SEQ ID NO: 195669 - DNA, 1071 bp, Homo sapiens
  Payload ID: 18619
  Gene Name: TSC22 domain family, member 4
  ENST ID: ENST00000423266
  CDS Start-End: 1-635
gtctcctctctgcctgcctggcaccagccagaccctgctctgcccggggggctctgagccccccaggcattcccttcactgcatccctctccattgggggggtgtctaaggaccctttccccttgggcatggcccagccaggggtctctgtcaagtccctggtgtcgtcttatgagacccgagtggtggggatggctccggggctgccccgaaaaaggggctgtgcctcttccccttgctctccccggggtgcatcccccatccgagggacatctgggcccccgccccaccggggcctgggaggccctgggcagcggccttcaacccgcagggggatggacaaaaccctcctctccctcattctctactgtcacagtggctccggaagcctggttggcattgacaacaaaatcgagcaagccatggacttggtgaagtcccacctcatgtttgcggtccgggaggaggtggaggtgctgaaggagcagatccgggaattggcggagcggaacgctgcgctggagcaggagaatgggctgctgcgcgccctggccagcccggagcagctggctcagctgccctcctcgggggtcccacggcttgggccccctgcgcccaatgggccctccgtctgagcctcccttcccttacaatgtgcctttggggctgcccggccttgcgtcagccgcctgccccctcttcctatgcagctttaatgtccccgtgtccccggggtgggagttcaaggctcagtaatggcctggtcccccggcccctgccccatctcctcatcatccccagccttgatggaggagggagggcttcaggacggggcgtcagagggagccccctctgggagggaaccaacccccaccctccctcctgggaccccccagcagtagacggcttgggggagtcggaggctccccggcagacaccccacccccatcttgttcccttgaggtgcctcctctcctctgcccaggggagggagtgtggacagtatctggaagttctgggattcaggttgttattaaaataataataataattaaaaactctgaagaaact

SEQ ID NO: 195670 - DNA, 503 bp, Homo sapiens
  Payload ID: 18619
  Gene Name: TSC22 domain family, member 4
  ENST ID: ENST00000456330
  CDS Start-End: 1-503
ggcactgtctcctctctgcctgcctggcaccagccagaccctgctctgcccggggggctctgagccccccaggcattcccttcactgcatccctctccattgggggggtgtctaaggaccctttccccttgggcatggcccagccaggggtctctgtcaagtccctggtgtcgtcttatgagacccgagtggtggggatggctccggggctgccccgaaaaaggggctgtgcctcttccccttgctctccccggggtgcatcccccatccgagggacatctgggcccccgccccaccggggcctgggaggccctgggcagcggccttcaacccgcagggggatggacaaaaccctcctctccctcattctctactgtcacagtggctccggaagcctggttggcattgacaacaaaatcgagcaagccatgccctcaaggcactgggcaggggatgaggcacccaccccgttgacgctgtgcctgtcccggggcccccaggac

SEQ ID NO: 195671 - DNA, 1960 bp, Homo sapiens
  Payload ID: 18620
  Gene Name: TSEN15 tRNA splicing endonuclease subunit
  Uniprot ID: Q8WW01
  ENST ID: ENST00000361641
  CDS Start-End: 80-595
ggaacccacaggcgcgcgcgccgctgcttctggccgggcgcgggtcgtggtgcaccacgggagcgccgcaccggccggcatggaggagcgcggcgattccgagccgacccccggctgcagcggcctgggtccgggcggtgttcgcggctttggcgacggcggtggagctccttcgtgggcccctgaggacgcctggatgggcactcaccctaagtatctagaaatgatggaattagatataggagatgccacccaagtttatgtagcgttcttggtttacctggacctcatggaaagcaaaagctggcatgaagtaaactgtgtaggattaccagaactccagctcatctgccttgttggtactgagatagaaggggaggggttacagactgtggtgcctacccccatcactgcttccctcagccataacaggataagggagatcttgaaggcatctcgaaagttgcaaggtgatccagatttgccgatgtcttttactttggccatagtggagtctgattctacaatagtctattataaacttactgatggatttatgctgccagaccctcagaatatttctcttagaagatgacatccatgtttcctgatgcttgttttattcatacaagattggatttgagacccatcagactgcttcatcttttatctcagaaatagggttgacgtacatagtgagggttgacttccccattccataaggttttcattctgaagagtaaaacttccccaggtagaagactttctccttcttaaaaaatatagggtgatttctttaaaactttgttatctagagacagtttaattacagttatatacaggtttatgcctaggatgtattcagatgggtgggacctgtgtgctgcttttgtcatcccacactcaaagttgtctctttgtttcttgctgccactgccagctcattgttgagactgccatttctttctcttactcagctctccccagtgccttttggccactgcagctaccgtagaatggcattttatatgtaccttgtcacccacttctgtttactttttcctctccagtaaaaagtaaaagatttctttcaattggtcttcccattgcagttactgttatttctcttttttggttaactttaaatcaaaactcaaaatatgttcatccagagtgtgtcttaagtaacttacgtgtcttaagtaacagggaccagagacatgttacctacaagagttctgggctatccttttcattcttatcacatatcatagcttgaatattacaacagtgtgggagagaatcaaccgtaaaaatgtcttcattaattagacccagttattccacttttgttaatgtctctcaaattgtacaaagtataaaaaattatatgcacaaagatgttccaagtgacattacttttagtagcccaaattataaaccactttaaagtttggggtaaagattggcaaactttttctataaagggccagaaagtaactattttaggtttttaaacctactgtctctgtcataacttgtcaacactgctgtatgaagcacaaaagcagccatagacaatacataaacaatacgggcgtggctttgttccagtaaaactttgtttacaaatgtggtgccatagtttgtcatccctgggtctaggaaatagtcaataaacagatatatacaaatgatacataatgtacttattaaaaattagtaatgaatattattaaaaacatgaaaatattaccttaagtaaaaattgcaagacggaaaagtgtataagtgggtgtaatcatggctgaaataacagaccaagcatatgataaaaagataacaaagtaaatcaaattactaactggttatagtgggataggaggcagaaaatggatgactttgtcttttctcaatgtttttatttgtattttataataaaaatgttttaaaattaaaa

SEQ ID NO: 195672 - DNA, 1743 bp, Homo sapiens
  Payload ID: 18620
  Gene Name: TSEN15 tRNA splicing endonuclease subunit
  Uniprot ID: Q8WW01
  ENST ID: ENST00000423085
  CDS Start-End: 11-400
accggccggcatggaggagcgcggcgattccgagccgacccccggctgcagcggcctgggtccgggcggtgttcgcggctttggcgacggcggtggagctccttcgtgggcccctgaggacgcctggatgggcactcaccctaagtatctagaaatgatggaattagatataggagatgccacccaagtttatgtagcgttcttggtttacctggacctcatggaaagcaaaagctggcatgaagtaaactgtgtaggattaccagaactccagctcatctgccttgttggtactgagatagaaggggaggggttacagactgtggtgcctacccccatcactgcttccctcagccataacagaatatttctcttagaagatgacatccatgtttcctgatgcttgttttattcatacaagattggatttgagacccatcagactgcttcatcttttatctcagaaatagggttgacgtacatagtgagggttgacttccccattccataaggttttcattctgaagagtaaaacttccccaggtagaagactttctccttcttaaaaaatatagggtgatttctttaaaactttgttatctagagacagtttaattacagttatatacaggtttatgcctaggatgtattcagatgggtgggacctgtgtgctgcttttgtcatcccacactcaaagttgtctctttgtttcttgctgccactgccagctcattgttgagactgccatttctttctcttactcagctctccccagtgccttttggccactgcagctaccgtagaatggcattttatatgtaccttgtcacccacttctgtttactttttcctctccagtaaaaagtaaaagatttctttcaattggtcttcccattgcagttactgttatttctcttttttggttaactttaaatcaaaactcaaaatatgttcatccagagtgtgtcttaagtaacttacgtgtcttaagtaacagggaccagagacatgttacctacaagagttctgggctatccttttcattcttatcacatatcatagcttgaatattacaacagtgtgggagagaatcaaccgtaaaaatgtcttcattaattagacccagttattccacttttgttaatgtctctcaaattgtacaaagtataaaaaattatatgcacaaagatgttccaagtgacattacttttagtagcccaaattataaaccactttaaagtttggggtaaagattggcaaactttttctataaagggccagaaagtaactattttaggtttttaaacctactgtctctgtcataacttgtcaacactgctgtatgaagcacaaaagcagccatagacaatacataaacaatacgggcgtggctttgttccagtaaaactttgtttacaaatgtggtgccatagtttgtcatccctgggtctaggaaatagtcaataaacagatatatacaaatgatacataatgtacttattaaaaattagtaatgaatattattaaaaacatgaaaatattaccttaagtaaaaattgcaagacggaaaagtgtataagtgggtgtaatcatggctgaaataacagaccaagcatatgataaaaagataacaaagtaaatcaaattactaactggttatagtgggataggaggcagaaaatggatgactttgtcttttctcaatgtttttatttgtattttataataaaaatgttttaaaa

SEQ ID NO: 195673 - DNA, 1628 bp, Homo sapiens
  Payload ID: 18620
  Gene Name: TSEN15 tRNA splicing endonuclease subunit
  ENST ID: ENST00000462677
  CDS Start-End: 1-410
aggagcgcggcgattccgagccgacccccggctgcagcggcctgggtccgggcggtgttcgcggctttggcgacggcggtggagctccttcgtgggcccctgaggacgcctggatgggcactcaccctaagtatctagaaatgatggaattagatataggagatgccacccaagtttatgtagcgttcttggtttacctggacctcatggaaagcaaaagctggcatgaagtaaactgtgtaggattaccagaactccagctcatctgccttgttggtactgagatagaaggggaggggttacagactgtggtgcctacccccatcactgcttccctcagccataacagatattggcgtgccacttttgaagaaggaaaatacttagctacattaaaagatttgcattgaagaagcaattgtgatatgctgccttttatcacagtgtgacttcccatcagtgctgagataagggagatcttgaaggcatctcgaaagttgcaaggtgatccagatttgccgatgtcttttactttggccatagtggagtctgattctacaatagtctattataaacttactgatggatttatgctgccagaccctcagaatatttctcttagaagatgacatccatgtttcctgatgcttgttttattcatacaagattggatttgagacccatcagactgcttcatcttttatctcagaaatagggttgacgtacatagtgagggttgacttccccattccataaggttttcattctgaagagtaaaacttccccaggtagaagactttctccttcttaaaaaatatagggtgatttctttaaaactttgttatctagagacagtttaattacagttatatacaggtttatgcctaggatgtattcagatgggtgggacctgtgtgctgcttttgtcatcccacactcaaagttgtctctttgtttcttgctgccactgccagctcattgttgagactgccatttctttctcttactcagctctccccagtgccttttggccactgcagctaccgtagaatggcattttatatgtaccttgtcacccacttctgtttactttttcctctccagtaaaaagtaaaagatttctttcaattggtcttcccattgcagttactgttatttctcttttttggttaactttaaatcaaaactcaaaatatgttcatccagagtgtgtcttaagtaacttacgtgtcttaagtaacagggaccagagacatgttacctacaagagttctgggctatccttttcattcttatcacatatcatagcttgaatattacaacagtgtgggagagaatcaaccgtaaaaatgtcttcattaattagacccagttattccacttttgttaatgtctctcaaattgtacaaagtataaaaaattatatgcacaaagatgttccaagtgacattacttttagtagcccaaattataaaccactttaaagtttggggtaaagattggcaaactttttctataaagggccagaaagtaactattttaggtttttaaacctactgtctctgtcataacttgtcaacactgctgtatgaagcacaaaagcagccatagacaatacataaacaata

SEQ ID NO: 195674 - DNA, 806 bp, Homo sapiens
  Payload ID: 18620
  Gene Name: TSEN15 tRNA splicing endonuclease subunit
  ENST ID: ENST00000485209
  CDS Start-End: 78-437
aacccacaggcgcgcgcgccgctgcttctggccgggcgcgggtcgtggtgcaccacgggagcgccgcaccggccggcatggaggagcgcggcgattccgagccgacccccggctgcagcggcctgggtccgggcggtgttcgcggctttggcgacggcggtggagctccttcgtgggcccctgaggacgcctggatgggcactcaccctaagtatctagaaatgatggaattagatataggagatgccacccaagtttatgtagcgttcttggtttacctggacctcatggaaagcaaaagctggcatgaagtaaactgtgtaggattaccagaactccagctcatctgccttgttggtactgagatagaaggggaggggttacagactgtggtgcctacccccatcactgcttccctcagccataacaggtggtaattaatgcttttctagcttgaatggctaaagcttgttttcttcttcaagtagaattagttggaatgataacttggataagggagatcttgaaggcatctcgaaagttgcaaggtgatccagatttgccgatgtcttttactttggccatagtggagtctgattctacaatagtctattataaacttactgatggatttatgctgccagaccctcagaatatttctcttagaagatgacatccatgtttcctgatgcttgttttattcatacaagattggatttgagacccatcagactgcttcatcttttatctcagaaatagggttgacgtacatagtgagggttgacttccccattccataaggtttt

SEQ ID NO: 195675 - DNA, 618 bp, Homo sapiens
  Payload ID: 18620
  Gene Name: TSEN15 tRNA splicing endonuclease subunit
  ENST ID: ENST00000533373
  CDS Start-End: 31-435
gtgcaccacgggagcgccgcaccggccggcatggaggagcgcggcgattccgagccgacccccggctgcagcggcctgggtccgggcggtgttcgcggctttggcgacggcggtggagctccttcgtgggcccctgaggacgcctggatgggcactcaccctaagtatctagaaatgatggaattagatataggagatgccacccaagtttatgtagcgttcttggtttacctggacctcatggaaagcaaaagctggcatgaagtaaactgtgtaggattaccagaactccagctcatctgccttgttggtactgagatagaaggggaggggttacagactgtggtgcctacccccatcactgcttccctcagccataacaggataagggagatcttgaaggcatctcgaaagttgcaagaatatttctcttagaagatgacatccatgtttcctgatgcttgttttattcatacaagattggatttgagacccatcagactgcttcatcttttatctcagaaatagggttgacgtacatagtgagggttgacttccccattccataaggttttcattctgaagagtaaaacttccccaggtagaagactttctcct

SEQ ID NO: 195676 - DNA, 2381 bp, Homo sapiens
  Payload ID: 18621
  Gene Name: TSEN2 tRNA splicing endonuclease subunit
  Uniprot ID: Q8NCE0
  ENST ID: ENST00000284995
  CDS Start-End: 388-1785
aagaaaggtaagggccctgggcgaggaaagcgcggccctttccgagtttggtgttttgcagcgaaaggaaatctcgctcttccgaaagtcctccagggcgagagaggaaagggcctaggtactgtgctggggtcgcacagccggccgagacagtgccgggacggggagccaggcttccgagtgcgcccggtcactgactcctccgcgctttcctcgtgcgcctgcagcccttggttcttggaaacgccggcgccttgttcagggctggtggggctggggcgcaaggtgcagctgacaatgcccgagaggagccgcagcctctggtggagttcggtcgggtgtgggggtagtcaaggaaagaagcaaagggaatacctcctctgaaaaatggcagaagcagttttccatgccccaaagaggaaaagaagagtgtatgagacttacgagtctccattgccaatcccttttggtcaggaccatggtcctctgaaagaattcaagatattccgtgctgaaatgattaacaacaatgtgattgtgaggaatgcggaggacattgagcagctctatgggaaaggttattttggaaaaggtattctttcaagaagccgtccaagcttcacaatttcagatcctaaactggttgctaaatggaaagatatgaagacaaacatgcctatcatcacatcaaagaggtatcagcatagtgttgagtgggcagcagagctgatgcgtagacaggggcaggatgagagtacagtgcgcagaatcctcaaggattacacgaaaccgcttgagcatcctcctgtgaaaaggaatgaagaggctcaagtgcatgacaagcttaactctggaatggtttccaacatggaaggcacagcagggggagagagaccttctgtggtaaacggggactctggaaagtcaggtggtgtgggtgatccccgtgagccattaggctgcctgcaggagggctctggctgccacccaacaacagagagctttgagaaaagcgtgcgagaggatgcctcacctctgccccatgtctgttgctgcaaacaagatgctctcatcctccagcgtggccttcatcatgaagacggcagccagcacatcggcctcctgcatcctggggacagagggcctgaccatgagtacgtgctggtcgaggaagcggagtgtgccatgagcgagagggaggctgccccaaatgaggaattggtgcaaagaaacaggttaatatgcagaagaaatccatataggatctttgagtatttgcaactcagcctagaagaggcctttttcttggtctatgctctgggatgtttaagtatttactatgagaaggagcctttaacgatagtgaagctctggaaagctttcactgtagttcagcccacgttcagaaccacctacatggcctaccattactttcgaagcaagggctgggtgcccaaagtgggactcaagtacgggacagatttactgctatatcggaaaggccctccattttaccatgcaagttattctgtcattatcgagctagttgatgaccattttgaaggctctctccgcaggcctctcagttggaagtccctggctgccttgagcagagtttccgttaatgtctctaaggaacttatgctgtgctatttgattaaaccctctactatgactgacaaggaaatggagtcaccagaatgtatgaaaaggattaaagttcaggaggtgattctgagtcgatgggtttcttcacgagagaggagtgaccaagacgatctttaacaattcaacctcaaatttctaatttcaccaacaactatttattgagggctaggtaaaaagttctttttgttgtaatcgtccattaattcataagttttaaagggcatggtgctcccagcaccagaaaactatcagtgtttttaaagataaattacacaagggaggagaaagatccctgtgctaggactgcagattctatacttgcgttggcctctaactctccaatccagagcctcctgcctctggcgtcagtcttttccctcatccactcactggggagattggactagaggagtcctgagaggacacttccaacaagagacatttattctctgattttacctgaaaatggtagtagtttacatttatacagtacagtttatgaagcactttcatacgcaggcatctcttgttacctacatctaagctgttcccgaaagagtgttacagaacacaacagtattgtacaatattcgataagcatatcttcactgcacttgttataaaaatgagtggtgaaataatgtttggagacataatgaaagcgattaacatttggcaaaatataataaagcctttttgtaattggtgagaaa

SEQ ID NO: 195677 - DNA, 2149 bp, Homo sapiens
  Payload ID: 18621
  Gene Name: TSEN2 tRNA splicing endonuclease subunit
  Uniprot ID: Q8NCE0
  ENST ID: ENST00000402228
  CDS Start-End: 156-1553
aacggcgagcgcgtggggccaagaaaggtaagggccctgggcgaggaaagcgcggccctttccgagtttggtgttttgcagcgaaaggaaatctcgctcttccgaaagtcctccagggcgagagaggaaagggcctagaatacctcctctgaaaaatggcagaagcagttttccatgccccaaagaggaaaagaagagtgtatgagacttacgagtctccattgccaatcccttttggtcaggaccatggtcctctgaaagaattcaagatattccgtgctgaaatgattaacaacaatgtgattgtgaggaatgcggaggacattgagcagctctatgggaaaggttattttggaaaaggtattctttcaagaagccgtccaagcttcacaatttcagatcctaaactggttgctaaatggaaagatatgaagacaaacatgcctatcatcacatcaaagaggtatcagcatagtgttgagtgggcagcagagctgatgcgtagacaggggcaggatgagagtacagtgcgcagaatcctcaaggattacacgaaaccgcttgagcatcctcctgtgaaaaggaatgaagaggctcaagtgcatgacaagcttaactctggaatggtttccaacatggaaggcacagcagggggagagagaccttctgtggtaaacggggactctggaaagtcaggtggtgtgggtgatccccgtgagccattaggctgcctgcaggagggctctggctgccacccaacaacagagagctttgagaaaagcgtgcgagaggatgcctcacctctgccccatgtctgttgctgcaaacaagatgctctcatcctccagcgtggccttcatcatgaagacggcagccagcacatcggcctcctgcatcctggggacagagggcctgaccatgagtacgtgctggtcgaggaagcggagtgtgccatgagcgagagggaggctgccccaaatgaggaattggtgcaaagaaacaggttaatatgcagaagaaatccatataggatctttgagtatttgcaactcagcctagaagaggcctttttcttggtctatgctctgggatgtttaagtatttactatgagaaggagcctttaacgatagtgaagctctggaaagctttcactgtagttcagcccacgttcagaaccacctacatggcctaccattactttcgaagcaagggctgggtgcccaaagtgggactcaagtacgggacagatttactgctatatcggaaaggccctccattttaccatgcaagttattctgtcattatcgagctagttgatgaccattttgaaggctctctccgcaggcctctcagttggaagtccctggctgccttgagcagagtttccgttaatgtctctaaggaacttatgctgtgctatttgattaaaccctctactatgactgacaaggaaatggagtcaccagaatgtatgaaaaggattaaagttcaggaggtgattctgagtcgatgggtttcttcacgagagaggagtgaccaagacgatctttaacaattcaacctcaaatttctaatttcaccaacaactatttattgagggctaggtaaaaagttctttttgttgtaatcgtccattaattcataagttttaaagggcatggtgctcccagcaccagaaaactatcagtgtttttaaagataaattacacaagggaggagaaagatccctgtgctaggactgcagattctatacttgcgttggcctctaactctccaatccagagcctcctgcctctggcgtcagtcttttccctcatccactcactggggagattggactagaggagtcctgagaggacacttccaacaagagacatttattctctgattttacctgaaaatggtagtagtttacatttatacagtacagtttatgaagcactttcatacgcaggcatctcttgttacctacatctaagctgttcccgaaagagtgttacagaacacaacagtattgtacaatattcgataagcatatcttcactgcacttgttataaaaatgagtggtgaaataatgtttggagacataatgaaagcgattaacatttggcaaaatataataaagcctttttgtaattggtgagaaa

SEQ ID NO: 195678 - DNA, 1909 bp, Homo sapiens
  Payload ID: 18621
  Gene Name: TSEN2 tRNA splicing endonuclease subunit
  Uniprot ID: Q8NCE0
  ENST ID: ENST00000454502
  CDS Start-End: 93-1313
actgcttgacggcagcggtgtccgccccacggccggcgttgccggggtaacggcgagcgcgtggggccaagaaagaatacctcctctgaaaaatggcagaagcagttttccatgccccaaagaggaaaagaagagtgtatgagacttacgagtctccattgccaatcccttttggtcaggaccatggtcctctgaaagaattcaagatattccgtgctgaaatgattaacaacaatgtgattgtgaggaatgcggaggacattgagcagctctatgggaaaggttattttggaaaaggtattctttcaagaagccgtccaagcttcacaatttcagatcctaaactggttgctaaatggaaagatatgaagacaaacatgcctatcatcacatcaaagaggtatcagcatagtgttgagtgggcagcagagctgatgcgtagacaggggcaggatgagagtacagtgcgcagaatcctcaaggattacacgaaaccgcttgagcatcctcctgtgaaaaggaatgaagaggctcaagtgcatgacaagcttaactctggaatggtttccaacatggaaggcacagcagggggagagagaccttctgtgcgtggccttcatcatgaagacggcagccagcacatcggcctcctgcatcctggggacagagggcctgaccatgagtacgtgctggtcgaggaagcggagtgtgccatgagcgagagggaggctgccccaaatgaggaattggtgcaaagaaacaggttaatatgcagaagaaatccatataggatctttgagtatttgcaactcagcctagaagaggcctttttcttggtctatgctctgggatgtttaagtatttactatgagaaggagcctttaacgatagtgaagctctggaaagctttcactgtagttcagcccacgttcagaaccacctacatggcctaccattactttcgaagcaagggctgggtgcccaaagtgggactcaagtacgggacagatttactgctatatcggaaaggccctccattttaccatgcaagttattctgtcattatcgagctagttgatgaccattttgaaggctctctccgcaggcctctcagttggaagtccctggctgccttgagcagagtttccgttaatgtctctaaggaacttatgctgtgctatttgattaaaccctctactatgactgacaaggaaatggagtcaccagaatgtatgaaaaggattaaagttcaggaggtgattctgagtcgatgggtttcttcacgagagaggagtgaccaagacgatctttaacaattcaacctcaaatttctaatttcaccaacaactatttattgagggctaggtaaaaagttctttttgttgtaatcgtccattaattcataagttttaaagggcatggtgctcccagcaccagaaaactatcagtgtttttaaagataaattacacaagggaggagaaagatccctgtgctaggactgcagattctatacttgcgttggcctctaactctccaatccagagcctcctgcctctggcgtcagtcttttccctcatccactcactggggagattggactagaggagtcctgagaggacacttccaacaagagacatttattctctgattttacctgaaaatggtagtagtttacatttatacagtacagtttatgaagcactttcatacgcaggcatctcttgttacctacatctaagctgttcccgaaagagtgttacagaacacaacagtattgtacaatattcgataagcatatcttcactgcacttgttataaaaatgagtggtgaaataatgtttggagacataatgaaagcgattaacatttggcaaaatataataaagcctttttgtaattggtgagaaa

SEQ ID NO: 195679 - DNA, 1239 bp, Homo sapiens
  Payload ID: 18621
  Gene Name: TSEN2 tRNA splicing endonuclease subunit
  ENST ID: ENST00000446004
  CDS Start-End: 104-1239
tttgcggccgcactgcttgacggcagcggtgtccgccccacggccggcgttgccggggtaacggcgagcgcgtggggccaagaaagaatacctcctctgaaaaatggcagaagcagttttccatgccccaaagaggaaaagaagagtgtatgagacttacgagtctccattgccaatcccttttggtcaggaccatggtcctctgaaagaattcaagatattccgtgctgaaatgattaacaacaatgtgattgtgaggaatgcggaggacattgagcagctctatgggaaaggttattttggaaaaggtattctttcaagaagccgtccaagcttcacaatttcagatcctaaactggttgctaaatggaaagatatgaagacaaacatgcctatcatcacatcaaagaggtatcagcatagtgttgagtgggcagcagagctgatgcgtagacaggggcaggatgagagtacagtgcgcagaatcctcaaggattacacgaaaccgcttgagcatcctcctgtgaaaaggaatgaagaggctcaagtgcatgacaagcttaactctggaatggtttccaacatggaaggcacagcagggggagagagaccttctgtggtaaacggggactctggaaagtcaggtggtgtgggtgatccccgtgagccattaggctgcctgcaggagggctctggctgccacccaacaacagagagctttgagaaaagcgtgcgagaggatgcctcacctctgccccatgtctgttgctgcaaacaagatgctctcatcctccagcgtggccttcatcatgaagacggcagccagcacatcggcctcctgcatcctggggacagagggcctgaccatgagtacgtgctggtcgaggaagcggagtgtgccatgagcgagagggaggctgccccaaatgaggaattggtgcaaagaaacaggttaatatgcagaagaaatccatataggatctttgagtatttgcaactcagcctagaagaggcctttttcttggtctatgctctgggatgtttaagtatttactatgagaaggagcctttaacgatagtgaagctctggaaagctttcactgtagttcagcccacgttcagaaccacctacatggcctaccattactttcgaagcaagggctgggtgcccaaagtgggactcaagtacgggacagatttactgctatatcggaaaggccctccattttaccatgcaag

SEQ ID NO: 195680 - DNA, 2697 bp, Homo sapiens
  Payload ID: 18621
  Gene Name: TSEN2 tRNA splicing endonuclease subunit
  Uniprot ID: Q8NCE0
  ENST ID: ENST00000444864
  CDS Start-End: 388-1596
aagaaaggtaagggccctgggcgaggaaagcgcggccctttccgagtttggtgttttgcagcgaaaggaaatctcgctcttccgaaagtcctccagggcgagagaggaaagggcctaggtactgtgctggggtcgcacagccggccgagacagtgccgggacggggagccaggcttccgagtgcgcccggtcactgactcctccgcgctttcctcgtgcgcctgcagcccttggttcttggaaacgccggcgccttgttcagggctggtggggctggggcgcaaggtgcagctgacaatgcccgagaggagccgcagcctctggtggagttcggtcgggtgtgggggtagtcaaggaaagaagcaaagggaatacctcctctgaaaaatggcagaagcagttttccatgccccaaagaggaaaagaagagtgtatgagacttacgagtctccattgccaatcccttttggtcaggaccatggtcctctgaaagaattcaagatattccgtgctgaaatgattaacaacaatgtgattgtgaggaatgcggaggacattgagcagctctatgggaaaggttattttggaaaaggtattctttcaagaagccgtccaagcttcacaatttcagatcctaaactggttgctaaatggaaagatatgaagacaaacatgcctatcatcacatcaaagaggtatcagcatagtgttgagtgggcagcagagctgatgcgtagacaggggcaggatgagagtacagtgcgcagaatcctcaaggattacacgaaaccgcttgagcatcctcctgtgaaaaggaatgaagaggctcaagtgcatgacaagcttaactctggaatggtttccaacatggaaggcacagcagggggagagagaccttctgtggtaaacggggactctggaaagtcaggtggtgtgggtgatccccgtgagccattaggctgcctgcaggagggctctggctgccacccaacaacagagagctttgagaaaagcgtgcgagaggatgcctcacctctgccccatgtctgttgctgcaaacaagatgctctcatcctccagcgtggccttcatcatgaagacggcagccagcacatcggcctcctgcatcctggggacagagggcctgaccatgagtacgtgctggtcgaggaagcggagtgtgccatgagcgagagggaggctgccccaaatgaggaagcctttttcttggtctatgctctgggatgtttaagtatttactatgagaaggagcctttaacgatagtgaagctctggaaagctttcactgtagttcagcccacgttcagaaccacctacatggcctaccattactttcgaagcaagggctgggtgcccaaagtgggactcaagtacgggacagatttactgctatatcggaaaggccctccattttaccatgcaagttattctgtcattatcgagctagttgatgaccattttgaaggctctctccgcaggcctctcagttggaagtccctggctgccttgagcagagtttccgttaatgtctctaaggtaacacaacatcagctttgccattggagtgtcacttaaatggttcagtttttttttttttcttaaatgtagtagaatcaaaaaagttagttgtagaaacttcataacattcctgccagtgacatgctggaagatttggggtcattcgtacccttcccttattgcgctagaagttgtcctcccctcatgttacattttattgtcccctccctcccaactgctgctgagctccaatgacggagctttggagtgtcccatggtgatctgatctgggtaggcattgcttctcttcccaggggtatcgttgctatgtgacttgttttatactgcaatttaacattcactcatacacatattcacaaaggagtcaaaacattgaaagtttgcagatctcttagagaggaagggacttgatatttgttgctaagcactttcccaccctgttgttatcctcatcctgaggatgagaaaccaaggttggagccgttgagtggctaatccaagatcacacagctcatgtgcatactcgggatccaaacccacagctctctggctccctggcttttgtttcactatatccttcgtgttgccatcagagataggagggactcagcttacacaaggactatcaagaaagaaagctgtgtgtgttctcattactcagtgatttgctggctgaaaacaaattgtagataccctctaatttcatcctcatgctgctggaggtgaggtggggctgaggccagagggtcttgcagggctagagatgactgccctttagagcaggttaggttgcctaggctttagcttggtcctatagaaaattagggagcctatactgtttctagaatttttatgcccattttaggggacttgtagcatatacttaatatgtcctcacttaacattgttgatatgttcttggaaactgcaactttaatgtcgtataacaaaaccgttttttcttctcatcatttcaagaaaacaatgttgaagtttatttgaagacctgctgtacatctgtattagtccattctcatgctgctataaagaaatacttgagactgggtaatttataatgaaaagaggtttaattgactcacagttccatgtggctggggaggcctcaggaaacttaca

SEQ ID NO: 195681 - DNA, 553 bp, Homo sapiens
  Payload ID: 18621
  Gene Name: TSEN2 tRNA splicing endonuclease subunit
  ENST ID: ENST00000412698
  CDS Start-End: 1-306
aaggaacttatgctgtgctatttgattaaaccctctactatgactgacaaggaaatggagtcaccagaatgtatgaaaaggattaaagttcagtctcgctctgtcgtccaggctggagtccaatgctgcgatcttggatcactgcaacctctgcctgctgggtttaagcgattctcatgcctcagcctcctgagtagctgggattacaggcacgcaccaccacacacggctaatttttgtatttttagtagagacggggtttcactatgttggccaggctggtctggaactcctgacctcaagtgatctgcccgccttggcctcccaaagtgctgagagtacaggcgtgagccactgcatccagctcttagcatgtgcttttaaagtaaaaaccacgaggagaaggtactcattacttcataacttgtgtctcacccaccttgctgtcttcacatccccactttctgtatgcacattggaaggtgaatttgttcagctcacattaatttataggaataattttcattgctctgtgaataaaatgtgctaccac

SEQ ID NO: 195682 - DNA, 784 bp, Homo sapiens
  Payload ID: 18621
  Gene Name: TSEN2 tRNA splicing endonuclease subunit
  ENST ID: ENST00000455118
  CDS Start-End: 1-245
agctagttgatgaccattttgaaggctctctccgcaggcctctcagttggaagtccctggctgccttgagcagagtttccgttaatgtctctaaggaacttatgctgtgctatttgattaaaccctctactatgactgacaaggaaatggagtcaccagaatgtatgaaaaggattaaagttcaggaggtgattctgagtcgatgggtttcttcacgagagaggagtgaccaagacgatctttaacaattcaacctcaaatttctaatttcaccaacaactatttattgagggctagtttctcatcccagtttccccagcctcctgtgaaggtgtcagagaaagaagatagccctctcttcatgtgctttctgaactctgccttttcagtgggcagaggaagtgctttgtagcagcaaacccaacccctgagcctccatgtgtcgggtcaggcaaaatgaaattgacacaggctggaattttactgatttcagtcattgctgggctcgtttgtgcaaatagactcagaagagctcctttaaaaggagtgaccatttcctgatttagattctgagggggtttttggttttttttactgttgttcactatcatgagcttaccatgtgcttttttctttttttttttcttgtgatgtagtctcgctctgtcgtccaggctggagtccaatgctgcgatcttggatcactgcaacctctgcctgctgggtttaagcgattctcatgcctcagcctcctgagtagctgggattacaggcacgcaccacc

SEQ ID NO: 195683 - DNA, 2279 bp, Homo sapiens
  Payload ID: 18621
  Gene Name: TSEN2 tRNA splicing endonuclease subunit
  Uniprot ID: Q8NCE0
  ENST ID: ENST00000415684
  CDS Start-End: 22-1341
aaagaatacctcctctgaaaaatggcagaagcagttttccatgccccaaagaggaaaagaagagtgtatgagacttacgagtctccattgccaatcccttttggtcaggaccatggtcctctgaaagaattcaagatattccgtgctgaaatgattaacaacaatgtgattgtgaggaatgcggaggacattgagcagctctatgggaaaggttattttggaaaaggtattctttcaagaagccgtccaagcttcacaatttcagatcctaaactggttgctaaatggaaagatatgaagacaaacatgcctatcatcacatcaaagaggtatcagcatagtgttgagtgggcagcagagctgatgcgtagacaggggcaggatgagagtacagtgcgcagaatcctcaaggattacacgaaaccgcttgagcatcctcctgtgaaaaggaatgaagaggctcaagtgcatgacaagcttaactctggaatggtttccaacatggaaggcacagcagggggagagagaccttctgtggtaaacggggactctggaaagtcaggtggtgtgggtgatccccgtgagccattaggctgcctgcaggagggctctggctgccacccaacaacagagagctttgagaaaagcgtgcgagaggatgcctcacctctgccccatgtctgttgctgcaaacaagatgctctcatcctccagcgtggccttcatcatgaagacggcagccagcacatcggcctcctgcatcctggggacagagggcctgaccatgagtacgtgctggtcgaggaagcggagtgtgccatgagcgagagggaggctgccccaaatgaggaagcctttttcttggtctatgctctgggatgtttaagtatttactatgagaaggagcctttaacgatagtgaagctctggaaagctttcactgtagttcagcccacgttcagaaccacctacatggcctaccattactttcgaagcaagggctgggtgcccaaagtgggactcaagtacgggacagatttactgctatatcggaaaggccctccattttaccatgcaagttattctgtcattatcgagctagttgatgaccattttgaaggctctctccgcaggcctctcagttggaagtccctggctgccttgagcagagtttccgttaatgtctctaaggaacttatgctgtgctatttgattaaaccctctactatgactgacaaggaaatggagtcaccagaatgtatgaaaaggattaaagttcaggaggtgattctgagtcgatgggtttcttcacgagagaggagtgaccaagacgatctttaacaattcaacctcaaatttctaatttcaccaacaactatttattgagggctaggtaaaaagttctttttgttgtaatcgtccattaattcataagttttaaagggcatggtgctcccagcaccagaaaactatcagtgtttttaaagataaattacacaagggaggagaaagatccctgtgctaggactgcagattctatacttgcgttggcctctaactctccaatccagagcctcctgcctctggcgtcagtcttttccctcatccactcactggggagattggactagaggagtcctgagaggacacttccaacaagagacatttattctctgattttacctgaaaatggtagtagtttacatttatacagtacagtttatgaagcactttcatacgcaggcatctcttgttacctacatctaagctgttcccgaaagagtgttacagaacacaacagtattgtacaatattcgataagcatatcttcactgcacttgttataaaaatgagtggtgaaataatgtttggagacataatgaaagcgattaacatttggcaaaatataataaagcctttttgtaattggtgagaaagtcatgaagacttaagttgcctcagggcatctggtggcaagaggagggagatgggtggctgggcatggtggcccatacctataatcccagcacttgggaggccttgggaggccaaggcgcatggatcgcttgagcccaggagttggagaccagcttgggcaacatggtgaaacctcctctctactaacaaaaattatccaagcattgtagcacatgcctgtaattccagctgctcaggagactaaggtaggaggatcgcttgagcccaggaggaagaggttgcagtgagcggagattgtgccactgcaatccagcctgagcaatagagcaaggtcctgtctc

SEQ ID NO: 195684 - DNA, 2294 bp, Homo sapiens
  Payload ID: 18622
  Gene Name: TSEN34 tRNA splicing endonuclease subunit
  Uniprot ID: Q9BSV6
  ENST ID: ENST00000302937
  CDS Start-End: 188-1120
tgacgaagttgacgagggtgtcggcatgagggggtggagcaaggagcgcgtggcgcggtgcgcagtgggtggctccacctcgactgcgaattactgtttatgaggtgactcgctggttctatcggtggacagtgggacattctgaagggaggcaaggaggcggactgagcgctcccaattggggaggatgctggtggtggaggtggcgaacggccgctccctggtgtggggagccgaggcggtgcaggccctccgggagcgcctgggtgtggggggccgcacggtaggcgccctgccccgcgggccccgccagaactcgcgcctgggcctcccgctgctgctgatgcccgaagaggcgcggctcttggccgagatcggcgccgtgactctggtcagcgccccgcgtccagactctcggcaccacagcctggccctgacatccttcaagcgccagcaagaggagagcttccaggagcagagcgccttggcagctgaggcccgggagacccgtcgtcaggagctcctggagaagattacggagggccaggctgctaagaagcagaaactagaacaggcttcaggggccagctcaagccaggaggccggctcgagccaggctgccaaagaggatgagaccagtgatggccaggcttcgggagagcaggaggaagctggcccctcgtcttcccaagcaggaccctcaaatggggtagcccccttgcccagatctgctctccttgtccagctggccactgccaggcctcgaccggtcaaggccaggcccctggactggcgtgtccagtctaaagactggccccacgccggccgccctgcccacgagctgcgctacagtatctacagagacctgtgggagcgaggcttcttcctcagtgcggctggcaagttcggaggtgacttcctggtctatcctggtgaccccctccgcttccacgcccattatatcgctcagtgctgggcccctgaggacaccatcccactccaagacctggttgctgctgggcgccttggaaccagcgtcagaaagaccctgctcctctgttctccgcagcctgatggtaaggtggtctacacctccctgcaatgggccagcctgcagtgaactccagagacctaggggatgtggctgtgtcggcagcaagagcctttctggatgttccccagctcttctctgggagtctagaacatcctcctacctttctccgcggttagtttttgattccaggttttcgaacactacatcttttttatgttcttccttgtttcaaagcacttattggctgtgtttttgtagttacctattttcacactgtgagcttcccgagaatggggcctgggtttgattcatctgttttctacagggtttaagtctcaggaggtctcaataaacttggtatataaatgttcatgatttgaatgtttgcgacagtcctggaacccgtggatggtctcatctgcatgtacaggtgagaaaaaggcctggaggagggggactgacttgcccaaagtcacacacttagtaaatagcaggcctggcctttcaaaattggtttttctgactcctaaatctgcactctttctacctcactaaacttccttttgaaaagatttctatgaaatttcccagatgcatacaaacgttataaataaaaatataggctgggcacgatgacccacacctgtaatcccacagaacttttggaggccaaggcagggggatcgcttgagcccaggagtttgagaccagctctggcaacattgtaatacccagtctctacaaaaaataatttaaaaaaaaattagccagggatcccttgagcctgggaagttgaggctgctgtgagctgtgattgcaccactgccctccagcctgggagacagagcaagaacctgtctcaaaaaatatatatatgtgtgtgtgtatatatgtaaatatacacacatgtatgtatatatatgtgtgtgtatatatatatatattatgaaaggaaatgagtattgtaattttaggagttcagagcctggggagaaaggaaggactctggaaggcgttctgctttttcatggcctgggtagtggtgaatttttttgatactgtatatttatattttagactcttttttggatgtgttatattctgcaatttttataaaagctaaaacacatgtatttgtaaaaaatttgcacttatgaaatcatttacccatgtttttgcttaagaaagtactagaacactaccactattccaataattacacctttatcttatcaatgtg

SEQ ID NO: 195685 - DNA, 1548 bp, Homo sapiens
  Payload ID: 18622
  Gene Name: TSEN34 tRNA splicing endonuclease subunit
  Uniprot ID: Q9BSV6
  ENST ID: ENST00000396383
  CDS Start-End: 312-1244
cgaggacgcccgaacgccgaacttcctgtgctcgggagggggcagggttttgtactgtgggagtctgagagcgaggaggtccgaaagccgaatcacagtcgttcggaaagaggaggagcgaaggctcgagcgtccggaagagggtgtggcctcggcggtgccttagcctccagagcttctgaccgctgacgggaacacccgaagggggacgcccactttgcaagagggtggtgccaaaatggacctttgtaagggggcgtgtcgccgcgcttgcggaggtttgtttttcacgctccaaggcgcaatggaggatgctggtggtggaggtggcgaacggccgctccctggtgtggggagccgaggcggtgcaggccctccgggagcgcctgggtgtggggggccgcacggtaggcgccctgccccgcgggccccgccagaactcgcgcctgggcctcccgctgctgctgatgcccgaagaggcgcggctcttggccgagatcggcgccgtgactctggtcagcgccccgcgtccagactctcggcaccacagcctggccctgacatccttcaagcgccagcaagaggagagcttccaggagcagagcgccttggcagctgaggcccgggagacccgtcgtcaggagctcctggagaagattacggagggccaggctgctaagaagcagaaactagaacaggcttcaggggccagctcaagccaggaggccggctcgagccaggctgccaaagaggatgagaccagtgatggccaggcttcgggagagcaggaggaagctggcccctcgtcttcccaagcaggaccctcaaatggggtagcccccttgcccagatctgctctccttgtccagctggccactgccaggcctcgaccggtcaaggccaggcccctggactggcgtgtccagtctaaagactggccccacgccggccgccctgcccacgagctgcgctacagtatctacagagacctgtgggagcgaggcttcttcctcagtgcggctggcaagttcggaggtgacttcctggtctatcctggtgaccccctccgcttccacgcccattatatcgctcagtgctgggcccctgaggacaccatcccactccaagacctggttgctgctgggcgccttggaaccagcgtcagaaagaccctgctcctctgttctccgcagcctgatggtaaggtggtctacacctccctgcaatgggccagcctgcagtgaactccagagacctaggggatgtggctgtgtcggcagcaagagcctttctggatgttccccagctcttctctgggagtctagaacatcctcctacctttctccgcggttagtttttgattccaggttttcgaacactacatcttttttatgttcttccttgtttcaaagcacttattggctgtgtttttgtagttacctattttcacactgtgagcttcccgagaatggggcctgggtttgattcatctgttttctacagggtttaagtctcaggaggtctcaataaacttggtatataaatgtt

SEQ ID NO: 195686 - DNA, 1349 bp, Homo sapiens
  Payload ID: 18622
  Gene Name: TSEN34 tRNA splicing endonuclease subunit
  Uniprot ID: Q9BSV6
  ENST ID: ENST00000396388
  CDS Start-End: 113-1045
gaggcctaggggcggggcttcgccgagaccccggaggctttgggtgcgctgcagcggtccgcggcgcgcagctgtttcggtaactgctttgcctcccggctcccgcaggaggatgctggtggtggaggtggcgaacggccgctccctggtgtggggagccgaggcggtgcaggccctccgggagcgcctgggtgtggggggccgcacggtaggcgccctgccccgcgggccccgccagaactcgcgcctgggcctcccgctgctgctgatgcccgaagaggcgcggctcttggccgagatcggcgccgtgactctggtcagcgccccgcgtccagactctcggcaccacagcctggccctgacatccttcaagcgccagcaagaggagagcttccaggagcagagcgccttggcagctgaggcccgggagacccgtcgtcaggagctcctggagaagattacggagggccaggctgctaagaagcagaaactagaacaggcttcaggggccagctcaagccaggaggccggctcgagccaggctgccaaagaggatgagaccagtgatggccaggcttcgggagagcaggaggaagctggcccctcgtcttcccaagcaggaccctcaaatggggtagcccccttgcccagatctgctctccttgtccagctggccactgccaggcctcgaccggtcaaggccaggcccctggactggcgtgtccagtctaaagactggccccacgccggccgccctgcccacgagctgcgctacagtatctacagagacctgtgggagcgaggcttcttcctcagtgcggctggcaagttcggaggtgacttcctggtctatcctggtgaccccctccgcttccacgcccattatatcgctcagtgctgggcccctgaggacaccatcccactccaagacctggttgctgctgggcgccttggaaccagcgtcagaaagaccctgctcctctgttctccgcagcctgatggtaaggtggtctacacctccctgcaatgggccagcctgcagtgaactccagagacctaggggatgtggctgtgtcggcagcaagagcctttctggatgttccccagctcttctctgggagtctagaacatcctcctacctttctccgcggttagtttttgattccaggttttcgaacactacatcttttttatgttcttccttgtttcaaagcacttattggctgtgtttttgtagttacctattttcacactgtgagcttcccgagaatggggcctgggtttgattcatctgttttctacagggtttaagtctcaggaggtctcaataaacttggtatataaatgtt

SEQ ID NO: 195687 - DNA, 1912 bp, Homo sapiens
  Payload ID: 18622
  Gene Name: TSEN34 tRNA splicing endonuclease subunit
  ENST ID: ENST00000429671
  CDS Start-End: 100-1047
tgacgaagttgacgagggtgtcggcatgagggggtggagcaaggagcgcgtggcgcggtgcgcagtgggtggctccacctcgactgcgaattactgtttatgaggaggatgctggtggtggaggtggcgaacggccgctccctggtgtggggagccgaggcggtgcaggccctccgggagcgcctgggtgtggggggccgcacggtaggcgccctgccccgcgggccccgccagaactcgcgcctgggcctcccgctgctgctgatgcccgaagaggcgcggctcttggccgagatcggcgccgtgactctggtcagcgccccgcgtccagactctcggcaccacagcctggccctgacatccttcaagcgccagcaagaggagagcttccaggagcagagcgccttggcagctgaggcccgggagacccgtcgtcaggagctcctggagaagattacggagggccaggctgctaagaagcagaaactagaacaggcttcaggggccagctcaagccaggaggccggctcgagccaggctgccaaagaggatgagaccagtgatggccaggcttcgggagagcaggaggaagctggcccctcgtcttcccaagcaggaccctcaaatggggtagcccccttgcccagatctgctctccttgtccagctggccactgccaggcctcgaccggtcaaggccaggcccctggactggcgtgtccagtctaaagactggccccacgccggccgccctgcccacgagctgcgctacagtatctacagagacctgtgggagcgaggcttcttcctcagtgcggctggcaagttcggaggtgacttcctggtctatcctggtgaccccctccgcttccacgcccattatatcgctcagtgctgggcccctgaggacaccatcccactccaagacctggttgctgctgggcgccttggaaccagcgtcagaaagaccctgctcctctgttctccgcagcctgatgggtttaagtctcaggaggtctcaataaacttggtatataaatgttcatgatttgaatgtttgcgacagtcctggaacccgtggatggtctcatctgcatgtacaggtgagaaaaaggcctggaggagggggactgacttgcccaaagtcacacacttagtaaatagcaggcctggcctttcaaaattggtttttctgactcctaaatctgcactctttctacctcactaaacttccttttgaaaagatttctatgaaatttcccagatgcatacaaacgttataaataaaaatataggctgggcacgatgacccacacctgtaatcccacagaacttttggaggccaaggcagggggatcgcttgagcccaggagtttgagaccagctctggcaacattgtaatacccagtctctacaaaaaataatttaaaaaaaaattagccagggatcccttgagcctgggaagttgaggctgctgtgagctgtgattgcaccactgccctccagcctgggagacagagcaagaacctgtctcaaaaaatatatatatgtgtgtgtgtatatatgtaaatatacacacatgtatgtatatatatgtgtgtgtatatatatatatattatgaaaggaaatgagtattgtaattttaggagttcagagcctggggagaaaggaaggactctggaaggcgttctgctttttcatggcctgggtagtggtgaatttttttgatactgtatatttatattttagactcttttttggatgtgttatattctgcaatttttataaaagctaaaacacatgtatttgtaaaaaatttgcacttatgaaatcatttacccatgtttttgcttaagaaagtactagaacactaccactattccaataattacacctttatcttatcaatgtg

SEQ ID NO: 195688 - DNA, 956 bp, Homo sapiens
  Payload ID: 18622
  Gene Name: TSEN34 tRNA splicing endonuclease subunit
  ENST ID: ENST00000455798
  CDS Start-End: 230-956
cacaagcttcggtttacttcgtagatagttgggtacaagtgacgctaggatgataggcggagtcaacaggttcgccagacacccatgagtatttacaagggggcggggcgaaagcgacttgccctcaaaggggcggaaccccgagggccggcgtgcgcctacgggaccgggccaggatgacgatcctcaagttcccaagtagaggagaggaagcggcagagggaggaggatgctggtggtggaggtggcgaacggccgctccctggtgtggggagccgaggcggtgcaggccctccgggagcgcctgggtgtggggggccgcacggtaggcgccctgccccgcgggccccgccagaactcgcgcctgggcctcccgctgctgctgatgcccgaagaggcgcggctcttggccgagatcggcgccgtgactctggtcagcgccccgcgtccagactctcggcaccacagcctggccctgacatccttcaagcgccagcaagaggagagcttccaggagcagagcgccttggcagctgaggcccgggagacccgtcgtcaggagctcctggagaagattacggagggccaggctgctaagaagcagaaactagaacaggcttcaggggccagctcaagccaggaggccggctcgagccaggctgccaaagaggatgagaccagtgatggccaggcttcgggagagcaggaggaagctggcccctcgtcttcccaagcaggaccctcaaatggggtagcccccttgcccagatctgctctccttgtccagctggccactgccaggcctcgaccggtcaaggccaggcccctggactggcgtgtccagtctaaagactggccccacgccggccgccctgcccacgagctgcgctacagtatctacagagacctgtgggagcgaggcttcttcctcagtgcggctggcaagttcggaggtg

SEQ ID NO: 195689 - DNA, 853 bp, Homo sapiens
  Payload ID: 18622
  Gene Name: TSEN34 tRNA splicing endonuclease subunit
  ENST ID: ENST00000456872
  CDS Start-End: 100-853
tgacgaagttgacgagggtgtcggcatgagggggtggagcaaggagcgcgtggcgcggtgcgcagtgggtggctccacctcgactgcgaattactgtttatgaggaggatgctggtggtggaggtggcgaacggccgctccctggtgtggggagccgaggcggtgcaggccctccgggagcgcctgggtgtggggggccgcacggtaggcgccctgccccgcgggccccgccagaactcgcgcctgggcctcccgctgctgctgatgcccgaagaggcgcggctcttggccgagatcggcgccgtgactctggtcagcgccccgcgtccagactctcggcaccacagcctggccctgacatccttcaagcgccagcaagaggagagcttccaggagcagagcgccttggcagctgaggcccgggagacccgtcgtcaggagctcctggagaagattacggagggccaggctgctaagaagcagaaactagaacaggcttcaggggccagctcaagccaggaggccggctcgagccaggctgccaaagaggatgagaccagtgatggccaggcttcgggagagcaggaggaagctggcccctcgtcttcccaagcaggaccctcaaatggggtagcccccttgcccagatctgctctccttgtccagctggccactgccaggcctcgaccggtcaaggccaggcccctggactggcgtgtccagtctaaagactggccccacgccggccgccctgcccacgagctgcgctacagtatctacagagacctgtgggagcgaggcttcttcctcagtgcggctggcaagttcggaggtgacttcctggtctatcctg

SEQ ID NO: 195690 - DNA, 2297 bp, Homo sapiens
  Payload ID: 18622
  Gene Name: TSEN34 tRNA splicing endonuclease subunit
  ENST ID: ENST00000613310
  CDS Start-End: 188-1120
tgacgaagttgacgagggtgtcggcatgagggggtggagcaaggagcgcgtggcgcggtgcgcagtgggtggctccacctcgactgcgaattactgtttatgaggtgactcgctggttctatcggtggacagtgggacattctgaagggaggcaaggaggcggactgagcgctcccaattggggaggatgctggtggtggaggtggcgaacggccgctccctggtgtggggagccgaggcggtgcaggccctccgggagcgcctgggtgtggggggccgcacggtaggcgccctgccccgcgggccccgccagaactcgcgcctgggcctcccgctgctgctgatgcccgaagaggcgcggctcttggccgagatcggcgccgtgactctggtcagcgccccgcgtccagactctcggcaccacagcctggccctgacatccttcaagcgccagcaagaggagagcttccaggagcagagcgccttggcagctgaggcccgggagacccgtcgtcaggagctcctggagaagattacggagggccaggctgctaagaagcagaaactagaacaggcttcaggggccagctcaagccaggaggccggctcgagccaggctgccaaagaggatgagaccagtgatggccaggcttcgggagagcaggaggaagctggcccctcgtcttcccaagcaggaccctcaaatggggtagcccccttgcccagatctgctctccttgtccagctggccactgccaggcctcgaccggtcaaggccaggcccctggactggcgtgtccagtctaaagactggccccacgccggccgccctgcccacgagctgcgctacagtatctacagagacctgtgggagcgaggcttcttcctcagtgcggctggcaagttcggaggtgacttcctggtctatcctggtgaccccctccgcttccacgcccattatatcgctcagtgctgggcccccgaggacaccatcccactccaagacctggttgctgctgggcgccttggaaccagcgtcagaaagaccctgctcctctgttctccgcagcctgatggtaaggtggtctacacctccctgcaatgggccagcctgcagtgaactccagagacctaggggatgtggctgtgtcggcagcaagagcctttctggatgttccccagctcttctctgggagtctagaacatcctcctacctttctccgcggttagtttttgattccaggttttcgaacactacatcttttttatgttcttccttgtttcaaagcacttattggctgtgtttttgtagttacctattttcacactgtgagcttcccgagaatggggcctgggtttgattcatctgttttctacagggtttaagtctcaggaggtctcaataaacttggtatataaatgttcatgatttgaatgtttgcgacagtcctggaacccgtggatggtctcatctgcatgtacaggtgagaaaaaggcctggaggggggggactgacttgcccaaagtcacacacttagtaaatagcaggcctggcctttcaaaattggtttttctgactcctaaatctgcactctttctacctcactaaacttcctcttgaaaagatttctatgaaatttcccagatgcatacaaacgttataaataaaaatataggctgggcacgatgacccacacctgtaatcccacagaacttttggaggccaaggcagggggatcgcttgagcccaggagtttgagaccagctctggcaacattgtaatacccagtctctacaaaaaataatttaaaaaaaaattagccagggatcccttgagcctgggaagttgaggctgctgtgagctgtgattgcaccactgccctccagcctgggagacagagcaagaacctgtctcaaaaaatatatatatgtgtgtgtgtatatatgtaaatatacacacatgtatgtatatatatgtgtgtgtatatatatatatattatgaaaggaaatgagtattgtaattttaggagttcagagcctggggagaaaggaaggactctggaaggcgttctgctttttcatggcctgggtagtggtggagaatttttttgatactgtatatttatattttagactcttttttggatgtgttatattctgcaatttttataaaagctaaaacacatgtatttgtaaaaaatttgcacttatgaaatcatttacccatgtttttgcttaagaaagtactagaacactaccactattccaataattacacctttatcttatcaatgtg

SEQ ID NO: 195691 - DNA, 956 bp, Homo sapiens
  Payload ID: 18622
  Gene Name: TSEN34 tRNA splicing endonuclease subunit
  ENST ID: ENST00000622076
  CDS Start-End: 230-956
cacaagcttcggtttacttcgtagatagttgggtacaagtgacgctaggatgataggcggagtcaacaggttcgccagacacccatgagtatttacaagggggcggggcgaaagcgacttgccctcaaaggggcggaaccccgagggccggcgtgcgcctacgggaccgggccagggtgacgatcctcaagttcccaagtagaggagaggaagcggcagagggaggaggatgctggtggtggaggtggcgaacggccgctccctggtgtggggagccgaggcggtgcaggccctccgggagcgcctgggtgtggggggccgcacggtaggcgccctgccccgcgggccccgccagaactcgcgcctgggcctcccgctgctgctgatgcccgaagaggcgcggctcttggccgagatcggcgccgtgactctggtcagcgccccgcgtccagactctcggcaccacagcctggccctgacatccttcaagcgccagcaagaggagagcttccaggagcagagcgccttggcagctgaggcccgggagacccgtcgtcaggagctcctggagaagattacggagggccaggctgctaagaagcagaaactagaacaggcttcaggggccagctcaagccaggaggccggctcgagccaggctgccaaagaggatgagaccagtgatggccaggcttcgggagagcaggaggaagctggcccctcgtcttcccaagcaggaccctcaaatggggtagcccccttgcccagatctgctctccttgtccagctggccactgccaggcctcgaccggtcaaggccaggcccctggactggcgtgtccagtctaaagactggccccacgccggccgccctgcccacgagctgcgctacagtatctacagagacctgtgggagcgaggcttcttcctcagtgcggctggcaagttcggaggtg

SEQ ID NO: 195692 - DNA, 1548 bp, Homo sapiens; identical to SEQ ID NO: 195685
  Payload ID: 18622
  Gene Name: TSEN34 tRNA splicing endonuclease subunit
  Uniprot ID: Q9BSV6
  ENST ID: ENST00000614948
  CDS Start-End: 312-1244

SEQ ID NO: 195693 - DNA, 1915 bp, Homo sapiens
  Payload ID: 18622
  Gene Name: TSEN34 tRNA splicing endonuclease subunit
  ENST ID: ENST00000614734
  CDS Start-End: 100-1047
tgacgaagttgacgagggtgtcggcatgagggggtggagcaaggagcgcgtggcgcggtgcgcagtgggtggctccacctcgactgcgaattactgtttatgaggaggatgctggtggtggaggtggcgaacggccgctccctggtgtggggagccgaggcggtgcaggccctccgggagcgcctgggtgtggggggccgcacggtaggcgccctgccccgcgggccccgccagaactcgcgcctgggcctcccgctgctgctgatgcccgaagaggcgcggctcttggccgagatcggcgccgtgactctggtcagcgccccgcgtccagactctcggcaccacagcctggccctgacatccttcaagcgccagcaagaggagagcttccaggagcagagcgccttggcagctgaggcccgggagacccgtcgtcaggagctcctggagaagattacggagggccaggctgctaagaagcagaaactagaacaggcttcaggggccagctcaagccaggaggccggctcgagccaggctgccaaagaggatgagaccagtgatggccaggcttcgggagagcaggaggaagctggcccctcgtcttcccaagcaggaccctcaaatggggtagcccccttgcccagatctgctctccttgtccagctggccactgccaggcctcgaccggtcaaggccaggcccctggactggcgtgtccagtctaaagactggccccacgccggccgccctgcccacgagctgcgctacagtatctacagagacctgtgggagcgaggcttcttcctcagtgcggctggcaagttcggaggtgacttcctggtctatcctggtgaccccctccgcttccacgcccattatatcgctcagtgctgggcccccgaggacaccatcccactccaagacctggttgctgctgggcgccttggaaccagcgtcagaaagaccctgctcctctgttctccgcagcctgatgggtttaagtctcaggaggtctcaataaacttggtatataaatgttcatgatttgaatgtttgcgacagtcctggaacccgtggatggtctcatctgcatgtacaggtgagaaaaaggcctggaggggggggactgacttgcccaaagtcacacacttagtaaatagcaggcctggcctttcaaaattggtttttctgactcctaaatctgcactctttctacctcactaaacttcctcttgaaaagatttctatgaaatttcccagatgcatacaaacgttataaataaaaatataggctgggcacgatgacccacacctgtaatcccacagaacttttggaggccaaggcagggggatcgcttgagcccaggagtttgagaccagctctggcaacattgtaatacccagtctctacaaaaaataatttaaaaaaaaattagccagggatcccttgagcctgggaagttgaggctgctgtgagctgtgattgcaccactgccctccagcctgggagacagagcaagaacctgtctcaaaaaatatatatatgtgtgtgtgtatatatgtaaatatacacacatgtatgtatatatatgtgtgtgtatatatatatatattatgaaaggaaatgagtattgtaattttaggagttcagagcctggggagaaaggaaggactctggaaggcgttctgctttttcatggcctgggtagtggtggagaatttttttgatactgtatatttatattttagactcttttttggatgtgttatattctgcaatttttataaaagctaaaacacatgtatttgtaaaaaatttgcacttatgaaatcatttacccatgtttttgcttaagaaagtactagaacactaccactattccaataattacacctttatcttatcaatgtg

SEQ ID NO: 195694 - DNA, 1915 bp, Homo sapiens; identical to SEQ ID NO: 195693
  Payload ID: 18622
  Gene Name: TSEN34 tRNA splicing endonuclease subunit
  ENST ID: ENST00000615811
  CDS Start-End: 100-1047

SEQ ID NO: 195695 - DNA, 1348 bp, Homo sapiens
  Payload ID: 18622
  Gene Name: TSEN34 tRNA splicing endonuclease subunit
  Uniprot ID: Q9BSV6
  ENST ID: ENST00000612393
  CDS Start-End: 113-1045
gaggcctaggggcggggcttcgccgagaccccggaggctttgggtgcgctgcagcggtccgcggcgcgcagctgtttcggtaactgctttgcctcccggctcccgcaggaggatgctggtggtggaggtggcgaacggccgctccctggtgtggggagccgaggcggtgcaggccctccgggagcgcctgggtgtggggggccgcacggtaggcgccctgccccgcgggccccgccagaactcgcgcctgggcctcccgctgctgctgatgcccgaagaggcgcggctcttggccgagatcggcgccgtgactctggtcagcgccccgcgtccagactctcggcaccacagcctggccctgacatccttcaagcgccagcaagaggagagcttccaggagcagagcgccttggcagctgaggcccgggagacccgtcgtcaggagctcctggagaagattacggagggccaggctgctaagaagcagaaactagaacaggcttcaggggccagctcaagccaggaggccggctcgagccaggctgccaaagaggatgagaccagtgatggccaggcttcgggagagcaggaggaagctggcccctcgtcttcccaagcaggaccctcaaatggggtagcccccttgcccagatctgctctccttgtccagctggccactgccaggcctcgaccggtcaaggccaggcccctggactggcgtgtccagtctaaagactggccccacgccggccgccctgcccacgagctgcgctacagtatctacagagacctgtgggagcgaggcttcttcctcagtgcggctggcaagttcggaggtgacttcctggtctatcctggtgaccccctccgcttccacgcccattatatcgctcagtgctgggcccctgaggacaccatcccactccaagacctggttgctgctgggcgccttggaaccagcgtcagaaagaccctgctcctctgttctccgcagcctgatggtaaggtggtctacacctccctgcaatgggccagcctgcagtgaactccagagacctaggggatgtggctgtgtcggcagcaagagcctttctggatgttccccagctcttctctgggagtctagaacatcctcctacctttctccgcggttagtttttgattccaggttttcgaacactacatcttttttatgttcttccttgtttcaaagcacttattggctgtgtttttgtagttacctattttcacactgtgagcttcccgagaatggggcctgggtttgattcatctgttttctacagggtttaagtctcaggaggtctcaataaacttggtatataaatgt

SEQ ID NO: 195696 - DNA, 956 bp, Homo sapiens
  Payload ID: 18622
  Gene Name: TSEN34 tRNA splicing endonuclease subunit
  ENST ID: ENST00000615482
  CDS Start-End: 230-956
cacaagcttcggtttacttcgtagatagttgggtacaagtgacgctaggatgataggcggagtcaacaggttcgccagatacccatgagtatttacaagggggcggggcgaaagcgacttgccctcaaaggggcggaaccccgagggccggcgtgcgcctacgggaccgggccagggtgacgatcctcaagttcccaagtagaggagaggaagcggcagagggaggaggatgctggtggtggaggtggcgaacggccgctccctggtgtggggagccgaggcggtgcaggccctccgggagcgcctgggtgtggggggccgcacggtaggcgccctgccccgcgggccccgccagaactcgcgcctgggcctcccgctgctgctgatgcccgaagaggcgcggctcttggccgagatcggcgccgtgactctggtcagcgccccgcgtccagactctcggcaccacagcctggccctgacatccttcaagcgccagcaagaggagagcttccaggagcagagcgccttggcagctgaggcccgggagacccgtcgtcaggagctcctggagaagattacggagggccaggctgctaagaagcagaaactagaacaggcttcaggggccagctcaagccaggaggccggctcgagccaggctgccaaagaggatgagaccagtgatggccaggcttcgggagagcaggaggaagctggcccctcgtcttcccaagcaggaccctcaaatggggtagcccccttgcccagatctgctctccttgtccagctggccactgccaggcctcgaccggtcaaggccaggcccctggactggcgtgtccagtctaaagactggccccacgccggccgccctgcccacgagctgcgctacagtatctacagagacctgtgggagcgaggcttcttcctcagtgcggctggcaagttcggaggtg

SEQ ID NO: 195697 - DNA, 1087 bp, Homo sapiens
  Payload ID: 18622
  Gene Name: TSEN34 tRNA splicing endonuclease subunit
  ENST ID: ENST00000614483
  CDS Start-End: 81-1028
gtcggcatgagggggtggagcaaggagcgcgtggcgcggtgcgcagtgggtggctccacctcgactgcgaattactgtttatgaggaggatgctggtggtggaggtggcgaacggccgctccctggtgtggggagccgaggcggtgcaggccctccgggagcgcctgggtgtggggggccgcacggtaggcgccctgccccgcgggccccgccagaactcgcgcctgggcctcccgctgctgctgatgcccgaagaggcgcggctcttggccgagatcggcgccgtgactctggtcagcgccccgcgtccagactctcggcaccacagcctggccctgacatccttcaagcgccagcaagaggagagcttccaggagcagagcgccttggcagctgaggcccgggagacccgtcgtcaggagctcctggagaagattacggagggccaggctgctaagaagcagaaactagaacaggcttcaggggccagctcaagccaggaggccggctcgagccaggctgccaaagaggatgagaccagtgatggccaggcttcgggagagcaggaggaagctggcccctcgtcttcccaagcaggaccctcaaatggggtagcccccttgcccagatctgctctccttgtccagctggccactgccaggcctcgaccggtcaaggccaggcccctggactggcgtgtccagtctaaagactggccccacgccggccgccctgcccacgagctgcgctacagtatctacagagacctgtgggagcgaggcttcttcctcagtgcggctggcaagttcggaggtgacttcctggtctatcctggtgaccccctccgcttccacgcccattatatcgctcagtgctgggcccccgaggacaccatcccactccaagacctggttgctgctgggcgccttggaaccagcgtcagaaagaccctgctcctctgttctccgcagcctgatgggtttaagtctcaggaggtctcaataaacttggtatataaatgttcatgatttgaatgtttgcgacagtcctggaacccgtggatggtctcatctgcatgtacaggtga

SEQ ID NO: 195698 - DNA, 1915 bp, Homo sapiens; identical to SEQ ID NO: 195693
  Payload ID: 18622
  Gene Name: TSEN34 tRNA splicing endonuclease subunit
  ENST ID: ENST00000613653
  CDS Start-End: 100-1047

SEQ ID NO: 195699 - DNA, 1348 bp, Homo sapiens; identical to SEQ ID NO: 195695
  Payload ID: 18622
  Gene Name: TSEN34 tRNA splicing endonuclease subunit
  Uniprot ID: Q9BSV6
  ENST ID: ENST00000618135
  CDS Start-End: 113-1045

SEQ ID NO: 195700 - DNA, 1548 bp, Homo sapiens
  Payload ID: 18622
  Gene Name: TSEN34 tRNA splicing endonuclease subunit
  Uniprot ID: Q9BSV6
  ENST ID: ENST00000615000
  CDS Start-End: 312-1244
cgaggacgcccgaacgccgaacttcctgtgctcgggagggggcagggttttgtactgtgggagtctgagagcgaggaggtccgaaagccgaatcacagtcgttcggaaagaggaggagcgaaggctcgagcgtccggaagagggtgtggcctcggcggtgccttagcctccagagcttctgaccgctgacgggaacacccgaagggggacgcccactttgcaagagggtggtgccaaaatggacctttgtaagggggcgtgtcgccgcgcttgcggaggtttgtttttcacgctccaaggcgcaatggaggatgctggtggtggaggtggcgaacggccgctccctggtgtggggagccgaggcggtgcaggccctccgggagcgcctgggtgtggggggccgcacggtaggcgccctgccccgcgggccccgccagaactcgcgcctgggcctcccgctgctgctgatgcccgaagaggcgcggctcttggccgagatcggcgccgtgactctggtcagcgccccgcgtccagactctcggcaccacagcctggccctgacatccttcaagcgccagcaagaggagagcttccaggagcagagcgccttggcagctgaggcccgggagacccgtcgtcaggagctcctggagaagattacggagggccaggctgctaagaagcagaaactagaacaggcttcaggggccagctcaagccaggaggccggctcgagccaggctgccaaagaggatgagaccagtgatggccaggcttcgggagagcaggaggaagctggcccctcgtcttcccaagcaggaccctcaaatggggtagcccccttgcccagatctgctctccttgtccagctggccactgccaggcctcgaccggtcaaggccaggcccctggactggcgtgtccagtctaaagactggccccacgccggccgccctgcccacgagctgcgctacagtatctacagagacctgtgggagcgaggcttcttcctcagtgcggctggcaagttcggaggtgacttcctggtctatcctggtgaccccctccgcttccacgcccattatatcgctcagtgctgggcccccgaggacaccatcccactccaagacctggttgctgctgggcgccttggaaccagcgtcagaaagaccctgctcctctgttctccgcagcctgatggtaaggtggtctacacctccctgcaatgggccagcctgcagtgaactccagagacctaggggatgtggctgtgtcggcagcaagagcctttctggatgttccccagctcttctctgggagtctagaacatcctcctacctttctccgcggttagtttttgattccaggttttcgaacactacatcttttttatgttcttccttgtttcaaagcacttattggctgtgtttttgtagttacctattttcacactgtgagcttcccgagaatggggcctgggtttgattcatctgttttctacagggtttaagtctcaggaggtctcaataaacttggtatataaatgtt

SEQ ID NO: 195701 - DNA, 2297 bp, Homo sapiens; identical to SEQ ID NO: 195690
  Payload ID: 18622
  Gene Name: TSEN34 tRNA splicing endonuclease subunit
  ENST ID: ENST00000611560
  CDS Start-End: 188-1120

SEQ ID NO: 195702 - DNA, 1424 bp, Homo sapiens
  Payload ID: 18622
  Gene Name: TSEN34 tRNA splicing endonuclease subunit
  Uniprot ID: Q9BSV6
  ENST ID: ENST00000612236
  CDS Start-End: 188-1120
tgacgaagttgacgagggtgtcggcatgagggggtggagcaaggagcgcgtggcgcggtgcgcagtgggtggctccacctcgactgcgaattactgtttatgaggtgactcgctggttctatcggtggacagtgggacattctgaagggaggcaaggaggcggactgagcgctcccaattggggaggatgctggtggtggaggtggcgaacggccgctccctggtgtggggagccgaggcggtgcaggccctccgggagcgcctgggtgtggggggccgcacggtaggcgccctgccccgcgggccccgccagaactcgcgcctgggcctcccgctgctgctgatgcccgaagaggcgcggctcttggccgagatcggcgccgtgactctggtcagcgccccgcgtccagactctcggcaccacagcctggccctgacatccttcaagcgccagcaagaggagagcttccaggagcagagcgccttggcagctgaggcccgggagacccgtcgtcaggagctcctggagaagattacggagggccaggctgctaagaagcagaaactagaacaggcttcaggggccagctcaagccaggaggccggctcgagccaggctgccaaagaggatgagaccagtgatggccaggcttcgggagagcaggaggaagctggcccctcgtcttcccaagcaggaccctcaaatggggtagcccccttgcccagatctgctctccttgtccagctggccactgccaggcctcgaccggtcaaggccaggcccctggactggcgtgtccagtctaaagactggccccacgccggccgccctgcccacgagctgcgctacagtatctacagagacctgtgggagcgaggcttcttcctcagtgcggctggcaagttcggaggtgacttcctggtctatcctggtgaccccctccgcttccacgcccattatatcgctcagtgctgggcccctgaggacaccatcccactccaagacctggttgctgctgggcgccttggaaccagcgtcagaaagaccctgctcctctgttctccgcagcctgatggtaaggtggtctacacctccctgcaatgggccagcctgcagtgaactccagagacctaggggatgtggctgtgtcggcagcaagagcctttctggatgttccccagctcttctctgggagtctagaacatcctcctacctttctccgcggttagtttttgattccaggttttcgaacactacatcttttttatgttcttccttgtttcaaagcacttattggctgtgtttttgtagttacctattttcacactgtgagcttcccgagaatggggcctgggtttgattcatctgttttctacagggtttaagtctcaggaggtctcaataaacttggtatataaatgtt

SEQ ID NO: 195703 - DNA, 1346 bp, Homo sapiens
  Payload ID: 18622
  Gene Name: TSEN34 tRNA splicing endonuclease subunit
  Uniprot ID: Q9BSV6
  ENST ID: ENST00000611798
  CDS Start-End: 110-1042
ctcgactgcgaattactgtttatgaggtgactcgctggttctatcggtggacagtgggacattctgaagggaggcaaggaggcggactgagcgctcccaattggggaggatgctggtggtggaggtggcgaacggccgctccctggtgtggggagccgaggcggtgcaggccctccgggagcgcctgggtgtggggggccgcacggtaggcgccctgccccgcgggccccgccagaactcgcgcctgggcctcccgctgctgctgatgcccgaagaggcgcggctcttggccgagatcggcgccgtgactctggtcagcgccccgcgtccagactctcggcaccacagcctggccctgacatccttcaagcgccagcaagaggagagcttccaggagcagagcgccttggcagctgaggcccgggagacccgtcgtcaggagctcctggagaagattacggagggccaggctgctaagaagcagaaactagaacaggcttcaggggccagctcaagccaggaggccggctcgagccaggctgccaaagaggatgagaccagtgatggccaggcttcgggagagcaggaggaagctggcccctcgtcttcccaagcaggaccctcaaatggggtagcccccttgcccagatctgctctccttgtccagctggccactgccaggcctcgaccggtcaaggccaggcccctggactggcgtgtccagtctaaagactggccccacgccggccgccctgcccacgagctgcgctacagtatctacagagacctgtgggagcgaggcttcttcctcagtgcggctggcaagttcggaggtgacttcctggtctatcctggtgaccccctccgcttccacgcccattatatcgctcagtgctgggcccccgaggacaccatcccactccaagacctggttgctgctgggcgccttggaaccagcgtcagaaagaccctgctcctctgttctccgcagcctgatggtaaggtggtctacacctccctgcaatgggccagcctgcagtgaactccagagacctaggggatgtggctgtgtcggcagcaagagcctttctggatgttccccagctcttctctgggagtctagaacatcctcctacctttctccgcggttagtttttgattccaggttttcgaacactacatcttttttatgttcttccttgtttcaaagcacttattggctgtgtttttgtagttacctattttcacactgtgagcttcccgagaatggggcctgggtttgattcatctgttttctacagggtttaagtctcaggaggtctcaataaacttggtatataaatgtt

SEQ ID NO: 195704 - DNA, 1548 bp, Homo sapiens; identical to SEQ ID NO: 195685
  Payload ID: 18622
  Gene Name: TSEN34 tRNA splicing endonuclease subunit
  Uniprot ID: Q9BSV6
  ENST ID: ENST00000616063
  CDS Start-End: 312-1244

SEQ ID NO: 195705 - DNA, 2297 bp, Homo sapiens; identical to SEQ ID NO: 195690
  Payload ID: 18622
  Gene Name: TSEN34 tRNA splicing endonuclease subunit
  ENST ID: ENST00000613888
  CDS Start-End: 188-1120

SEQ ID NO: 195706 - DNA, 2421 bp, Homo sapiens
  Payload ID: 18622
  Gene Name: TSEN34 tRNA splicing endonuclease subunit
  ENST ID: ENST00000616209
  CDS Start-End: 312-1244
cgaggacgcccgaacgccgaacttcctgtgctcgggagggggcagggttttgtactgtgggagtctgagagcgaggaggtccgaaagccgaatcacagtcgttcggaaagaggaggagcgaaggctcgagcgtccggaagagggtgtggcctcggcggtgccttagcctccagagcttctgaccgctgacgggaacacccgaagggggacgcccactttgcaagagggtggtgccaaaatggacctttgtaagggggcgtgtcgccgcgcttgcggaggtttgtttttcacgctccaaggcgcaatggaggatgctggtggtggaggtggcgaacggccgctccctggtgtggggagccgaggcggtgcaggccctccgggagcgcctgggtgtggggggccgcacggtaggcgccctgccccgcgggccccgccagaactcgcgcctgggcctcccgctgctgctgatgcccgaagaggcgcggctcttggccgagatcggcgccgtgactctggtcagcgccccgcgtccagactctcggcaccacagcctggccctgacatccttcaagcgccagcaagaggagagcttccaggagcagagcgccttggcagctgaggcccgggagacccgtcgtcaggagctcctggagaagattacggagggccaggctgctaagaagcagaaactagaacaggcttcaggggccagctcaagccaggaggccggctcgagccaggctgccaaagaggatgagaccagtgatggccaggcttcgggagagcaggaggaagctggcccctcgtcttcccaagcaggaccctcaaatggggtagcccccttgcccagatctgctctccttgtccagctggccactgccaggcctcgaccggtcaaggccaggcccctggactggcgtgtccagtctaaagactggccccacgccggccgccctgcccacgagctgcgctacagtatctacagagacctgtgggagcgaggcttcttcctcagtgcggctggcaagttcggaggtgacttcctggtctatcctggtgaccccctccgcttccacgcccattatatcgctcagtgctgggcccccgaggacaccatcccactccaagacctggttgctgctgggcgccttggaaccagcgtcagaaagaccctgctcctctgttctccgcagcctgatggtaaggtggtctacacctccctgcaatgggccagcctgcagtgaactccagagacctaggggatgtggctgtgtcggcagcaagagcctttctggatgttccccagctcttctctgggagtctagaacatcctcctacctttctccgcggttagtttttgattccaggttttcgaacactacatcttttttatgttcttccttgtttcaaagcacttattggctgtgtttttgtagttacctattttcacactgtgagcttcccgagaatggggcctgggtttgattcatctgttttctacagggtttaagtctcaggaggtctcaataaacttggtatataaatgttcatgatttgaatgtttgcgacagtcctggaacccgtggatggtctcatctgcatgtacaggtgagaaaaaggcctggaggggggggactgacttgcccaaagtcacacacttagtaaatagcaggcctggcctttcaaaattggtttttctgactcctaaatctgcactctttctacctcactaaacttcctcttgaaaagatttctatgaaatttcccagatgcatacaaacgttataaataaaaatataggctgggcacgatgacccacacctgtaatcccacagaacttttggaggccaaggcagggggatcgcttgagcccaggagtttgagaccagctctggcaacattgtaatacccagtctctacaaaaaataatttaaaaaaaaattagccagggatcccttgagcctgggaagttgaggctgctgtgagctgtgattgcaccactgccctccagcctgggagacagagcaagaacctgtctcaaaaaatatatatatgtgtgtgtgtatatatgtaaatatacacacatgtatgtatatatatgtgtgtgtatatatatatatattatgaaaggaaatgagtattgtaattttaggagttcagagcctggggagaaaggaaggactctggaaggcgttctgctttttcatggcctgggtagtggtggagaatttttttgatactgtatatttatattttagactcttttttggatgtgttatattctgcaatttttataaaagctaaaacacatgtatttgtaaaaaatttgcacttatgaaatcatttacccatgtttttgcttaagaaagtactagaacactaccactattccaataattacacctttatcttatcaatgtg

SEQ ID NO: 195707 - DNA, 856 bp, Homo sapiens
  Payload ID: 18622
  Gene Name: TSEN34 tRNA splicing endonuclease subunit
  ENST ID: ENST00000617739
  CDS Start-End: 99-856
gacgaagttgacgagggtgtcggcatgagggggtggagcaaggagcgcgtggcgcggtgcgcagtgggtggctccacctcgactgcgaattactgtttatgaggaggatgctggtggtggaggtggcgaacggccgctccctggtgtggggagccgaggcggtgcaggccctccgggagcgcctgggtgtggggggccgcacggtaggcgccctgccccgcgggccccgccagaactcgcgcctgggcctcccgctgctgctgatgcccgaagaggcgcggctcttggccgagatcggcgccgtgactctggtcagcgccccgcgtccagactctcggcaccacagcctggccctgacatccttcaagcgccagcaagaggagagcttccaggagcagagcgccttggcagctgaggcccgggagacccgtcgtcaggagctcctggagaagattacggagggccaggctgctaagaagcagaaactagaacaggcttcaggggccagctcaagccaggaggccggctcgagccaggctgccaaagaggatgagaccagtgatggccaggcttcgggagagcaggaggaagctggcccctcgtcttcccaagcaggaccctcaaatggggtagcccccttgcccagatctgctctccttgtccagctggccactgccaggcctcgaccggtcaaggccaggcccctggactggcgtgtccagtctaaagactggccccacgccggccgccctgcccacgagctgcgctacagtatctacagagacctgtgggagcgaggcttcttcctcagtgcggctggcaagttcggaggtgacttcctggtctatcctggtga

SEQ ID NO: 195708 - DNA, 852 bp, Homo sapiens
  Payload ID: 18622
  Gene Name: TSEN34 tRNA splicing endonuclease subunit
  ENST ID: ENST00000617559
  CDS Start-End: 99-852
gacgaagttgacgagggtgtcggcatgagggggtggagcaaggagcgcgtggcgcggtgcgcagtgggtggctccacctcgactgcgaattactgtttatgaggaggatgctggtggtggaggtggcgaacggccgctccctggtgtggggagccgaggcggtgcaggccctccgggagcgcctgggtgtggggggccgcacggtaggcgccctgccccgcgggccccgccagaactcgcgcctgggcctcccgctgctgctgatgcccgaagaggcgcggctcttggccgagatcggcgccgtgactctggtcagcgccccgcgtccagactctcggcaccacagcctggccctgacatccttcaagcgccagcaagaggagagcttccaggagcagagcgccttggcagctgaggcccgggagacccgtcgtcaggagctcctggagaagattacggagggccaggctgctaagaagcagaaactagaacaggcttcaggggccagctcaagccaggaggccggctcgagccaggctgccaaagaggatgagaccagtgatggccaggcttcgggagagcaggaggaagctggcccctcgtcttcccaagcaggaccctcaaatggggtagcccccttgcccagatctgctctccttgtccagctggccactgccaggcctcgaccggtcaaggccaggcccctggactggcgtgtccagtctaaagactggccccacgccggccgccctgcccacgagctgcgctacagtatctacagagacctgtgggagcgaggcttcttcctcagtgcggctggcaagttcggaggtgacttcctggtctatcctg

SEQ ID NO: 195709 - DNA, 2421 bp, Homo sapiens; identical to SEQ ID NO: 195706
  Payload ID: 18622
  Gene Name: TSEN34 tRNA splicing endonuclease subunit
  ENST ID: ENST00000617149
  CDS Start-End: 312-1244

SEQ ID NO: 195710 - DNA, 2421 bp, Homo sapiens; identical to SEQ ID NO: 195706
  Payload ID: 18622
  Gene Name: TSEN34 tRNA splicing endonuclease subunit
  ENST ID: ENST00000619994
  CDS Start-End: 312-1244

SEQ ID NO: 195711 - DNA, 956 bp, Homo sapiens; identical to SEQ ID NO: 195691
  Payload ID: 18622
  Gene Name: TSEN34 tRNA splicing endonuclease subunit
  ENST ID: ENST00000621740
  CDS Start-End: 230-956

SEQ ID NO: 195712 - DNA, 2421 bp, Homo sapiens; identical to SEQ ID NO: 195706
  Payload ID: 18622
  Gene Name: TSEN34 tRNA splicing endonuclease subunit
  ENST ID: ENST00000622538
  CDS Start-End: 312-1244

SEQ ID NO: 195713 - DNA, 1912 bp, Homo sapiens; identical to SEQ ID NO: 195687
  Payload ID: 18622
  Gene Name: TSEN34 tRNA splicing endonuclease subunit
  ENST ID: ENST00000618447
  CDS Start-End: 100-1047

SEQ ID NO: 195714 - DNA, 1915 bp, Homo sapiens; identical to SEQ ID NO: 195693
  Payload ID: 18622
  Gene Name: TSEN34 tRNA splicing endonuclease subunit
  ENST ID: ENST00000619273
  CDS Start-End: 100-1047

SEQ ID NO: 195715 - DNA, 1915 bp, Homo sapiens; identical to SEQ ID NO: 195693
  Payload ID: 18622
  Gene Name: TSEN34 tRNA splicing endonuclease subunit
  ENST ID: ENST00000613337
  CDS Start-End: 100-1047

SEQ ID NO: 195716 - DNA, 2421 bp, Homo sapiens; identical to SEQ ID NO: 195706
  Payload ID: 18622
  Gene Name: TSEN34 tRNA splicing endonuclease subunit
  ENST ID: ENST00000614984
  CDS Start-End: 312-1244

SEQ ID NO: 195717 - DNA, 2297 bp, Homo sapiens; identical to SEQ ID NO: 195690
  Payload ID: 18622
  Gene Name: TSEN34 tRNA splicing endonuclease subunit
  ENST ID: ENST00000622524
  CDS Start-End: 188-1120

SEQ ID NO: 195718 - DNA, 1424 bp, Homo sapiens; identical to SEQ ID NO: 195702
  Payload ID: 18622
  Gene Name: TSEN34 tRNA splicing endonuclease subunit
  Uniprot ID: Q9BSV6
  ENST ID: ENST00000615975
  CDS Start-End: 188-1120

SEQ ID NO: 195719 - DNA, 1915 bp, Homo sapiens; identical to SEQ ID NO: 195693
  Payload ID: 18622
  Gene Name: TSEN34 tRNA splicing endonuclease subunit
  ENST ID: ENST00000619263
  CDS Start-End: 100-1047

SEQ ID NO: 195720 - DNA, 2297 bp, Homo sapiens; identical to SEQ ID NO: 195690
  Payload ID: 18622
  Gene Name: TSEN34 tRNA splicing endonuclease subunit
  ENST ID: ENST00000617902
  CDS Start-End: 188-1120

SEQ ID NO: 195721 - DNA, 1912 bp, Homo sapiens; identical to SEQ ID NO: 195687
  Payload ID: 18622
  Gene Name: TSEN34 tRNA splicing endonuclease subunit
  ENST ID: ENST00000617543
  CDS Start-End: 100-1047

SEQ ID NO: 195722 - DNA, 1327 bp, Homo sapiens
  Payload ID: 18622
  Gene Name: TSEN34 tRNA splicing endonuclease subunit
  Uniprot ID: Q9BSV6
  ENST ID: ENST00000615079
  CDS Start-End: 92-1024
gccgagaccccggaggctttgggtgcgctgcagcggtctgcggcgcgcagctgtttcggtaactgctttgcctcccggctcccgcaggaggatgctggtggtggaggtggcgaacggccgctccctggtgtggggagccgaggcggtgcaggccctccgggagcgcctgggtgtggggggccgcacggtaggcgccctgccccgcgggccccgccagaactcgcgcctgggcctcccgctgctgctgatgcccgaagaggcgcggctcttggccgagatcggcgccgtgactctggtcagcgccccgcgtccagactctcggcaccacagcctggccctgacatccttcaagcgccagcaagaggagagcttccaggagcagagcgccttggcagctgaggcccgggagacccgtcgtcaggagctcctggagaagattacggagggccaggctgctaagaagcagaaactagaacaggcttcaggggccagctcaagccaggaggccggctcgagccaggctgccaaagaggatgagaccagtgatggccaggcttcgggagagcaggaggaagctggcccctcgtcttcccaagcaggaccctcaaatggggtagcccccttgcccagatctgctctccttgtccagctggccactgccaggcctcgaccggtcaaggccaggcccctggactggcgtgtccagtctaaagactggccccacgccggccgccctgcccacgagctgcgctacagtatctacagagacctgtgggagcgaggcttcttcctcagtgcggctggcaagttcggaggtgacttcctggtctatcctggtgaccccctccgcttccacgcccattatatcgctcagtgctgggcccccgaggacaccatcccactccaagacctggttgctgctgggcgccttggaaccagcgtcagaaagaccctgctcctctgttctccgcagcctgatggtaaggtggtctacacctccctgcaatgggccagcctgcagtgaactccagagacctaggggatgtggctgtgtcggcagcaagagcctttctggatgttccccagctcttctctgggagtctagaacatcctcctacctttctccgcggttagtttttgattccaggttttcgaacactacatcttttttatgttcttccttgtttcaaagcacttattggctgtgtttttgtagttacctattttcacactgtgagcttcccgagaatggggcctgggtttgattcatctgttttctacagggtttaagtctcaggaggtctcaataaacttggtatataaatgt

SEQ ID NO: 195723 - DNA, 2297 bp, Homo sapiens; identical to SEQ ID NO: 195690
  Payload ID: 18622
  Gene Name: TSEN34 tRNA splicing endonuclease subunit
  ENST ID: ENST00000613712
  CDS Start-End: 188-1120

SEQ ID NO: 195724 - DNA, 2421 bp, Homo sapiens; identical to SEQ ID NO: 195706
  Payload ID: 18622
  Gene Name: TSEN34 tRNA splicing endonuclease subunit
  ENST ID: ENST00000615900
  CDS Start-End: 312-1244

SEQ ID NO: 195725 - DNA, 1944 bp, Homo sapiens
  Payload ID: 18623
  Gene Name: TSEN54 tRNA splicing endonuclease subunit
  Uniprot ID: Q7Z6J9
  ENST ID: ENST00000333213
  CDS Start-End: 37-1617
ggcgtggcggcgcgcgcagcggcaggcggcggcgggatggagcccgagcccgagcccgcggccgtggaggttcccgcggggcgcgtgctcagcgcccgggagctcttcgccgcccgctcgcggtcgcagaagctgccccagcgctcgcatggccccaaggactttctgcccgacggctcggcagctcaggccgagcggctgcgccggtgccgggaagagctctggcagctgctggcagagcagcgcgtggagcgcctgggcagcttggtggctgccgagtggaggccagaagagggcttcgtggagttgaagtctcccgcgggcaaattctggcagaccatgggcttctcagagcagggccggcagcgccttcacccggaagaggccttgtatcttctggagtgtggctccatccacctcttccaccaagacctgccactgtctatccaggaagcttaccagctgctgctgaccgaccacactgtgaccttcctgcagtaccaggtcttcagccacctgaagaggttgggttatgtggttcgacgattccaaccaagctctgtcctgtccccgtatgagaggcagcttaacctggatgccagcgtgcagcacttggaggatggagatggcaagagaaagaggagcagctccagccctcggtccattaataagaaggccaaggccctggacaactccctgcaacccaagagtctggcagcctccagcccacctccctgcagccagcccagccaatgcccagaggagaaaccccaggagtcaagccccatgaagggcccagggggcccctttcagcttctggggtccctgggccccagccctggcccggccagggagggggtggggtgcagctgggagagtggcagagccgagaacggagtcacgggagccggtaagcggcgctggaacttcgagcagatctccttccccaacatggcttcagacagccgccacacccttctgcgcgccccagccccagagctgctcccggccaacgtggctgggcgggagacagacgctgagtcctggtgccagaagctgaaccagcgcaaggagaagctctccaggcgggaacgggagcaccacgcggaggccgcgcagttccaggaagatgtcaacgccgatcccgaggtgcagcggtgctccagctggcgggagtacaaggagctgctgcagcggcggcaggtgcagaggagccagcgccgggcccctcacctgtggggccagcccgtcaccccgctgctgagtcctggccaggccagctccccagccgtggtccttcagcatatctctgtgctgcagacaacacaccttcctgatggaggtgcccggctgttggagaagtctgggggcttggaaatcatctttgatgtttaccaggccgacgctgtggccacattccgaaagaataaccctggcaaaccctatgcccggatgtgcattagtggatttgatgagcctgtcccagacctctgcagcctcaagcggttgtcttaccagagtggggatgtccctctgatctttgccctggtggatcatggtgacatctccttctacagcttcagggacttcacgttgccccaggatgtggggcactgacctcacagctctgcagaggatggagcttgctccgggggaccgggactgtctgttctcagggaccatctcggctgcctcctgtacccagactctaacctgtagcttcagaggccagtctgggccttggccctgggtgtctgatactcacagagtgaaactgtgaccctctcccttccctgctgccttgcagtgacccctctggaactcaggactcgattttaaggacccaggaggtggggcagaagagaggactgtgtgcctttaacgagagggtgcctgcttcgtgctataaagccaaagccattaaaaatagatttcttttctgct

SEQ ID NO: 195726 - DNA, 627 bp, Homo sapiens
  Payload ID: 18623
  Gene Name: TSEN54 tRNA splicing endonuclease subunit
  ENST ID: ENST00000434205
  CDS Start-End: 410-627
ggacggaagacaccgaaggaatggcgaacctccccggaccgctcctgacagttcccgggtggccttcggcctgcaaagtcggaatttgcacaccctccgctcgtccttccctgagcccttctgccctccttgcccagcccgggcggtggggactaagcagcgcgaggctgcagaggggcggtcacaagtgtgaccattcgcactgcactccagacgccggctcctcaggctttactggagagaagccccgaggagggctaggggcaaaagaggggccttctgcatctccagcaacctgcgggctgagctcccagacccggcgtcggggggcagcttggtggctgccgagtggaggccagaagagggcttcgtggagttgaagtctcccgcgggcaaattctggcagaccatgggcttctcagagcagggccggcagcgccttcacccggaagaggccttgtatcttctggagtgtggctccatccacctcttccaccaagacctgccactgtctatccaggaagcttaccagctgctgctgaccgaccacactgtgaccttcctgcagtaccaggtcttcagccacctgaagaggttgggttatgtggttcgacgattccaaccaag

SEQ ID NO: 195727 - DNA, 1139 bp, Homo sapiens
  Payload ID: 18623
  Gene Name: TSEN54 tRNA splicing endonuclease subunit
  ENST ID: ENST00000545228
  CDS Start-End: 1-778
caacatggcttcagacagccgccacacccttctgcgcgccccagccccagagctgctcccggccaacgtggctgggcgggagacagacgctgagtcctggtgccagaagctgaaccagcgcaaggagaagctctccaggcgggaacgggagcaccacgcggaggccgcgcagttccaggaagatgtcaacgccgatcccgaggtgcagcggtgctccagctggcgggagtacaaggagctgctgcagcggcggcaggtgcagaggagccagcgccgggcccctcacctgtggggccagcccgtcaccccgctgctgagtcctggccaggccagctccccaggtaccccctcagcctgccacatcttcgagggccactggcagctgaggaatcacaggactttggaaagggcatggatgaactgggatggattgaggcttaaggaagatgtgggaggagggagtggacccacaagcacggtcagttctccggcggctgcagcagggcctgtgtgggaaggcttagagatgccgtggtccttcagcatatctctgtgctgcagacaacacaccttcctgatggaggtgcccggctgttggagaagtctgggggcttggaaatcatctttgatgtttaccaggccgacgctgtggccacattccgaaagaataaccctggcaaaccctatgcccggatgtgcattagtggatttgatgagcctgtcccagacctctgcagcctcaagcggttgtcttaccagagtggggatgtccctctgatctttgccctggtggatcatggtgacatctccttctacagcttcagggacttcacgttgccccaggatgtggggcactgacctcacagctctgcagaggatggagcttgctccgggggaccgggactgtctgttctcagggaccatctcggctgcctcctgtacccagactctaacctgtagcttcagaggccagtctgggccttggccctgggtgtctgatactcacagagtgaaactgtgaccctctcccttccctgctgccttgcagtgacccctctggaactcaggactcgattttaaggacccaggaggtggggcagaagagaggactgtgtgcctttaacgagagggtgcctgct

SEQ ID NO: 195728 - DNA, 765 bp, Homo sapiens
  Payload ID: 18623
  Gene Name: TSEN54 tRNA splicing endonuclease subunit
  ENST ID: ENST00000583818
  CDS Start-End: 1-429
cgctcgcatggccccaaggactttctgcccgacggctcggcagctcaggccgagcggctgcgccggtgccgggaagagctctggcagctgctggcagagcagcgcgtggagcgcctgggcagcttggtggctgccgagtggaggccagaagagggcttcgtggagttgaagtctcccgcgggcaaattctggcagaccatgggcttctcagagcagggccggcagcgccttcacccggaagaggccttgtatcttctggagtgtggctccatccacctcttccaccaagacctgccactgtctatccaggaagcttaccagctgctgctgaccgaccacactgtgaccttcctgcagtaccaggtcttcagccacctgaagaggttgggttatgtggttcgacgattccaaccaagatccccaggctgaggaggtgggtcagtggcccacccgctgttctcaccccacagctctgtcctgtccccgtatgagaggcagcttaacctggatgccagcgtgcagcacttggaggatggagatggcaagagaaagaggagcagctccagccctcggtccattaataagaaggccaaggccctggacaactccctgcaacccaagagtctggcagcctccagcccacctccctgcagccagcccagccaatgcccagaggagaaaccccaggagtcaagccccatgaagggcccagggggcccctttcagcttctggggtccctgggccccagccctggcccggccagg

SEQ ID NO: 195729 - DNA, 798 bp, Homo sapiens
  Payload ID: 18623
  Gene Name: TSEN54 tRNA splicing endonuclease subunit
  ENST ID: ENST00000583173
  CDS Start-End: 1-537
atggagcccgagcccgagcccgcggccgtggaggttcccgcggggcgcgtgctcaggggcagcttggtggctgccgagtggaggccagaagagggcttcgtggagttgaagtctcccgcgggcaaattctggcagaccatgggcttctcagagcagggccggcagcgccttcacccggaagaggccttgtatcttctggagtgtggctccatccacctcttccaccaagacctgccactgtctatccaggaagcttaccagctgctgctgaccgaccacactgtgaccttcctgcagtaccaggtcttcagccacctgaagaggttgggttatgtggttcgacgattccaaccaagctctgtcctgtccccgtatgagaggcagcttaacctggatgccagcgtgcagcacttggaggatggagatggcaagagaaagaggagcagctccagccctcgacagccgccacacccttctgcgcgccccagccccagagctgctcccggccaacgtggctgggcgggagacagacgctgagtcctggtgccagaagctgaaccagcgcaaggagaagctctccaggcgggaacgggagcaccacgcggaggccgcgcagttccaggaagatgtcaacgccgatcccgaggtgcagcggtgctccagctggcgggagtacaaggagctgctgcagcggcggcaggtgcagaggagccagcgccgggcccctcacctgtggggccagcccgtcaccccgctgctgagtcctggccaggccagctccccagccgtggtccttca

SEQ ID NO: 195730 - DNA, 994 bp, Homo sapiens
  Payload ID: 18623
  Gene Name: TSEN54 tRNA splicing endonuclease subunit
  ENST ID: ENST00000578415
  CDS Start-End: 1-502
ggactttctgcccgacggctcggcagctcaggccgagcggctgcgccggtgccgggaagagctctggcagctgctggcagagcagcgcgtggagcgcctcttggtggctgccgagtggaggccagaagagggcttcgtggagttgaagtctcccgcggtgagcggcgggctcggggaccggggaccgccctccctgccctccctgccctccctcccttgtgacacttgctctgggccccacacagggcaaattctggcagaccatgggcttctcagagcagggccggcagcgccttcacccggaagaggccttgtatcttctggagtgtggctccatccacctcttccaccaagacctgccactgtctatccaggaagcttaccagctgctgctgaccgaccacactgtgaccttcctgcagtaccaggtcttcagccacctgaagaggttgggttatgtggttcgacgattccaaccaagctctgtcctgtccccgtatgagaggcagcttaacctggatgccagcgtgcagcacttggaggatggagatggcaagagaaagaggagcagctccagccctcggtccattaataagaaggccaaggccctggacaactccctgcaacccaagagtctggcagcctccagcccacctccctgcagccagcccagccaatgcccagaggagaaaccccaggagtcaagccccatgaagggcccagggggcccctttcagcttctggggtccctgggccccagccctggcccggccagggagggggtggggtgcagctgggagagtggcagagccgagaacggagtcacgggagccggtaagcggcgctggaacttcgagcagatctccttccccaacatggcttcagacagccgccacacccttctgcgcgccccagccccagagctgctcccggccaacgtggctgggcgggagacagacgctgagtcctggtgccagaagctgaaccagcgcaa

SEQ ID NO: 195731 - DNA, 1907 bp, Homo sapiens
  Payload ID: 18624
  Gene Name: t-SNARE domain containing 1
  ENST ID: ENST00000307180
  CDS Start-End: 119-1663
acgtgatgtttgggtgcccgccccgcccgcctcgcccgccgtgagcgcccggagcggtccgcgagccaccgaggcccagctcagtgtggaggctgctggccctgccatctgtaagaagatgtcatacggatccatcgcccgtggaggtggcctggggagccgtggccctttcgggggaccttcgagacaaggctgtcagcccctagagtgcgctagatgttggaccgagtatggaatccgccatttcccctgcccgtcgccagagagcaagctgcagaaccgctgtgtggggaaggacggggaaggtgatctggggccagcaggcacgcctattgtcccaagggccaggaagcgagggcctggggttgcccctgaaggcagccggatgccggagcccacctcatcacccaccattggcccgaggaaggactcggctgctgggccccatggccggatggcggggcccagcactacccgggccaagaagaggaagcccaacttctgcccgcaggagaccgaggtgctggtgtccaaggtgagcaagcaccaccagctgctgtttggcacggggctgctgaaggccgagcccactcgcaggtaccgcgtgtggagccgcatcctgcaggccgtgaatgcgctgggctactgtcgccgcgacgttgtggacctgaagcacaagtggcgggacctacgagccgtcgtgcggcgcaagctgggcgacctccggaaggcggcccatggccccagccctggttccggcaagccccaggccctggctctcacgcccgtggagcaggtggtggccaagaccttctcttgccaggccctgccctccgagggcttcagtctggagccgcccagagccacccaggtcgatccgtgcaacctccaggagctgttccaggagatgtcggccaacgtcttccgaatcaactccagtgtgacctccttggagcggagccttcagtccttagggacaccgagtgacacgcaggagcttcgggacagcctgcacacggcacagcaggagaccaacaagaccattgcagccagcgccagctccgtgaagcagatggccgagctgctgcgcagctcctgcccgcaggagcgtctgcagcaggagcgtcctcagctggaccggctgaaaacccagctctcagatgccattcagtgctatggagtggtgcagaagaaaattgcagaaaagtccagagcgctgcttcccatggcgcagaggggcagtaaacagcagagtccccaggccccgtttgccgagctggctgatgatgagaaggtctttaacgggagtgacaacatgtggcagggccaggagcaggcgctgctcccggacatcactgaagaggacctggaggccatccggctgcgggaggaggccatcctgcagatggagagcaacttgctggatgtgaatcagatcatcaaggacttggcctccatggtgtcagagcaaggagaagctgttgatagtattgaagccagccttgaggctgcgtcctcgcatgcggaggcagcccgccagctcctggctggagccagccggcaccaactccagagacacaagatcaagtgctgcttcctatcagctggagtcactgccctgcttgtcatcatcatcatcatcgccacctctgtccgaaagtgatgctacccgtgcatcggccgctgaaccgtcagctggctgtggtgtgggctctccagccccgagcacccctcctggcccggagctgggagctgatggagtccgctgcgttgtcagctgatgccgtcacttggcctgcaatggacccgagagcttcacagctgcctgctgtcctcccctgcactgaccccactcgcccctgtgtcggccccagctgagcacccgaataaaccgctgtggcttatcc

SEQ ID NO: 195732 - DNA, 1742 bp, Homo sapiens
  Payload ID: 18624
  Gene Name: t-SNARE domain containing 1
  ENST ID: ENST00000520166
  CDS Start-End: 40-1584
ctcagtgtggaggctgctggccctgccatctgtaagaagatgtcatacggatccatcgcccgtggaggtggcctggggagccgtggccctttcgggggaccttcgagacaaggctgtcagcccctagagtgcgctagatgttggaccgagtatggaatccgccatttcccctgcccgtcgccagagagcaagctgcagaaccgctgtgtggggaaggacggggaaggtgatctggggccagcaggcacgcctattgtcccaagggccaggaagcgagggcctggggttgcccctgaaggcagccggatgccggagcccacctcatcacccaccattggcccgaggaaggactcggctgctgggccccatggccggatggcggggcccagcactacccgggccaagaagaggaagcccaacttctgcccgcaggagaccgaggtgctggtgtccaaggtgagcaagcaccaccagctgctgtttggcacggggctgctgaaggccgagcccactcgcaggtaccgcgtgtggagccgcatcctgcaggccgtgaatgcgctgggctactgtcgccgcgacgttgtggacctgaagcacaagtggcgggacctacgagccgtcgtgcggcgcaagctgggcgacctccggaaggcggcccatggccccagccctggttccggcaagccccaggccctggctctcacgcccgtggagcaggtggtggccaagaccttctcttgccaggccctgccctccgagggcttcagtctggagccgcccagagccacccaggtcgatccgtgcaacctccaggagctgttccaggagatgtcggccaacgtcttccgaatcaactccagtgtgacctccttggagcggagccttcagtccttagggacaccgagtgacacgcaggagcttcgggacagcctgcacacggcacagcaggagaccaacaagaccattgcagccagcgccagctccgtgaagcagatggccgagctgctgcgcagctcctgcccgcaggagcgtctgcagcaggagcgtcctcagctggaccggctgaaaacccagctctcagatgccattcagtgctatggagtggtgcagaagaaaattgcagaaaagtccagagcgctgcttcccatggcgcagaggggcagtaaacagcagagtccccaggccccgtttgccgagctggctgatgatgagaaggtctttaacgggagtgacaacatgtggcagggccaggagcaggcgctgctcccggacatcactgaagaggacctggaggccatccggctgcgggaggaggccatcctgcagatggagagcaacttgctggatgtgaatcagatcatcaaggacttggcctccatggtgtcagagcaaggagaagctgttgatagtattgaagccagccttgaggctgcgtcctcgcatgcggaggcagcccgccagctcctggctggagccagccggcaccaactccagagacacaagatcaagtgctgcttcctatcagctggagtcactgccctgcttgtcatcatcatcatcatcgccacctctgtccgaaagtgatgctacccgtgcatcggccgctgaaccgtcagctggctgtggtgtgggctctccagccccgagcacccctcctggcccggagctgggagctgatggagtccgctgcgttgtcagctgatgccgtcacttggcctgcaatggacccgagagcttcacag

SEQ ID NO: 195733 - DNA, 1963 bp, Homo sapiens
  Payload ID: 18624
  Gene Name: t-SNARE domain containing 1
  Uniprot ID: Q96NA8
  ENST ID: ENST00000524325
  CDS Start-End: 177-1718
cggcggccattggctggtgcgggagggggcgcgcacgccggcggcgggaggggccgtcacgtgatgtttgggtgcccgccccgcccgcctcgcccgccgtgagcgcccggagcggtccgcgagccaccgaggcccagctcagtgtggaggctgctggccctgccatctgtaagaagatgtcatacggatccatcgcccgtggaggtggcctggggagccgtggccctttcgggggaccttcgagacaaggctgtcagcccctagagtgcgctagatgttggaccgagtatggaatccgccatttcccctgcccgtcgccagagagcaagctgcagaaccgctgtgtggggaaggacggggaaggtgatctggggccagcaggcacgcctattgtcccaagggccaggaagcgagggcctggggttgcccctgaaggcagccggatgccggagcccacctcatcacccaccattggcccgaggaaggactcggctgctgggccccatggccggatggcggggcccagcactacccgggccaagaagaggaagcccaacttctgcccgcaggagaccgaggtgctggtgtccaaggtgagcaagcaccaccagctgctgtttggcacggggctgctgaaggccgagcccactcgcaggtaccgcgtgtggagccgcatcctgcaggccgtgaatgcgctgggctactgtcgccgcgacgttgtggacctgaagcacaagtggcgggacctacgagccgtcgtgcggcgcaagctgggcgacctccggaaggcggcccatggccccagccctggttccggcaagccccaggccctggctctcacgcccgtggagcaggtggtggccaagaccttctcttgccaggccctgccctccgagggcttcagtctggagccgcccagagccacccaggtcgatccgtgcaacctccaggagctgttccaggagatgtcggccaacgtcttccgaatcaactccagtgtgacctccttggagcggagccttcagtccttagggacaccgagtgacacgcaggagcttcgggacagcctgcacacggcacagcaggagaccaacaagaccattgcagccagcgccagctccgtgaagcagatggccgagctgctgcgcagctcctgcccgcaggagcgtctgcagcaggagcgtcctcagctggaccggctgaaaacccagctctcagatgccattcagtgctatggagtggtgcagaagaaaattgcagaaaagtccagagcgctgcttcccatggcgcagaggggcagtaaacagagtccccaggccccgtttgccgagctggctgatgatgagaaggtctttaacgggagtgacaacatgtggcagggccaggagcaggcgctgctcccggacatcactgaagaggacctggaggccatccggctgcgggaggaggccatcctgcagatggagagcaacttgctggatgtgaatcagatcatcaaggacttggcctccatggtgtcagagcaaggagaagctgttgatagtattgaagccagccttgaggctgcgtcctcgcatgcggaggcagcccgccagctcctggctggagccagccggcaccaactccagagacacaagatcaagtgctgcttcctatcagctggagtcactgccctgcttgtcatcatcatcatcatcgccacctctgtccgaaagtgatgctacccgtgcatcggccgctgaaccgtcagctggctgtggtgtgggctctccagccccgagcacccctcctggcccggagctgggagctgatggagtccgctgcgttgtcagctgatgccgtcacttggcctgcaatggacccgagagcttcacagctgcctgctgtcctcccctgcactgaccccactcgcccctgtgtcggccccagctgagcacccgaataaaccgctgtggcttatcca

SEQ ID NO: 195734 - DNA, 589 bp, Homo sapiens
  Payload ID: 18624
  Gene Name: t-SNARE domain containing 1
  ENST ID: ENST00000520462
  CDS Start-End: 139-589
gaccctgagccgcagccccgcgagagcgccgcatttcggggaccggcccgcgggcacatgagcccctcggcgggtcctcgcgcgctgttcagaccccagctcagtgtggaggctgctggccctgccatctgtaagaagatgtcatacggatccatcgcccgtggaggtggcctggggagccgtggccctttcgggggaccttcgagacaaggctgtcagcccctagagtgcgctagatgttggaccgagtatggaatccgccatttcccctgcccgtcgccagagagcaagctgcagaaccgctgtgtggggaaggacggggaaggtgatctggggccagcaggcacgcctattgtcccaagggccaggaagcgagggcctggggttgcccctgaaggcagccggatgccggagcccacctcatcacccaccattggcccgaggaaggactcggctgctgggccccatggccggatggcggggcccagcactacccgggccaagaagaggaagcccaacttctgcccgcaggagaccgaggtgctggtgtccaaggtgagcaagcaccaccagctgctgtttggcacgg

SEQ ID NO: 195735 - DNA, 2110 bp, Homo sapiens
  Payload ID: 18624
  Gene Name: t-SNARE domain containing 1
  ENST ID: ENST00000519651
  CDS Start-End: 105-938
tgcccgccccgcccgcctcgcccgccgtgagcgcccggagcggtccgcgagccaccgaggcccagctcagtgtggaggctgctggccctgccatctgtaagaagatgtcatacggatccatcgcccgtggaggtggcctggggagccgtggccctttcgggggaccttcgagacaaggctgtcagcccctagccacccaggtcgatccgtgcaacctccaggagctgttccaggagatgtcggccaacgtcttccgaatcaactccagtgtgacctccttggagcggagccttcagtccttagggacaccgagtgacacgcaggagcttcgggacagcctgcacacggcacagcaggagaccaacaagaccattgcagccagcgccagctccgtgaagcagatggccgagctgctgcgcagctcctgcccggagcgtctgcagcaggagcgtcctcagctggaccggctgaaaacccagctctcagatgccattcagtgctatggagtggtgcagaagaaaattgcagaaaagtccagagcgctgcttcccatggcgcagaggggcagtaaacagcagagtccccaggccccgtttgccgagctggctgatgatgagaaggtctttaacgggagtgacaacatgtggcagggccaggagcaggcgctgctcccggacatcactgaagaggacctggaggccatccggctgcgggaggaggccatcctgcagatggagagcaacttgctggatgtgaatcagatcatcaaggacttggcctccatggtgtcagagcaaggagaagctgttgatagtattgaagccagccttgaggctgcgtcctcgcatgcggaggcagcccgccagctcctggctggagccagccggcaccaactgatgaggaggacgagacccccagctgcttgtggctgcccctgaggtccctggaagggcccagcctgcctgaacctgaccccctggacttacgaggagtcttccacgcacccacctcctcaccctccccacctgcttccccagcctccaccccaccagcaaccacactcatgggggccttccagccttccccgccctcttcggcgccagcacctcccttgccctccaggaggaccccagcggcagcatctgaaacgtccgcatttgagcagcagctgctggactcccaccggcagcagggcgccctgctgtcctcctgggcccagcagcagagcacactcatggcccagcaaaacctgctgctgcagcggctggccgagcagagccagcgtctggccgatggcgtggaggccctcaaccggaccctcgagaggctggtggaagcacgccctacccgggaagcctcaccctcactccaggacggtagtcctgccagtggagtggcccaggggcctgctggaggctcccaggacagccccaagggcacccactcggggctcgaggtcttctcagggatgatcttgaaggtggaggaggagatatagggctggtcgggggtgctggcagagccaaagggcaggagcagggcctccagtctttcccctgctgagtccaggcaggggagaggtggcagtgactgggtctccagggcaccgggacaactccagtccaggagaccggaaggatgagaggatgtgggctgtctacctgtgatgtcgcgtccttgccattgcctgtagagggtggtgacctgcagggaaaggctgcagagagccgacctgtgggactcagtggaccaggtctactcagggatgatgctgttggaggctccaaccccatgtggcagcagctgcgaagtctgcagcccagcgtccctggaagcaggggaggtggggaagatgcactgaggggccccctgctcactggaactctggaaagggtggctcagccaggctctaaaaaggtcccaagcgtgatctggtgtgactcctgaaagcccctgtccctttggtgggcatgcacacttggagggcagggctcctctgccctacgtggttctggcccaggggaaccacatcccatatgcctggaataatttctatccaattttctgttataaatacataaatatatatatatatatatatatgcctata

SEQ ID NO: 195736 - DNA, 583 bp, Homo sapiens
  Payload ID: 18624
  Gene Name: t-SNARE domain containing 1
  ENST ID: ENST00000518720
  CDS Start-End: 178-583
acgtgatgtttgggtgcccgccccgcccgcctcgcccgccgtgagcgcccggagcggtccgcgagccaccgaggcccagtgtcctgggacaatttttggcacattggaaatgttcagccaaattcctctacaaaaccatcagctgctgtagctgcacagtcttgagtgttcctgtccatgaacatgctcagtgtggaggctgctggccctgccatctgtaagaagatgtcatacggatccatcgcccgtggaggtggcctggggagccgtggccctttcgggggaccttcgagacaaggctgtcagcccctagagtgcgctagatgttggaccgagtatggaatccgccatttcccctgcccgtcgccagagagcaagctgcagaaccgctgtgtggggaaggacggggaaggtgatctggggccagcaggcacgcctattgtcccaagggccaggaagcgagggcctggggttgcccctgaaggcagccggatgccggagcccacctcatcacccaccattggcccgaggaaggactcggctgctgggccccatggccggatggcggggcccagcactaccc

SEQ ID NO: 195737 - DNA, 3429 bp, Homo sapiens
  Payload ID: 18625
  Gene Name: TSNAX-DISC1 readthrough (NMD candidate)
  ENST ID: ENST00000602634
  CDS Start-End: 159-575
acgtgagaggagacttccggccactgcgttgtagtcggcccggctgcaaagcgtttttctgcaggctgttttcccaggttccctcggcctgtacctcgcgcactcctcttgctccaggtccttcagtctccgctcgtctcaccgtaggctgtgacgacatgagcaacaaagaaggatcaggagggttcaggaaaaggaagcatgacaatttcccacataaccaaagaagagaagggaaggatgttaattcatcttcacccgtgatgttggcctttaaatcatttcagcaggaacttgatgcaaggcatgacaaatatgagagacttgtgaaacttagtcgggatataactgttgaaagtaaaaggacaatttttctcctccataggattacaagtgctcctgatatggaagatatattgactgaatcagaaattaaattggatggtgtcagacaaaagatattccaggtagcccaagagctatcaggggaagatatgcatcagttccatcgagccattactacagaagtttacaggcaagatcctactcacagaggctcttgggatcaaggctgacagaagctccatctgaagacttttatactatagaggcagaaaaagagtgatgaatcaagcactggcttctaaagcttccgcccagatgggaagcatatctcctctgctcacatttccctgaccaaagccagtcacatggccatcctcagcttcagagaggttgggaaggcattcccactatgtgtctggatgccagcaactcagaaatatttggcagccgggattgcttaccacctgcagcgtgctttcggaggcggcggctggcacggaggccgggctacatgagaagctcgacagggcctgggatcgggttcctttccccagcagtgggcacactgttccggttcccaggaggggtgtctggcgaggagtcccaccactcggagtccagggccagacagtgtggccttgactcgagaggcctcttggtccggagccctgtttccaagagtgcagcagcccctactgtgacctctgtgagaggaacctcggcgcactttgggattcagctcagaggtggcaccagattgcctgacaggcttagctggccgtgtggccctgggagtgctgggtggcagcaagagtttgcagccatggatagttctgagaccctggacgccagctgggaggcagcctgcagcgatggagcaaggcgtgtccgggcagcaggctctctgccatcagcagagttgagtagcaacagctgcagccctggctgtggccctgaggtccccccaacccctcctggctctcacagtgcctttacctcaagctttagctttattcggctctcgcttggctctgccggggaacgtggagaagcagaaggctgcccaccatccagagaggctgagtcccattgccagagcccccaggagatgggagccaaagctgccagcttggacgggcctcacgaggacccgcgatgtctctctcggcccttcagtctcttggctacacgggtctctgcagacttggcccaggccgcaaggaacagctccaggccagagcgtgacatgcattctttaccagacatggaccctggctcctccagttctctggatccctcactggctggctgtggtggtgatgggagcagcggctcaggggatgcccactcttgggacaccctgctcaggaaatgggagccagtgctgcgggactgcctgctgagaaaccggaggcagatggaggtaatatccttaagattaaaacttcagaaacttcaggaagatgcagttgagaatgatgattatgataaagctgagacgttacaacaaagattagaagacctggaacaagagaaaatcagcctgcactttcaacttccttcaaggcagccagctcttagcagtttcctgggtcacctggcagcacaagtccaggctgccttgcgccgtggggccactcagcaggccagcggagatgacacccacaccccactgagaatggagccgaggctgttggaacccactgctcaggacagcttgcacgtgtccatcacgagacgagactggcttcttcaggaaaagcagcagctacagaaagaaatcgaagctctccaagcaaggatgtttgtgctggaagccaaagatcaacagctgagaagggaaatagaggagcaagagcagcaactccagtggcagggctgcgacctgaccccactggtgggccagctgtccctgggtcagctgcaggaggtcagcaaggccttgcaggacaccctggcctcagccggtcagattcccttccatgcagagccaccggaaaccataaggagcctccaggaaagaataaaatccctcaacttgtcacttaaagaaatcactactaaggtgtgtatgagtgagaaattctgcagcaccctgaggaagaaagttaacgatattgaaacccaactaccagccttgcttgaagccaaaatgcatgccatatcaggaaaccatttctggacggctaaagacctcaccgaggagattagatcattaacatcagagagagaagggctggagggactcctcagcaagctgttggtgttgagttccaggaatgtcaaaaagctgggaagtgttaaagaagattacaacagactgagaagagaagtggagcaccaggagactgcctatggtaggtagtgcacaactgttccccggcaagatattgatgatatttgttgtgttttgtggccaggcagaatgttctgtgccttatgtgaacgtcactgtgaagagcgtcatggagcacatggcccttttccttggggacatttttggcaggtgccttggcaaaccgaatggaattacttgtcagcttttgttttcatattcacatgtgacatcttttctttttctgttccctgtctcaacctgtgtttgctaatagccttgttattatttagagcagtctctcccttggcaaggtcttgagcattttctttgtgtgacaattatcttccttttgtcccttggctccgtctccttgtctgcacaatcatagactaaatcaggctgatctgagaaaattgagggaagaccataaagtggctcttctatgtgtggacttttctgagagcttctttccccaggaaggatgatgtagaagatgtgaatgccgccttagccaaagtgtctgcttgtcagaggagttcaagtgttcctgtgttctttccttttccagtcgttaggagtaactgagcttactctgagatttgcacccagagggatggtctcagaagacgctggttcagtgcaaattgagatggtaaaaacttatttcttaaaaaatggttcctaaataaatgtcatttactaaaacaaatgaaagaaatatatatatgaataaatggctatatttt

SEQ ID NO: 195738 - DNA, 3557 bp, Homo sapiens
  Payload ID: 18625
  Gene Name: TSNAX-DISC1 readthrough (NMD candidate)
  ENST ID: ENST00000602962
  CDS Start-End: 159-719
acgtgagaggagacttccggccactgcgttgtagtcggcccggctgcaaagcgtttttctgcaggctgttttcccaggttccctcggcctgtacctcgcgcactcctcttgctccaggtccttcagtctccgctcgtctcaccgtaggctgtgacgacatgagcaacaaagaaggatcaggagggttcaggaaaaggaagcatgacaatttcccacataaccaaagaagagaagggaaggatgttaattcatcttcacccgtgatgttggcctttaaatcatttcagcaggaacttgatgcaaggcatgacaaatatgagagacttgtgaaacttagtcgggatataactgttgaaagtaaaaggacaatttttctcctccataggattacaagtgctcctgatatggaagatatattgactgaatcagaaattaaattggatggtgtcagacaaaagatattccaggtagcccaagagctatcaggggaagatatgcatcagttccatcgagccattactacaggactacaggaatatgtggaagctgtctcttttcaacacttcatcaaaacacgatcattaattagtatggatgaaattaataaacaattgatatttacgactgaagacaatgggaaagaaaataaaactaagtttacaggcaagatcctactcacagaggctcttgggatcaaggctgacagaagctccatctgaagacttttatactatagaggcagaaaaagagtgatgaatcaagcactggcttctaaagcttccgcccagatgggaagcatatctcctctgctcacatttccctgaccaaagccagtcacatggccatcctcagcttcagagaggttgggaaggcattcccactatgtgtctggatgccagcaactcagaaatatttggcagccgggattgcttaccacctgcagcgtgctttcggaggcggcggctggcacggaggccgggctacatgagaagctcgacagggcctgggatcgggttcctttccccagcagtgggcacactgttccggttcccaggaggggtgtctggcgaggagtcccaccactcggagtccagggccagacagtgtggccttgactcgagaggcctcttggtccggagccctgtttccaagagtgcagcagcccctactgtgacctctgtgagaggaacctcggcgcactttgggattcagctcagaggtggcaccagattgcctgacaggcttagctggccgtgtggccctgggagtgctgggtggcagcaagagtttgcagccatggatagttctgagaccctggacgccagctgggaggcagcctgcagcgatggagcaaggcgtgtccgggcagcaggctctctgccatcagcagagttgagtagcaacagctgcagccctggctgtggccctgaggtccccccaacccctcctggctctcacagtgcctttacctcaagctttagctttattcggctctcgcttggctctgccggggaacgtggagaagcagaaggctgcccaccatccagagaggctgagtcccattgccagagcccccaggagatgggagccaaagctgccagcttggacgggcctcacgaggacccgcgatgtctctctcggcccttcagtctcttggctacacgggtctctgcagacttggcccaggccgcaaggaacagctccaggccagagcgtgacatgcattctttaccagacatggaccctggctcctccagttctctggatccctcactggctggctgtggtggtgatgggagcagcggctcaggggatgcccactcttgggacaccctgctcaggaaatgggagccagtgctgcgggactgcctgctgagaaaccggaggcagatggaggtaatatccttaagattaaaacttcagaaacttcaggaagatgcagttgagaatgatgattatgataaagctgagacgttacaacaaagattagaagacctggaacaagagaaaatcagcctgcactttcaacttccttcaaggcagccagctcttagcagtttcctgggtcacctggcagcacaagtccaggctgccttgcgccgtggggccactcagcaggccagcggagatgacacccacaccccactgagaatggagccgaggctgttggaacccactgctcaggacagcttgcacgtgtccatcacgagacgagactggcttcttcaggaaaagcagcagctacagaaagaaatcgaagctctccaagcaaggatgtttgtgctggaagccaaagatcaacagctgagaagggaaatagaggagcaagagcagcaactccagtggcagggctgcgacctgaccccactggtgggccagctgtccctgggtcagctgcaggaggtcagcaaggccttgcaggacaccctggcctcagccggtcagattcccttccatgcagagccaccggaaaccataaggagcctccaggaaagaataaaatccctcaacttgtcacttaaagaaatcactactaaggtgtgtatgagtgagaaattctgcagcaccctgaggaagaaagttaacgatattgaaacccaactaccagccttgcttgaagccaaaatgcatgccatatcaggaaaccatttctggacggctaaagacctcaccgaggagattagatcattaacatcagagagagaagggctggagggactcctcagcaagctgttggtgttgagttccaggaatgtcaaaaagctgggaagtgttaaagaagattacaacagactgagaagagaagtggagcaccaggagactgcctatggtaggtagtgcacaactgttccccggcaagatattgatgatatttgttgtgttttgtggccaggcagaatgttctgtgccttatgtgaacgtcactgtgaagagcgtcatggagcacatggcccttttccttggggacatttttggcaggtgccttggcaaaccgaatggaattacttgtcagcttttgttttcatattcacatgtgacatcttttctttttctgttccctgtctcaacctgtgtttgctaatagccttgttattatttagagcagtctctcccttggcaaggtcttgagcattttctttgtgtgacaattatcttccttttgtcccttggctccgtctccttgtctgcacaatcatagactaaatcaggctgatctgagaaaattgagggaagaccataaagtggctcttctatgtgtggacttttctgagagcttctttccccaggaaggatgatgtagaagatgtgaatgccgccttagccaaagtgtctgcttgtcagaggagttcaagtgttcctgtgttctttccttttccagtcgttaggagtaactgagcttactctgagatttgcacccagagggatggtctcagaagacgctggttcagtgcaaattgagatggtaaaaacttatttcttaaaaaatggttcctaaataaatgtcatttactaaaacaaatgaaagaaatatatatatgaataaatggctatatttt

SEQ ID NO: 195739 - DNA, 3454 bp, Homo sapiens
  Payload ID: 18625
  Gene Name: TSNAX-DISC1 readthrough (NMD candidate)
  ENST ID: ENST00000602567
  CDS Start-End: 159-719
acgtgagaggagacttccggccactgcgttgtagtcggcccggctgcaaagcgtttttctgcaggctgttttcccaggttccctcggcctgtacctcgcgcactcctcttgctccaggtccttcagtctccgctcgtctcaccgtaggctgtgacgacatgagcaacaaagaaggatcaggagggttcaggaaaaggaagcatgacaatttcccacataaccaaagaagagaagggaaggatgttaattcatcttcacccgtgatgttggcctttaaatcatttcagcaggaacttgatgcaaggcatgacaaatatgagagacttgtgaaacttagtcgggatataactgttgaaagtaaaaggacaatttttctcctccataggattacaagtgctcctgatatggaagatatattgactgaatcagaaattaaattggatggtgtcagacaaaagatattccaggtagcccaagagctatcaggggaagatatgcatcagttccatcgagccattactacaggactacaggaatatgtggaagctgtctcttttcaacacttcatcaaaacacgatcattaattagtatggatgaaattaataaacaattgatatttacgactgaagacaatgggaaagaaaataaaactaagtttacaggcaagatcctactcacagaggctcttgggatcaaggctgacagaagctccatctgaagacttttatactatagaggcagaaaaagagtgatgaatcaagcactggcttctaaagcttccgcccagatgggaagcatatctcctctgctcacatttccctgaccaaagccagtcacatggccatcctcagcttcagagaggttgggaaggcattcccactatgtgtctggatgccagcaactcagaaatatttggcagccgggattgcttaccacctgcagcgtgctttcggaggcggcggctggcacggaggccgggctacatgagaagctcgacagggcctgggatcgggttcctttccccagcagtgggcacactgttccggttcccaggaggggtgtctggcgaggagtcccaccactcggagtccagggccagacagtgtggccttgactcgagaggcctcttggtccggagccctgtttccaagagtgcagcagcccctactgtgacctctgtgagaggaacctcggcgcactttgggattcagctcagaggtggcaccagattgcctgacaggcttagctggccgtgtggccctgggagtgctgggtggcagcaagagtttgcagccatggatagttctgagaccctggacgccagctgggaggcagcctgcagcgatggagcaaggcgtgtccgggcagcaggctctctgccatcagcagagttgagtagcaacagctgcagccctggctgtggccctgaggtccccccaacccctcctggctctcacagtgcctttacctcaagctttagctttattcggctctcgcttggctctgccggggaacgtggagaagcagaaggctgcccaccatccagagaggctgagtcccattgccagagcccccaggagatgggagccaaagctgccagcttggacgggcctcacgaggacccgcgatgtctctctcggcccttcagtctcttggctacacgggtctctgcagacttggcccaggccgcaaggaacagctccaggccagagcgtgacatgcattctttaccagacatggaccctggctcctccagttctctggatccctcactggctggctgtggtggtgatgggagcagcggctcaggggatgcccactcttgggacaccctgctcaggaaatgggagccagtgctgcgggactgcctgctgagaaaccggaggcagatggaggtaatatccttaagattaaaacttcagaaacttcaggaagatgcagttgagaatgatgattatgataaagctgagacgttacaacaaagattagaagacctggaacaagagaaaatcagcctgcactttcaacttccttcaaggcagccagctcttagcagtttcctgggtcacctggcagcacaagtccaggctgccttgcgccgtggggccactcagcaggccagcggagatgacacccacaccccactgagaatggagccgaggctgttggaacccactgctcaggacagcttgcacgtgtccatcacgagacgagactggcttcttcaggaaaagcagcagctacagaaagaaatcgaagctctccaagcaaggatgtttgtgctggaagccaaagatcaacagctgagaagggaaatagaggagcaagagcagcaactccagtggcagggctgcgacctgaccccactggtgggccagctgtccctgggtcagctgcaggaggtcagcaaggccttgcaggacaccctggcctcagccggtcagattcccttccatgcagagccaccggaaaccataaggagcctccaggaaagaataaaatccctcaacttgtcacttaaagaaatcactactaaggaaaccatttctggacggctaaagacctcaccgaggagattagatcattaacatcagagagagaagggctggagggactcctcagcaagctgttggtgttgagttccaggaatgtcaaaaagctgggaagtgttaaagaagattacaacagactgagaagagaagtggagcaccaggagactgcctatggtaggtagtgcacaactgttccccggcaagatattgatgatatttgttgtgttttgtggccaggcagaatgttctgtgccttatgtgaacgtcactgtgaagagcgtcatggagcacatggcccttttccttggggacatttttggcaggtgccttggcaaaccgaatggaattacttgtcagcttttgttttcatattcacatgtgacatcttttctttttctgttccctgtctcaacctgtgtttgctaatagccttgttattatttagagcagtctctcccttggcaaggtcttgagcattttctttgtgtgacaattatcttccttttgtcccttggctccgtctccttgtctgcacaatcatagactaaatcaggctgatctgagaaaattgagggaagaccataaagtggctcttctatgtgtggacttttctgagagcttctttccccaggaaggatgatgtagaagatgtgaatgccgccttagccaaagtgtctgcttgtcagaggagttcaagtgttcctgtgttctttccttttccagtcgttaggagtaactgagcttactctgagatttgcacccagagggatggtctcagaagacgctggttcagtgcaaattgagatggtaaaaacttatttcttaaaaaatggttcctaaataaatgtcatttactaaaacaaatgaaagaaatatatatatgaataaatggctatatttt

SEQ ID NO: 195740 - DNA, 3048 bp, Homo sapiens
  Payload ID: 18625
  Gene Name: TSNAX-DISC1 readthrough (NMD candidate)
  ENST ID: ENST00000602885
  CDS Start-End: 159-281
acgtgagaggagacttccggccactgcgttgtagtcggcccggctgcaaagcgtttttctgcaggctgttttcccaggttccctcggcctgtacctcgcgcactcctcttgctccaggtccttcagtctccgctcgtctcaccgtaggctgtgacgacatgagcaacaaagaaggatcaggagggttcaggaaaaggaagcatgacaatttcccacataaccaaagaagagaagggaaggatgttaattcatcttcacccgtgatgttggcctttaaatgactacaggaatatgtggaagctgtctcttttcaacacttcatcaaaacacgatcattaattagtatggatgaaattaataaacaattgatatttacgactgaagacaatgggaaagaaaataaaactgcagccgggattgcttaccacctgcagcgtgctttcggaggcggcggctggcacggaggccgggctacatgagaagctcgacagggcctgggatcgggttcctttccccagcagtgggcacactgttccggttcccaggaggggtgtctggcgaggagtcccaccactcggagtccagggccagacagtgtggccttgactcgagaggcctcttggtccggagccctgtttccaagagtgcagcagcccctactgtgacctctgtgagaggaacctcggcgcactttgggattcagctcagaggtggcaccagattgcctgacaggcttagctggccgtgtggccctgggagtgctgggtggcagcaagagtttgcagccatggatagttctgagaccctggacgccagctgggaggcagcctgcagcgatggagcaaggcgtgtccgggcagcaggctctctgccatcagcagagttgagtagcaacagctgcagccctggctgtggccctgaggtccccccaacccctcctggctctcacagtgcctttacctcaagctttagctttattcggctctcgcttggctctgccggggaacgtggagaagcagaaggctgcccaccatccagagaggctgagtcccattgccagagcccccaggagatgggagccaaagctgccagcttggacgggcctcacgaggacccgcgatgtctctctcggcccttcagtctcttggctacacgggtctctgcagacttggcccaggccgcaaggaacagctccaggccagagcgtgacatgcattctttaccagacatggaccctggctcctccagttctctggatccctcactggctggctgtggtggtgatgggagcagcggctcaggggatgcccactcttgggacaccctgctcaggaaatgggagccagtgctgcgggactgcctgctgagaaaccggaggcagatggaggtaatatccttaagattaaaacttcagaaacttcaggaagatgcagttgagaatgatgattatgataaagctgagacgttacaacaaagattagaagacctggaacaagagaaaatcagcctgcactttcaacttccttcaaggcagccagctcttagcagtttcctgggtcacctggcagcacaagtccaggctgccttgcgccgtggggccactcagcaggccagcggagatgacacccacaccccactgagaatggagccgaggctgttggaacccactgctcaggacagcttgcacgtgtccatcacgagacgagactggcttcttcaggaaaagcagcagctacagaaagaaatcgaagctctccaagcaaggatgtttgtgctggaagccaaagatcaacagctgagaagggaaatagaggagcaagagcagcaactccagtggcagggctgcgacctgaccccactggtgggccagctgtccctgggtcagctgcaggaggtcagcaaggccttgcaggacaccctggcctcagccggtcagattcccttccatgcagagccaccggaaaccataaggagcctccaggaaagaataaaatccctcaacttgtcacttaaagaaatcactactaaggtgtgtatgagtgagaaattctgcagcaccctgaggaagaaagttaacgatattgaaacccaactaccagccttgcttgaagccaaaatgcatgccatatcaggaaaccatttctggacggctaaagacctcaccgaggagattagatcattaacatcagagagagaagggctggagggactcctcagcaagctgttggtgttgagttccaggaatgtcaaaaagctgggaagtgttaaagaagattacaacagactgagaagagaagtggagcaccaggagactgcctatggtaggtagtgcacaactgttccccggcaagatattgatgatatttgttgtgttttgtggccaggcagaatgttctgtgccttatgtgaacgtcactgtgaagagcgtcatggagcacatggcccttttccttggggacatttttggcaggtgccttggcaaaccgaatggaattacttgtcagcttttgttttcatattcacatgtgacatcttttctttttctgttccctgtctcaacctgtgtttgctaatagccttgttattatttagagcagtctctcccttggcaaggtcttgagcattttctttgtgtgacaattatcttccttttgtcccttggctccgtctccttgtctgcacaatcatagactaaatcaggctgatctgagaaaattgagggaagaccataaagtggctcttctatgtgtggacttttctgagagcttctttccccaggaaggatgatgtagaagatgtgaatgccgccttagccaaagtgtctgcttgtcagaggagttcaagtgttcctgtgttctttccttttccagtcgttaggagtaactgagcttactctgagatttgcacccagagggatggtctcagaagacgctggttcagtgcaaattgagatggtaaaaacttatttcttaaaaaatggttcctaaataaatgtcatttactaaaacaaatgaaagaaatatatatatgaataaatggctatatttt

SEQ ID NO: 195741 - DNA, 3294 bp, Homo sapiens
  Payload ID: 18625
  Gene Name: TSNAX-DISC1 readthrough (NMD candidate)
  ENST ID: ENST00000602956
  CDS Start-End: 159-725
acgtgagaggagacttccggccactgcgttgtagtcggcccggctgcaaagcgtttttctgcaggctgttttcccaggttccctcggcctgtacctcgcgcactcctcttgctccaggtccttcagtctccgctcgtctcaccgtaggctgtgacgacatgagcaacaaagaaggatcaggagggttcaggaaaaggaagcatgacaatttcccacataaccaaagaagagaagggaaggatgttaattcatcttcacccgtgatgttggcctttaaatcatttcagcaggaacttgatgcaaggcatgacaaatatgagagacttgtgaaacttagtcgggatataactgttgaaagtaaaaggacaatttttctcctccataggattacaagtgctcctgatatggaagatatattgactgaatcagaaattaaattggatggtgtcagacaaaagatattccaggtagcccaagagctatcaggggaagatatgcatcagttccatcgagccattactacaggactacaggaatatgtggaagctgtctcttttcaacacttcatcaaaacacgatcattaattagtatggatgaaattaataaacaattgatatttacgactgaagacaatgggaaagaaaataaaactgcagccgggattgcttaccacctgcagcgtgctttcggaggcggcggctggcacggaggccgggctacatgagaagctcgacagggcctgggatcgggttcctttccccagcagtgggcacactgttccggttcccaggaggggtgtctggcgaggagtcccaccactcggagtccagggccagacagtgtggccttgactcgagaggcctcttggtccggagccctgtttccaagagtgcagcagcccctactgtgacctctgtgagaggaacctcggcgcactttgggattcagctcagaggtggcaccagattgcctgacaggcttagctggccgtgtggccctgggagtgctgggtggcagcaagagtttgcagccatggatagttctgagaccctggacgccagctgggaggcagcctgcagcgatggagcaaggcgtgtccgggcagcaggctctctgccatcagcagagttgagtagcaacagctgcagccctggctgtggccctgaggtccccccaacccctcctggctctcacagtgcctttacctcaagctttagctttattcggctctcgcttggctctgccggggaacgtggagaagcagaaggctgcccaccatccagagaggctgagtcccattgccagagcccccaggagatgggagccaaagctgccagcttggacgggcctcacgaggacccgcgatgtctctctcggcccttcagtctcttggctacacgggtctctgcagacttggcccaggccgcaaggaacagctccaggccagagcgtgacatgcattctttaccagacatggaccctggctcctccagttctctggatccctcactggctggctgtggtggtgatgggagcagcggctcaggggatgcccactcttgggacaccctgctcaggaaatgggagccagtgctgcgggactgcctgctgagaaaccggaggcagatggaggtaatatccttaagattaaaacttcagaaacttcaggaagatgcagttgagaatgatgattatgataaagctgagacgttacaacaaagattagaagacctggaacaagagaaaatcagcctgcactttcaacttccttcaaggcagccagctcttagcagtttcctgggtcacctggcagcacaagtccaggctgccttgcgccgtggggccactcagcaggccagcggagatgacacccacaccccactgagaatggagccgaggctgttggaacccactgctcaggacagcttgcacgtgtccatcacgagacgagactggcttcttcaggaaaagcagcagctacagaaagaaatcgaagctctccaagcaaggatgtttgtgctggaagccaaagatcaacagctgagaagggaaatagaggagcaagagcagcaactccagtggcagggctgcgacctgaccccactggtgggccagctgtccctgggtcagctgcaggaggtcagcaaggccttgcaggacaccctggcctcagccggtcagattcccttccatgcagagccaccggaaaccataaggagcctccaggaaagaataaaatccctcaacttgtcacttaaagaaatcactactaaggtgtgtatgagtgagaaattctgcagcaccctgaggaagaaagttaacgatattgaaacccaactaccagccttgcttgaagccaaaatgcatgccatatcaggaaaccatttctggacggctaaagacctcaccgaggagattagatcattaacatcagagagagaagggctggagggactcctcagcaagctgttggtgttgagttccaggaatgtcaaaaagctgggaagtgttaaagaagattacaacagactgagaagagaagtggagcaccaggagactgcctatggtaggtagtgcacaactgttccccggcaagatattgatgatatttgttgtgttttgtggccaggcagaatgttctgtgccttatgtgaacgtcactgtgaagagcgtcatggagcacatggcccttttccttggggacatttttggcaggtgccttggcaaaccgaatggaattacttgtcagcttttgttttcatattcacatgtgacatcttttctttttctgttccctgtctcaacctgtgtttgctaatagccttgttattatttagagcagtctctcccttggcaaggtcttgagcattttctttgtgtgacaattatcttccttttgtcccttggctccgtctccttgtctgcacaatcatagactaaatcaggctgatctgagaaaattgagggaagaccataaagtggctcttctatgtgtggacttttctgagagcttctttccccaggaaggatgatgtagaagatgtgaatgccgccttagccaaagtgtctgcttgtcagaggagttcaagtgttcctgtgttctttccttttccagtcgttaggagtaactgagcttactctgagatttgcacccagagggatggtctcagaagacgctggttcagtgcaaattgagatggtaaaaacttatttcttaaaaaatggttcctaaataaatgtcatttactaaaacaaatgaaagaaatatatatatgaataaatggctatatttt

SEQ ID NO: 195742 - DNA, 3326 bp, Homo sapiens
  Payload ID: 18626
  Gene Name: TSPY-like 1
  Uniprot ID: Q9H0U9
  ENST ID: ENST00000368608
  CDS Start-End: 74-1387
gcggcggttagctcccagttcggcctctgaggaaaacgggcgttcgcctgcggttggtccgactgttagcaacatgagcggcctggatggggtcaagaggaccactcccctccaaacccacagcatcattatttctgaccaagtcccgagcgaccaggacgcacaccagtacctgaggctccgcgaccaaagcgaggcgacacaggtgatggcggagccgggtgagggaggctcggagaccgtcgcgctcccgcctccaccgccttcagaggaggggggcgtaccccaggatgccgcgggccgtggcggtactccccagatccgagttgttgggggtcgcggtcatgtggcgatcaaagccgggcaggaagagggccagcctcccgccgaaggcctggcagccgcttctgtggtgatggcagccgaccgcagcctgaaaaagggcgttcagggtggagagaaggccctagaaatctgtggcgcccagagatccgcgtctgagctgacggcgggggcggaggctgaggcggaggaggtgaagacaggaaagtgcgccaccgtctcagcagccgtggctgagagggagagcgctgaggtggtgaaggaaggcctggcggagaaggaggtaatggaggagcagatggaggtagaggagcagccgccagaaggtgaagaaatagaagtggcggaggaggatagattggaggaggaggcgagggaggaagaagggccctggcctttgcatgaggctctccgcatggaccctctggaggccatccagctggaactggacactgtgaatgctcaggccgacagggccttccaacagctggagcacaagtttgggcggatgcgtcgacactacctggagcggaggaactacatcattcagaatatcccgggcttctggatgactgcttttcgaaaccacccccagttgtccgccatgattaggggccaagatgcagagatgttaaggtacataaccaatttagaggtgaaggaactcagacaccctagaaccggttgcaagttcaagttcttctttagaagaaacccctacttcagaaacaagctgattgtcaaggaatatgaggtaagatcctccggccgagtggtgtctctttctactccaattatatggcgcagggggcatgaaccccagtccttcattcgcagaaaccaagacctcatctgcagcttcttcacttggttttcagaccacagccttccagagtccgacaaaattgctgagattattaaagaggatctgtggccaaatccactgcaatactacctgttgcgtgaaggagtccgtagagcccgacgtcgcccgctaagggagcctgtagagatccccaggccctttgggttccagtctggttaacatttgcccttgggaatactcctgcacaaggtctcctaccaccttctgctggacctgtgcttgggcatcagcaatgagtatgccttctattgtgctttgtttttgctgacttttctgcaccctgtttcctttggatattcagttctctcaacctcaagattgagacggtggtgggtatgcttctccacttccatatgaccttcatgctgttctggaatatcacatgctacgaggtcatccttcacactacttgtaagccaagcaaatgatactgtagattgtactgcctttatctgcactgcttggaccctgtttattcccagggcctctgaactggttgctgtcacttggatttctagctttgggagcctgttccacctactcagctctgcattgagcagtatgggcacatgccctgtggacagttactggacgttaatgaactcagaggagaaaagcagtgagccacttgttctgtgtgatttatggtacttcattgctcttccttcacctctagtcactttctattgctacctgccctacattggctcctgccaaggtccctctctctccctgttttccttttttttttttttttttttttttttgagacggaggacggagtcttgctctgtcgcccaggttggagtgcagtggcgcgatctcggctcactgcaacctccacctcccgggttcaagcgattctcctgcctcagcctcccgagtagctgggactacaggcgcgcgccgccacgcccggctaatttttatatttttagtagagacggggtttcaccatgctggccaggctggtctcgaaccccgatctcgtgatccgccctccttagcctcccaatcctctcttaaaaaagtgatagctcagaaacatttgtaaaagcaaggtttttatttcattttggctctgtcattttcagaggcaaagaagttggcctgtaaaatagagtgctagagctcttacgcccctccccttcttcccaacttcctacttcctagcccttttatcaactcctagaatagttaaagagagacacatctagatgggatgaaaggtgccctaagcaggagaaactgaacaaaaggctagaggcatgggccaggtaaaaattgggcctagagtgaagactgtgctgtcgttaagagctttcgaggaaggagtacttactccccaatgatgatgaatggaaaaatacttttcagggagaattgaaggggttaaagtgttaaatatgttgcctagacaagggttctttaaagaaagacagcgcaactttgaatgctttcttacttgttttgtgacctaatttatgtggaagattgttatttcattaggatttagtaaaatttttttttctgattctaaacttattgtgaaaattgagctgtacagatattcttttgatttcaattgggaacatttggaagaacaacagtcttacttgcctgtacaatatagagacatatgaatagtcataacagttttcaacttgttcttgtttctgttaaactatattcctagaaacatagtttgaacaacttggtctttgttaggcttgtcaaattgccttcatggaaaaataatctacaaaagtatggtttaattgattgtcttacatgataattttccctggtaacaacttagtaagtgatatatcttttttcctaaattgcttaaatactgtgaaattgctctgacaaattggaagtgtaccattggcatatttgtcttcctttttatgcatgatggtaaaataaaagcatgttgttctgctagatttcttatttttcaccttacccataaatgtaatgcttgaatgaagttgttcatattaattaaaaattatggaatcattaaagtcctttaatccattaaagttcttaatggattaaaatcattaaagttcttaatggattaaaatca

SEQ ID NO: 195743 - DNA, 2815 bp, Homo sapiens
  Payload ID: 18627
  Gene Name: TSPY-like 2
  Uniprot ID: Q9H2G4
  ENST ID: ENST00000375442
  CDS Start-End: 133-2214
agagcgaggtggtgaggagagctggttgcgtgagtctcctcagctctgcttaccggtgcgactagcggcagcgacgcggctaaaagcgaaggggcgagtgcgagtcccctgagctgtacgaacgcggtcgccatggaccgcccagatgaggggcctccggccaagacccgccgcctgagcagctccgagtctccacagcgcgacccgcccccgccgccgccgccgccgccgctcctccgactgccgctgcctccaccccagcagcgcccgaggctccaggaggaaacggaggcggcacaggtgctggccgatatgaggggggtgggactgggccccgcgctgcccccgccgcctccctatgtcattctcgaggagggggggatccgcgcatacttcacgctcggtgctgagtgtcccggctgggattctaccatcgagtcggggtatggggaggcgcccccgcccacggagagcctggaagcactccccactcctgaggcctcgggggggagcctggaaatcgattttcaggttgtacagtcgagcagttttggtggagagggggccctagaaacctgtagcgcagtggggtgggcgccccagaggttagttgacccgaagagcaaggaagaggcgatcatcatagtggaggatgaggatgaggatgagcgggagagtatgaggagcagcaggaggcggcggcggcggcggaggaggaagcagaggaaggtgaagagggaaagcagagagagaaatgccgagaggatggagagcatcctgcaggcactggaggatattcagctggatctggaggcagtgaacatcaaggcaggcaaagccttcctgcgtctcaagcgcaagttcatccagatgcgaagacccttcctggagcgcagagacctcatcatccagcatatcccaggcttctgggtcaaagcattcctcaaccaccccagaatttcaattttgatcaaccgacgtgatgaagacattttccgctacttgaccaatctgcaggtacaggatctcagacatatctccatgggctacaaaatgaagctgtacttccagactaacccctacttcacaaacatggtgattgtcaaggagttccagcgcaaccgctcaggccggctggtgtctcactcaaccccaatccgctggcaccggggccaggaaccccaggcccgtcgtcacgggaaccaggatgcgagccacagctttttcagctggttctcaaaccatagcctcccagaggctgacaggattgctgagattatcaagaatgatctgtgggttaaccctctacgctactacctgagagaaaggggctccaggataaagagaaagaagcaagaaatgaagaaacgtaaaaccaggggcagatgtgaggtggtgatcatggaagacgcccctgactattatgcagtggaagacattttcagcgagatctcagacattgatgagacaattcatgacatcaagatctctgacttcatggagaccaccgactacttcgagaccactgacaatgagataactgacatcaatgagaacatctgcgacagcgagaatcctgaccacaatgaggtccccaacaacgagaccactgataacaacgagagtgctgatgaccacgaaaccactgacaacaatgagagtgcagatgacaacaacgagaatcctgaagacaataacaagaacactgatgacaacgaagagaaccctaacaacaacgagaacacttacggcaacaacttcttcaaaggtggcttctggggcagccatggcaacaaccaggacagcagcgacagtgacaatgaagcagatgaggccagtgatgatgaagataatgatggcaacgaaggtgacaatgagggcagtgatgatgatggcaatgaaggtgacaatgaaggcagcgatgatgacgacagagacattgagtactatgagaaagttattgaagactttgacaaggatcaggctgactacgaggacgtgatagagatcatctcagacgaatcagtggaagaagagggcattgaggaaggcatccagcaagatgaggacatctatgaggaaggaaactatgaggaggaaggaagtgaagatgtctgggaagaaggggaagattcggacgactctgacctagaggatgtgcttcaggtcccaaacggttgggccaatccggggaagagggggaaaaccggataagggttttccccttttggggatcacctctctgtatcccccacccactatcccatttgccctcctcctcagctagggccacgcggccccacattgcacttctggggggtgaccgacttcgtacacgggtttaaagtttatttttatggtttagtcattgcagagttcttattttggggggagggaaagggggctagtccccttcttttggccctccgcccccgcaggcttctgtgtgctgctaactgtatttattgtgatgccttggtcagggcccctctacccacttctcccagtcagttgtggccccagcccctctccctgtgctgtgtggagtggacaccctgacccccgaagcggggagggccgctgtggccttcgtcacagccgcgcagtgcccatggaggcgctgctgccaccttcctctcccaagttctttctccatccctctcctcttcccgccgcgccgctagcccgcctcggtgtctatgcaaggccgcttcgccattgcggtattctttgcggtattcttgtccccgtcccccagaaggctcgcctctccccgtggaccctgttaatcccaataaaattctgagcaagttca

SEQ ID NO: 195744 - DNA, 869 bp, Homo sapiens
  Payload ID: 18627
  Gene Name: TSPY-like 2
  ENST ID: ENST00000579390
  CDS Start-End: 119-869
aggagagctggttgcgtgagtctcctcagctctgcttaccggtgcgactagcggcagcgacgcggctaaaagcgaaggggcgagtgcgagtcccctgagctgtacgaacgcggtcgccatggaccgcccagatgaggggcctccggccaagacccgccgcctgagcagctccgagtctccacagcgcgacccgcccccgccgccgccgccgccgccgctcctccgactgccgctgcctccaccccagcagcgcccgaggctccaggaggaaacggaggcggcacagattatcaagaatgatctgtgggttaaccctctacgctactacctgagagaaaggggctccaggataaagagaaagaagcaagaaatgaagaaacgtaaaaccaggggcagatgtgaggtggtgatcatggaagacgcccctgactattatgcagtggaagacattttcagcgagatctcagacattgatgagacaattcatgacatcaagatctctgacttcatggagaccaccgactacttcgagaccactgacaatgagataactgacatcaatgagaacatctgcgacagcgagaatcctgaccacaatgaggtccccaacaacgagaccactgataacaacgagagtgctgatgaccacgaaaccactgacaacaatgagagtgcagatgacaacaacgagaatcctgaagacaataacaagaacactgatgacaacgaagagaaccctaacaacaacgagaacacttacggcaacaacttcttcaaaggtggcttctggggcagccatggcaacaaccaggacagcagcgacagtgacaatgaagcagatgaggccagtgatgatgaagataatgatg

SEQ ID NO: 195745 - DNA, 966 bp, Homo sapiens
  Payload ID: 18627
  Gene Name: TSPY-like 2
  ENST ID: ENST00000578306
  CDS Start-End: 1-370
ggaagaggcgatcatcatagtggaggatgaggatgaggatgagcgggagagtatgaggagcagcaggaggcggcggcggcggcggaggaggaagcagaggaaggtgaagagggaaagcagagagagaaatgccgagaggatggagagcatcctgcaggcactggaggatattcagctggatctggaggcagtgaacatcaaggcaggcaaagccttcctgcgtctcaagcgcaagttcatccagatgcgaagacccttcctggagcgcagagacctcatcatccagcatatcccaggcttctgggtcaaagcactccactcatcagttcctcaaccaccccagaatttcaattttgatcaaccgacgtgatgaagacattttccgctacttgaccaatctgcaggtacaggatctcagacatatctccatgggctacaaaatgaagctgtacttccagactaacccctacttcacaaacatggtgattgtcaaggagttccagcgcaaccgctcaggccggctggtgtctcactcaaccccaatccgctggcaccggggccaggaaccccaggcccgtcgtcacgggaaccaggatgcgagccacagctttttcagctggttctcaaaccatagcctcccagaggctgacaggattgctgagattatcaagaatgatctgtgggttaaccctctacgctactacctgagagaaaggggctccaggataaagagaaagaagcaagaaatgaagaaacgtaaaaccaggggcagatgtgaggtggtgatcatggaagacgcccctgactattatgcagtggaagacattttcagcgagatctcagacattgatgagacaattcatgacatcaagatctctgacttcatggagaccaccgactacttcgagaccactgacaatgagataactgacatcaatgagaacatctgcgacagcgagaatcctg

SEQ ID NO: 195746 - DNA, 4180 bp, Homo sapiens
  Payload ID: 18628
  Gene Name: TSPY-like 4
  Uniprot ID: Q9UJ04
  ENST ID: ENST00000420283
  CDS Start-End: 133-1377
cctgacatcaccagttgccatggtagcaccgccgagagtaaaggaggggtggtgctagacgtttcgggcagagctcggccgctgcggaggacaaggaactctccctctcccactagtctgacttcttccaaaatgagcggcctggatgggggcaacaagctccctctcgcccaaaccggcggcctggctgctcccgaccatgcctcaggagatccggaccgagaccagtgccaagggctccgtgaagaaaccgaggcgacacaggtgatggcgaacacaggtgggggcagcctggagaccgttgcggaggggggtgcatcccaggatcctgtcgactgtggccccgcgctccgcgtcccagttgccgggagtcgcggcggtgcagcgaccaaagccgggcaggaggatgctccaccttctacgaaaggtctggaagcagcctctgccgccgaggctgctgacagcagccagaaaaatggctgtcagcttggagagccccgtggccctgctgggcagaaggctctagaagcctgtggcgcagggggcttggggtctcagatgataccggggaagaaggccaaggaagtgacgactaaaaaacgcgccatctcggcagcagtggaaaaggagggagaagcaggggcggcgatggaggaaaagaaggtagtgcagaaggaaaaaaaggtggcaggaggggtgaaagaggagacacggcccagggccccgaagatcaataactgcatggactcactggaggccatcgatcaagagttgtcaaacgtaaatgcccaggctgacagggccttccttcagcttgagcgcaagtttggccgcatgcgaaggctccacatgcagcgcagaagtttcattatccagaatatcccaggtttctgggttactgcctttcgaaaccacccccagctgtcacctatgatcagtggccaagatgaagacatgctgaggtacatgatcaatttggaggtggaggagcttaaacaccccagagcaggctgcaaattcaagttcatctttcagggcaacccctacttccgaaatgaggggcttgtcaaggaatatgaacgcagatcctctggccgggtggtgtctctttccactccaatccgctggcaccgaggccaagacccccaggctcatatccacagaaaccgggaagggaacactatccctagtttcttcaactggttttcagaccacagccttctagaattcgacagaattgcagagattatcaaaggagaactgtggcccaatcccctacaatactacctgatgggtgaagggccccgtagaggaattcgaggcccaccaaggcagccagtggagagcgccagatccttcaggttccagtctggctaatctctgtcctgtgagaagcttctgcacaagtttccttaccacctcctcttggacctatgcttggccaacagcatgcagtcttccatctgctttctcttcatactgtggattatcttttcctttggttctaaatcttcagtaatcggttgcaagattgttggcttacctgcctgtgccattcttcctctgggccttcatgcttttctgcattgtgttaacatgtttcaagtgcatggccttctacggcttctatgccaagcgtatgatactatagatatagtgtaccatactgcctttctttgcatggcttggaccctatctgtgaccatgctcttctcccaatttaagtggttctgtaccacaaagaatcttgatacattttcacaaataactgattgggcttcatactttatgctggctgtgtcctgatacccatgtacttatggtaagctatttgggtattaccactgcaagacaaaactgatatcttaacccggccatcaacccaaattggacattccagactaccaccaactggatcccagctgccttcctgggcttgtgccatccaccctactggttatctgatagaacaagctggtggctgatgggtgactgctaggcgtgactgaggtaatagatgaaaagtgttctatgttatcacattggttttcctgtacctttggttactctacgtcatgaccagctgctggtgagtatgaagcctgtgctatagcccacccctactcactctcaccttctggttgaactttgcttaggccaccattgtctgcctcatcaggaactatctgtagacgtagctcccagggagctcacagcaacaccccctaccaccaggatgggcagtaatatgtgacagagcccaaagcaaggctggaacgcagtcccttccagcttagtctttctgactcctagccaacaaaccatccttaatgtgagcaacttctttaggcatttcctcttttccccgcctgcacccactctgaacatgacaaaagttgccagagttggggcattgaggaagagatatttctggaatgtgagacttgttatgcctctgtctctttctctccctcctcctcccctctccctccccctctccctcccatcccttttcttccctttcactctgaagcagttttagcttattaacagaaaacaaaactggcaaagcaggctttttgtttaatttgctctttccctgattgtgttcagagagaaaggttatgattaaatgggctccagatctcttattgcccttattcctccaccccacttcttttagcaaggtctgaaagtttcaaagggagacctataggttaattgtttagttataggcagtgttaaattaggcagattttgacatatttatctttttaccccatccattctaccaaaacctgtgtatttcttgagtttttagtttgagaagctggaaagagagagaagggcctcacagtgatgggttcaggacgggtcaaaggcaaaggcctttgtgatgtgagcaaaggcaaccaaaacttagcctcactccacttttctaaagatggaaattcttttttgggccttggactgcttctagggtagcattttgtaggtcactcttctcctttgtactattttgtttctgccctgatgtcccttgggtctccatcctactgcctggctttcttggccctcatttctcagcttctgcatttccttccctgctcctaacaaatgaagaagcaggctgcagcctgcattgtggaagatctccagcctccttgtaggggataaggggatgtgcagcatctgtgtggattttcacggacaagttccagtaggtgggacagtgatgccgtcaaggcttagttatgatcatgtgtggtgataaagaccatccaccatcacccttttcccctttggttttgaaggccttgccctaagctacctgagggtttaggaggtctgaacacacacagtggagaggttaatctaggttgggaaactgagtaaaagtccagagcaggaatgagcctgctgtggcgtgggtttggaaaggctcacaggaaagaacctgcaggatcaggggtgggaggggaggcccctgaggtgctctccagggaagaggggctggggtttaaatagcatgcttggaggaagattttccttcaatttttcctaagtccttgaattcaccagtagatttttgtaaacaaaatgtaagtcgatgttttctctcaattatcctaggagtgacctttatatgtgtggaagattaatggtatatgctccttatgtcactgtttttgagtaaaatccatttcctttctctgtttcagcctatgacaaaattgatgtttacaggcctgctttttgcttataattgacaacatgtgcaaaaataccaaatttgtgtcctgtgcagtatgaagaattcagtgaatattcattaatgtattagcttgttttgctctctgttcatatatggctctattcttagaaatataatttgaatgtgatctttcaatagtctgaatattttacaaattatagctatgtcttgtgaaaataacctcaaaaagaaaaatacgactctgttgtcttacttgatatttcttgccctagtaatgtacttgacatttatgttcctaagcagtgtaagtaccagtagaatttctctgtcaaactcaatgatcatttagtacttttgtcttctcccatgtgcttgaaggaaaaataaagtgtcactaccgtatttcttgttttcatcaaaaaataaaaataatttaaaaaattc

SEQ ID NO: 195747 - DNA, 4491 bp, Homo sapiens
  Payload ID: 18629
  Gene Name: TSPY-like 5
  Uniprot ID: Q86VY4
  ENST ID: ENST00000322128
  CDS Start-End: 121-1374
acagttgtacgttcgtgacgtcggcggttgccgtggagagacccgctcggtcccgaccgagagctggcgtcaggagccgcagggtcacagcgtgtctttgaagctgcctccgccgccaccatgagcggccgaagtcggggtcgaaagtcctcccgcgccaaaaaccggggcaaaggccgcgccaaagcccgagtccgccctgctccggacgacgccccgcgcgacccggacccttcacagtaccagagtctcggggaagacacccaggcggcacaggtgcaggctggcgcggggtggggtggcctggaagccgctgcgtccgcgcagctcctccggctcggggaggaggccgcctgccggctccccctggactgtggcctcgcgctgcgggcccgagctgcgggggaccacgggcaggccgcggccaggcccggcccggggaaggccgcatctctctcggagcgcctggccgcagacactgtcttcgtgggaacagcgggaaccgtgggaaggccgaaaaatgccccccgcgttggaaaccggcgtggccctgccgggaagaaggccccagaaacctgtagcaccgcggggagggggcctcaggtcatagctggtgggaggcagaagaaaggggcggcaggggagaatacctcggtgtcagctggggaggaaaagaaggaagagagggatgcagggtcggggcccccagcgacggaaggcagcatggatacgctggagaacgtgcagctgaagctggagaacatgaacgcccaggcggacagggcctaccttcggctctccaggaagtttgggcagttgcgactgcagcacttggagcgcaggaaccacctcatccaaaatatcccgggcttctgggggcaagcatttcagaaccatccccagctagcatcctttctgaatagccaagagaaagaggtactgagctacttaaacagcttggaagtggaagagctcggccttgccagattgggctacaaaatcaagttctacttcgatcgcaacccgtatttccaaaataaggtgctcatcaaggaatatgggtgtggtccttctggccaggtggtgtctcgttctactccaatccagtggctcccagggcatgatctccagtccctaagccagggaaacccagaaaacaaccgtagtttctttgggtggttttcaaaccacagctccattgagtctgacaagattgtggagataatcaacgaagaattgtggcccaatcccttgcagttctaccttttgagtgaaggggctcgtgtagagaaaggaaaggaaaaagaaggcaggcaaggtccaggaaagcagccaatggagactactcagcctggggtgagccaatccaactgatcctgcacaagtctccctgctacctcctgctgggctgctcctggttgactacatatttggctctctgccttctcttcatgttggcctctgtgtactatagaccctttggactttagttacaagaatatggcatttatgatcatgttcttttgcctcccatagcctcttgcttttctacgttagtgtcacatgttatgtgatcgcacccggactgttcatatgttaagcacacatactttagatgtgtgctccctgttatctacattgcctggaccttgttcttggctctggcctttcctacttgtctttaacatggacactcatgagtcatcctccaggacgaccagtgcatcctcaagctctgctccttcagggccagtgacttgctgggcttcgtgttcatgctggccatgcatgtcatctatgcaagcgtttccattgccactgcagaatgaagccagtgcacatggtattagtcatcagccagaacttcctgttctgtgggtctggggtcaccagctgagatgtcacctgctttatttctggctttggcctgtggtctgtgatacccatcctgcttgatgttctgcagaatggcacttgactgctgggcatgcatgaagttaagggcaagaaacagtatgccatgtgttctgtaccatcatgtgtctcttcttgcttctgggcccttctactggtgaactttcatcaagatctgcgccatgccgtgtcactatcaagccattaagttttgtctgggttgctgtcagccccagttggcttcctggtcaacaaggacctcaagaactgcctgtggaccgaggccccctaccagtgcatgagacacacacctaccctccccagctttccaggaaccctactggctgccagactgatgggcgggctggtatgtgtggacatgtgttcactgtcattatgctgtggctccaggtgagggtgaggactgggcctatatagaatccagataccattgtcaacttcccttattcccgtctaagatgtgagcagagtgccatagtaggggttctgggaagaggtatttctgatttgtgggcctctgcttgcttgacttcaggtcacttatacttcttattttgcttgcctgccttcatccctcatttcctccctctcattcttctttcctccctccctttcctggtagcctcctttcctccccttctgccttccccttccttctttccttattcttttttattttgtttaaatagtaccacagagaaaacaactgaaaaaccacatttttctacatacagctggggaggtagctgagaacttggcactgcgcacacatactaggttgaaagagagttgaggaaaccagaaggccaagtggatctgctggcaaaccctgaacctgtctcctgcgcttgctctacagttctgaagttgaaaatccttttcatgcctagcatctgcttgagttataaaccccaaggcagccatgtcatagactagtgtttactcttgttttgactttgttttaatgcttcctaagacccaagtgcctcctgctgtttcctcctttgtggtagcctctggccatctggacctcaatccccagctttcccactttcagcagtcctttgctctctttgcttctacctcaaatagccccaggagtgggctttagtctccaatatggagcatctcaagcttctcctgggggatggggattgggatgggcagaatctgttttggatctccgggttatttccagtgggtgtaaaagcagagctgggcctttccctctcttatccctgagggtgggtaagaaggactgtatctacacctgttcttccctaccttctcttttgttagggaggcctcattctaagttcctcaagagagtccttggcttaaagctgtagcaagggtgtgctaggtgggggatttggagcaaaaccgtcgagtaggcatgatactggtatggagtgggcctgcaaaatcagacagaaatggcttgagaagccgcagggggagcatgcctgtctctcagtgatagagtatgggagggacctccctagcttggaaaatgagaattgaaggggttatgaacaaataggatgcctagttgaggatgttcccaaagttttgtccaatcttatcattagtagattttataagccacagagacaaaccagaaacggaataatgttactttggatgctttatttttttgttctaggtgtggctttgtacatgcagaagaatgctatatgctgcacattttgcctttaaagtcttacgactttccccattttagtctaatgggaagatacagatgtgcaagtctgcttttttgttttttgttattatttttttttttttgctctgtgttatggacattttcagacatgcacagaagtggagaggatggtccttggaccccatgtgtccatcacctagctgcatcacttatcagctatggtcaacctggtttcatctgtatctctctcttttcacctgtattgtttattgaaaatccaagacactatgccaatgcaaccgtgactactttgggagattggtagtctcttttgatggtgatagtgatggggtgcactatcataatcacatcaggtctgctttttgcttttaatgttaactaatgaagttccagagatgggccttagaaatgtgttttaagaattaacaaggagtctcaaaaagaaatgagagggatgcttcctttcccttgcatctacaaaacaagagagagactgttctgttgtaaaactctttcaaaaattctgatatggtaaggtacttgagacccttcaccagaatgtcaatctttttttctgtgtaacatggaaacttgtgtgaccattagcattgttatcagcttgtactggtctcataactctggttttggaagaataatttggaaattgttgctgtgttctgtgaaaataacctccccaaaataattagtaactggttgttctacttggtaatttgacaccctgttaataacgcaattatttctgtgttcttaaacagtataaatagttgtaagtttgcatgcatgatggaaaaataaaaacctgtatctctgttatatttctgattttc

SEQ ID NO: 195748 - DNA, 3089 bp, Homo sapiens
  Payload ID: 18630
  Gene Name: TSPY-like 6
  Uniprot ID: Q8N831
  ENST ID: ENST00000317802
  CDS Start-End: 122-1354
gagactgaagagtgggcggcgcaaatgggcgaggtgtttactcgccattttgtgtgaggaacgttgacgctacctacctctggcctggcctctacccactgctgccctggccgctaccaacatgagcctcccggagagtcctcacagccccgctactctcgactatgctctggaagacccgcaccagggccagaggtcccgagaaaagagcaaggcgacagaggtaatggcagatatgtttgatggccgcttggagccaatcgtgttcccaccgccccggcttccagaggagggggtcgcgccccaggatcccgcagatggtggccatactttccacatcttggtcgatgcgggtcgcagtcatggagccatcaaagcggggcaggaagtgactccaccacccgcggagggcctagaagcggcctctgcctcgctgacaactgacggcagcctcaaaaatggctttccgggtgaagagacgcacggcctaggtggggagaaggctctagaaacctgtggggcagggaggtcggagtctgaagtgattgcagaggggaaggccgaggacgtgaagcctgaggagtgtgccatgttctcagccccagtggatgagaagccaggaggcgaagaaatggacgtggcggaagaaaacagagcaatagatgaggtaaacagggaggcagggcctgggcccgggcccgggcccctgaacgtgggtctccacctgaaccccctggagtccatccagctggaactggactccgtgaatgcagaggctgacagggcgctcctgcaggtggagcgcaggtttgggcagattcatgaatactacctggagcagaggaatgacatcattcgcaatatcccgggcttctgggtcactgctttccgccaccacccacagctgtctgccatgattagaggccaagatgccgagatgttaagctacttaaccaatttggaagtgaaggagctcagacaccctaggacaggctgcaagtttaagttcttctttcaaagaaacccttacttcagaaacaagctgattgtaaaggtgtatgaggtcagatccttcggccaagtggtgtctttttccactctaatcatgtggcgccggggccatggaccccagtccttcattcataggaaccgacatgtcatctgcagcttcttcacctggttttcagaccacagccttccagagtccgacaggattgctcagattattaaagaggacctctggtcaaatccactgcagtactacctgttgggtgaagacgcccatagagctagacgtcgcctggtaagggagccagtggagatccccaggccctttgggttccagtgtggttaacctttgcctttggaattactcctgcagaaggttgcctgccaccaccagctggacctgagcttgggcaacagcattaggtatgccctttactttttttgttctgactttcctgtaccctctgtttaaactttccgttctctcaacctgaagattgagaccttggtggctgtgctgctcccctttcacctggtcgtcttgctattctgcattaacatcacatgctcccagccgatgggtcacatccttctaagcgaagcgaatgatgctgtaggttacactgtatttacctttgtttggactcggtttgttcccaggacctctggtctggctcctcctacttggatttctagctgtgtctaagaacctattcagctcaccctgctctgcatctgacagtacaggtgcatggcctgtggacaattgctgggcattaatgaagtcaagggagaacagcagggggcaagttggtctgtgtgaattatgggaccccattacttttcctgagactggtcacctattgctgcctgctactggctattcccaagtactgctacttgggcagctccctgctgagtgaacatatcccagaccattgccagctccactctctggtttctaataaacagggatctccagaacactggtggtggacacagctttcctgtcagcacacaaaagacctgttcctcttccaaaagacctctctttaccaccaccaccctcatcactcagaaaccctactgtttgttagacaggtggttgaggggacatgtcagaccctatcctcatggcaaggttaatatgttggtgttcttgacaagtaccaggctttctcagccacaaccagtggattcattcaaaatctaggtacctttatttgcctcccttcctgaacctaatgaagtgccagagtgagtgtacactttcttttctctcatctctcataaatctcttctgtcttcctttaaaaaaaacaaaagtagtagttcagaaacatccgcagaagcaggctttttagtttcttggctctctttgtcatgtccagaggcaggctgttctgtaaaatagactgccagacctcttattgcccattctcctttcttctcagcccctcacccctctttagcaattcctagagggtttaaaggactacagagctgtatggaatgaaaggtgatttctagttcagagtggatagaagaactaaagagattgtgatgggtgctctaggcagggaaaactgaacaaaaaggcagaaatgattcaggggaaaatcgggcctagaatttacactgggttgactagttatgatgggaagagaagtacttttttttagtatgcacgtagaagaatagaagatggttggagtgttaaatatgttccctagagaagggttctttgaagaaacactgcaattttgggtgttctctttcttgtttgcatatggccttacttatgtggaagattaatactgtgttataatattttctctttctgtttactgggaagattcagctgtacagattttcttttactttcaaatagaaatatttggaataatatcagtctttcttttttgtacattatgtggatatggatattcatggcagttttcagcctgttcttgtttctgttaaaaccgtatctttaacattttaatttgaataacttggtcttatctgatgcggaagactggaaactattgtgttcatgggtaaataaactacaaaatatt

SEQ ID NO: 195749 - DNA, 5188 bp, Homo sapiens
  Payload ID: 18631
  Gene Name: TSR1, 20S rRNA accumulation, homolog (S. cerevisiae)
  Uniprot ID: Q2NL82
  ENST ID: ENST00000301364
  CDS Start-End: 1081-3495
cccgcacagacgtcaggcggcaggcccggccccttcccacagccggaggggggttgcgcacagcgacgggggatcggggcggggagaggccgtgcgcgcctaggggcggcagacccgggcgcgcgccacgggggtcgctgtcatggcaacgcacccgctcccgcatggagggcgcgaagccgcattgtgagcgctggccctggagcccgcggccccgcggctgagagcgagcctcggtcccgctgaagctcccctgacttctgcctgctccctctcccgacgggacggaaagggccggggctcgggcatggggtcccctgcggtccgagcctgcccacggcgaagccggtgcagcctggccccgtgacccctctgaatccccgtccggccgtcgccgtgcagttgtcaagtttctgggaagattagtgggagcgcagccgcccgagcccgacggccggagggtcgcggccagtcccccttgccgggtcgccacgtcccacaaggtccttcccggccgctccgtgggaggcggggcgcaggttggagtaacagggacgggcttgagctggtacggaaccgggcaaggtgagagaagtgtcttccacgcgattcccaagcctcgctagggaatcgagggagaagaaaggttgctcagagtgataaagaacatgccgttgcaaacggaagagcaacgtgcccgaatctaggtgacaggaagggcttaggccttttcggcacgaatggagccttccagtcaacatgcttctacgtgatgcagctttatagcgcaaaaaaatgacaatgcaaggggtacaaacagccctgctagaccaacagcccgagcctcgacagtctacatccggcgccttcaagcccccaaccacacactgcgaagtgggaaaagttcccagcgcggcttggcgaacccgctaacacggcgctctcacgagctgctggaaaagaccttcgcgagagggcgcagggagtcccgctccctggagggcccgcccccttggaggggaccggaagcgcttgtcctggcccggaagcagtgctgactccgtacacgcgcgctgcggcatggcggcccaccgccccggcccgctcaagcagcagaataaagctcataaaggcggacggcatcggggtcggggatctgcacagcgggacggcaagggccgtctggcactgaaaaccctaagcaagaaggtgagaaaagaactcagcagagtcgaccagaggcatcgcgccagccagctccgaaagcagaagaaggaggcggttctggcagagaagagacagctgggtggcaaggatggccctcctcatcaggtactggtggtgcccctgcacagcagaatttccctgccagaggccatgcagctgcttcaagatagggacactggaacagtacacttgaatgaattgggaaacacccagaactttatgctgctgtgcccccgcttgaaacatcggtggtttttcacctcagcaaggccaggggatctgcacgttgtgttagacatggctaaagtagctgataccatcctgttcctccttgatccactagaaggctgggacagcaccggtgattactgtctttcctgcctctttgctcagggccttccgacctatacactagctgtccaggggatttctggcctcccactgaagaaacaaatagataccaggaagaagctaagtaaagcagtggagaagcgctttccgcatgacaaactcctcttgttagacactcaacaggaggcagggatgctgcttaggcagttggctaaccagaagcaacagcatcttgcttttcgagatcggcgggcctacctatttgcccatgctgttgattttgttcctagtgaagagaataacttggtgggcaccttgaaaatttcaggctatgttcgagggcagactctgaatgtcaataggttgctgcatatcgttggatatggtgatttccagatgaaacagatagatgcccccggagaccctttccctttaaatcctagaggaattaaaccccaaaaggacccagacatggcaatggagatttgtgctacggatgctgtagatgatatggaagaaggtcttaaagtcctaatgaaggcagaccctggtagacaggaatccttgcaagcagaggttatcccagatccaatggagggagagcaaacctggcccactgaggaggagctgagcgaggcaaaggatttcttgaaggaaagttctaaggtggtaaagaaggtccccaaaggaacatccagttaccaagctgaatggattttggatggtggcagccaaagtggtggggaaggagatgaatatgaatatgatgatatggaacatgaggattttatggaggaggaatctcaggatgagagtagtgaagaagaggaagaatatgaaactatgactattggggagtctgtgcatgatgatctgtatgataagaaagtagatgaagaagctgaggcaaaaatgttggagaaatataaacaagaaagactggaagagatgtttccagatgaagtggacacgccccgtgatgtggctgctcgaattcgatttcagaaatacagaggccttaagagcttccggacatctccatgggatcctaaggaaaaccttcctcaagattatgctcgaatatttcagtttcagaactttactaacactaggaaaagcatctttaaagaggttgaagaaaaagaggttgaaggagctgaggttggctggtatgtcacacttcatgtctctgaagtccccgtctcagtggtcgagtgcttcaggcaaggaacacccttgattgcattttctttactacctcatgaacagaagatgtcagtattgaatatggtggtgaggcgtgaccctggcaacactgaacctgtgaaagccaaggaagagctcatatttcactgtggattcaggcgcttccgagcctcacctttattctctcagcacactgcagcggacaaacataaattgcagagattcctgactgctgacatggccctggtggcgacagtctatgcgccaatcacttttcctcctgcatctgtgctgcttttcaagcaaaaaagcaatggaatgcacagcctcattgctacaggccatcttatgtcagtagatccagacagaatggtcatcaagagagttgttctgagtggtcatcctttcaaaatttttactaagatggcagtagtacgttacatgttcttcaacagagaggatgtgctgtggtttaaaccagtggaactgagaacgaagtggggccggagaggacatatcaaggaacctttaggtacccatggccacatgaaatgcagctttgatgggaagctaaaatctcaagacacagtactgatgaacctgtataaacgagtcttccccaaatggacttatgatccatatgtaccagaaccagtaccctggctgaaaagtgagatttcttcaacagtgcctcaagggggcatggagtaatggattcaaagagattctgtcttaccggtgccagtcagtactccagggatgggaggcacaagttgtgattgggcaaagtttattttctatgtcagcctgtcagtccactgccccattttgcaagacttttttttagccttgacaaaatgtctcagttaagtataaaagtttttccactacttagtccaaaaaaaactattaaatcttaatgaaatagccactctccattaagaatctgataactaagagttgacaatactaggaaacaaaatgtcttcagtatctaaagacactgaattcccaccatttccttttctgtaaattaaacagaaacagactgataagaagctggcctttcagcctgcttcacccaagttatggaggaggttaagtctacatttccaccactgagcacaatacaaatgttctttacttctggggaaacagtttgaaaatgttgagacagcacagcagccactccaacaccagctgtaggttcaatgagtagtttcatcctctcccacaccagctgggttgcacactgttgatatggaagggagtaggaattagtgaaaggggagtctagttggtttacctataaagttcagatgagaatacgtgtccagtttgaattttcttatcactgtgtacacacgcttcccaaagcttttctttaattctgactctgcttctgtcaagagggttgtcattaatacatctagggtaccctcccatgtcatgaagttacctagtcaggttcccgtgggtcacttgctactcctaagggaagtttcttctgcctaagaagttacaccatgctttgctatttcttttcttgctggagcctcaccttaatttcatcctctgtgacagtgaagatatcatccacaaggtccctgataataggccaggtgttcaagccaatgctggatttgacaccatctgctatggtttctggaggataaagattgggcatcagtttccccttcagcttggactggtagcagtcatctgcatttgagggttcagcagcatataccttcacactaggtttcagagcctgggaagaggaatattaagacatcttaacaacaaaccacaacattgcctgcatgtctaaaagaaaatatgggcctggtgtggtggctcacacctgtaatcccaacactttgggagcccgaggcgggtggatcagctgaggtcaggagttcaagaccagcctggccaacctggtgaaatgcagtgtcaactaaaaataggaaaatcagccaggcgtggtggcagacccctgtaatcccagctactcaagaggctgaggtaggagaatcacttgaacttgggaggggtaggttgcagtgagctgagatcacaccaaaatggggtggggcgcagtggctcacgcctgtaatcccagcactttgggaggccgaggtgggcggatcacgaggtagggagatcaagaccatcctggctaacacggtgaaaccccgtctctactaaaaatacaaaaaaaaaaaacaaaaaaaaactagccaggcatggtggcaggcacctgtagtcccagctactcgggaggcagaggcaggagaatggcgtgaacctgggaggtggagcttgcagtgagccaagatcgtgccactgcactccagcctgggtgacagagtgagactccgtctcaaaaaaaaaaagaaaa

SEQ ID NO: 195750 - DNA, 1290 bp, Homo sapiens
  Payload ID: 18631
  Gene Name: TSR1, 20S rRNA accumulation, homolog (S. cerevisiae)
  ENST ID: ENST00000576112
  CDS Start-End: 31-1137
agtgctgactccgtacacgcgcgctgcggcatggcggcccaccgccccggcccgctcaagcagcagaataaagctcataaaggcggacggcatcggggtcggggatctgcacagcgggacggcaagggccgtctggcactgaaaaccctaagcaagaaggtgagaaaagaactcagcagagtcgaccagaggcatcgcgccagccagctccgaaagcagaagaaggaggcggttctggcagagaagagacagctgggtggcaaggatggccctcctcatcaggtactggtggtgcccctgcacagcagaatttccctgccagaggccatgcagctgcttcaagatagggacactggaacagtacacttgaatgaattgggaaacacccagaactttatgctgctgtgcccccgcttgaaacatcggtggtttttcacctcagcaaggccaggggatctgcacgttgtgttagacatggctaaagtagctgataccatcctgttcctccttgatccactagaaggctgggacagcaccgcactagctgtccaggggatttctggcctcccactgaagaaacaaatagataccaggaagaagctaagtaaagcagtggagaagcgctttccgcatgacaaactcctcttgttagacactcaacaggaggcagggatgctgcttaggcagttggctaaccagaagcaacagcatcttgcttttcgagatcggcgggcctacctatttgcccatgctgttgattttgttcctagtgaagagaataacttggtgggcaccttgaaaatttcaggctatgttcgagggcagactctgaatgtcaataggttgctgcatatcgttggatatggtgatttccagatgaaacagatagatgcccccggagaccctttccctttaaatcctagaggaattaaaccccaaaaggacccagacatggcaatggagatttgtgctacggatgctgtagatgatatggaagaaggtcttaaagtcctaatgaaggcagaccctggtagacaggaatccttgcaagcagaggttatcccagatccaatggagggagagcaaacctggcccactgaggaggagctgagcgaggcaaagggtcagtattggtaaacttgtctgtaattcatctgacctggaattgtggattttctgtagctgttccaagtgagggccctataggatagagtggggtgggggtatagttgaaagtctctcctcaccctcaaatgctgtatgttttcaataaacaaacattatacacag

SEQ ID NO: 195751 - DNA, 387 bp, Homo sapiens
  Payload ID: 18631
  Gene Name: TSR1, 20S rRNA accumulation, homolog (S. cerevisiae)
  ENST ID: ENST00000575049
  CDS Start-End: 1-161
aagaggttgaaggagctgaggttggctggtatgtcacacttcatgtctctgaagtccccgtctcagtggtcgagtgcttcaggcaaggaacacccttgattgcattttctttactacctcatgaacagaagcggacaaacataaattgcagagattcctgactgctgacatggccctggtggcgacagtctatgcgccaatcacttttcctcctgcatctgtgctgcttttcaagcaaaaaagcaatggaatgcacagcctcattgctacaggccatcttatgtcagtagatccagacagaatggtcatcaagagagttgttctgagtggtcatcctttcaaaatttttactaagatggcagtagtacgttacatgttcttcaacag

SEQ ID NO: 195752 - DNA, 794 bp, Homo sapiens
  Payload ID: 18631
  Gene Name: TSR1, 20S rRNA accumulation, homolog (S. cerevisiae)
  ENST ID: ENST00000571806
  CDS Start-End: 231-443
agtctacatccggcgccttcaagcccccaaccacacactgcgaagtgggaaaagttcccagcgcggcttggcgaacccgctaacacggcgctctcacgagctgctggaaaagaccttcgcgagagggcgcagggagtcccgctccctggagggcccgcccccttggaggggaccggaagcgcttgtcctggcccggaagcagtgctgactccgtacacgcgcgctgcggcatggcggcccaccgccccggcccgctcaagcagcagaataaagctcataaaggcggacggcatcggggtcggggatctgcacagcgggacggcaagggttctggcagagaagagacagctgggtggcaaggatggccctcctcatcaggtactggtggtgcccctgcacagcagaatttccctgccagaggccatgcagctgcttcaagatagggacactggaacagtacacttgaatgaattgggaaacacccagaactttatgctgctgtgcccccgcttgaaacatcggtggtttttcacctcagcaaggccaggggatctgcacgttgtgttagacatggctaaagtagctgataccatcctgttcctccttgatccactagaaggctgggacagcaccggtgattactgtctttcctgcctctttgctcagggccttccgacctatacactagctgtccaggggatttctggcctcccactgaagaaacaaatagataccaggaagaagctaagtaaagcagtggagaagcgctttccgcatgacaaactcctcttgtt

SEQ ID NO: 195753 - DNA, 1534 bp, Homo sapiens
  Payload ID: 18632
  Gene Name: TSR2, 20S rRNA accumulation, homolog (S. cerevisiae)
  Uniprot ID: Q969E8
  ENST ID: ENST00000375151
  CDS Start-End: 22-597
cacgtggactggggccggataatggcgggcgctgcagaagatgcgcgagctcttttccgggctggggtctgcgcggccctggaggcctggccggccttgcagatcgctgtggagaatggcttcgggggtgtgcacagccaggagaaggccaagtggctggggggtgcagtggaggattacttcatgcgcaatgctgacttggagctagatgaggtggaagacttccttggagagctgttgaccaacgagtttgatacagttgtggaagacgggagtctgccccaggtgagccagcaactgcagaccatgttccaccacttccagaggggtgatggggctgctctgagggagatggcctcctgcatcactcagagaaaatgcaaggtcacagccactgcacttaagacagctagagagactgatgaggatgaagatgatgtggacagtgtggaagagatggaggtcacagctacgaatgatggggctgctacagatggggtctgcccccagcctgaaccctctgatccagacgctcagactattaaggaagaggatatagtggaagatggctggaccattgtccggagaaaaaaatgagtggggatgattggaaatggctttgggcccttatttgctgttctaagagttgtctgtaggggttttttttttgaggattgcagacctgtggactggttaccccatctccaccctctcccctgttcctctgtctggctccctccagggcaaggaaaacctagggtccttggtcttgggggtggggggaccttttccagcatattcccctgggcctttagttaacatccgagtgacgaagccgggttccccagtacagtgtcttttgggtgcggtcattgtgaggaaggggatgagtgagtgtgggtgtggctggaggaggagctagatgccggtggacagtgggcaggtggatttggggaggagaggatcagcagcagcagcagtactcagtgatagggggctggctgggtcaggaatggtgagatgaacatgcaagtggaagagagaatagttgaaaatgtgaatgaaagtagctctggagcctctcccttaccccaccccacacacacgcaacagctctgtacccctgcccagaacttggaacctcccaggaatgctgccttccttcagcccagcctccagtcctgggttccctcaggaattcgaagaccttggctaggtggtgagcttggaagagctgggctttgttttctgtctcctctaacctctttccttactccttatcccatcccatttgagttcaggggtgaggcttaagatcttaataaataataccttactgcttaatctgtggcttgacctgtgagtagtagccttagaatcagccttctgggagctcagcttcagagtttacaagggagcagtttctgggcccaccctagcagcctggtactttggacaaccaaacagatgaacgaacggagcacagcagtgctatgaaagttactgtaagcctgaaataaactgtatttttctt

SEQ ID NO: 195754 - DNA, 1243 bp, Homo sapiens
  Payload ID: 18633
  Gene Name: TSR3, 20S rRNA accumulation, homolog (S. cerevisiae)
  Uniprot ID: Q9UJK0
  ENST ID: ENST00000007390
  CDS Start-End: 108-1046
ggaccggaagtggcgtccggcgcaagcgctggcagccgcacagcccattgggaggccgaggggcgcggccgtggggtggggagtccccggcaccccaggtccgcgccatgggccgcaggagggcagcgcgcgggccgggggcggaaggcggccgccctcggcacctcccgacgcgctccctggaggccttcgccgaggaggtcggcgccgcgctgcaggcttccgtggagccaggggcggctgacggcgagggcggcccgggcccggcggcgctgccctgcacgctggccatgtgggagttgggccactgcgacccccggcgctgcacgggccgcaagctggcccgcctggggctggtgcgctgcctgcgcctgggccacagattcggcggtctggtgctgagccccgtgggcaagcagtacgcgtcccccgcagacagacagctggtggcgcagtctggggtcgccgtcatcgactgctcctgggccaggctggacgagacaccgtttgggaagatgcgagggagccacttgcgcctgttgccctacctggtggccgccaaccccgtgaactatggccggccctacagactttcctgcgtggaagcgtttgctgccaccttctgcatcgtaggctttccagaccttgctgtcattttgctgcggaagtttaaatggggcaagggcttcttggacctgaaccgccagctcctggacaagtacgcggcctgcggcagcccggaggaggtgctgcaggcggagcaggagttcttggccaatgccaaggagagcccccaggaggaggagatcgatcccttcgatgtggattcagggagagagtttggaaaccccaacaggcctgtggccagcacccggctgccctcggacactgatgacagtgatgcgtctgaggacccagggcctggcgccgagcgcggaggagccagcagcagctgctgtgaagaggagcagacgcagggacggggggctgaggccagggccccggctgaggtttggaaaggaatcaagaaacggcagagagactgagggttgcagacacatatatttttgaggctgggtgacgagaaaatctagagacatgagggacataaatgggcctggcagcctcggctctttgcggctgctggcaggactgagctgtccgggttctccccacacttccagcacagctgtgctctgtgtcctgcctcggcgctctcgcaaatgaagctgcaggccaagaa

SEQ ID NO: 195755 - DNA, 649 bp, Homo sapiens
  Payload ID: 18633
  Gene Name: TSR3, 20S rRNA accumulation, homolog (S. cerevisiae)
  ENST ID: ENST00000566296
  CDS Start-End: 1-329
cgcctggggctggtgcgctgcctgcgcctgggccacagattcggcggtctggtgctgagccccgtgggcaagcagtacgcgtcccccgcagacagacagctggtggcgcagtctggggtcgccgtcatcgactgctcctgggccaggctggacgagacaccgtttgggaagatgcgagggagccacttgcgcctgttgccctacctggtggccgccaaccccgtgaactatggccggccctacagactttcctgcgtggaagcgtttgctgccaccttctgcatcgtaggctttccagaccttgctgtcattttgctgcggaagtttaaatggggcaagggcttcttggacctgaaccgccagctcctggacaagtacgcggcctgcggcagcccggaggaggtgctgcaggcggagcaggagttcttggccaatgccaaggagagcccccaggaggaggagatcggctgccctcggacactgatgacagtgatgcgtctgaggacccagggcctggcgccgagcgcggaggagccagcagcagctgctgtgaagaggagcagacgcagggacggggggctgaggccagggccccggctgaggtttggaaaggaatcaagaaacggcagagagactgagggttgcagac

SEQ ID NO: 195756 - DNA, 438 bp, Homo sapiens
  Payload ID: 18634
  Gene Name: TSSK6 activating co-chaperone
  Uniprot ID: Q96A04
  ENST ID: ENST00000368251
  CDS Start-End: 48-425
tgaggctgtgagcagtaccggagggcaccacacctgttggtgttcagatggagcggcacactagtcatcctaacagaaaagttccagccaaagaggaagctaatgctgtgcctctctgtagagcaaaaccctcccccagctatattaatcttcaagcaagttccccaccagccacttttctgaacatccagacaacaaagctgccctcggttgatcacaagcccaaggaatgcctaggactcctggaatgtatgtatgcaaacctccagcttcagacccagctcgcccaacaacagatggctgttttggaacatttacaggcatctgtgacacaactggctcctgggaggggaagcaataactcttctctcccagccttatctcctaatccattgttaaatcacctgccccaattcagtaaatgaattgtggaacaaa

SEQ ID NO: 195757 - DNA, 491 bp, Homo sapiens
  Payload ID: 18634
  Gene Name: TSSK6 activating co-chaperone
  Uniprot ID: Q96A04
  ENST ID: ENST00000368252
  CDS Start-End: 101-478
agccttagcaacaggtggactagagaggcgggactccagccagcacatgggggaaagacctgccggcttggcgcagggcaccacacctgttggtgttcagatggagcggcacactagtcatcctaacagaaaagttccagccaaagaggaagctaatgctgtgcctctctgtagagcaaaaccctcccccagctatattaatcttcaagcaagttccccaccagccacttttctgaacatccagacaacaaagctgccctcggttgatcacaagcccaaggaatgcctaggactcctggaatgtatgtatgcaaacctccagcttcagacccagctcgcccaacaacagatggctgttttggaacatttacaggcatctgtgacacaactggctcctgggaggggaagcaataactcttctctcccagccttatctcctaatccattgttaaatcacctgccccaattcagtaaatgaattgtggaacaaa

SEQ ID NO: 195758 - DNA, 512 bp, Homo sapiens
  Payload ID: 18634
  Gene Name: TSSK6 activating co-chaperone
  Uniprot ID: Q96A04
  ENST ID: ENST00000368253
  CDS Start-End: 127-504
ggcgcaggcgccaaggctctggcagttggccagcacaccactacgcatgtgtgtcaactctagggttgggtgctggggttgcggctttcggttaacaccgcaggcaccacacctgttggtgttcagatggagcggcacactagtcatcctaacagaaaagttccagccaaagaggaagctaatgctgtgcctctctgtagagcaaaaccctcccccagctatattaatcttcaagcaagttccccaccagccacttttctgaacatccagacaacaaagctgccctcggttgatcacaagcccaaggaatgcctaggactcctggaatgtatgtatgcaaacctccagcttcagacccagctcgcccaacaacagatggctgttttggaacatttacaggcatctgtgacacaactggctcctgggaggggaagcaataactcttctctcccagccttatctcctaatccattgttaaatcacctgccccaattcagtaaatgaattgtgga

SEQ ID NO: 195759 - DNA, 598 bp, Homo sapiens
  Payload ID: 18634
  Gene Name: TSSK6 activating co-chaperone
  Uniprot ID: Q96A04
  ENST ID: ENST00000368254
  CDS Start-End: 208-585
ggcagttggccagcacaccactacgcatgtgtgtcaactctagggttgggtgctggggttgcggctttcggttaacaccgcagattggaacaggctgagatctgctggagacaacttaggaaattatcatagtgaaaatactaacatggattgttgatcatctgatgctatgattctttcccaggcaccacacctgttggtgttcagatggagcggcacactagtcatcctaacagaaaagttccagccaaagaggaagctaatgctgtgcctctctgtagagcaaaaccctcccccagctatattaatcttcaagcaagttccccaccagccacttttctgaacatccagacaacaaagctgccctcggttgatcacaagcccaaggaatgcctaggactcctggaatgtatgtatgcaaacctccagcttcagacccagctcgcccaacaacagatggctgttttggaacatttacaggcatctgtgacacaactggctcctgggaggggaagcaataactcttctctcccagccttatctcctaatccattgttaaatcacctgccccaattcagtaaatgaattgtggaacaaa

SEQ ID NO: 195760 - DNA, 751 bp, Homo sapiens
  Payload ID: 18634
  Gene Name: TSSK6 activating co-chaperone
  Uniprot ID: Q96A04
  ENST ID: ENST00000368255
  CDS Start-End: 361-738
aggaggatcgcttgaacctgggaggcagaggttgcagtgaacagagatcgcgccactgcaacccagcctgggtgacagagcgagactttgtctcaaaatataaaaagaaaaaaaataagggatcttccaaaaggaaaaggtgaccagtcgagaaatctgggaaaacccaactggttagtgggaaagagtacaacgccggggacacggagggaacgattacatctaagatcagtgagattggaacaggctgagatctgctggagacaacttaggaaattatcatagtgaaaatactaacatggattgttgatcatctgatgctatgattctttcccaggcaccacacctgttggtgttcagatggagcggcacactagtcatcctaacagaaaagttccagccaaagaggaagctaatgctgtgcctctctgtagagcaaaaccctcccccagctatattaatcttcaagcaagttccccaccagccacttttctgaacatccagacaacaaagctgccctcggttgatcacaagcccaaggaatgcctaggactcctggaatgtatgtatgcaaacctccagcttcagacccagctcgcccaacaacagatggctgttttggaacatttacaggcatctgtgacacaactggctcctgggaggggaagcaataactcttctctcccagccttatctcctaatccattgttaaatcacctgccccaattcagtaaatgaattgtggaacaaa

SEQ ID NO: 195761 - DNA, 741 bp, Homo sapiens
  Payload ID: 18634
  Gene Name: TSSK6 activating co-chaperone
  ENST ID: ENST00000481479
  CDS Start-End: 362-664
tgcgactcggctcctatcggaccgtgaaggctaagaaaggcttcacagttcccactcttttggtctagccttagcaacaggtggactagagaggcgggactccagccagcacatgggggaaagacctgccggcttggcgcagggtgaagtgggagttgtagtcttaccgggccggactgcgcagcctttttccgggcacactgggagttgtggtttatcgcctctggactaatggctattggaacaggctgagatctgctggagacaacttaggaaattatcatagtgaaaatactaacatggattgttgatcatctgatgctatgattctttcccaggcaccacacctgttggtgttcagatggagcggcacactagtcatcctaacagaaaagttccagccaaagaggaagctaatgctgtgcctctctgtagagcaaaaccctcccccagctatattaatcttcaagcaagttccccaccagccacttttctgaacatccagacaacaaagctgccctcggcccaaggaatgcctaggactcctggaatgtatgtatgcaaacctccagcttcagacccagctcgcccaacaacagatggctgttttggaacatttacaggcatctgtgacacaactggctcctgggaggggaagcaataactcttctctcccagccttatctcctaatccattgttaaatcacctgccccaattcagtaaatgaattgtggaacaaa

SEQ ID NO: 195762 - DNA, 477 bp, Homo sapiens
  Payload ID: 18634
  Gene Name: TSSK6 activating co-chaperone
  ENST ID: ENST00000466306
  CDS Start-End: 101-403
gtcttaccgggccggactgcgcagcctttttccgggcacactgggagttgtggtttatcgcctctggactaatggctgcaccacacctgttggtgttcagatggagcggcacactagtcatcctaacagaaaagttccagccaaagaggaagctaatgctgtgcctctctgtagagcaaaaccctcccccagctatattaatcttcaagcaagttccccaccagccacttttctgaacatccagacaacaaagctgccctcggcccaaggaatgcctaggactcctggaatgtatgtatgcaaacctccagcttcagacccagctcgcccaacaacagatggctgttttggaacatttacaggcatctgtgacacaactggctcctgggaggggaagcaataactcttctctcccagccttatctcctaatccattgttaaatcacctgccccaattcagtaaatgaattgtggaac

SEQ ID NO: 195763 - DNA, 601 bp, Homo sapiens
  Payload ID: 18634
  Gene Name: TSSK6 activating co-chaperone
  ENST ID: ENST00000470342
  CDS Start-End: 224-526
caggcgccaaggctctggcagttggccagcacaccactacgcatgtgtgtcaactctagggttgggtgctggggttgcggctttcggttaacaccgcagattggaacaggctgagatctgctggagacaacttaggaaattatcatagtgaaaatactaacatggattgttgatcatctgatgctatgattctttcccaggcaccacacctgttggtgttcagatggagcggcacactagtcatcctaacagaaaagttccagccaaagaggaagctaatgctgtgcctctctgtagagcaaaaccctcccccagctatattaatcttcaagcaagttccccaccagccacttttctgaacatccagacaacaaagctgccctcggcccaaggaatgcctaggactcctggaatgtatgtatgcaaacctccagcttcagacccagctcgcccaacaacagatggctgttttggaacatttacaggcatctgtgacacaactggctcctgggaggggaagcaataactcttctctcccagccttatctcctaatccattgttaaatcacctgccccaattcagtaaatgaattgtggaaca

SEQ ID NO: 195764 - DNA, 2712 bp, Homo sapiens
  Payload ID: 18635
  Gene Name: tsukushi, small leucine rich proteoglycan
  Uniprot ID: Q8WUA8
  ENST ID: ENST00000333090
  CDS Start-End: 175-1236
cccgcggccggcccgagccgccacccggcgcccggcaggggggagcctggctgcgggcggggaccggggggcgggccgcgccgcgcggagaaaagcgctggccggagggcccgcggccgggccgccggggtgagcgtgccgaggcggctgtggcgcaggcttccagcccccaccatgccgtggcccctgctgctgctgctggccgtgagtggggcccagacaacccggccatgcttccccgggtgccaatgcgaggtggagaccttcggccttttcgacagcttcagcctgactcgggtggattgtagcggcctgggcccccacatcatgccggtgcccatccctctggacacagcccacttggacctgtcctccaaccggctggagatggtgaatgagtcggtgttggcggggccgggctacacgacgttggctggcctggatctcagccacaacctgctcaccagcatctcacccactgccttctcccgccttcgctacctggagtcgcttgacctcagccacaatggcctgacagccctgccagccgagagcttcaccagctcacccctgagcgacgtgaaccttagccacaaccagctccgggaggtctcagtgtctgccttcacgacgcacagtcagggccgggcactacacgtggacctctcccacaacctcattcaccgcctcgtgccccaccccacgagggccggcctgcctgcgcccaccattcagagcctgaacctggcctggaaccggctccatgccgtgcccaacctccgagacttgcccctgcgctacctgagcctggatgggaaccctctagctgtcattggtccgggtgccttcgcggggctgggaggccttacacacctgtctctggccagcctgcagaggctccctgagctggcgcccagtggcttccgtgagctaccgggcctgcaggtcctggacctgtcgggcaaccccaagcttaactgggcaggagctgaggtgttttcaggcctgagctccctgcaggagctggacctttcgggcaccaacctggtgcccctgcctgaggcgctgctcctccacctcccggcactgcagagcgtcagcgtgggccaggatgtgcggtgccggcgcctggtgcgggagggcacctacccccggaggcctggctccagccccaaggtggccctgcactgcgtagacacccgggattctgctgccaggggccccaccatcttgtgacaaatggtgtggcccagggccacataacagactgctgtcctgggctgcctcaggtcccgagtaacttatgttcaatgtgccaacaccagtggggagcccgcaggcctatgtggcagcgtcaccacaggagttgtgggcctaggagaggctttggacctgggagccacacctaggagcaaagtctcacccctttgtctacgttgcttccccaaaccatgagcagagggacttcgatgccaaaccagactcgggtcccctcctgcttcccttccccacttatcccccaagtgccttccctcatgcctgggccggcctgacccgcaatgggcagagggtgggtgggaccccctgctgcagggcagagttcaggtccactgggctgagtgtccccttgggcccatggcccagtcactcaggggcgagtttcttttctaacatagccctttctttgccatgaggccatgaggcccgcttcatccttttctatttccctagaaccttaatggtagaaggaattgcaaagaatcaagtccacccttctcatgtgacagatggggaaactgaggccttgagaaggaaaaaggctaatctaagttcctgcgggcagtggcatgactggagcacagcctcctgcctcccagcccggacccaatgcactttcttgtctcctctaataagccccaccctccccgcctgggctccccttgctgcccttgcctgttccccattagcacaggagtagcagcagcaggacaggcaagagcctcacaagtgggactctgggcctctgaccagctgtgcggcatgggctaagtcactctgcccttcggagcctctggaagcttagggcacattggttccagcctagccagtttctcaccctgggttggggtcccccagcatccagactggaaacctacccattttcccctgagcatcctctagatgctgccccaaggagttgctgcagttctggagcctcatctggctgggatctccaaggggcctcctggattcagtccccactggccctgagcacgacagcccttcttaccctcccaggaatgccgtgaaaggagacaaggtctgcccgacccatgtctatgctctacccccagggtagcatctcagcttccgaaccctgggctgtttccttagtcttcattttataaaagttgttgcctttttaacggagtgtcactttcaaccggcctcccctacccctgctggccggggatggagacatgtcatttgtaaaagcagaaaaaggttgcatttgttcacttttgtaatattgtcctgggcctgtgttggggtgttgggggaagctgggcatcagtggccacatgggcatcaggggctggccccacagagaccccacagggcagtgagctctgtcttcccccacctgcctagcccatcatctatctaaccggtccttgatttaataaacactataaaaagttctttgcttta

SEQ ID NO: 195765 - DNA, 3554 bp, Homo sapiens
  Payload ID: 18635
  Gene Name: tsukushi, small leucine rich proteoglycan
  Uniprot ID: Q8WUA8
  ENST ID: ENST00000527881
  CDS Start-End: 1027-2088
gtacacagaagtcaagaattgaggtttgggaacctctgcctagatttcagaagatgtatggaaacacctggatgcccaggcaaaagtttgctgcaggggtgggaccctcatggagaacctctgctagggcagtgcagaaaggaaatgtggggttggagtagagtccctactggggcaccgcctagtggagctgtgagaagaggggcaccatcctctagaccgcagaatggcagatccactaacagcttgcactgtgcacctggaaaagctgcagacactcaacgccagtccgtgaaagcagccagaaaggaggctgcaccctgcaaagccacgggggtggagctgcccaagactgtgggaacccacctcttgcatcagcatgactcagatatgcgggacatggagtcaaaggagatcattttggaactttaataagatttgactgccctgctggattttgaacttgcctggggcctgtagcccctttgttttggctaatttcttccatgtggaacagctgtatttacccaatgcctgtacccccactgtatctaggaagtaactaacttgcttttgattttacaggctcgtaggtggaagggacttgtctcagatgagacattggactgtggacttttgggttaatactgaaatgagttaagactttgggggactgttgggaaggcatgattggttttgaaatgtgagaacatgagatttgggagggaccaggggtggaatgatatggtttagctgtgcccgcacccaaatctcaacttgaattgtatctcccagtattcccatgtgttgtgggagggacccagtgggaggtaattgaatcatggggccagtctttcccgagctattctcgtgatagtgaataagtctcacaagatctgatgggtttatcaggggcttcagcttttgcttcctcctcattctctcttgccgccgccatgtaagaagtgccttttgccttccaccatgattgttagaccttccacagccacgtggaattcccccaccatgccgtggcccctgctgctgctgctggccgtgagtggggcccagacaacccggccatgcttccccgggtgccaatgcgaggtggagaccttcggccttttcgacagcttcagcctgactcgggtggattgtagcggcctgggcccccacatcatgccggtgcccatccctctggacacagcccacttggacctgtcctccaaccggctggagatggtgaatgagtcggtgttggcggggccgggctacacgacgttggctggcctggatctcagccacaacctgctcaccagcatctcacccactgccttctcccgccttcgctacctggagtcgcttgacctcagccacaatggcctgacagccctgccagccgagagcttcaccagctcacccctgagcgacgtgaaccttagccacaaccagctccgggaggtctcagtgtctgccttcacgacgcacagtcagggccgggcactacacgtggacctctcccacaacctcattcaccgcctcgtgccccaccccacgagggccggcctgcctgcgcccaccattcagagcctgaacctggcctggaaccggctccatgccgtgcccaacctccgagacttgcccctgcgctacctgagcctggatgggaaccctctagctgtcattggtccgggtgccttcgcggggctgggaggccttacacacctgtctctggccagcctgcagaggctccctgagctggcgcccagtggcttccgtgagctaccgggcctgcaggtcctggacctgtcgggcaaccccaagcttaactgggcaggagctgaggtgttttcaggcctgagctccctgcaggagctggacctttcgggcaccaacctggtgcccctgcctgaggcgctgctcctccacctcccggcactgcagagcgtcagcgtgggccaggatgtgcggtgccggcgcctggtgcgggagggcacctacccccggaggcctggctccagccccaaggtggccctgcactgcgtagacacccgggattctgctgccaggggccccaccatcttgtgacaaatggtgtggcccagggccacataacagactgctgtcctgggctgcctcaggtcccgagtaacttatgttcaatgtgccaacaccagtggggagcccgcaggcctatgtggcagcgtcaccacaggagttgtgggcctaggagaggctttggacctgggagccacacctaggagcaaagtctcacccctttgtctacgttgcttccccaaaccatgagcagagggacttcgatgccaaaccagactcgggtcccctcctgcttcccttccccacttatcccccaagtgccttccctcatgcctgggccggcctgacccgcaatgggcagagggtgggtgggaccccctgctgcagggcagagttcaggtccactgggctgagtgtccccttgggcccatggcccagtcactcaggggcgagtttcttttctaacatagccctttctttgccatgaggccatgaggcccgcttcatccttttctatttccctagaaccttaatggtagaaggaattgcaaagaatcaagtccacccttctcatgtgacagatggggaaactgaggccttgagaaggaaaaaggctaatctaagttcctgcgggcagtggcatgactggagcacagcctcctgcctcccagcccggacccaatgcactttcttgtctcctctaataagccccaccctccccgcctgggctccccttgctgcccttgcctgttccccattagcacaggagtagcagcagcaggacaggcaagagcctcacaagtgggactctgggcctctgaccagctgtgcggcatgggctaagtcactctgcccttcggagcctctggaagcttagggcacattggttccagcctagccagtttctcaccctgggttggggtcccccagcatccagactggaaacctacccattttcccctgagcatcctctagatgctgccccaaggagttgctgcagttctggagcctcatctggctgggatctccaaggggcctcctggattcagtccccactggccctgagcacgacagcccttcttaccctcccaggaatgccgtgaaaggagacaaggtctgcccgacccatgtctatgctctacccccagggtagcatctcagcttccgaaccctgggctgtttccttagtcttcattttataaaagttgttgcctttttaacggagtgtcactttcaaccggcctcccctacccctgctggccggggatggagacatgtcatttgtaaaagcagaaaaaggttgcatttgttcacttttgtaatattgtcctgggcctgtgttggggtgttgggggaagctgggcatcagtggccacatgggcatcaggggctggccccacagagaccccacagggcagtgagctctgtcttcccccacctgcctagcccatcatctatctaaccggtccttgatttaataaacactataaaaagtt

SEQ ID NO: 195766 - DNA, 542 bp, Homo sapiens
  Payload ID: 18635
  Gene Name: tsukushi, small leucine rich proteoglycan
  ENST ID: ENST00000525167
  CDS Start-End: 227-542
agaccccggctgggaggaagaggcgagcggtgggtcccaggctccggccctgggctggggagaggaagggacagggcggctggcgttgccctccccgcgcttcttggaaagagtgtgatccagagttgcgtctgtttggtagggagacaggctccgctttgagacccactctccgtttgcagcccgcccccggggtagggggccaaccctcggacccgcccccaccatgccgtggcccctgctgctgctgctggccgtgagtggggcccagacaacccggccatgcttccccgggtgccaatgcgaggtggagaccttcggccttttcgacagcttcagcctgactcgggtggattgtagcggcctgggcccccacatcatgccggtgcccatccctctggacacagcccacttggacctgtcctccaaccggctggagatggtgaatgagtcggtgttggcggggccgggctacacgacgttggctggcctggatctcagccacaacctgctcaccagcatctcacccactgccttctccc

SEQ ID NO: 195767 - DNA, 643 bp, Homo sapiens
  Payload ID: 18635
  Gene Name: tsukushi, small leucine rich proteoglycan
  ENST ID: ENST00000533752
  CDS Start-End: 192-643
aataaggaaagaagcagcaagcagactgggtgtgttaacaagtctgggccactgcaggaggtacattgcccaatttctgcaccccgaggccctccaaagtctaggagaagctcctgggaggtccagggcccaagaccaaagcctctatcaactctcccacctgtgaactgcccctctcccaagcccccaccatgccgtggcccctgctgctgctgctggccgtgagtggggcccagacaacccggccatgcttccccgggtgccaatgcgaggtggagaccttcggccttttcgacagcttcagcctgactcgggtggattgtagcggcctgggcccccacatcatgccggtgcccatccctctggacacagcccacttggacctgtcctccaaccggctggagatggtgaatgagtcggtgttggcggggccgggctacacgacgttggctggcctggatctcagccacaacctgctcaccagcatctcacccactgccttctcccgccttcgctacctggagtcgcttgacctcagccacaatggcctgacagccctgccagccgagagcttcaccagctcacccctgagcgacgtgaaccttagccacaaccagctccgggaggtctcagtgtctgcctt

SEQ ID NO: 195768 - DNA, 2666 bp, Homo sapiens
  Payload ID: 18635
  Gene Name: tsukushi, small leucine rich proteoglycan
  Uniprot ID: Q8WUA8
  ENST ID: ENST00000612930
  CDS Start-End: 130-1191
acattgcccaatttctgcaccccgaggccctccaaagtctaggagaagctcctgggaggtccagggcccaagaccaaagcctctatcaactctcccacctgtgaactgcccctctcccaagcccccaccatgccgtggcccctgctgctgctgctggccgtgagtggggcccagacaacccggccatgcttccccgggtgccaatgcgaggtggagaccttcggccttttcgacagcttcagcctgactcgggtggattgtagcggcctgggcccccacatcatgccggtgcccatccctctggacacagcccacttggacctgtcctccaaccggctggagatggtgaatgagtcggtgttggcggggccgggctacacgacgttggctggcctggatctcagccacaacctgctcaccagcatctcacccactgccttctcccgccttcgctacctggagtcgcttgacctcagccacaatggcctgacagccctgccagccgagagcttcaccagctcacccctgagcgacgtgaaccttagccacaaccagctccgggaggtctcagtgtctgccttcacgacgcacagtcagggccgggcactacacgtggacctctcccacaacctcattcaccgcctcgtgccccaccccacgagggccggcctgcctgcgcccaccattcagagcctgaacctggcctggaaccggctccatgccgtgcccaacctccgagacttgcccctgcgctacctgagcctggatgggaaccctctagctgtcattggtccgggtgccttcgcggggctgggaggccttacacacctgtctctggccagcctgcagaggctccctgagctggcgcccagtggcttccgtgagctaccgggcctgcaggtcctggacctgtcgggcaaccccaagcttaactgggcaggagctgaggtgttttcaggcctgagctccctgcaggagctggacctttcgggcaccaacctggtgcccctgcctgaggcgctgctcctccacctcccggcactgcagagcgtcagcgtgggccaggatgtgcggtgccggcgcctggtgcgggagggcacctacccccggaggcctggctccagccccaaggtggccctgcactgcgtagacacccgggattctgctgccaggggccccaccatcttgtgacaaatggtgtggcccagggccacataacagactgctgtcctgggctgcctcaggtcccgagtaacttatgttcaatgtgccaacaccagtggggagcccgcaggcctatgtggcagcgtcaccacaggagttgtgggcctaggagaggctttggacctgggagccacacctaggagcaaagtctcacccctttgtctacgttgcttccccaaaccatgagcagagggacttcgatgccaaaccagactcgggtcccctcctgcttcccttccccacttatcccccaagtgccttccctcatgcctgggccggcctgacccgcaatgggcagagggtgggtgggaccccctgctgcagggcagagttcaggtccactgggctgagtgtccccttgggcccatggcccagtcactcaggggcgagtttcttttctaacatagccctttctttgccatgaggccatgaggcccgcttcatccttttctatttccctagaaccttaatggtagaaggaattgcaaagaatcaagtccacccttctcatgtgacagatggggaaactgaggccttgagaaggaaaaaggctaatctaagttcctgcgggcagtggcatgactggagcacagcctcctgcctcccagcccggacccaatgcactttcttgtctcctctaataagccccaccctccccgcctgggctccccttgctgcccttgcctgttccccattagcacaggagtagcagcagcaggacaggcaagagcctcacaagtgggactctgggcctctgaccagctgtgcggcatgggctaagtcactctgcccttcggagcctctggaagcttagggcacattggttccagcctagccagtttctcaccctgggttggggtcccccagcatccagactggaaacctacccattttcccctgagcatcctctagatgctgccccaaggagttgctgcagttctggagcctcatctggctgggatctccaaggggcctcctggattcagtccccactggccctgagcacgacagcccttcttaccctcccaggaatgccgtgaaaggagacaaggtctgcccgacccatgtctatgctctacccccagggtagcatctcagcttccgaaccctgggctgtttccttagtcttcattttataaaagttgttgcctttttaacggagtgtcactttcaaccggcctcccctacccctgctggccggggatggagacatgtcatttgtaaaagcagaaaaaggttgcatttgttcacttttgtaatattgtcctgggcctgtgttggggtgttgggggaagctgggcatcagtggccacatgggcatcaggggctggccccacagagaccccacagggcagtgagctctgtcttcccccacctgcctagcccatcatctatctaaccggtccttgatttaataaacactataaaaagttctttgcttt

SEQ ID NO: 195769 - DNA, 3477 bp, Homo sapiens
  Payload ID: 18636
  Gene Name: TTK protein kinase
  Uniprot ID: P33981
  ENST ID: ENST00000230510
  CDS Start-End: 582-3152
aaaaagcactgaaattcttgagctggcggcagggctgaacgtagctcagtgaaagatcctttcttgccacatcctctctaagccaggctgtgagaaccgcgggaaacgaaggagaagggtggcggtggggtcagtaaagggccggcccaaggtgcatcttttaggtcctgatgctaggagcagccgtccctgcccctatattcctctcactgggtaggtttgctcgggagtggctacctcccaggcaaaaattcggcctggttaaactggaaagaccaggaaagcccgcccacgggcgtccggggaacgcctgcaaagtgccagcaccctaccaacccaggcgccgcacgggtggggtcgcggccgcaggctcttccggggcgggcctagcctgacgcaggaggaggggcggcccccgtcgcacaagaaccaatcacgactgtcgcttctacgtggctagcattgaccaataggagaccgtagtgatagcgacggggaaattcaaacgtgtttgcggaaaggagtttgggttccatcttttcatttccccagcgcagctttctgtagtttttttcttagaaatggaatccgaggatttaagtggcagagaattgacaattgattccataatgaacaaagtgagagacattaaaaataagtttaaaaatgaagaccttactgatgaactaagcttgaataaaatttctgctgatactacagataactcgggaactgttaaccaaattatgatgatggcaaacaacccagaggactggttgagtttgttgctcaaactagagaaaaacagtgttccgctaagtgatgctcttttaaataaattgattggtcgttacagtcaagcaattgaagcgcttcccccagataaatatggccaaaatgagagttttgctagaattcaagtgagatttgctgaattaaaagctattcaagagccagatgatgcacgtgactactttcaaatggccagagcaaactgcaagaaatttgcttttgttcatatatcttttgcacaatttgaactgtcacaaggtaatgtcaaaaaaagtaaacaacttcttcaaaaagctgtagaacgtggagcagtaccactagaaatgctggaaattgccctgcggaatttaaacctccaaaaaaagcagctgctttcagaggaggaaaagaagaatttatcagcatctacggtattaactgcccaagaatcattttccggttcacttgggcatttacagaataggaacaacagttgtgattccagaggacagactactaaagccaggtttttatatggagagaacatgccaccacaagatgcagaaataggttaccggaattcattgagacaaactaacaaaactaaacagtcatgcccatttggaagagtcccagttaaccttctaaatagcccagattgtgatgtgaagacagatgattcagttgtaccttgttttatgaaaagacaaacctctagatcagaatgccgagatttggttgtgcctggatctaaaccaagtggaaatgattcctgtgaattaagaaatttaaagtctgttcaaaatagtcatttcaaggaacctctggtgtcagatgaaaagagttctgaacttattattactgattcaataaccctgaagaataaaacggaatcaagtcttctagctaaattagaagaaactaaagagtatcaagaaccagaggttccagagagtaaccagaaacagtggcaatctaagagaaagtcagagtgtattaaccagaatcctgctgcatcttcaaatcactggcagattccggagttagcccgaaaagttaatacagagaaacataccacttttgagcaacctgtcttttcagtttcaaaacagtcaccaccaatatcaacatctaaatggtttgacccaaaatctatttgtaagacaccaagcagcaataccttggatgattacatgagctgttttagaactccagttgtaaagaatgactttccacctgcttgtcagttgtcaacaccttatggccaacctgcctgtttccagcagcaacagcatcaaatacttgccactccacttcaaaatttacaggttttagcatcttcttcagcaaatgaatgcatttcggttaaaggaagaatttattccatattaaagcagataggaagtggaggttcaagcaaggtatttcaggtgttaaatgaaaagaaacagatatatgctataaaatatgtgaacttagaagaagcagataaccaaactcttgatagttaccggaacgaaatagcttatttgaataaactacaacaacacagtgataagatcatccgactttatgattatgaaatcacggaccagtacatctacatggtaatggagtgtggaaatattgatcttaatagttggcttaaaaagaaaaaatccattgatccatgggaacgcaagagttactggaaaaatatgttagaggcagttcacacaatccatcaacatggcattgttcacagtgatcttaaaccagctaactttctgatagttgatggaatgctaaagctaattgattttgggattgcaaaccaaatgcaaccagatacaacaagtgttgttaaagattctcaggttggcacagttaattatatgccaccagaagcaatcaaagatatgtcttcctccagagagaatgggaaatctaagtcaaagataagccccaaaagtgatgtttggtccttaggatgtattttgtactatatgacttacgggaaaacaccatttcagcagataattaatcagatttctaaattacatgccataattgatcctaatcatgaaattgaatttcccgatattccagagaaagatcttcaagatgtgttaaagtgttgtttaaaaagggacccaaaacagaggatatccattcctgagctcctggctcatccatatgttcaaattcaaactcatccagttaaccaaatggccaagggaaccactgaagaaatgaaatatgttctgggccaacttgttggtctgaattctcctaactccattttgaaagctgctaaaactttatatgaacactatagtggtggtgaaagtcataattcttcatcctccaagacttttgaaaaaaaaaggggaaaaaaatgatttgcagttattcgtaatgtcagataccacctataaaatatattggactgttatactcttgaatccctgtggaaatctacatttgaagacaacatcactctgaagtgttatcagcaaaaaaaattcagtagattatctttaaaagaaaactgtaaaaatagcaaccacttatggcactgtatatattgtagacttgttttctctgttttatgctcttgtgtaatctacttgacatcattttactcttggaatagtgggtggatagcaagtatattctaaaaaactttgtaaataaagttttgtggctaaaatgacactaacattt

SEQ ID NO: 195770 - DNA, 3010 bp, Homo sapiens
  Payload ID: 18636
  Gene Name: TTK protein kinase
  Uniprot ID: P33981
  ENST ID: ENST00000369798
  CDS Start-End: 112-2685
agcattgaccaataggagaccgtagtgatagcgacggggaaattcaaacgtgtttgcggaaaggagtttgggttccatcttttcatttccccagcgcagctttctgtagaaatggaatccgaggatttaagtggcagagaattgacaattgattccataatgaacaaagtgagagacattaaaaataagtttaaaaatgaagaccttactgatgaactaagcttgaataaaatttctgctgatactacagataactcgggaactgttaaccaaattatgatgatggcaaacaacccagaggactggttgagtttgttgctcaaactagagaaaaacagtgttccgctaagtgatgctcttttaaataaattgattggtcgttacagtcaagcaattgaagcgcttcccccagataaatatggccaaaatgagagttttgctagaattcaagtgagatttgctgaattaaaagctattcaagagccagatgatgcacgtgactactttcaaatggccagagcaaactgcaagaaatttgcttttgttcatatatcttttgcacaatttgaactgtcacaaggtaatgtcaaaaaaagtaaacaacttcttcaaaaagctgtagaacgtggagcagtaccactagaaatgctggaaattgccctgcggaatttaaacctccaaaaaaagcagctgctttcagaggaggaaaagaagaatttatcagcatctacggtattaactgcccaagaatcattttccggttcacttgggcatttacagaataggaacaacagttgtgattccagaggacagactactaaagccaggtttttatatggagagaacatgccaccacaagatgcagaaataggttaccggaattcattgagacaaactaacaaaactaaacagtcatgcccatttggaagagtcccagttaaccttctaaatagcccagattgtgatgtgaagacagatgattcagttgtaccttgttttatgaaaagacaaacctctagatcagaatgccgagatttggttgtgcctggatctaaaccaagtggaaatgattcctgtgaattaagaaatttaaagtctgttcaaaatagtcatttcaaggaacctctggtgtcagatgaaaagagttctgaacttattattactgattcaataaccctgaagaataaaacggaatcaagtcttctagctaaattagaagaaactaaagagtatcaagaaccagaggttccagagagtaaccagaaacagtggcaatctaagagaaagtcagagtgtattaaccagaatcctgctgcatcttcaaatcactggcagattccggagttagcccgaaaagttaatacagagcagaaacataccacttttgagcaacctgtcttttcagtttcaaaacagtcaccaccaatatcaacatctaaatggtttgacccaaaatctatttgtaagacaccaagcagcaataccttggatgattacatgagctgttttagaactccagttgtaaagaatgactttccacctgcttgtcagttgtcaacaccttatggccaacctgcctgtttccagcagcaacagcatcaaatacttgccactccacttcaaaatttacaggttttagcatcttcttcagcaaatgaatgcatttcggttaaaggaagaatttattccatattaaagcagataggaagtggaggttcaagcaaggtatttcaggtgttaaatgaaaagaaacagatatatgctataaaatatgtgaacttagaagaagcagataaccaaactcttgatagttaccggaacgaaatagcttatttgaataaactacaacaacacagtgataagatcatccgactttatgattatgaaatcacggaccagtacatctacatggtaatggagtgtggaaatattgatcttaatagttggcttaaaaagaaaaaatccattgatccatgggaacgcaagagttactggaaaaatatgttagaggcagttcacacaatccatcaacatggcattgttcacagtgatcttaaaccagctaactttctgatagttgatggaatgctaaagctaattgattttgggattgcaaaccaaatgcaaccagatacaacaagtgttgttaaagattctcaggttggcacagttaattatatgccaccagaagcaatcaaagatatgtcttcctccagagagaatgggaaatctaagtcaaagataagccccaaaagtgatgtttggtccttaggatgtattttgtactatatgacttacgggaaaacaccatttcagcagataattaatcagatttctaaattacatgccataattgatcctaatcatgaaattgaatttcccgatattccagagaaagatcttcaagatgtgttaaagtgttgtttaaaaagggacccaaaacagaggatatccattcctgagctcctggctcatccatatgttcaaattcaaactcatccagttaaccaaatggccaagggaaccactgaagaaatgaaatatgttctgggccaacttgttggtctgaattctcctaactccattttgaaagctgctaaaactttatatgaacactatagtggtggtgaaagtcataattcttcatcctccaagacttttgaaaaaaaaaggggaaaaaaatgatttgcagttattcgtaatgtcagataccacctataaaatatattggactgttatactcttgaatccctgtggaaatctacatttgaagacaacatcactctgaagtgttatcagcaaaaaaaattcagtagattatctttaaaagaaaactgtaaaaatagcaaccacttatggcactgtatatattgtagacttgttttctctgttttatgctcttgtgtaatctacttgacatcattttactcttggaatagtgggtggatagcaagtatattctaaaaaactttgtaaataaagttttgtggctaaaatgacactaacattt

SEQ ID NO: 195771 - DNA, 530 bp, Homo sapiens
  Payload ID: 18636
  Gene Name: TTK protein kinase
  ENST ID: ENST00000509313
  CDS Start-End: 67-306
aaacgtgtttgcggaaaggagtttgggttccatcttttcatttccccagcgcagctttctgtagaaatggaatccgaggatttaagtggcagagaattgacaattgattccataatgaacaaagtgagagacattaaaaataagtttaaaaatgaagaccttactgatgaactaagcttgaataaaatttctgctgatactacagaatgcaggctacatgatggcagggtttttgtctgttatatccacagaactttgaatggtgtctggcacatgataactcgggaactgttaaccaaattatgatgatggcaaacaacccagaggactggttgagtttgttgctcaaactagagaaaaacagtgttccgctaagtgatgctcttttaaataaattgattggtcgttacagtcaagcaattgaagcgcttcccccagataaatatggccaaaatgagagttttgctagaattcaagtgagatttgctgaattaaaagctattcaagagccagatgatgcacgtgactac

SEQ ID NO: 195772 - DNA, 549 bp, Homo sapiens
  Payload ID: 18636
  Gene Name: TTK protein kinase
  ENST ID: ENST00000511260
  CDS Start-End: 98-549
atgcgacgcggctaaacgagctggagggggaggggatgtctcactgcctcagcgggtctggccggtggggtgatgcaggaggttttgttgaggaaaaatggaatccgaggatttaagtggcagagaattgacaattgattccataatgaacaaagtgagagacattaaaaataagtttaaaaatgaagaccttactgatgaactaagcttgaataaaatttctgctgatactacagataactcgggaactgttaaccaaattatgatgatggcaaacaacccagaggactggttgagtttgttgctcaaactagagaaaaacagtgttccgctaagtgatgctcttttaaataaattgattggtcgttacagtcaagcaattgaagcgcttcccccagataaatatggccaaaatgagagttttgctagaattcaagtgagatttgctgaattaaaagctattcaagagccagatgatgcacgtgactactttcaaatggccagagcaaactgcaagaaatttgcttttgttcatatatcttttgcaca

SEQ ID NO: 195773 - DNA, 3725 bp, Homo sapiens
  Payload ID: 18636
  Gene Name: TTK protein kinase
  Uniprot ID: P33981
  ENST ID: ENST00000509894
  CDS Start-End: 830-3400
accacaaagccacttagcggcagagcctcgcacccgcgaagattattactagggagatgtttttacccctgaggacacctgagcccttaagtggggcaggcttcgagggaggggggccgataaggcgacttcagacagggcaatcacgatgggcgcttgagttctgcgcagaattttgacaagggggagggtcttggcttgaagacagagcgtggagtcatttaaggataatggaagggcataagcagaagctcaaggataaaaagcactgaaattcttgagctggcggcagggctgaacgtagctcagtgaaagatcctttcttgccacatcctctctaagccaggctgtgagaaccgcgggaaacgaaggagaagggtggcggtggggtcagtaaagggccggcccaaggtgcatcttttaggtcctgatgctaggagcagccgtccctgcccctatattcctctcactgggtaggtttgctcgggagtggctacctcccaggcaaaaattcggcctggttaaactggaaagaccaggaaagcccgcccacgggcgtccggggaacgcctgcaaagtgccagcaccctaccaacccaggcgccgcacgggtggggtcgcggccgcaggctcttccggggcgggcctagcctgacgcaggaggaggggcggcccccgtcgcacaagaaccaatcacgactgtcgcttctacgtggctagcattgaccaataggagaccgtagtgatagcgacggggaaattcaaacgtgtttgcggaaaggagtttgggttccatcttttcatttccccagcgcagctttctgtagaaatggaatccgaggatttaagtggcagagaattgacaattgattccataatgaacaaagtgagagacattaaaaataagtttaaaaatgaagaccttactgatgaactaagcttgaataaaatttctgctgatactacagataactcgggaactgttaaccaaattatgatgatggcaaacaacccagaggactggttgagtttgttgctcaaactagagaaaaacagtgttccgctaagtgatgctcttttaaataaattgattggtcgttacagtcaagcaattgaagcgcttcccccagataaatatggccaaaatgagagttttgctagaattcaagtgagatttgctgaattaaaagctattcaagagccagatgatgcacgtgactactttcaaatggccagagcaaactgcaagaaatttgcttttgttcatatatcttttgcacaatttgaactgtcacaaggtaatgtcaaaaaaagtaaacaacttcttcaaaaagctgtagaacgtggagcagtaccactagaaatgctggaaattgccctgcggaatttaaacctccaaaaaaagcagctgctttcagaggaggaaaagaagaatttatcagcatctacggtattaactgcccaagaatcattttccggttcacttgggcatttacagaataggaacaacagttgtgattccagaggacagactactaaagccaggtttttatatggagagaacatgccaccacaagatgcagaaataggttaccggaattcattgagacaaactaacaaaactaaacagtcatgcccatttggaagagtcccagttaaccttctaaatagcccagattgtgatgtgaagacagatgattcagttgtaccttgttttatgaaaagacaaacctctagatcagaatgccgagatttggttgtgcctggatctaaaccaagtggaaatgattcctgtgaattaagaaatttaaagtctgttcaaaatagtcatttcaaggaacctctggtgtcagatgaaaagagttctgaacttattattactgattcaataaccctgaagaataaaacggaatcaagtcttctagctaaattagaagaaactaaagagtatcaagaaccagaggttccagagagtaaccagaaacagtggcaatctaagagaaagtcagagtgtattaaccagaatcctgctgcatcttcaaatcactggcagattccggagttagcccgaaaagttaatacagagaaacataccacttttgagcaacctgtcttttcagtttcaaaacagtcaccaccaatatcaacatctaaatggtttgacccaaaatctatttgtaagacaccaagcagcaataccttggatgattacatgagctgttttagaactccagttgtaaagaatgactttccacctgcttgtcagttgtcaacaccttatggccaacctgcctgtttccagcagcaacagcatcaaatacttgccactccacttcaaaatttacaggttttagcatcttcttcagcaaatgaatgcatttcggttaaaggaagaatttattccatattaaagcagataggaagtggaggttcaagcaaggtatttcaggtgttaaatgaaaagaaacagatatatgctataaaatatgtgaacttagaagaagcagataaccaaactcttgatagttaccggaacgaaatagcttatttgaataaactacaacaacacagtgataagatcatccgactttatgattatgaaatcacggaccagtacatctacatggtaatggagtgtggaaatattgatcttaatagttggcttaaaaagaaaaaatccattgatccatgggaacgcaagagttactggaaaaatatgttagaggcagttcacacaatccatcaacatggcattgttcacagtgatcttaaaccagctaactttctgatagttgatggaatgctaaagctaattgattttgggattgcaaaccaaatgcaaccagatacaacaagtgttgttaaagattctcaggttggcacagttaattatatgccaccagaagcaatcaaagatatgtcttcctccagagagaatgggaaatctaagtcaaagataagccccaaaagtgatgtttggtccttaggatgtattttgtactatatgacttacgggaaaacaccatttcagcagataattaatcagatttctaaattacatgccataattgatcctaatcatgaaattgaatttcccgatattccagagaaagatcttcaagatgtgttaaagtgttgtttaaaaagggacccaaaacagaggatatccattcctgagctcctggctcatccatatgttcaaattcaaactcatccagttaaccaaatggccaagggaaccactgaagaaatgaaatatgttctgggccaacttgttggtctgaattctcctaactccattttgaaagctgctaaaactttatatgaacactatagtggtggtgaaagtcataattcttcatcctccaagacttttgaaaaaaaaaggggaaaaaaatgatttgcagttattcgtaatgtcagataccacctataaaatatattggactgttatactcttgaatccctgtggaaatctacatttgaagacaacatcactctgaagtgttatcagcaaaaaaaattcagtagattatctttaaaagaaaactgtaaaaatagcaaccacttatggcactgtatatattgtagacttgttttctctgttttatgctcttgtgtaatctacttgacatcattttactcttggaatagtgggtggatagcaagtatattctaaaaaactttgtaaataaagttttgtggctaaaatgacactaacattt

SEQ ID NO: 195774 - DNA, 541 bp, Homo sapiens
  Payload ID: 18636
  Gene Name: TTK protein kinase
  ENST ID: ENST00000502580
  CDS Start-End: 125-541
gtaggtaagttctgtcttaccggtgcaccggcgcactgaggaacagccgcagccggtgtaggggctcattgttagcgctggtcggtgaggggtggggcgaggtgggggcagctcggagccagaaatggaatccgaggatttaagtggcagagaattgacaattgattccataatgaacaaagtgagagacattaaaaataagtttaaaaatgaagaccttactgatgaactaagcttgaataaaatttctgctgatactacagataactcgggaactgttaaccaaattatgatgatggcaaacaacccagaggactggttgagtttgttgctcaaactagagaaaaacagtgttccgctaagtgatgctcttttaaataaattgattggtcgttacagtcaagcaattgaagcgcttcccccagataaatatggccaaaatgagagttttgctagaattcaagtgagatttgctgaattaaaagctattcaagagccagatgatgcacgtgactactttcaaatggccagagcaaactgc

SEQ ID NO: 195775 - DNA, 569 bp, Homo sapiens
  Payload ID: 18636
  Gene Name: TTK protein kinase
  ENST ID: ENST00000504040
  CDS Start-End: 43-569
agttaaagtaggagttatgactgttcagtttttttcttagaaatggaatccgaggatttaagtggcagagaattgacaattgattccataatgaacaaagtgagagacattaaaaataagtttaaaaatgaagaccttactgatgaactaagcttgaataaaatttctgctgatactacagataactcgggaactgttaaccaaattatgatgatggcaaacaacccagaggactggttgagtttgttgctcaaactagagaaaaacagtgttccgctaagtgatgctcttttaaataaattgattggtcgttacagtcaagcaattgaagcgcttcccccagataaatatggccaaaatgagagttttgctagaattcaagtgagatttgctgaattaaaagctattcaagagccagatgatgcacgtgactactttcaaatggccagagcaaactgcaagaaatttgcttttgttcatatatcttttgcacaatttgaactgtcacaaggtaatgtcaaaaaaagtaaacaacttcttcaaaaagctgtagaacgtggagcagtacc

SEQ ID NO: 195776 - DNA, 240 bp, Homo sapiens
  Payload ID: 18636
  Gene Name: TTK protein kinase
  ENST ID: ENST00000627129
  CDS Start-End: 1-240
atggaatccgaggatttaagtggcagagaattgacaattgattccataatgaacaaagtgagagacattaaaaataagtttaaaaatgaagaccttactgatgaactaagcttgaataaaatttctgctgatactacagaatgcaggctacatgatggcagggtttttgtctgttatatccacagaactttgaatggtgtctggcacatgataactcgggaactgttaaccaaattatga

SEQ ID NO: 195777 - DNA, 2071 bp, Homo sapiens
  Payload ID: 18637
  Gene Name: Tu translation elongation factor, mitochondrial
  Uniprot ID: P49411
  ENST ID: ENST00000313511
  CDS Start-End: 140-1507
agacactggcggctagaggggcccggacttgccctcccagctctaacttccgccggaagtgccttccagccgcaggcgcccttcttcttctgtgcgctcgggctcctggtcccggctccccggttaccggggcgcgagtatgaccacaatggcggccgccaccctgctgcgcgcgacgccccacttcagcggtctcgccgccggccggaccttcctgctgcagggtctgttgcggctgctgaaagccccggcattgcctctcttgtgccgcggcctggccgtggaggccaagaagacttacgtgcgcgacaagccacatgtgaatgtgggtaccatcggccatgtggaccacgggaagaccacgctgactgcagccatcacgaagattctagctgagggaggtggggctaagttcaagaagtacgaggagattgacaatgccccggaggagcgagctcggggtatcaccatcaatgcggctcatgtggagtatagcactgccgcccgccactacgcccacacagactgcccgggtcatgcagattatgttaagaatatgatcacaggcactgcacccctcgacggctgcatcctggtggtagcagccaatgacggccccatgccccagacccgagagcacttattactggccagacagattggggtggagcatgtggtggtgtatgtgaacaaggctgacgctgtccaggactctgagatggtggaactggtggaactggagatccgggagctgctcaccgagtttggctataaaggggaggagaccccagtcatcgtaggctctgctctctgtgcccttgagggtcgggaccctgagttaggcctgaagtctgtgcagaagctactggatgctgtggacacttacatcccagtgcccgcccgggacctggagaagcctttcctgctgcctgtggaggcggtgtactccgtccctggccgtggcaccgtggtgacaggtacactagagcgtggcattttaaagaagggagacgagtgtgagctcctaggacatagcaagaacatccgcactgtggtgacaggcattgagatgttccacaagagcctggagagggccgaggccggagataacctcggggccctggtccgaggcttgaagcgggaggacttgcggcggggcctggtcatggtcaagccaggttccatcaagccccaccagaaggtggaggcccaggtttacatcctcagcaaggaggaaggtggccgccacaagccctttgtgtcccacttcatgcctgtcatgttctccctgacttgggacatggcctgtcggattatcctgcccccagagaaggagcttgccatgcccggggaggacctgaagttcaacctaatcttgcggcagccaatgatcttagagaaaggccagcgtttcaccctgcgagatggcaaccggactattggcaccggtctagtcaccaacacgctggccatgactgaggaggagaagaatatcaaatggggttgagtgtgcagatctctgctcagcttcccttgcgtttaaggcctgccctagccagggctccctcctgcttccagtaccctctcatggcataggctgcaacccagcagagggcagctagatggacatttcccctgctcggaagggttggcctgcctggctggggaggtcagtaaactttgaatagtaagccagcctgtgtcctgtgtcctttgtgcaaattggagaggataggggaggacaaaaagggtgttgaaccccagacagatggggagcttgtgagatcccagagcagttttaacggataaatcaagtccagtgagcttagtgattgcctagacacagtaggatgccgttattcagcctcctgggagatagtgggaaagaatgttctatcgctctggagccagcatggcttcagctcaggtgccaaacccatcttgtttcctcggaatactaagtgaatgtctagcatccattcacattctgtgggaacagggactggacaggcatacctcagatgctgtaggtttgcttccagactaccacaataaagcaggtcacaaattt

SEQ ID NO: 195778 - DNA, 966 bp, Homo sapiens
  Payload ID: 18637
  Gene Name: Tu translation elongation factor, mitochondrial
  ENST ID: ENST00000565012
  CDS Start-End: 62-367
cccttcttcttctgtgcgctcgggctcctggtcccggctccccggttaccggggcgcgagtatgaccacaatggcggccgccaccctgctgcgcgcgacgccccacttcagcggtctcgccgccggccggaccttcctgctgcagggtctgttgcggctgctgaaagccccggcattgcctctcttgtgccgcggcctggccgtggaggccaagaagacttacgtgcgcgacaagccacatgtgaatgtgggtaccatcggccatgtggaccacgggaagaccacgctgactgcagccatcacgaagaaatatgatcacaggcactgcacccctcgacggctgcatcctggtggtagcagccaatgacggccccatgccccagacccgagagcacttattactggccagacagattggggtggagcatgtggtggtgtatgtgaacaaggctgacgctgtccaggactctgagatggtggaactggtggaactggagatccgggagctgctcaccgagtttggctataaaggggaggagaccccagtcatcgtaggctctgctctctgtgcccttgagggtcgggaccctgagttaggcctgaagtctgtgcagaagctactggatgctgtggacacttacatcccagtgcccgcccgggacctggagaagcctttcctgctgcctgtggaggcggtgtactccgtccctggccgtggcaccgtggtgacaggtacactagagcgtggcattttaaagaagggagacgagtgtgagctcctaggacatagcaagaacatccgcactgtggtgacaggcattgagatgttccacaagagcctggagagggccgaggccggagataacctcggggccctggtccgaggcttgaagcgggaggacttgcggcggggcctggtcatggtcaagccaggttccatcaagccccaccagaaggtggaggccc

SEQ ID NO: 195779 - DNA, 2019 bp, Homo sapiens
  Payload ID: 18638
  Gene Name: tubby bipartite transcription factor
  Uniprot ID: P50607
  ENST ID: ENST00000299506
  CDS Start-End: 150-1670
tggcgtgcagcgcgggcctcggcggggcccagcgccccggcccgggaggatgcggcccggggcggcccgggagctgagcagggcccccgcgccggcccctccgggccccggcctccagagccgcagccaccgccccgcccccgagagacatgacttccaagccgcattccgactggattccctacagtgtcttagatgatgagggcagaaacctgaggcagcagaagcttgatcggcagcgggccctgctggagcagaagcagaagaagaagcgccaggagcccctgatggtgcaggccaatgcagatgggcggccccggagccggcgggcccggcagtcagaggaacaagcccccctggtggagtcctacctcagcagcagtggcagcaccagctaccaagttcaagaggccgactcactcgccagtgtgcagctgggagccacgcgcccaacagcaccagcttcagccaagagaaccaaggcggcagctacagcagggggccagggtggcgccgctaggaaggagaagaagggaaagcacaaaggcaccagcgggccagcagcactggcagaagacaagtctgaggcccaaggcccagtgcagattctgactgtgggccagtcagaccacgcccaggacgcaggggagacggcagctggtgggggcgaacggcccagcgggcaggatctccgtgccacgatgcagaggaagggcatctccagcagcatgagctttgacgaggatgaggaggatgaggaggagaatagctccagctcctcccagctaaatagtaacacccgccccagctctgctactagcaggaagtccgtcagggaggcagcctcagcccctagcccaacagctccagagcaaccagtggacgttgaggtccaggatcttgaggagtttgcactgaggccggccccccagggtatcaccatcaaatgccgcatcactcgggacaagaaagggatggaccggggcatgtaccccacctactttctgcacctggaccgtgaggatgggaagaaggtgttcctcctggcgggaaggaagagaaagaagagtaaaacttccaattacctcatctctgtggacccaacagacttgtctcgaggaggggacagctatatcgggaaactgcggtccaacttgatgggcaccaagttcactgtttatgacaatggagtcaaccctcagaaggcctcatcctccactttggaaagtggaaccttacgtcaggagctggcagctgtgtgctacgagacaaacgtcttaggcttcaaggggcctcggaagatgagcgtgattgtcccaggcatgaacatggttcatgagagagtctctatccgcccccgcaacgagcatgagacactgctagcacgctggcagaataagaacacggagagtatcatcgagctgcaaaacaagacacctgtctggaatgatgacacacagtcctatgtactcaacttccatgggcgcgtcacacaggcctccgtgaagaacttccagatcatccatggcaatgacccggactacatcgtgatgcagtttggccgggtagcagaggatgtgttcaccatggattacaactacccgctgtgtgcactgcaggcctttgccattgccctgtccagcttcgacagcaagctggcgtgcgagtagaggcctcttcgtgccctttggggttgcccagcctggagcggagcttgcctgcctgcctgtggagacagccctgcctatcctctgtatataggccttccgccagatgaagctttggccctcagtgggctccctggcccagccagccaggaactggctcctttgcctctgctactgaggcaggggagtagtggagagcgggtgggtgggtgtgaagggatgagaataattctttccatgccacgagatcaacacacactcccacccttggggtagtagtgtgttgtagtcgtacttaccaagctgagcaacctcttcagctgggaaggccgcaagaggcatagagggagag

SEQ ID NO: 195780 - DNA, 6420 bp, Homo sapiens
  Payload ID: 18638
  Gene Name: tubby bipartite transcription factor
  Uniprot ID: P50607
  ENST ID: ENST00000305253
  CDS Start-End: 242-1927
cttgaggattcagtctggtcctgaagggtttggggggagactgcgaccagaagatgtttccatgtcctaattaatgggtgatggtggttgttagtctgactgttgccacggtgatgaagggagacatccaagtgctggtttcagtactgaggcgaatacagggaatttcaacaggctccaggtcttactatgcagcctgaagtgggaccatcccttaaacccactccatcctgtggccacgatgggggccaggacacctttgccttctttctgggtttctttctttgccgagacagggattttgttcccaggaggcactccctggcccatgggatctcagcattcaaagcagcacaggaaacctgggcccctgaaacggggccaccgaagagatcggagaacaaccaggaggaagtactggaaggaaggaagggagatcgctcgtgtcttagatgatgagggcagaaacctgaggcagcagaagcttgatcggcagcgggccctgctggagcagaagcagaagaagaagcgccaggagcccctgatggtgcaggccaatgcagatgggcggccccggagccggcgggcccggcagtcagaggaacaagcccccctggtggagtcctacctcagcagcagtggcagcaccagctaccaagttcaagaggccgactcactcgccagtgtgcagctgggagccacgcgcccaacagcaccagcttcagccaagagaaccaaggcggcagctacagcagggggccagggtggcgccgctaggaaggagaagaagggaaagcacaaaggcaccagcgggccagcagcactggcagaagacaagtctgaggcccaaggcccagtgcagattctgactgtgggccagtcagaccacgcccaggacgcaggggagacggcagctggtgggggcgaacggcccagcgggcaggatctccgtgccacgatgcagaggaagggcatctccagcagcatgagctttgacgaggatgaggaggatgaggaggagaatagctccagctcctcccagctaaatagtaacacccgccccagctctgctactagcaggaagtccgtcagggaggcagcctcagcccctagcccaacagctccagagcaaccagtggacgttgaggtccaggatcttgaggagtttgcactgaggccggccccccagggtatcaccatcaaatgccgcatcactcgggacaagaaagggatggaccggggcatgtaccccacctactttctgcacctggaccgtgaggatgggaagaaggtgttcctcctggcgggaaggaagagaaagaagagtaaaacttccaattacctcatctctgtggacccaacagacttgtctcgaggaggggacagctatatcgggaaactgcggtccaacttgatgggcaccaagttcactgtttatgacaatggagtcaaccctcagaaggcctcatcctccactttggaaagtggaaccttacgtcaggagctggcagctgtgtgctacgagacaaacgtcttaggcttcaaggggcctcggaagatgagcgtgattgtcccaggcatgaacatggttcatgagagagtctctatccgcccccgcaacgagcatgagacactgctagcacgctggcagaataagaacacggagagtatcatcgagctgcaaaacaagacacctgtctggaatgatgacacacagtcctatgtactcaacttccatgggcgcgtcacacaggcctccgtgaagaacttccagatcatccatggcaatgacccggactacatcgtgatgcagtttggccgggtagcagaggatgtgttcaccatggattacaactacccgctgtgtgcactgcaggcctttgccattgccctgtccagcttcgacagcaagctggcgtgcgagtagaggcctcttcgtgccctttggggttgcccagcctggagcggagcttgcctgcctgcctgtggagacagccctgcctatcctctgtatataggccttccgccagatgaagctttggccctcagtgggctccctggcccagccagccaggaactggctcctttgcctctgctactgaggcaggggagtagtggagagcgggtgggtgggtgtgaagggatgagaataattctttccatgccacgagatcaacacacactcccacccttggggtagtagtgtgttgtagtcgtacttaccaagctgagcaacctcttcagctgggaaggccgcaagaggcatagagggagaggaagcacactgcagggctgctgtggcccagtcgtccgctcagccaaggagtcagatggcaatgggtactccagcaggtaggggcacagtgaatgtgtgtatgtatgaaggccacatcaactttatgtagcaaagggcttggtggccaagcctggcccttaaacaactgcagaaagcccttcaacttcagaaggcctcactcaagcctgagagaagttgggagggtggtggggacaggtaagtggcaggaccctgtcaggattgcaggtgcctggcttgctgtggctatgggaatcagctggtggctaggtttctagcgcatttgatttctccaggtttgctgtgtctcacagaggcagtaggaacccagctctcagggctgtcttggtggatgggccctgcaagacacaggctcagcatgcagaagtgcatgaacagggtccctggatcagggttgttctgggagtcctgtcagcttccccaggagctctctgctgagcagcccagcacaacccccaggaaacacaaatggggtccaggtcaccagcctgactgcacacagctaggcatgcctgggaatcctgctgccagagaaccattcccaagccatggcatgctccttgaagaatctctcctctctctctctctctggaaagacccaactttctcactgctgtcagccaagtcatggttggtaaccatgtaggttcttgggagggaatgggacagggtgaataaagcagggaatattttagaaccacaagagatcagcagtggcaggacccttaggaatctagtacaaccttgttgctttaggtgagtcacactcagaaaatggggcttgccctgggtcacctagctggttaatggcagcattcagaacttcaagttctcttgatttctttgttcccactgtcccccaagaaactagtatctctggcctcctgggggcccattctgcatgccctccccacttcccccgattcagagacttagaagcatcagagttgataaattagattgaaaccattccagtaggaaatcaggcagttccctgttgaaagttgtctggctttttgcacgtgagtatgatccaggattggcctgtgtctggcccctccgcgagggctactcagcagtaagcaggccttagtacggctgctgcacacttctcggtctaggtgggagagagtgcataaaggttctggggctgggcctgagcctaactccctccactaccgctatttctccttggatggcaccatccaccctgcaggcttgggaactgtaagctcaagcttttgctcatttgtcatttaccctggtggaggcttcttgcccagatagagatctgaaattggtgggaagcaagcaggggtcgtaccttgctttagagtagatgtttggaaaagctaagtagaaattttttaaaatagaagttgtattttaaacgtgttaggctttataggtgaaggacttgttttgacttaagtagaagtaatatgctctcatttctttgtaatctagattttcctatgttgaatgcttaaagcaaggcatacctgtcctagcaggatctgcccacacctcggccgtacatctctgtgagagaccccctccaacgattagcttttgcaacatggtccagtttctagagggcactagaactttgtgccagcgctggcgagataccatggtgccatcctcctttctatagttccagtttagcccttccctgcctttaaggagaagagatcttcatggtgacatttgagatgatggaaactagatcgtctctaatgttaggtcaagctatttctctggatctatgattttaagatagaacaggctggttctgagttctggtgagacggagaccccggtggcagtggaaaaatcagaagcacaaaggaaaactcttggcctctgctttctcctgtagcacaaagagggagttggctggatcttttggtggagtcaggaaagacaggctgagctttctagcctaagtgtggagaaggatagcctcagccacaaaactctgtcaggcattgaatgacaagcatcagtagctgagtgcactcctggtgatcctggttttccttgaccactggccctggggccatgggtgcatggactcgtaaagctgctagggcccctagaaaccacctgggttcagcctctcccacaataagagttcttgcccttcataccctctacctggatggatggtctttgggcagggaattaatgacagaatgagcagtccctaatggtattgggcagttgggagtgagtttaggcagcttctctgtaaccgcttctggggccacaccccaaaactctacaccctctgccccagaacaattctgcagagtggtgaagttcacttccccaactcttctccaagtctagctttcctttccttctggctccaaggtgctctgtgtccgtctgtgtatgtgtgtgtctgtgcgtctgtgtgtttatttggggaaaagggcaatcagcaatcaactgaggtttcttaattgtgattatattcctgagaatgaatgagtaggaaaggaataaggatgttgttatgatcgcctgtggattttgtccattcatctcatgctctctgaacagaaggtatacctgggaagataccagctttttctctcagggttctgagtcagaggacaccatccaagaatgttgttagcttttcagttcccgctctgcattgcctgaaaaaactggtatgttgcacgtatgcttttggttgaaattgaacatactctagtgaatgtgccttaaaaatcaagacactagttcagaggaagcacataatgtccagatctatggcgaacacaggtgttggaagccaggactgtgataatcagaagctataagagaactttcggagcctgcctccttcagtgacaagtagggcacaaaattctagaagcagaaggttgtttttttttttttttctccattctgaaaatagcaggacatttacctcttaaataaacttagcatttagaggtaattctaaatttaacaagtgacagggttggtttcaaagaaaaaggtccatgctttgcttacaatggagtctgcagtgaggggagatgctgggatagccatttccatggctctgttatgcaagcacaaatttcatctcctagatggacttcctggttttctcttactgcagtaacactggccttcccttctctaattccttaccccagctgcggcatccctgtgttaactcaggatgccaagtggccctcagattacacttctccagatagctgaatgagtctgctttcactgtgactgggacctgaatgacctgcagtcagggcccagagttgggactctatactaccctgggctctggtctgtaggtttgtagtagccaccggtaataagccaagggctaggctcttgtttgagtttatggccacctggaattttcagtcatctcatgatacaggcgggaggggcagaacagatagattacgacaggtttggtttttaaattttccaaccaagtggaaaggcaagttggtcttatagaaagcactactgcacttagtagctatgtgattttgagcaaaccacataatctctctaggtccattttcctaaccacaagataaagatgttacattgtcaaagcttgccgtaggatttggggtgaatgaaaattattccttgctttcatcactacctttatagctctcatcactacctttatagctcatcactgtgcctttttttctttcctaagaaagacatcacatccctctcctctcctcctctgtgctcctgtccctccctccccctagcaaggtccaggcaaagctggagatgaggctgagatccagagtttcctagaacgcaacttaggatggctaggaaagggaagcctgactgctcggtcaggagggtgcagtatctcttgctgggaacacagccagttttcacaatgcctagactgtgtatgtctatttgcacaagattgtcttttcctattttggagtggtcagacattttatttttgttcaagattatctggcgttttagacaaatttgcaaaactgtgcttttattgactttttgaataaactttggtattctggagcaaa

SEQ ID NO: 195781 - DNA, 1759 bp, Homo sapiens
  Payload ID: 18638
  Gene Name: tubby bipartite transcription factor
  ENST ID: ENST00000534099
  CDS Start-End: 60-1598
cagccccaagcccagcgccgccgccgcccgcggagccccgagcggagccggaggcggcgatggagggagtcagcagccaccggaccctgtcttacagccgctggagctatgacagtgtcttagatgatgagggcagaaacctgaggcagcagaagcttgatcggcagcgggccctgctggagcagaagcagaagaagaagcgccaggagcccctgatggtgcaggccaatgcagatgggcggccccggagccggcgggcccggcagtcagaggaacaagcccccctggtggagtcctacctcagcagcagtggcagcaccagctaccaagttcaagaggccgactcactcgccagtgtgcagctgggagccacgcgcccaacagcaccagcttcagccaagagaaccaaggcggcagctacagcagggggccagggtggcgccgctaggaaggagaagaagggaaagcacaaaggcaccagcgggccagcagcactggcagaagacaagtctgaggcccaaggcccagtgcagattctgactgtgggccagtcagaccacgcccaggacgcaggggagacggcagctggtgggggcgaacggcccagcgggcaggatctccgtgccacgatgcagaggaagggcatctccagcagcatgagctttgacgaggatgaggaggatgaggaggagaatagctccagctcctcccagctaaatagtaacacccgccccagctctgctactagcaggaagtccgtcagggaggcagcctcagcccctagcccaacagctccagagcaaccagtggacgttgaggtccaggatcttgaggagtttgcactgaggccggccccccagggtatcaccatcaaatgccgcatcactcgggacaagaaagggatggaccggggcatgtaccccacctactttctgcacctggaccgtgaggatgggaagaaggtgttcctcctggcgggaaggaagagaaagaagagtaaaacttccaattacctcatctctgtggacccaacagacttgtctcgaggaggggacagctatatcgggaaactgcggtccaacttgatgggcaccaagttcactgtttatgacaatggagtcaaccctcagaaggcctcatcctccactttggaaagtggaaccttacgtcaggagctggcagctgtgtgctacgagacaaacgtcttaggcttcaaggggcctcggaagatgagcgtgattgtcccaggcatgaacatggttcatgagagagtctctatccgcccccgcaacgagcatgagacactgctagcacgctggcagaataagaacacggagagtatcatcgagctgcaaaacaagacacctgtctggaatgatgacacacagtcctatgtactcaacttccatgggcgcgtcacacaggcctccgtgaagaacttccagatcatccatggcaatgacccggactacatcgtgatgcagtttggccgggtagcagaggatgtgttcaccatggattacaactacccgctgtgtgcactgcaggcctttgccattgccctgtccagcttcgacagcaagctggcgtgcgagtagaggcctcttcgtgccctttggggttgcccagcctggagcggagcttgcctgcctgcctgtggagacagccctgcctatcctctgtatataggccttccgccagatgaagctttggccctcagtgggctccctggcccagccagccaggaactggctccttt

SEQ ID NO: 195782 - DNA, 2162 bp, Homo sapiens
  Payload ID: 18639
  Gene Name: tubby like protein 1
  Uniprot ID: O00294
  ENST ID: ENST00000229771
  CDS Start-End: 81-1709
gaagttgagccgagattagcaggagtcgggagggaggctcctagacctgcagagaaaggggtgcgataggcaaaggcaccatgcctctgcgggatgaaaccctccgagaggtgtgggcctctgacagtgggcatgaagaagaaagcctgagcccggaggccccgcggcgccccaaacagcgacccgccccggcacagaggctaaggaagaagaggacggaggcccccgaatccccctgccccacgggatccaagccccggaagcccggagctgggcggacggggaggccgcgggaggagccttccccagacccagcccaggcccgggcgccgcagacggtctacgccaggttcctcagggaccccgaggccaagaagcgcgacccccgggaaacctttctggtagcccgtgccccagacgcggaggacgaggaggaggaggaagaggaggacgaggaggacgaggaagaggaggcagaggaaaagaaagagaaaatccttctgcctcccaagaagcccctgagagagaagagctccgcagacctgaaggagaggagggccaaggcccagggcccaaggggagacctgggaagccctgaccccccaccgaaacctctgcgtgttaggaataaggaagctccagcaggggaggggaccaagatgagaaagaccaagaagaaagggtctggggaggccgacaaggacccctcagggagcccagccagtgcgaggaagagcccagcagccatgtttctggttggggaaggcagtcctgacaagaaagccctgaagaagaaaggcactcccaaaggcgcgaggaaggaggaagaagaggaggaggaggcagctacggtgataaagaagagcaatcaaaagggcaaagccaaaggaaaaggcaaaaagaaagcgaaggaggagagggccccgtctccccccgtggaggtggacgaaccccgggagtttgtgctccggcctgccccccagggccgcacggtgcgctgccggctgacccgggacaaaaagggcatggatcgaggcatgtatccctcctacttcctgcacctggacacggagaagaaggtgttcctcttggctggcaggaaacgaaaacggagcaagacagccaattacctcatctccatcgaccctaccaatctgtcccgaggaggggagaatttcatcgggaagctgaggtccaacctcctggggaaccgcttcacggtctttgacaacgggcagaacccacagcgtgggtacagcactaatgtggcaagccttcggcaggagctggcagctgtgatctatgaaaccaacgtgctgggcttccgtggcccccggcgcatgaccgtcatcattcctggcatgagtgcggagaacgagagggtccccatccggccccgaaatgctagtgacggcctgctggtgcgctggcagaacaagacgctggagagcctcatagaactgcacaacaagccacctgtctggaacgatgacagtggctcctacaccctcaacttccaaggccgggtcacccaggcctcagtcaagaacttccagattgtccacgctgatgaccccgactatatcgtgctgcagttcggccgcgtggcggaggacgccttcaccctagactaccggtacccgctgtgcgccctgcaggccttcgccatcgccctctccagtttcgacgggaagctggcctgcgagtgaccccagcagcccctcagcgcccccagagcccgtcagcgtgggggaaaggattcagtggaggctggcagggtccctccagcaaagctcccgcggaaaactgctcctgtgtcggggctgacctctcactgcctctcggtgacctccgtcctctccccagcctggcacaggccgaggcaggaggagcccggacggcgggtaggacggagatgaagaacatctggagttggagccgcacatctggtctcggagctcgcctgcgccgctgtgcccccctcctccccgcgccccagtcacttcctgtccgggagcagtagtcattgttgttttaacctcccctctccccgggaccgcgctagggctccgaggagctggggcgggctaggaggagggggtaggtgatgggggacgagggccaggcacccacatccccaataaagccgcgtccttggccaa

SEQ ID NO: 195783 - DNA, 1941 bp, Homo sapiens
  Payload ID: 18639
  Gene Name: tubby like protein 1
  Uniprot ID: O00294
  ENST ID: ENST00000322263
  CDS Start-End: 19-1488
gcgataggcaaaggcaccatgcctctgcgggatgaaaccctccgagaggtgtgggcctctgacagtgggcatgaagaagaaagcctgagcccggaggccccgcggcgccccaaacagcgacccgccccggcacagaggctaaggaagaagaggacggaggcccccgaatccccctgccccacgggatccaagccccggaagcccggagaggaggaggaggaagaggaggacgaggaggacgaggaagaggaggcagaggaaaagaaagagaaaatccttctgcctcccaagaagcccctgagagagaagagctccgcagacctgaaggagaggagggccaaggcccagggcccaaggggagacctgggaagccctgaccccccaccgaaacctctgcgtgttaggaataaggaagctccagcaggggaggggaccaagatgagaaagaccaagaagaaagggtctggggaggccgacaaggacccctcagggagcccagccagtgcgaggaagagcccagcagccatgtttctggttggggaaggcagtcctgacaagaaagccctgaagaagaaaggcactcccaaaggcgcgaggaaggaggaagaagaggaggaggaggcagctacggtgataaagaagagcaatcaaaagggcaaagccaaaggaaaaggcaaaaagaaagcgaaggaggagagggccccgtctccccccgtggaggtggacgaaccccgggagtttgtgctccggcctgccccccagggccgcacggtgcgctgccggctgacccgggacaaaaagggcatggatcgaggcatgtatccctcctacttcctgcacctggacacggagaagaaggtgttcctcttggctggcaggaaacgaaaacggagcaagacagccaattacctcatctccatcgaccctaccaatctgtcccgaggaggggagaatttcatcgggaagctgaggtccaacctcctggggaaccgcttcacggtctttgacaacgggcagaacccacagcgtgggtacagcactaatgtggcaagccttcggcaggagctggcagctgtgatctatgaaaccaacgtgctgggcttccgtggcccccggcgcatgaccgtcatcattcctggcatgagtgcggagaacgagagggtccccatccggccccgaaatgctagtgacggcctgctggtgcgctggcagaacaagacgctggagagcctcatagaactgcacaacaagccacctgtctggaacgatgacagtggctcctacaccctcaacttccaaggccgggtcacccaggcctcagtcaagaacttccagattgtccacgctgatgaccccgactatatcgtgctgcagttcggccgcgtggcggaggacgccttcaccctagactaccggtacccgctgtgcgccctgcaggccttcgccatcgccctctccagtttcgacgggaagctggcctgcgagtgaccccagcagcccctcagcgcccccagagcccgtcagcgtgggggaaaggattcagtggaggctggcagggtccctccagcaaagctcccgcggaaaactgctcctgtgtcggggctgacctctcactgcctctcggtgacctccgtcctctccccagcctggcacaggccgaggcaggaggagcccggacggcgggtaggacggagatgaagaacatctggagttggagccgcacatctggtctcggagctcgcctgcgccgctgtgcccccctcctccccgcgccccagtcacttcctgtccgggagcagtagtcattgttgttttaacctcccctctccccgggaccgcgctagggctccgaggagctggggcgggctaggaggagggggtaggtgatgggggacgagggccaggcacccacatccccaataaagccgcgtccttggccaa

SEQ ID NO: 195784 - DNA, 492 bp, Homo sapiens
  Payload ID: 18639
  Gene Name: tubby like protein 1
  ENST ID: ENST00000428978
  CDS Start-End: 9-492
aaggcaccatgcctctgcgggatgaaaccctccgagaggtgtgggcctctgacagtgggcatgaagaagaaagcctgagcccggaggccccgcggcgccccaaacagcgacccgccccggcacagaggctaaggaagaagaggacggaggcccccgaatccccctgccccacgggatccaagccccggaagcccggagagtttctacctgcagaggaggaggaggaagaggaggacgaggaggacgaggaagaggaggcagaggaaaagaaagagaaaatccttctgcctcccaagaagcccctgagagagaagagctccgcagacctgaaggagaggagggccaaggcccagggcccaaggggagacctgggaagccctgaccccccaccgaaacctctgcgtgttaggaataaggaagctccagcaggggaggggaccaagatgagaaagaccaagaagaaagggtctggggaggccgacaaggacccct

SEQ ID NO: 195785 - DNA, 2084 bp, Homo sapiens
  Payload ID: 18639
  Gene Name: tubby like protein 1
  ENST ID: ENST00000614066
  CDS Start-End: 12-1634
gcaaaggcaccatgcctctgcgggatgaaaccctccgagaggtgtgggcctctgacagtgggcatgaagaagaaagcctgagcccggaggccccgcggcgccccaaacagcgacccgccccggcacagaggctaaggaagaagaggacggaggcccccgaatccccctgccccacgggatccaagccccggaagcccggagctgggcggacggggaggccgcgggaggagccttccccagacccagcccaggcccgggcgccgcagacggtctacgccaggttcctcagggaccccgaggccaagaagcgcgacccccgggaaacctttctggtagcccgtgccccagacgcggaggacgaggaggaggaggaagaggaggacgaggaggacgaggaagaggaggcagaggaaaagaaagagaaaatccttctgcctcccaagaagcccctgagagagaagagctccgcagacctgaaggagaggagggccaaggcccagggcccaaggggagacctgggaagccctgaccccccaccgaaacctctgcgtgttaggaataaggaagctccagcaggggaggggaccaagatgagaaagaccaagaagaaagggtctggggaggccgacaaggacccctcagggagcccagccagtgcgaggaagagcccagcagccatgtttctggttggggaaggcagtcctgacaagaaagccctgaagaagaaaggcactcccaaaggcgcgaggaaggaggaagaagaggaggaggaggcagctacggtgataaagaagagcaatcaaaagggcaaagccaaaggaaaaggcaaaaagaaggaggagagggccccgtctccccccgtggaggtggacgaaccccgggagtttgtgctccggcctgccccccagggccgcacggtgcgctgccggctgacccgggacaaaaagggcatggatcgaggcatgtatccctcctacttcctgcacctggacacggagaagaaggtgttcctcttggctggcaggaaacgaaaacggagcaagacagccaattacctcatctccatcgaccctaccaatctgtcccgaggaggggagaatttcatcgggaagctgaggtccaacctcctggggaaccgcttcacggtctttgacaacgggcagaacccacagcgtgggtacagcactaatgtggcaagccttcggcaggagctggcagctgtgatctatgaaaccaacgtgctgggcttccgtggcccccggcgcatgaccgtcatcattcctggcatgagtgcggagaacgagagggtccccatccggccccgaaatgctagtgacggcctgctggtgcgctggcagaacaagacgctggagagcctcatagaactgcacaacaagccacctgtctggaacgatgacagtggctcctacaccctcaacttccaaggccgggtcacccaggcctcagtcaagaacttccagattgtccacgctgatgaccccgactatatcgtgctgcagttcggccgcgtggcggaggacgccttcaccctagactaccggtacccgctgtgcgccctgcaggccttcgccatcgccctctccagtttcgacgggaagctggcctgcgagtgaccccagcagcccctcagcgcccccagagcccgtcagcgtgggggaaaggattcagtggaggctggcagggtccctccagcaaagctcccgcggaaaactgctcctgtgtcggggctgacctctcactgcctctcggtgacctccgtcctctccccagcctggcacaggccgaggcaggaggagcccggacggcgggtaggacggagatgaagaacatctggagttggagccgcacatctggtctcggagctcgcctgcgccgctgtgcccccctcctccccgcgccccagtcacttcctgtccgggagcagtagtcattgttgttttaacctcccctctccccgggaccgcgctagggctccgaggagctggggcgggctaggaggagggggtaggtgatgggggacgagggccaggcacccacatccccaataaagccgcgtccttggc

SEQ ID NO: 195786 - DNA, 1754 bp, Homo sapiens
  Payload ID: 18640
  Gene Name: tubby like protein 2
  Uniprot ID: O00295
  ENST ID: ENST00000221399
  CDS Start-End: 146-1708
ggaagtggagagtggagggtcagaagggagtggaccagttcaggtcccagagggaatcctccctccctctgagccgtctttcttctcctccctatttcgcagatatcccgagattaggtccccagcttccaaagagaggatcagaatgtctcaggataatgacacattgatgagagacatcctggggcatgagctcgctgctatgaggctgcagaagctggaacagcagcggcggctgtttgaaaagaagcagcgacagaagcgccaggagctcctcatggttcaggccaatcctgacgcttccccgtggctttggcgctcttgtctgcgggaggagcgccttttaggtgacagaggccttgggaaccctttcctccggaagaaagtgtcagaggcacatctgccctctggcatccacagtgccctgggcaccgtgagctgtggtggagacggcaggggcgagcgcggcctcccgacaccgcggacagaagcagtgttcaggaatctcggtctccagtcccctttcttatcctggctcccagacaattccgatgcagaattggaggaagtctccgtggagaatggttccgtctctcccccaccttttaaacagtctccgagaatccgacgcaagggttggcaagcccaccaacgacctgggacccgtgcagagggtgagagtgactcccaggatatgggagatgcacacaagtcacccaatatgggaccaaaccctggaatggatggtgactgtgtatatgaaaacttggccttccaaaaggaagaagacttggaaaagaagagagaggcctctgagtctacagggacgaactcctcagcagcacacaacgaagagttgtccaaggccctgaaaggcgagggtggcacggacagcgaccatatgaggcacgaagcctccttggcaatccgctccccctgccctgggctggaggaggacatggaagcctacgtgctgcggccagcgctcccgggcaccatgatgcagtgctacctcacccgtgacaagcacggcgtggacaagggcttgttccccctctactacctctacctggagacctctgacagcctgcagcgcttcctcctggctgggcgaaagagaagaaggagcaaaacttctaattacctcatctccctggatcctacacacctatctcgggacggggacaatttcgtgggcaaagtcagatccaatgtcttcagcaccaagttcaccatctttgacaatggggtgaatcctgaccgggagcatttaaccaggaatactgcccggatcagacaggagctgggggctgtgtgttatgagcccaacgtcttaggatacctggggcctcggaaaatgactgtgattctcccaggaaccaacagccagaaccagcgaatcaatgtccagccactaaatgaacaggagtcgctactgagtcgttaccaacgtggggacaaacaagggttgcttttgttgcacaacaaaaccccgtcgtgggacaaggagaacggtgtctacacgctcaatttccatggtcgagtcactcgggcttcggtgaagaacttccaaatcgtggatcccaaacaccaagaacatctggtgctccagttcggccgagtgggcccagacacattcaccatggacttctgctttccatttagcccgctccaggccttcagcatctgcttgtccagtttcaattagaagctggctgttgaataactcaataaaataccatacccttgccagc

SEQ ID NO: 195787 - DNA, 840 bp, Homo sapiens
  Payload ID: 18640
  Gene Name: tubby like protein 2
  ENST ID: ENST00000518572
  CDS Start-End: 149-840
agatatcccgagattaggtccccagcttccaaagagaggatcaggtatgtttagagattggccagagaggcaaggtaccgaggcatcaatgtgagcagcctctccaggcacctggtgaggagaacaagtctcccggatcccaggcagaatgtctcaggataatgacacattgatgagagacatcctggggcatgagctcgctgctatgaggctgcagaagctggaacagcagcggcggctgtttgaaaagaagcagcgacagaagcgccaggagctcctcatggttcaggccaatcctgacgcttccccgtggctttggcgctcttgtctgcgggaggagcgccttttaggtgacagagtgttcaggaatctcggtctccagtcccctttcttatcctggctcccagacaattccgatgcagaattggaggaagtctccgtggagaatggttccgtctctcccccaccttttaaacagtctccgagaatccgacgcaagggttggcaagcccaccaacgacctgggacccgtgcagagggtgagagtgactcccaggatatgggagatgcacacaagtcacccaatatgggaccaaaccctggaatggatggtgactgtgtatatgaaaacttggccttccaaaaggaagaagacttggaaaagaagagagaggcctctgagtctacagggacgaactcctcagcagcacacaacgaagagttgtccaaggccctgaaaggcgagggtggcacggacagcgaccatatgaggcacgaagcctccttggcaatccgctccccctgccctgggctggaggaggacatggaagcctacgtgct

SEQ ID NO: 195788 - DNA, 649 bp, Homo sapiens
  Payload ID: 18640
  Gene Name: tubby like protein 2
  ENST ID: ENST00000520977
  CDS Start-End: 89-649
gggactctcttgggcaaccgaggttccctgtgcactgtcaccatgggcctgtgtctctctcagcatcctggggcatgagctcgctgctatgaggctgcagaagctggaacagcagcggcggctgtttgaaaagaagcagcgacagaagcgccaggagctcctcatggttcaggccaatcctgacgcttccccgtggctttggcgctcttgtctgcgggaggagcgccttttaggtgacagaggccttgggaaccctttcctccggaagaaagtgtcagaggcacatctgccctctggcatccacagtgccctgggcaccgtgagctgtggtggagacggcaggggcgagcgcggcctcccgacaccgcggacagaagcagtgttcaggaatctcggtctccagtcccctttcttatcctggctcccagacaattccgatgcagaattggaggaagtctccgtggagaatggttccgtctctcccccaccttttaaacagtctccgagaatccgacgcaagggttggcaagcccaccaacgacctgggacccgtgcagagggtgagagtgactcccaggatatgggagatgcacacaagtcacccaatatgggaccaaaccctggaatggatggtgactgtgtatatgaa

SEQ ID NO: 195789 - DNA, 283 bp, Homo sapiens
  Payload ID: 18640
  Gene Name: tubby like protein 2
  ENST ID: ENST00000522341
  CDS Start-End: 1-243
tgggacaaggagaacggtgtctacacgctcaatttccatggtcgagtcactcgggcttcggtgaagaacttccaaatcgtggatcccaaacaccgtgagctcctggaaaccagtttagccgggccagaagaacatctggtgctccagttcggccgagtgggcccagacacattcaccatggacttctgctttccatttagcccgctccaggccttcagcatctgcttgtccagtttcaattagaagctggctgttgaataactcaataaaataccataccctt

SEQ ID NO: 195790 - DNA, 736 bp, Homo sapiens
  Payload ID: 18640
  Gene Name: tubby like protein 2
  ENST ID: ENST00000522945
  CDS Start-End: 106-736
agcggacttgcggacccccgtgggaagctggaaacaggctactagatcccgacaggagtgggtgctgggattcgggctgcctgggtccggaagcaaatttaaagaatgtctcaggataatgacacattgatgagagacatcctggggcatgagctcgctgctatgaggctgcagaagctggaacagcagcggcggctgtttgaaaagaagcagcgacagaagcgccaggagctcctcatggttcaggccaatcctgacgcttccccgtggctttggcgctcttgtctgcgggaggagcgccttttaggccttgggaaccctttcctccggaagaaagtgtcagaggcacatctgccctctggcatccacagtgccctgggcaccgtgagctgtggtggagacggcaggggcgagcgcggcctcccgacaccgcggacagaagcagtgttcaggaatctcggtctccagtcccctttcttatcctggctcccagacaattccgatgcagaattggaggaagtctccgtggagaatggttccgtctctcccccaccttttaaacagtctccgagaatccgacgcaagggttggcaagcccaccaacgacctgggacccgtgcagagggtgagagtgactcccaggatatgggagatgcacacaagtcacccaatatgggaccaaaccctggaatggatggtgactgtgtatatgaaaacttggccttccaaaaggaag

SEQ ID NO: 195791 - DNA, 1951 bp, Homo sapiens
  Payload ID: 18641
  Gene Name: tubby like protein 3
  Uniprot ID: O75386
  ENST ID: ENST00000397132
  CDS Start-End: 42-1547
ggaagagtgtgtacgtggtgggggcttcctcggtggcgggcatggaggcttcgcgctgccggctcagtcccagcggcgacagtgtcttccatgaagaaatgatgaagatgcgacaggctaagctggattatcagaggctactacttgagaagaggcaaaggaaaaagcgccttgagccatttatggtgcagcccaatccagaagccaggctacgtcgggcaaagccaagggccagtgatgagcagactcccttggtgaactgtcatactccccacagcaatgtcatcttacatggtattgatggtccagctgctgtcctgaaaccagacgaagttcatgctccatcagtaagctcctctgttgtggaagaagatgctgaaaacaccgtggatactgcttccaagccaggacttcaggagcgtctccaaaagcatgatatctctgaaagtgtgaacttcgatgaggagactgatggaatatcccagtcagcatgtttagaaagacccaattctgcatcaagccagaattcaaccgatacaggcacttccggttctgctactgccgcccaaccagctgataacctcctgggagacatagacgacctggaggactttgtgtatagtcctgcccctcaaggtgtcacagtaagatgtcggataatccgggataaaaggggaatggatcggggtctcttccccacctactatatgtacttggaaaaagaagaaaatcagaagatatttcttcttgcagctagaaagcggaaaaagagcaaaacagccaactaccttatctccattgatccagttgatttatctcgtgaaggagaaagttatgtcggcaagcttagatccaacctcatggggaccaagtttacagtttatgaccgtggcatctgccccatgaagggccggggtttggtaggagcggcccacacccggcaggagctggctgccatctcctatgaaacaaacgtacttggatttaaaggtcctaggaaaatgtctgtgatcattcctggaatgacactgaatcataagcagatcccctatcagccacaaaacaaccatgacagtttgctctcaaggtggcagaacagaactatggaaaatctggttgagctgcacaacaaggcccccgtctggaacagtgacactcagtcctatgtcctcaacttccgtggccgggtcactcaggcgtctgtgaagaacttccagatagtccacaaaaatgaccctgattatatagtcatgcagtttggacgtgtggcagatgacgtgttcacactggattacaactacccactttgtgcagtacaggcctttggcatcggtctttctagctttgacaaatgtatccaaaccttgagaatgcaggagctctgtgagctccaccgtcagcaccattcagctgcatcccttgtgcacagaactgtttgccagcgttgggtgggacacccgtggcggctgctccctcagacctcccttctgtggactgacctctcacctccgcctgttgttcctgcaccacatcagataagcatgtgaaggagggccaactggcagctgcgggacccttggcttgtcccccaccgacaagtcccacctgctgggtgaggacgagactgtttccatctcaggcatgtatcccaccaagtgcctccctcacagccatgcccagaagcctcacacctcgtcaccaccaccaccccccaccccatcctgaggcactgcctggcagataaccctggttggccacagaagctattaatacacgacagcatgtggggaaggacttatggtgggccaggtggacctcatcctgcttcttcctccctctggtttaaagagatatataaactaatttcacataatttgtgtgtgcaggtgattggtttttacataagtcctatttataccttttatatgttacagaaataaaagttaattta

SEQ ID NO: 195792 - DNA, 3076 bp, Homo sapiens
  Payload ID: 18641
  Gene Name: tubby like protein 3
  Uniprot ID: O75386
  ENST ID: ENST00000448120
  CDS Start-End: 52-1380
gcgacggcggggaagagtgtgtacgtggtgggggcttcctcggtggcgggcatggaggcttcgcgctgccggctcagtcccagcggcgacagtgtcttccatgaagaaatgatgaagatgcgacaggctaagctggattatcagaggctactacttgagaagaggcaaaggaaaaagcgccttgagccatttatggtgcagcccaatccagaagccaggctacgtcgggcaaagccaagggccagtgatgagcagactcccttggtgaactgtcatactccccacagcaatgtcatcttacatggtattgatggtccagctgctgtcctgaaaccagacgaagttcatgctccatcagtaagctcctctgttgtggaagaagatgctgaaaacaccgtggatactgcttccaagccaggacttcaggagcgtctccaaaagcatgatatctctgaaagtgtgaacttcgatgaggagactgatggaatatcccagtcagcatgtttagaaagacccaattctgcatcaagccagaattcaaccgatacaggcacttccggttctgctactgccgcccaaccagctgataacctcctgggagacatagacgacctggaggactttgtgtatagtcctgcccctcaaggtgtcacagtaagatgtcggataatccgggataaaaggggaatggatcggggtctcttccccacctactatatgtacttggaaaaagaagaaaatcagaagatatttcttcttgcagctagaaagcggaaaaagagcaaaacagccaactaccttatctccattgatccagttgatttatctcgtgaaggagaaagttatgtcggcaagcttagatccaacctcatggggaccaagtttacagtttatgaccgtggcatctgccccatgaagggccggggtttggtaggagcggcccacacccggcaggagctggctgccatctcctatgaaacaaacgtacttggatttaaaggtcctaggaaaatgtctgtgatcattcctggaatgacactgaatcataagcagatcccctatcagccacaaaacaaccatgacagtttgctctcaaggtggcagaacagaactatggaaaatctggttgagctgcacaacaaggcccccgtctggaacagtgacactcagtcctatgtcctcaacttccgtggccgggtcactcaggcgtctgtgaagaacttccagatagtccacaaaaatgaccctgattatatagtcatgcagtttggacgtgtggcagatgacgtgttcacactggattacaactacccactttgtgcagtacaggcctttggcatcggtctttctagctttgacagtaagctggcgtgtgaatgagagaacagtcaggcagggagcccttctccccacagagctttcaggagcagacagtggcctccccttcccctccctgccccaggacttaaagagcaatagtttgccccttttggaatgatctctgaatatataaaacacacacacaaagagcaatagtttgccccttttggaacgacccctgaatatataaaacacacacacgaagagcaatagtttgccccttttggaacgacccctgaatatataaaacacacacgaagagcaatagtttgccccttttggaacgacccctgaatatataaaacacacacacgaagagcaatagtttgccccttttggaacgacccctgaatatataaaacacacacacaccccgcgcactctcactccttttccaggtttcatagacttggtgagggatcacagcttagcatgggtgagagatgatttaaagcacagggagattcttgtcacattggggtctccaaagctagaatgggatttcatgtgcttggaaacttgcagtagaatcagggactgacatcgcagttcctctcctctcttcattccctcacagcagattggccggcaccaatcttagtcaagagtggctgtgatcacatttgtgatcaattatgtgagaattttatataattgtcttcatttcaattaaggctgaaagcataaactctagaggtgactcagtcaggactgacagtaatgtgataattgccttcattttcaacccaggagtgcctctcacagctatatgactacggatccattagtgaggagcgacacacacacctgtaggcatcctgtgcaaacactttgtcattatcaagagagatggcagtattgaccatttagtttagttaaaaaaaaaaaaaaaaaggtggcaggagaggctttggggaggatcagccagcagacatgagcactgctggcccgtgtggcagagctgtggactttcttctcggctccctcaaccctggctcaggcacagaaggtgttttgctacgtttttttgattattacacccctccacgtattatgtgactcttacaccagttcacccttcccagaatgtatccaaaccttgagaatgcaggagctctgtgagctccaccgtcagcaccattcagctgcatcccttgtgcacagaactgtttgccagcgttgggtgggacacccgtggcggctgctccctcagacctcccttctgtggactgacctctcacctccgcctgttgttcctgcaccacatcagataagcatgtgaaggagggccaactggcagctgcgggacccttggcttgtcccccaccgacaagtcccacctgctgggtgaggacgagactgtttccatctcaggcatgtatcccaccaagtgcctccctcacagccatgcccagaagcctcacacctcgtcaccaccaccaccccccaccccatcctgaggcactgcctggcagataaccctggttggccacagaagctattaatacacgacagcatgtggggaaggacttatggtgggccaggtggacctcatcctgcttcttcctccctctggtttaaagagatatataaactaatttcacataatttgtgtgtgcaggtgattggtttttacataagtcctatttataccttttatatgttacagaaataaaagttaatttatataaaaatg

SEQ ID NO: 195793 - DNA, 1229 bp, Homo sapiens
  Payload ID: 18641
  Gene Name: tubby like protein 3
  ENST ID: ENST00000538354
  CDS Start-End: 58-177
actctagcgacggcggggaagagtgtgtacgtggtgggggcttcctcggtggcgggcatggaggcttcgcgctgccggctcagtcccagcggcgacagtgtcttccatgaagaaatgatgaagatgcgacaggctaagctggattatcaggtattgatggtccagctgctgtcctgaaaccagacgaagttcatgctccatcagtaagctcctctgttgtggaagaagatgctgaaaacaccgtggatactgcttccaagccaggacttcaggagcgtctccaaaagcatgatatctctgaaagtgtgaacttcgatgaggagactgatggaatatcccagtcagcatgtttagaaagacccaattctgcatcaagccagaattcaaccgatacaggcacttccggttctgctactgccgcccaaccagctgataacctcctgggagacatagacgacctggaggactttgtgtatagtcctgcccctcaaggtgtcacagtaagatgtcggataatccgggataaaaggggaatggatcggggtctcttccccacctactatatgtacttggaaaaagaagaaaatcagaagatccaacctcatggggaccaagtttacagtttatgaccgtggcatctgccccatgaagggccggggtttggtaggagcggcccacacccggcaggagctggctgccatctcctatgaaacaaacgtacttggatttaaaggtcctaggaaaatgtctgtgatcattcctggaatgacactgaatcataagcagatcccctatcagccacaaaacaaccatgacagtttgctctcaaggtggcagaacagaactatggaaaatctggttgagctgcacaacaaggcccccgtctggaacagtgacactcagtcctatgtcctcaacttccgtggccgggtcactcaggcgtctgtgaagaacttccagatagtccacaaaaatgaccctgattatatagtcatgcagtttggacgtgtggcagatgacgtgttcacactggattacaactacccactttgtgcagtacaggcctttggcatcggtctttctagctttgacagtaagctggcgtgtgaatgagagaacagtcaggcagggagcccttctccccacagagctttcaggagcagacagtggcctccccttcccctccctgccccaggacttaaagagcaatagtttgccccttttggaat

SEQ ID NO: 195794 - DNA, 449 bp, Homo sapiens
  Payload ID: 18641
  Gene Name: tubby like protein 3
  ENST ID: ENST00000538704
  CDS Start-End: 1-328
cccctatcagccacaaaacaaccatgacagtttgctctcaaggtggcagaacagaactatggaaaatctggttgagctgcacaacaaggcccccgtctggaacagtgacactcagtcctatgtcctcaacttccgtggccgggtcactcaggcgtctgtgaagaacttccagatagtccacaaaaatgaccctgattatatagtcatgcagtttggacgtgtggcagatgacgtgttcacactggattacaactacccactttgtgcagtacaggcctttggcatcggtctttctagctttgacagagtgcctctcacagctatatgactacggatccattagtgaggagcgacacacacacctgtaggcatcctgtgcaaacactttgtcattatcaagagagatggcagtattgaccatttagtttagttaaaaaaaaaaaaaaaaa

SEQ ID NO: 195795 - DNA, 542 bp, Homo sapiens
  Payload ID: 18641
  Gene Name: tubby like protein 3
  ENST ID: ENST00000541678
  CDS Start-End: 1-400
cattcctggaatgacactgaatcataagcagatcccctatcagccacaaaacaaccatgacagtttgctctcaaggtggcagaacagaactatggaaaatctggttgagctgcacaacaaggcccccgtctggaacagtgacactcagtcctatgtcctcaacttccgtggccgggtcactcaggcgtctgtgaagaacttccagatagtccacaaaaatgaccctgattatatagtcatgcagtttggacgtgtggcagatgacgtgttcacactggattacaactacccactttgtgcagtacaggcctttggcatcggtctttctagctttgacacagattggccggcaccaatcttagtcaagagtggctgtgatcacatttgtgatcaattatgagtgcctctcacagctatatgactacggatccattagtgaggagcgacacacacacctgtaggcatcctgtgcaaacactttgtcattatcaagagagatggcagtattgaccatttagtttagttaaaaaaaaaaaaaaaaa

SEQ ID NO: 195796 - DNA, 1373 bp, Homo sapiens
  Payload ID: 18641
  Gene Name: tubby like protein 3
  ENST ID: ENST00000545331
  CDS Start-End: 58-177
actctagcgacggcggggaagagtgtgtacgtggtgggggcttcctcggtggcgggcatggaggcttcgcgctgccggctcagtcccagcggcgacagtgtcttccatgaagaaatgatgaagatgcgacaggctaagctggattatcaggtattgatggtccagctgctgtcctgaaaccagacgaagttcatgctccatcagtaagctcctctgttgtggaagaagatgctgaaaacaccgtggatactgcttccaagccaggacttcaggagcgtctccaaaagcatggatacaggcacttccggttctgctactgccgcccaaccagctgataacctcctgggagacatagacgacctggaggactttgtgtatagtcctgcccctcaaggtgtcacagtaagatgtcggataatccgggataaaaggggaatggatcggggtctcttccccacctactatatgtacttggaaaaagaagaaaatcagaagatatttcttcttgcagctagaaagcggaaaaagagcaaaacagccaactaccttatctccattgatccagttgatttatctcgtgaaggagaaagttatgtcggcaagcttagatccaacctcatggggaccaagtttacagtttatgaccgtggcatctgccccatgaagggccggggtttggtaggagcggcccacacccggcaggagctggctgccatctcctataaccatgacagtttgctctcaaggtggcagaacagaactatggaaaatctggttgagctgcacaacaaggcccccgtctggaacagtgacactcagtcctatgtcctcaacttccgtggccgggtcactcaggcgtctgtgaagaacttccagatagtccacaaaaatgaccctgattatatagtcatgcagtttggacgtgtggcagatgacgtgttcacactggattacaactacccactttgtgcagtacaggcctttggcatcggtctttctagctttgacagtaagctggcgtgtgaatgagagaacagtcaggcagggagcccttctccccacagagctttcaggagcagacagtggcctccccttcccctccctgccccaggacttaaagagcaatagtttgccccttttggaatgatctctgaatatataaaacacacacacaaagagcaatagtttgccccttttggaacgacccctgaatatataaaacacacacacgaagagcaatagtttgccccttttggaacgacccctgaatatataaaacacacacgaagagcaatagtttgccccttttggaacgacccctgaatatataaaacacacacacgaagagcaatagtttgccccttttggaacga

SEQ ID NO: 195797 - DNA, 548 bp, Homo sapiens
  Payload ID: 18641
  Gene Name: tubby like protein 3
  ENST ID: ENST00000544943
  CDS Start-End: 138-548
agccactctagcgacggcggggaagagtgtctagaaagcggaaaaagagcaaaacagccaactaccttatctccattgatccagttgatttatctcgtgaaggagaaagttatgtcggcaagcttagatccaacctcatggggaccaagtttacagtttatgaccgtggcatctgccccatgaagggccggggtttggtaggagcggcccacacccggcaggagctggctgccatctcctatgaaacaaacgtacttggatttaaaggtcctaggaaaatgtctgtgatcattcctggaatgacactgaatcataagcagatcccctatcagccacaaaacaaccatgacagtttgctctcaaggtggcagaacagaactatggaaaatctggttgagctgcacaacaaggcccccgtctggaacagtgacactcagtcctatgtcctcaacttccgtggccgggtcactcaggcgtctgtgaagaacttccagatagtccacaaaaatgaccctgattatatagtcatgcagtttggacgtgtggca

SEQ ID NO: 195798 - DNA, 978 bp, Homo sapiens
  Payload ID: 18641
  Gene Name: tubby like protein 3
  Uniprot ID: O75386
  ENST ID: ENST00000540184
  CDS Start-End: 77-589
attccgggctcgaaggctgtgcggtctgccaggagctgcggccccgtccggcccgggctgtgtcttccatgaagaaatgatgaagatgcgacaggctaagctggattatcagaggctactacttgagaagaggcaaaggaaaaagcgccttgagccatttatggtgcagcccaatccagaagccaggctacgtcgggcaaagccaagggccagtgatgagcagactcccttggtgaactgtcatactccccacagcaatgtcatcttacatggtattgatggtccagctgctgtcctgaaaccagacgaagttcatgctccatcagtaagctcctctgttgtggaagaagatgctgaaaacaccgtggatactgcttccaagccaggacttcaggagcgtctccaaaagcatgatatctctgaaagtgtgaacttcgatgaggagactgatggaatatcccagtcagcatgtttagaaagacccaattctgcatcaagccagaattcaaccttttcctcattctgtcagaagactgaagacacgggatacaggcacttccggttctgctactgccgcccaaccagctgataacctcctgggagacatagacgacctggaggactttgtgtatagtcctgcccctcaaggtgtcacagtaagatgtcggataatccgggataaaaggggaatggatcggggtctcttccccacctactatatgtacttggaaaaagaagaaaatcagaagatatttcttcttgcagctagaaagcggaaaaagagcaaaacagccaactaccttatctccattgatccagttgatttatctcgtgaaggagaaagttatgtcggcaagcttagatccaacctcatggggaccaagtttacagtttatgaccgtggcatctgccccatgaagggccggggtttggtaggagcggcccacacccggcaggagctggctgccatctcctatg

SEQ ID NO: 195799 - DNA, 1430 bp, Homo sapiens
  Payload ID: 18641
  Gene Name: tubby like protein 3
  ENST ID: ENST00000610453
  CDS Start-End: 45-1367
cggggaagagtgtgtacgtggtgggggcttcctcggtggcgggcatggaggcttcgcgctgccggctcagtcccagcggcgacagtgtcttccatgaagaaatgatgaagatgcgacaggctaagctggattatcagaggctactacttgagaagaggcaaaggaaaaagcgccttgagccatttatggtgcagcccaatccagaagccaggctacgtcgggcaaagccaagggccagtgatgagcagactcccttggtgaactgtcatactccccacagcaatgtcatcttacatggtattgatggtccagctgctgtcctgaaaccagacgaagttcatgctccatcagtaagctcctctgttgtggaagaagatgctgaaaacaccgtggatactgcttccaagccaggacttcaggagcgtctccaaaagcatgatatctctgaaagtgtgaacttcgatgaggagactgatggaatatcccagtcagcatgtttagaaagacccaattctgcatcaagccagaattcaaccgatacaggccttccggttctgctactgccgcccaaccagctgataacctcctgggagacagacgacctggaggactttgtgtatagtcctgcccctcaaggtgtcacagtaagatgtcggataatccgggataaaaggggaatggatcggggtcttccccacctactatatgtacttggaaaagaagaaaatcagaagatatttcttcttgcagctagaaagcggaaaaagagcaaaacagccaactaccttatctccattgatccagttgatttatctcgtgaaggagaaagttatgtcggcaagcttagatccaacctcatggggaccaagtttacagtttatgaccgtggcatctgccccatgaagggccggggtttggtaggagcggcccacacccggcaggagctggctgccatctcctatgaaacaaacgtacttggatttaaaggtcctaggaaaatgtctgtgatcattcctggaatgacactgaatcataagcagatcccctatcagccacaaaacaaccatgacagtttgctctcaaggtggcagaacagaactatggaaaatctggttgagctgcacaacaaggcccccgtctggaacagtgacactcagtcctatgtcctcaacttccgtggccgggtcactcaggcgtctgtgaagaacttccagatagtccacaaaaatgaccctgattatatagtcatgcagtttggacgtgtggcagatgacgtgttcacactggattacaactacccactttgtgcagtacaggcctttggcatcggtctttctagctttgacagtaagctggcgtgtgaatgagagaacagtcaggcagggagcccttctccccacagagctttcaggagcagacagtggcctccc

SEQ ID NO: 195800 - DNA, 5170 bp, Homo sapiens
  Payload ID: 18642
  Gene Name: tubby like protein 4
  Uniprot ID: Q9NRJ4
  ENST ID: ENST00000367094
  CDS Start-End: 1358-3394
gaaattttaatttattattcccccccttttttcctgcatctataggataatattgtaaaatagcaattgaaaccaataattattaaataaatatcaaggaaaatccaagcaaagctttctttttgttggactagtggtgtggtgtttggagacagtctctgaatgtgaacaggaaagcacccatcagcaaaacactatcactctctagggagacagctgggggaatctgactctggcttctgcttttgttttaagggattaacttccctgtcaagtccaagaagacttgcgtatgagaagattacctgatggacttaattctaagattagcttttttcatcaagatggaaaaagatctttaggagcagaaaaggggagtgctaactgggggagcgagaagggagacgagcaaaagaaacaaaatcttgccacgtggctctgttttgtcagcaagaggatttaagactcacccagggcaaacactgggaccactgtaagagcgctggaacattctgcctcttgagtgaaggggccttctttctagcctctatggcactgaggggtgcgccggctggtggaggagcagtccgatggagccctgcgttccccggggacacagggccaagctttgaggtggaaagtttctggttctgaaacaacaaggagagagtctgtttttcttcctaaaatttggactcttgtctgcacaaactctggtctgttttgcacggtttgtgtgcctttttttccctttatgcaatctttttcagctttagcagcagaaatttgtctagttcaggaaacatgctagagggtggcttcagaaggaagatgatcctgtgtattctgtctctgcatccgaacttttgaagagaaaaattcgagctagagggattcttaaagccttaagttacttgaaatctatgtatttgcaaccctttgtctctggaatcatattacactaaactggaatctcaggctgaatgagaataaccaagtggagtaaaaagaagaaaaccgtttcttgatcaccacttaattaacgatgctctttctccaaaggatcagcacgttcttcctctgagaacttgaaaatacaaatggaccccatgtttttttaagcattaccttttcttagaagactgccatcatcttttatagaggaattttttcactatgcattcggtggatctttataaaatactgaccttctaattagattcaggtcagtcttaattaaagggggaaaaaagcaacgcaagccaaccacaaaaacacatataccaatgaaagaaattggtttaaatttcacagcattaacattactttttaagtaaaacagttcattgaagaaagtatgtatgcagcagtggaacatgggcctgtgctttgcagcgattccaacatcctgtgcctgtcctggaaggggcgtgtccccaagagtgagaaggagaagcctgtgtgcaggagacgctactatgaggaaggctggctggccacgggcaacgggcgaggagtggttggggtgactttcacctctagtcactgtcgcagggacaggagtactccacagaggataaatttcaacctccggggccacaatagcgaggttgtgctggtgaggtggaatgagccctaccagaaactggccacgtgcgatgcggacggaggcatattcgtgtggattcagtacgagggcaggtggtctgtggagctggtcaacgaccgcggggcgcaggtgagtgatttcacgtggagccatgatggaactcaagcacttatttcctatcgagatgggtttgtcctggttgggtctgtcagtggacaaagacactggtcatccgaaatcaacttggaaagtcaaattacgtgtggcatatggactcctgacgaccaacaggtgctgtttggcacggccgatgggcaggtgattgtcatggattgccacggcagaatgctggcccacgtcctcttgcacgagtcagacggtgtcctcggcatgtcctggaactacccgatcttcctggtggaggacagcagcgagagcgacacggactcagatgactacgcccctccccaagatggtccggcagcatatcccatcccagtgcagaacatcaagcctctgctcaccgtcagcttcacctcgggagacatcagcttaatgaacaactacgatgacttgtctcccacggtcatccgctcagggctgaaagaggtggtagcccagtggtgcacacagggggacttgctggcagtcgctgggatggaacggcagacccagcttggtgagcttcccaatggtccccttctgaagagtgccatggtcaagttctacaatgttcgtggggagcacatcttcacactggacactctcgtgcagcgccccatcatctccatctgctggggtcaccgggattcgaggctgttgatggcatcaggaccagccctgtacgtggtgcgtgtggagcaccgggtgtccagcctgcagctgctgtgccagcaggccatcgccagcaccttgcgtgaggacaaggacgtcagcaagctgactctgcccccccgcctctgctcctacctctccactgccttcatccccaccatcaagcccccaattccagatccgaacaacatgagagactttgtcagctacccatcagccggcaacgagcggctgcactgcaccatgaagcgcacagaggacgacccggaggtgggcggcccgtgctacacgctctacctggagtacctgggcgggcttgtgcccatcctcaaagggcggcgcatcagcaagctgcggccagagttcgtcatcatggacccgcggacagatagcaaaccagatgaaatctatgggaacagcttgatttctactgtgatcgacagctgcaactgctcagactccagtgacattgagctgagtgatgactgggctgccaagaaatctcccaaaatctccagagctagcaaatcacccaaactcccaaggatcagcattgaggcccgcaagtcacccaagctgccccgggctgctcaggagctctcccggtccccacggttgcccctgcgcaagccctctgtgggctcgcccagcctgactcggagagagtttccttttgaagacatcactcagcacaactatcttgctcaggtcacgtctaatatctggggaaccaaatttaagattgtgggcttggctgctttcctgccaaccaacctcggtgcagtaatctataaaaccagcctcctgcatctccagccgcggcagatgaccatttatctcccagaagttcggaaaatttccatggactatattaatttacctgtcttcaacccaaatgttttcagtgaagatgaagatgatttaccaggtgatgcagtttggacggattgatggcagtgcgtacattctagacttccagtatccgttctcagccgtgcaggcctttgcagttgccctggccaacgtgactcagcgcctcaaatgaagagactggtgtggggaggagagagatgcagagagcctttggaagaggtcttcggagatgccagaggagccctctaggggtccgatgcctgggaggaccagaagccaacagcaaaactggaaaagcccggcaggcccaggagagggcgctgacctgtggtcgtcatttatttggttgggttttattaccttttattgtctgttcttcttttcttctttcatttcagtggcatttggaagcaaagagtgctaggcacctgctgttctttcaggaaacagcttggctgtggtaatgctctactgggcccttcagaatgaagacagtctgccttagagcctgctattcttttagacatagggaggatgcattatcctgtattctcctccaacatcaccactagcgtaaaagcaaaaagcttttacaaaacacagccaaaaattctcaagatgcaggttcttggggaatgggatggggacagcatttgatttacactgattatgttactccccaaaaggtgacttaattaataaagggcatttgggcagacacactgtgttggaccaacaaagtaggctctttacaggggtgttctcaccaggtagaaatgcgatttgctcactgaggatgttggggaagggacgaagggtaaagaagaaactgcacgtatacacaggttcacatcactctgcagacagcaatgtgactcagcgtgtgacttgtagcagcagtacgagggctacactcctctgctgaggatgtctacattgaaagcctccactagtttcatcgtttgtcaaagttccgtaggatcagtgatggtcattcagcatgactggttctgggagaaggtgagagacaaaaatggaaagatcctggcctgtggtagtggtagcagttttctcaaataatgtggtgacagtcactagatcctcacatgctgagaaacagcctctactctctctgccccttttactttttaatctggaatgcattactgtaaacatgatctttcccatgagataccatgttctatgccttcccattctaaaagtgtggacaacgcttgatttgaaaccactccttttctcctcttggctacattaaaattcagttgactacaaatgctttctatcaaattagaaatgtaaccaaaaaaatgttaagtgttcaccagggtattaaaatacagaggagtatggtcaaatctttgacaaaattttcatgatcttctctaacaaaaaaagttgtttattaactgtacagactgtttactaaggagctaaaccactgagaaaacgttattaaaattgtaatacctaggtagttggttgatcacagtttgttaattgtataaaaaaaaattacctagaatatctcttcccacttcctcgtcctcgtgagaacctgtgggcagtattcaagccctgatgacaaaacccagtgttttttgttgttgttttttgttgttgttttttgtttttgtttttgtttttctcagtcttacctgtgatgttgtttaggatcaggcccctctcctgggcctgctgtgcaggagcacaggaactatctgctggcgttgggttccaaatttgcattttatttggaaacagacaagtagaagatgctacagaaaagtattttcaaatttaaacgttttttaatcccctgttttagttaaaaaa

SEQ ID NO: 195801 - DNA, 11295 bp, Homo sapiens
  Payload ID: 18642
  Gene Name: tubby like protein 4
  Uniprot ID: Q9NRJ4
  ENST ID: ENST00000367097
  CDS Start-End: 1530-6161
tgtttgttgcactttatttttcagtgggtttggtgatttggacggattaaaattctagactgaaaagtaactcctactgtggttatggctagaggaaagcaagttcaagtatgatgggacaagtttgaataatgaactgattcctttgcctatcttaattaactgtatttgagaaattttaatttattattcccccccttttttcctgcatctataggataatattgtaaaatagcaattgaaaccaataattattaaataaatatcaaggaaaatccaagcaaagctttctttttgttggactagtggtgtggtgtttggagacagtctctgaatgtgaacaggaaagcacccatcagcaaaacactatcactctctagggagacagctgggggaatctgactctggcttctgcttttgttttaagggattaacttccctgtcaagtccaagaagacttgcgtatgagaagattacctgatggacttaattctaagattagcttttttcatcaagatggaaaaagatctttaggagcagaaaaggggagtgctaactgggggagcgagaagggagacgagcaaaagaaacaaaatcttgccacgtggctctgttttgtcagcaagaggatttaagactcacccagggcaaacactgggaccactgtaagagcgctggaacattctgcctcttgagtgaaggggccttctttctagcctctatggcactgaggggtgcgccggctggtggaggagcagtccgatggagccctgcgttccccggggacacagggccaagctttgaggtggaaagtttctggttctgaaacaacaaggagagagtctgtttttcttcctaaaatttggactcttgtctgcacaaactctggtctgttttgcacggtttgtgtgcctttttttccctttatgcaatctttttcagctttagcagcagaaatttgtctagttcaggaaacatgctagagggtggcttcagaaggaagatgatcctgtgtattctgtctctgcatccgaacttttgaagagaaaaattcgagctagagggattcttaaagccttaagttacttgaaatctatgtatttgcaaccctttgtctctggaatcatattacactaaactggaatctcaggctgaatgagaataaccaagtggagtaaaaagaagaaaaccgtttcttgatcaccacttaattaacgatgctctttctccaaaggatcagcacgttcttcctctgagaacttgaaaatacaaatggaccccatgtttttttaagcattaccttttcttagaagactgccatcatcttttatagaggaattttttcactatgcattcggtggatctttataaaatactgaccttctaattagattcaggtcagtcttaattaaagggggaaaaaagcaacgcaagccaaccacaaaaacacatataccaatgaaagaaattggtttaaatttcacagcattaacattactttttaagtaaaacagttcattgaagaaagtatgtatgcagcagtggaacatgggcctgtgctttgcagcgattccaacatcctgtgcctgtcctggaaggggcgtgtccccaagagtgagaaggagaagcctgtgtgcaggagacgctactatgaggaaggctggctggccacgggcaacgggcgaggagtggttggggtgactttcacctctagtcactgtcgcagggacaggagtactccacagaggataaatttcaacctccggggccacaatagcgaggttgtgctggtgaggtggaatgagccctaccagaaactggccacgtgcgatgcggacggaggcatattcgtgtggattcagtacgagggcaggtggtctgtggagctggtcaacgaccgcggggcgcaggtgagtgatttcacgtggagccatgatggaactcaagcacttatttcctatcgagatgggtttgtcctggttgggtctgtcagtggacaaagacactggtcatccgaaatcaacttggaaagtcaaattacgtgtggcatatggactcctgacgaccaacaggtgctgtttggcacggccgatgggcaggtgattgtcatggattgccacggcagaatgctggcccacgtcctcttgcacgagtcagacggtgtcctcggcatgtcctggaactacccgatcttcctggtggaggacagcagcgagagcgacacggactcagatgactacgcccctccccaagatggtccggcagcatatcccatcccagtgcagaacatcaagcctctgctcaccgtcagcttcacctcgggagacatcagcttaatgaacaactacgatgacttgtctcccacggtcatccgctcagggctgaaagaggtggtagcccagtggtgcacacagggggacttgctggcagtcgctgggatggaacggcagacccagcttggtgagcttcccaatggtccccttctgaagagtgccatggtcaagttctacaatgttcgtggggagcacatcttcacactggacactctcgtgcagcgccccatcatctccatctgctggggtcaccgggattcgaggctgttgatggcatcaggaccagccctgtacgtggtgcgtgtggagcaccgggtgtccagcctgcagctgctgtgccagcaggccatcgccagcaccttgcgtgaggacaaggacgtcagcaagctgactctgcccccccgcctctgctcctacctctccactgccttcatccccaccatcaagcccccaattccagatccgaacaacatgagagactttgtcagctacccatcagccggcaacgagcggctgcactgcaccatgaagcgcacagaggacgacccggaggtgggcggcccgtgctacacgctctacctggagtacctgggcgggcttgtgcccatcctcaaagggcggcgcatcagcaagctgcggccagagttcgtcatcatggacccgcggacagatagcaaaccagatgaaatctatgggaacagcttgatttctactgtgatcgacagctgcaactgctcagactccagtgacattgagctgagtgatgactgggctgccaagaaatctcccaaaatctccagagctagcaaatcacccaaactcccaaggatcagcattgaggcccgcaagtcacccaagctgccccgggctgctcaggagctctcccggtccccacggttgcccctgcgcaagccctctgtgggctcgcccagcctgactcggagagagtttccttttgaagacatcactcagcacaactatcttgctcaggtcacgtctaatatctggggaaccaaatttaagattgtgggcttggctgctttcctgccaaccaacctcggtgcagtaatctataaaaccagcctcctgcatctccagccgcggcagatgaccatttatctcccagaagttcggaaaatttccatggactatattaatttacctgtcttcaacccaaatgttttcagtgaagatgaagatgatttaccagtgacaggagcatctggtgtccctgagaacagcccaccttgtaccgtgaacatccctattgcaccgatccacagctcggctcaggctatgtcccccacgcagagcatagggctggtgcagtccctactggccaatcagaatgtgcagctagatgtcctgaccaaccagacgacagctgtagggacagcagaacatgcaggtgacagtgccacccagtacccagtctccaaccggtactccaatcctggacaggtgattttcggaagcgtggaaatgggccgcatcattcagaacccccctccactgtccctgcctcccccgccgcaggggcccatgcagctgtccacggtgggccatggagaccgagaccacgaacacctgcagaagtcagccaaggccctgcggccaacaccgcagctggcagctgagggggacgcagtggtctttagtgccccccaggaggtccaggtgacgaagataaaccctccacccccgtacccaggaaccatccccgctgcccccaccacagcagcacccccgccccctctgccgcccccacagcccccagtggatgtgtgcttgaagaagggcgacttctccctctaccccacgtcagtgcactaccagacccccctgggctatgagaggatcaccaccttcgacagcagtggcaacgtggaggaggtgtgccggccccgcacccggatgctgtgctcccagaacacgtacaccctccccggcccgggtagctctgccaccttgaggctcacggccactgagaagaaggtccctcagccctgcagcagtgccaccctgaaccgcctgaccgtccctcgctactccatccccaccggggacccacccccgtatcctgaaattgccagccagctggcccaggggcggggggctgcccagaggtccgacaatagcctcatccacgctaccctgcggaggaacaaccgtgaggctacgctcaagatggcccagctggccgacagcccgcgggcccccctgcagcccctggccaagtccaagggcgggcccgggggggtggtgacacagctcccagcgcggcccccacctgccctgtacacctgcagtcagtgcagtggcacagggcccagctcacagcccggagcctccctggcccataccgccagcgcctccccgttggcctcccagtcctcctacagcctcctgagcccacccgacagcgcccgcgaccgcaccgactacgtcaactcggccttcacggaggacgaggccctgtcccagcactgtcagcttgagaagcccttgaggcaccctcccctgcctgaagctgctgtcaccctgaaacggccacccccttaccagtgggaccccatgctgggtgaggatgtttgggttcctcaagaaaggacagcacagacttcagggcccaaccccttaaaactgtcctctctgatgctgagtcagggccagcacctggacgtgtcccgactgcccttcatctcccccaagtctcctgccagccccactgccactttccaaacaggctatgggatgggagtgccatatccaggaagctataacaacccccctttgcctggagtgcaggctccctgctctcccaaagatgccctgtccccaacgcagtttgcacaacaggagcctgctgtggtccttcagccgctgtacccacccagcctctcctattgcaccctgccccccatgtacccaggaagcagcacgtgctctagtttacagctgccacctgtcgccttgcatccatggagttcctacagcgcctgcccgcccatgcagaacccccagggcactctccccccaaagccacacttggtggtggagaagccccttgtgtccccaccacctgccgacctccaaagccacttgggcacagaggtgatggtagagactgcagacaacttccaggaagtcctctccctgaccgaaagcccagtcccccagcggacagaaaaatttggaaagaagaaccggaagcgcctggacagccgagcagaagaaggcagcgttcaggccatcactgagggcaaagtgaagaaggaggctaggactttgagtgactttaattccctaatctccagcccacacctggggagagagaagaagaaagtgaagagtcagaaagaccaactgaagtcaaagaagttgaataagacaaacgagttccaggacagctccgagagcgagcctgagctgttcatcagcggggatgagctcatgaaccagagccagggcagcagaaagggctggaaaagcaagcgctccccacgggccgccggcgagctggaggaggccaagtgccggcgggccagtgagaaggaggacgggcggctgggcagccaaggcttcgtgtacgtgatggccaacaagcagccgctgtggaacgaggccacccaggtctaccagctggacttcggggggcgggtgacccaggagtccgccaagaacttccagattgagttagaggggcggcaggtgatgcagtttggacggattgatggcagtgcgtacattctagacttccagtatccgttctcagccgtgcaggcctttgcagttgccctggccaacgtgactcagcgcctcaaatgaagagactggtgtggggaggagagagatgcagagagcctttggaagaggtcttcggagatgccagaggagccctctaggggtccgatgcctgggaggaccagaagccaacagcaaaactggaaaagcccggcaggcccaggagagggcgctgacctgtggtcgtcatttatttggttgggttttattaccttttattgtctgttcttcttttcttctttcatttcagtggcatttggaagcaaagagtgctaggcacctgctgttctttcaggaaacagcttggctgtggtaatgctctactgggcccttcagaatgaagacagtctgccttagagcctgctattcttttagacatagggaggatgcattatcctgtattctcctccaacatcaccactagcgtaaaagcaaaaagcttttacaaaacacagccaaaaattctcaagatgcaggttcttggggaatgggatggggacagcatttgatttacactgattatgttactccccaaaaggtgacttaattaataaagggcatttgggcagacacactgtgttggaccaacaaagtaggctctttacaggggtgttctcaccaggtagaaatgcgatttgctcactgaggatgttggggaagggacgaagggtaaagaagaaactgcacgtatacacaggttcacatcactctgcagacagcaatgtgactcagcgtgtgacttgtagcagcagtacgagggctacactcctctgctgaggatgtctacattgaaagcctccactagtttcatcgtttgtcaaagttccgtaggatcagtgatggtcattcagcatgactggttctgggagaaggtgagagacaaaaatggaaagatcctggcctgtggtagtggtagcagttttctcaaataatgtggtgacagtcactagatcctcacatgctgagaaacagcctctactctctctgccccttttactttttaatctggaatgcattactgtaaacatgatctttcccatgagataccatgttctatgccttcccattctaaaagtgtggacaacgcttgatttgaaaccactccttttctcctcttggctacattaaaattcagttgactacaaatgctttctatcaaattagaaatgtaaccaaaaaaatgttaagtgttcaccagggtattaaaatacagaggagtatggtcaaatctttgacaaaattttcatgatcttctctaacaaaaaaagttgtttattaactgtacagactgtttactaaggagctaaaccactgagaaaacgttattaaaattgtaatacctaggtagttggttgatcacagtttgttaattgtataaaaaaaaattacctagaatatctcttcccacttcctcgtcctcgtgagaacctgtgggcagtattcaagccctgatgacaaaacccagtgttttttgttgttgttttttgttgttgttttttgtttttgtttttgtttttctcagtcttacctgtgatgttgtttaggatcaggcccctctcctgggcctgctgtgcaggagcacaggaactatctgctggcgttgggttccaaatttgcattttatttggaaacagacaagtagaagatgctacagaaaagtattttcaaatttaaacgttttttaatcccctgttttagttaaaaaattggaaaagaaaccgacccatttttttcccagatcaagatgacatgacatcactcccaattctctccaaaccccagagaaatactgacgaagttttctgatgtggcaaaggatatttcccatctaataccagtttctcatttatatttaacgtattggacctgatatttttagtgggtgcattcttccagaaagaattcagcaatgttatcagaattaattcttttatatgagtttatgtagcttgatatggtgtttcagtgcttattggttgtgcaataatggttatagcctgttagataatctaaatgcaattcccctgttttgtcgtttaggagataattatttatcttgcttttcatagtgttcttaggaattattttgttgttacgttttggtgagttatacccattttatttatttagaaaaatagtatctttgttaacgacttacatggtcacagtatattttgctgcaagaaataaagaggatatgatagaaggtttttttttttttttttttttttttttgagacggagtcccactcttgtcgcccaactagagtgtagtggcacaatctcggctccccacaacctctgactccagggttcaggtgattattttgcctcagcctcccaagcagctgggattatagacacccgccaacacgccaggctaatgtttttgtatttttaatagagatggggttttgccatgttggccaggctggtcttgaactcctgacctcaggtgatccgcccgcctcggcctcccaaagtgctgggattacagacgtgagccaccactcccggcccatagaaggttttttgctggataatttgtaacttttctaattgggaaaaaattcctattaatcacttaaaaatttttttttgtattttgtgttattgattatatacaaaggagactttttttttgagataacactcaaatagtattctcttcttttgaaaattttatttttatctgaaaataacagttgatctgaaataaaaaggggagacctattagaatgagagtagccaaggaaagagttactaggtaataagcttcactttttgtgttctaattgtttttgagatataaagaccctgaaaaagcccattttagaacctgtttaataagagcaaatataggggaaaatctttgaaatgaaagctacaaatacatgtgagaagaaaaaaatggatttttttagcaaataattaactaagcttctaaatgcctagctccctcccccaaaggcgctttcccccgatggaggcacaggcttctgtctcggatgtttggcgcacgtgagtttgtatgagtttgtaccggagtgaccccggcagccactgcccacctcccctctacccaggggcctgaaaagaggggctgccctcctgcgccaaggcagacacaagctgcgggctgtgcggtcctagtagtgtgacgtttcagttaatagtggtggtcttattttcaactatgctttcattcagtcagtctctgttgactaaatacgacgaaaattcatactttatgcaggagatttctaaaaatttaatgtttattaatagtttatgaatatcaagatacctcattgaatccctaaatttaaaagcagtccagtaaaaggttaactgtataaagaatctatgactttttgagggaagtgtgatatattaacaaatataaccaattctaaatttgttttagctctaacctcatcaaaccaaaggcacagatttgtgtacaatatacccattgaatgtatatcctgagaaaaattggggccaaagaagcaggaaaatctcaaagctctaatggcagcataaatcaaagaatttcacaggctagtgtttttatccatagccattgctcccttgtcaagtgtctcacaaggacatggaagaatgtgttatgttcatcttgtaatcatagcaaaaagtctgcaaaccccagggtcaagcctgctctgccacagggttggatggtgaccttgggcaagtccctggggctggctaggcctccacttgtccatctgtgaaatgaaaggatcagcctggacagccctctaaactcccttacagctctcagcctaagagcgcagcactgaacagcctcatcattccacttttcatgggaaatatatttcacaccattgcctttgtgtagagaaatatttcttttcctgtgttaatgagctatgtactgaatataaaccagtgcatttaaagtaatatcttttgtgcacctctaaatgtgtttggaattgtgtttgttctcatagaatatacaaaagtactgattctaggtaagaaggagtctccacgggtgtgccctgctcagctggatgtccatgagaacagccatgaaataagtcactacttgtccccaaaaccacaggaatatatacctaggtcacctcaaattcctgagtgtgctctgccatgttacacggtcttcaaattgaaaaggtttcttgaaaaggaaagtttggcccagcaactggagaaggagtccatggtgtcgctgtgtgcctgtatcatttggccaagtcaatggttgtaagcaaagttagtggagacaaaaatgtgtccaaaatgtcgtttgagttcctgggatttctgtaatagcacacaactcagaactcttcagcatttgtgtgattccttacctctggctgataaaactctaatgggttgtggcttactttgtttccattttctttggctttgtgcaatttttgtgtaactttacttgtacctatattttctgtttacagttctttttaaggggaggggtagggttctaagatcttgttgtttattgtagataaaaattttttcgtgttgtagaaaagcatgggttatgcgtttgactgaaaaagacactgtattatttaccaaaggggtattgtttttgcatttgtttataaatgcattattttggtactgtaaatttggacataatttctgagtttattactactggcattttctttttcccttttttttttttttaaccgtaagtgcacgatgcaggtgcataggccccagaccaaactagaccaccagcatgttcatgtccagacctcggcagtggcgtgcactgcttgtgcacctcagttcctccagtgttggtttgtttgttttttaattcagcatcctgctggttttactttccaagcaagatctgttgcgactcccaaatgcgttttaatgagctcatccttatttgcctttcttcttacgtattttgtgtattagattgtgcaggagatattctagaaggcattaatggtttgcattcaaaacgatgtggtttgtccaagttattttctgtctttattactgagacggattaatctccttatttttttcttgatgatttgaagttgtaagagttgtccagctattgcttaataaaattttgcagatcaaaaaa

SEQ ID NO: 195802 - DNA, 804 bp, Homo sapiens
  Payload ID: 18642
  Gene Name: tubby like protein 4
  ENST ID: ENST00000613390
  CDS Start-End: 1-650
gtccccttctgaagagtgccatggtcaagttctacaatgttcgtggggagcacatcttcacactggacactctcgtgcagcgccccatcatctccatctgctggggtcaccgggattcgaggctgttgatggcatcaggaccagccctgtacgtggtgcgtgtggagcaccgggtgtccagcctgcagctgctgtgccagcaggccatcgccagcaccttgcgtgaggacaaggacgtcagcaagctgactctgcccccccgcctctgctcctacctctccactgccttcatccccaccatcaagcccccaattccagatccgaacaacatgagagactttgtcagctacccatcagccggcaacgagcggctgcactgcaccatgaagcgcacagaggacgacccggaggtgggcggcccgtgctacacgctctacctggagtacctgggcgggcttgtgcccatcctcaaagggcggcgcatcagcaagctgcggccagagttcgtcatcatggacccgcggacagatagcaaaccaggatcagcattgaggcccgcaagtcacccaagctgccccgggctgctcaggagctctcccggtccccacggttgcccctgcgcaagccctctgtgggctcgcccagcctgactcggagagagtttccttttgaagacatcactcagcacaactatcttgctcaggtcacgtctaatatctggggaaccaaatttaagattgtgggcttggctgctttcctgccaaccaacctcggtgcagtaatctataaaaccagcctcctgca

SEQ ID NO: 195803 - DNA, 8604 bp, Homo sapiens
  Payload ID: 18643
  Gene Name: tuberous sclerosis 1
  Uniprot ID: Q92574
  ENST ID: ENST00000298552
  CDS Start-End: 223-3717
gtgctgtacgtccaagatggcggcgccctgtaggctggagggactgtgaggtaaacagctgagggggaggagacggtggtgaccatgaaagacaccaggttgacagcactggaaactgaagtaccagttgtcgctagaacagtttggtagtggccccaatgaagaaccttcagaacctgtagcacacgtcctggagccagcacagcgccttcgagcgagagaatggcccaacaagcaaatgtcggggagcttcttgccatgctggactcccccatgctgggtgtgcgggacgacgtgacagctgtctttaaagagaacctcaattctgaccgtggccctatgcttgtaaacaccttggtggattattacctggaaaccagctctcagccggcattgcacatcctgaccaccttgcaagagccacatgacaagcacctcttggacaggattaacgaatatgtgggcaaagccgccactcgtttatccatcctctcgttactgggtcatgtcataagactgcagccatcttggaagcataagctctctcaagcacctcttttgccttctttactaaaatgtctcaagatggacactgacgtcgttgtcctcacaacaggcgtcttggtgttgataaccatgctaccaatgattccacagtctgggaaacagcatcttcttgatttctttgacatttttggccgtctgtcatcatggtgcctgaagaaaccaggccacgtggcggaagtctatctcgtccatctccatgccagtgtgtacgcactctttcatcgcctttatggaatgtacccttgcaacttcgtctcctttttgcgttctcattacagtatgaaagaaaacctggagacttttgaagaagtggtcaagccaatgatggagcatgtgcgaattcatccggaattagtgactggatccaaggaccatgaactggaccctcgaaggtggaagagattagaaactcatgatgttgtgatcgagtgtgccaaaatctctctggatcccacagaagcctcatatgaagatggctattctgtgtctcaccaaatctcagcccgctttcctcatcgttcagccgatgtcaccaccagcccttatgctgacacacagaatagctatgggtgtgctacttctaccccttactccacgtctcggctgatgttgttaaatatgccagggcagctacctcagactctgagttccccatcgacacggctgataactgaaccaccacaagctactctttggagcccatctatggtttgtggtatgaccactcctccaacttctcctggaaatgtcccacctgatctgtcacacccttacagtaaagtctttggtacaactgcaggtggaaaaggaactcctctgggaaccccagcaacctctcctcctccagccccactctgtcattcggatgactacgtgcacatttcactcccccaggccacagtcacaccccccaggaaggaagagagaatggattctgcaagaccatgtctacacagacaacaccatcttctgaatgacagaggatcagaagagccacctggcagcaaaggttctgtcactctaagtgatcttccagggtttttaggtgatctggcctctgaagaagatagtattgaaaaagataaagaagaagctgcaatatctagagaactttctgagatcaccacagcagaggcagagcctgtggttcctcgaggaggctttgactctcccttttaccgagacagtctcccaggttctcagcggaagacccactcggcagcctccagttctcagggcgccagcgtgaaccctgagcctttacactcctccctggacaagcttgggcctgacacaccaaagcaagcctttactcccatagacctgccctgcggcagtgctgatgaaagccctgcgggagacagggaatgccagacttctttggagaccagtatcttcactcccagtccttgtaaaattccacctccgacgagagtgggctttggaagcgggcagcctcccccgtatgatcatctttttgaggtggcattgccaaagacagcccatcattttgtcatcaggaagactgaggagctgttaaagaaagcaaaaggaaacacagaggaagatggtgtgccctctacctccccaatggaagtgctggacagactgatacagcagggagcagacgcgcacagcaaggagctgaacaagttgcctttacccagcaagtctgtcgactggacccactttggaggctctcctccttcagatgagatccgcaccctccgagaccagttgcttttactgcacaaccagttactctatgagcgttttaagaggcagcagcatgccctccggaacaggcggctcctccgcaaggtgatcaaagcagcagctctggaggaacataatgctgccatgaaagatcagttgaagttacaagagaaggacatccagatgtggaaggttagtctgcagaaagaacaagctagatacaatcagctccaggagcagcgtgacactatggtaaccaagctccacagccagatcagacagctgcagcatgaccgagaggaattctacaaccagagccaggaattacagacgaagctggaggactgcaggaacatgattgcggagctgcggatagaactgaagaaggccaacaacaaggtgtgtcacactgagctgctgctcagtcaggtttcccaaaagctctcaaacagtgagtcggtccagcagcagatggagttcttgaacaggcagctgttggttcttggggaggtcaacgagctctatttggaacaactgcagaacaagcactcagataccacaaaggaagtagaaatgatgaaagccgcctatcggaaagagctagaaaaaaacagaagccatgttctccagcagactcagaggcttgatacctcccaaaaacggattttggaactggaatctcacctggccaagaaagaccaccttcttttggaacagaagaaatatctagaggatgtcaaactccaggcaagaggacagctgcaggccgcagagagcaggtatgaggctcagaaaaggataacccaggtgtttgaattggagatcttagatttatatggcaggttggagaaagatggcctcctgaaaaaacttgaagaagaaaaagcagaagcagctgaagcagcagaagaaaggcttgactgttgtaatgacgggtgctcagattccatggtagggcacaatgaagaggcatctggccacaacggtgagaccaagacccccaggcccagcagcgcccggggcagtagtggaagcagaggtggtggaggcagcagcagcagcagcagcgagctttctaccccagagaaacccccacaccagagggcaggcccattcagcagtcggtgggagacgactatgggagaagcgtctgccagcatccccaccactgtgggctcacttcccagttcaaaaagcttcctgggtatgaaggctcgagagttatttcgtaataagagcgagagccagtgtgatgaggacggcatgaccagtagcctttctgagagcctaaagacagaactgggcaaagacttgggtgtggaagccaagattcccctgaacctagatggccctcacccgtctcccccgaccccggacagtgttggacagctacatatcatggactacaatgagactcatcatgaacacagctaaggaatgatggtcaatcagtgttaacttgcatattgttggcacagaacaggaggtgtgaatgcacgtttcaaagctttcctgtttccagggtctgagtgcaagttcatgtgtggaaatgggacggaggtcctttggacagctgactgaatgcagaacggtttttggatctggcattgaaatgcctcttgaccttcccctccacccgccctaaccccctctcatttacctcgcagtgtgttctaatccaagggccagttggtgttcctcagtagctttactttcttcctttcccccccaaatggttgcgtcctttgaacctgtgcaatatgaggccaaatttaatctttgagtctaacacaccactttctgctttcccgaagttcagataactgggttggctctcaattagaccaggtagtttgttgcattgcaggtaagtctggttttgtcccttccaggaggacatagcctgcaaagctggttgtctttacatgaaagcgtttacatgagactttccgactgcttttttgattctgaagttcagcatctaaagcagcaggtctagaagaacaacggtttattcatacttgcattcttttggcagttctgataagcttcctagaaagttctgtgtaaacagaagcctgtttcagaaatctggagctggcactgtggagaccacacaccctttgggaaagctcttgtctcttcttcccccactacctcttatttatttggtgtttgcttgaatgctggtactattgtgaccacaggctggtgtgtaggtggtaaaacctgttctccataggagggaaggagcagtcactgggagaggttacccgagaagcacttgagcatgaggaactgcacctttaggccatctcagcttgctgggccttttgttaaacccttctgtctactggcctccctttgtgtgcatacgcctcttgttcatgtcagcttatatgtgacactgcagcagaaaggctctgaaggtccaaagagtttctgcaaagtgtatgtgaccatcatttcccaggccattagggttgcctcactgtagcaggttctaggctaccagaagaggggcagctttttcataccaattccaactttcaggggctgactctccagggagctgatgtcatcacactctccatgttagtaatggcagagcagtctaaacagagtccgggagaatgctggcaaaggctggctgtgtatacccactaggctgccccacgtgctcccgagagatgacactagtcagaaaattggcagtggcagagaatccaaactcaacaagtgctcctgaaagaaacgctagaagcctaagaactgtggtctggtgttccagctgaggcagggggatttggtaggaaggagccagtgaacttggctttcctgtttctatctttcattaaaaagaatagaaggattcagtcataaagaggtaaaaaactgtcacggtacgaaatcttagtgcccacggaggcctcgagcagagagaatgaaagtcttttttttttttttttttttttagcatggcaataaatattctagcatccctaactaaaggggactagacagttagagactctgtcaccctagctataccagcagaaaacctgttcaggcaggctttctgggtgtgactgattcccagcctgtggcagggcgtggtcccaactactcagcctagcacaggctggcagttggtactgaattgtcagatgtggagtattagtgacaccacacatttaattcagctttgtccaaaggaaagcttaaaacccaatacagtctagtttcctggttccgttttagaaaaggaaaacgtgaacaaacttagaaagggaaggaaatcccatcagtgaatcctgaaactggttttaagtgctttccttctcctcatgcccaagagatctgtgccatagaacaagataccaggcacttaaagccttttcctgaattggaaaggaaaagaggcccaagtgcaaaagaaaaaacattttagaaacggacagcttataaaaataaagggaagaaaggaggcagcatggagagaggcctgtgctagaagctccatggacgtgtctgcacagggtcctcagctcatccatgcggcctgggtgtccttttactcagctttataacaaatgtggctccaagctcaggtgcctttgagttctaggaggctgtgggttttattcaactacggttgggagaatgagacctggagtcatgttgaaggtgcccaacctaaaaatgtaggctttcatgttgcaaagaactccagagtcagtagttaggtttggtttggttttggacatgataaacctgccaagagtcaacaggtcacttgatcatgctgcagtgggtagttctaaggatggaaaggtgacagtattactctcgagaggcaattcagtcctgggcaaaggtattagtacaataagcgttaagggcagagtctaccttgaaaccaattaagcagcttggtattcataaatattgggattggatggcctccatccagaaatcactatgggtgagcatacctgtctcagctgtttggccaatgtgcataacctactcggatccccacctgacactaaccagagtcagcacaggccccgaggagcccgaagtctgctgctgtgcagcatggaattcctttaaaaaggtgcactacagttttagcggggagggggataggaagacgcagagcaaatgagctccggagtccctgcaggtgaataaacacacagatctgcatctgatagaactttgatggattttcaaaaagccgttgacaaggctctgctatacagtctataaaaattgttattatgggattggaagaaacacgtggtcatgaatagaaaaaaaacaaacccaaaggtaggaaggtcaaggtcatttcttagatggagaagttgtgaaagatgtccttggagatgagttttaggaccagcattactaaggcaggtgggcagacagtgacctctctaggtgtgtccacagagtttttcaggagagaaaactgcctgacctttgggactaagctgcggaatcttcttactaagcttgaagagtggagaggcgagaggtgagctactttgtgagccaaagcttatgtgacatggttggggaaacagtccaaactgttctgagaaggtgaactgttacgacccaggacaattagaaaaattcacccaccatgccgcacattactgggtaaaagcagggcagcagggaacaaaactccagactcttgggccgtccccatttgcaacagcacacatagtttctggtatatttgttgggaaagataaaactctagcagttgttgaggggaggatgtataaaatggtcatggggatgaaaggatctctgagaccacagaggctcagactcactgttaagaatagaaaactgggtatgcgtttcatgtagccagcagaactgaagtgtgctgtgacaagccaatgtgaatttctaccaaatagtagagcataccacttgaagaaggaaagaaccgaagagcaaacaaaagttctgcgtaatgagactcaccttttctcgctgaaagcactaagaggtgggaggaggcctgcacaggctggaggagggtttgggcagagcgaagacccggccaggaccttggtgagatggggtgccgcccacctcctgcggatactcttggagagttgttcccccagggggctctgccccacctggagaaggaagctgcctggtgtggagtgactcaaatcagtatacctatctgctgcaccttcactctccagggtacatgctttaaaaccgacccgcaacaagtattggaaaaatgtatccagtctgaagatgtttgtgtatctgtttacatccagagttctgtgacacatgccccccagattgctgcaaagatcccaaggcattgattgcacttgattaagcttttgtctgtaggtgaaagaacaagtttaggtcgaggactggcccctaggctgctgctgtgacccttgtcccatgtggcttgtttgcctgtccgggactcttcgatgtgcccaggggagcgtgttcctgtctcttccatgccgtcctgcagtccttatctgctcgcctgagggaagagtagctgtagctacaagggaagcctgcctggaagagccgagcacctgtgcccatggcttctggtcatgaaacgagttaatgatggcagaggagcttcctccccacttcgcagcgccacattatccatcctctgagataagtaggctggtttaaccattggaatggacctttcagtggaaaccctgagagtctgagaacccccagaccaacccttccctccctttccccacctcttacagtgtttggacaggagggtatggtgctgctctgtgtagcaagtactttggcttatgaaagaggcagccacgcattttgcactaggaagaatcagtaatcacttttcagaagacttctatggaccacaaatatattacggaggaacagattttgctaagacataatctagttttataactcaatcatgaatgaaccatgtgtggcaaacttgcagtttaaaggggtcccatcagtgaaagaaactgattttttttaacggactgcttttagttaaattgaagaaagtcagctcttgtcaaaaggtctaaactttcccgcctcaatcctaaaagcatgtcaacaatccacatcagatgccataaatatgaactgcaggataaaatggtacaatcttagtgaatgggaattggaatcaaaagagtttgctgtccttcttagaatgttctaaaatgtcaaggcagttgcttgtgtttaactgtgaacaaataaaaatttattgttttgcactac

SEQ ID NO: 195804 - DNA, 1507 bp, Homo sapiens
  Payload ID: 18643
  Gene Name: tuberous sclerosis 1
  ENST ID: ENST00000403810
  CDS Start-End: 235-1335
acgacgggggaggtgctgtacgtccaagatggcggcgccctgtaggctggagggactgtgaggtaaacagctgagggggaggagacggtggtgaccatgaaagacaccaggttgacagcactggaaactgaagtaccagttgtcgctagaacagtttggtagtggccccaatgaagaaccttcagaacctgtagcacacgtcctggagccagcacagcgccttcgagcgagagaatggcccaacaagcaaatgtcggggagcttcttgccatgctggactcccccatgctgggtgtgcgggacgacgtgacagctgtctttaaagagaacctcaattctgaccgtggccctatgcttgtaaacaccttggtggattattacctggaaaccagctctcagccggcattgcacatcctgaccaccttgcaagagccacatgacaagcacctcttggacaggattaacgaatatgtgggcaaagccgccactcgtttatccatcctctcgttactgggtcatgtcataagactgcagccatcttggaagcataagctctctcaagcacctcttttgccttctttactaaaatgtctcaagatggacactgacgtcgttgtcctcacaacaggcgtcttggtgttgataaccatgctaccaatgattccacagtctgggaaacagcatcttcttgatttctttgacatttttggccgtctgtcatcatggtgcctgaagaaaccaggccacgtggcggaagtctatctcgtccatctccatgccagtgtgtacgcactctttcatcgcctttatggaatgtacccttgcaacttcgtctcctttttgcgttctcattacagtatgaaagaaaacctggagacttttgaagaagtggtcaagccaatgatggagcatgtgcgaattcatccggaattagtgactggatccaaggaccatgaactggaccctcgaaggtggaagagattagaaactcatgatgttgtgatcgagtgtgccaaaatctctctggatcccacagaagcctcatatgaagatggctattctgtgtctcaccaaatctcagcccgctttcctcatcgttcagccgatgtcaccaccagcccttatgctgacacacagaatagctatgggtgtgctacttctaccccttactccacgtctcggctgatgttgttaaatatgccagggcagctacctcagactctgagttccccatcgacacggctgataactgaaccaccacaagtatggtgtcaactagtgtgcctgctctctcctctgctttctggtgaagctgaccctttgggtcagatttagtatgtggttgggaaaatttcacactgctcatttcaggagtcacttttaaggatccatgatattagcaaagaaagttactgttgcctcttagattcatcttgaagtcttgatttacaaaatgcaacttgtttcttgatacgcttttaataagatgcctttttctagatgaaaa

SEQ ID NO: 195805 - DNA, 8463 bp, Homo sapiens
  Payload ID: 18643
  Gene Name: tuberous sclerosis 1
  Uniprot ID: Q92574
  ENST ID: ENST00000440111
  CDS Start-End: 84-3578
cagtttggtagtggccccaatgaagaaccttcagaacctgtagcacacgtcctggagccagcacagcgccttcgagcgagagaatggcccaacaagcaaatgtcggggagcttcttgccatgctggactcccccatgctgggtgtgcgggacgacgtgacagctgtctttaaagagaacctcaattctgaccgtggccctatgcttgtaaacaccttggtggattattacctggaaaccagctctcagccggcattgcacatcctgaccaccttgcaagagccacatgacaagcacctcttggacaggattaacgaatatgtgggcaaagccgccactcgtttatccatcctctcgttactgggtcatgtcataagactgcagccatcttggaagcataagctctctcaagcacctcttttgccttctttactaaaatgtctcaagatggacactgacgtcgttgtcctcacaacaggcgtcttggtgttgataaccatgctaccaatgattccacagtctgggaaacagcatcttcttgatttctttgacatttttggccgtctgtcatcatggtgcctgaagaaaccaggccacgtggcggaagtctatctcgtccatctccatgccagtgtgtacgcactctttcatcgcctttatggaatgtacccttgcaacttcgtctcctttttgcgttctcattacagtatgaaagaaaacctggagacttttgaagaagtggtcaagccaatgatggagcatgtgcgaattcatccggaattagtgactggatccaaggaccatgaactggaccctcgaaggtggaagagattagaaactcatgatgttgtgatcgagtgtgccaaaatctctctggatcccacagaagcctcatatgaagatggctattctgtgtctcaccaaatctcagcccgctttcctcatcgttcagccgatgtcaccaccagcccttatgctgacacacagaatagctatgggtgtgctacttctaccccttactccacgtctcggctgatgttgttaaatatgccagggcagctacctcagactctgagttccccatcgacacggctgataactgaaccaccacaagctactctttggagcccatctatggtttgtggtatgaccactcctccaacttctcctggaaatgtcccacctgatctgtcacacccttacagtaaagtctttggtacaactgcaggtggaaaaggaactcctctgggaaccccagcaacctctcctcctccagccccactctgtcattcggatgactacgtgcacatttcactcccccaggccacagtcacaccccccaggaaggaagagagaatggattctgcaagaccatgtctacacagacaacaccatcttctgaatgacagaggatcagaagagccacctggcagcaaaggttctgtcactctaagtgatcttccagggtttttaggtgatctggcctctgaagaagatagtattgaaaaagataaagaagaagctgcaatatctagagaactttctgagatcaccacagcagaggcagagcctgtggttcctcgaggaggctttgactctcccttttaccgagacagtctcccaggttctcagcggaagacccactcggcagcctccagttctcagggcgccagcgtgaaccctgagcctttacactcctccctggacaagcttgggcctgacacaccaaagcaagcctttactcccatagacctgccctgcggcagtgctgatgaaagccctgcgggagacagggaatgccagacttctttggagaccagtatcttcactcccagtccttgtaaaattccacctccgacgagagtgggctttggaagcgggcagcctcccccgtatgatcatctttttgaggtggcattgccaaagacagcccatcattttgtcatcaggaagactgaggagctgttaaagaaagcaaaaggaaacacagaggaagatggtgtgccctctacctccccaatggaagtgctggacagactgatacagcagggagcagacgcgcacagcaaggagctgaacaagttgcctttacccagcaagtctgtcgactggacccactttggaggctctcctccttcagatgagatccgcaccctccgagaccagttgcttttactgcacaaccagttactctatgagcgttttaagaggcagcagcatgccctccggaacaggcggctcctccgcaaggtgatcaaagcagcagctctggaggaacataatgctgccatgaaagatcagttgaagttacaagagaaggacatccagatgtggaaggttagtctgcagaaagaacaagctagatacaatcagctccaggagcagcgtgacactatggtaaccaagctccacagccagatcagacagctgcagcatgaccgagaggaattctacaaccagagccaggaattacagacgaagctggaggactgcaggaacatgattgcggagctgcggatagaactgaagaaggccaacaacaaggtgtgtcacactgagctgctgctcagtcaggtttcccaaaagctctcaaacagtgagtcggtccagcagcagatggagttcttgaacaggcagctgttggttcttggggaggtcaacgagctctatttggaacaactgcagaacaagcactcagataccacaaaggaagtagaaatgatgaaagccgcctatcggaaagagctagaaaaaaacagaagccatgttctccagcagactcagaggcttgatacctcccaaaaacggattttggaactggaatctcacctggccaagaaagaccaccttcttttggaacagaagaaatatctagaggatgtcaaactccaggcaagaggacagctgcaggccgcagagagcaggtatgaggctcagaaaaggataacccaggtgtttgaattggagatcttagatttatatggcaggttggagaaagatggcctcctgaaaaaacttgaagaagaaaaagcagaagcagctgaagcagcagaagaaaggcttgactgttgtaatgacgggtgctcagattccatggtagggcacaatgaagaggcatctggccacaacggtgagaccaagacccccaggcccagcagcgcccggggcagtagtggaagcagaggtggtggaggcagcagcagcagcagcagcgagctttctaccccagagaaacccccacaccagagggcaggcccattcagcagtcggtgggagacgactatgggagaagcgtctgccagcatccccaccactgtgggctcacttcccagttcaaaaagcttcctgggtatgaaggctcgagagttatttcgtaataagagcgagagccagtgtgatgaggacggcatgaccagtagcctttctgagagcctaaagacagaactgggcaaagacttgggtgtggaagccaagattcccctgaacctagatggccctcacccgtctcccccgaccccggacagtgttggacagctacatatcatggactacaatgagactcatcatgaacacagctaaggaatgatggtcaatcagtgttaacttgcatattgttggcacagaacaggaggtgtgaatgcacgtttcaaagctttcctgtttccagggtctgagtgcaagttcatgtgtggaaatgggacggaggtcctttggacagctgactgaatgcagaacggtttttggatctggcattgaaatgcctcttgaccttcccctccacccgccctaaccccctctcatttacctcgcagtgtgttctaatccaagggccagttggtgttcctcagtagctttactttcttcctttcccccccaaatggttgcgtcctttgaacctgtgcaatatgaggccaaatttaatctttgagtctaacacaccactttctgctttcccgaagttcagataactgggttggctctcaattagaccaggtagtttgttgcattgcaggtaagtctggttttgtcccttccaggaggacatagcctgcaaagctggttgtctttacatgaaagcgtttacatgagactttccgactgcttttttgattctgaagttcagcatctaaagcagcaggtctagaagaacaacggtttattcatacttgcattcttttggcagttctgataagcttcctagaaagttctgtgtaaacagaagcctgtttcagaaatctggagctggcactgtggagaccacacaccctttgggaaagctcttgtctcttcttcccccactacctcttatttatttggtgtttgcttgaatgctggtactattgtgaccacaggctggtgtgtaggtggtaaaacctgttctccataggagggaaggagcagtcactgggagaggttacccgagaagcacttgagcatgaggaactgcacctttaggccatctcagcttgctgggccttttgttaaacccttctgtctactggcctccctttgtgtgcatacgcctcttgttcatgtcagcttatatgtgacactgcagcagaaaggctctgaaggtccaaagagtttctgcaaagtgtatgtgaccatcatttcccaggccattagggttgcctcactgtagcaggttctaggctaccagaagaggggcagctttttcataccaattccaactttcaggggctgactctccagggagctgatgtcatcacactctccatgttagtaatggcagagcagtctaaacagagtccgggagaatgctggcaaaggctggctgtgtatacccactaggctgccccacgtgctcccgagagatgacactagtcagaaaattggcagtggcagagaatccaaactcaacaagtgctcctgaaagaaacgctagaagcctaagaactgtggtctggtgttccagctgaggcagggggatttggtaggaaggagccagtgaacttggctttcctgtttctatctttcattaaaaagaatagaaggattcagtcataaagaggtaaaaaactgtcacggtacgaaatcttagtgcccacggaggcctcgagcagagagaatgaaagtcttttttttttttttttttttttagcatggcaataaatattctagcatccctaactaaaggggactagacagttagagactctgtcaccctagctataccagcagaaaacctgttcaggcaggctttctgggtgtgactgattcccagcctgtggcagggcgtggtcccaactactcagcctagcacaggctggcagttggtactgaattgtcagatgtggagtattagtgacaccacacatttaattcagctttgtccaaaggaaagcttaaaacccaatacagtctagtttcctggttccgttttagaaaaggaaaacgtgaacaaacttagaaagggaaggaaatcccatcagtgaatcctgaaactggttttaagtgctttccttctcctcatgcccaagagatctgtgccatagaacaagataccaggcacttaaagccttttcctgaattggaaaggaaaagaggcccaagtgcaaaagaaaaaacattttagaaacggacagcttataaaaataaagggaagaaaggaggcagcatggagagaggcctgtgctagaagctccatggacgtgtctgcacagggtcctcagctcatccatgcggcctgggtgtccttttactcagctttataacaaatgtggctccaagctcaggtgcctttgagttctaggaggctgtgggttttattcaactacggttgggagaatgagacctggagtcatgttgaaggtgcccaacctaaaaatgtaggctttcatgttgcaaagaactccagagtcagtagttaggtttggtttggttttggacatgataaacctgccaagagtcaacaggtcacttgatcatgctgcagtgggtagttctaaggatggaaaggtgacagtattactctcgagaggcaattcagtcctgggcaaaggtattagtacaataagcgttaagggcagagtctaccttgaaaccaattaagcagcttggtattcataaatattgggattggatggcctccatccagaaatcactatgggtgagcatacctgtctcagctgtttggccaatgtgcataacctactcggatccccacctgacactaaccagagtcagcacaggccccgaggagcccgaagtctgctgctgtgcagcatggaattcctttaaaaaggtgcactacagttttagcggggagggggataggaagacgcagagcaaatgagctccggagtccctgcaggtgaataaacacacagatctgcatctgatagaactttgatggattttcaaaaagccgttgacaaggctctgctatacagtctataaaaattgttattatgggattggaagaaacacgtggtcatgaatagaaaaaaaacaaacccaaaggtaggaaggtcaaggtcatttcttagatggagaagttgtgaaagatgtccttggagatgagttttaggaccagcattactaaggcaggtgggcagacagtgacctctctaggtgtgtccacagagtttttcaggagagaaaactgcctgacctttgggactaagctgcggaatcttcttactaagcttgaagagtggagaggcgagaggtgagctactttgtgagccaaagcttatgtgacatggttggggaaacagtccaaactgttctgagaaggtgaactgttacgacccaggacaattagaaaaattcacccaccatgccgcacattactgggtaaaagcagggcagcagggaacaaaactccagactcttgggccgtccccatttgcaacagcacacatagtttctggtatatttgttgggaaagataaaactctagcagttgttgaggggaggatgtataaaatggtcatggggatgaaaggatctctgagaccacagaggctcagactcactgttaagaatagaaaactgggtatgcgtttcatgtagccagcagaactgaagtgtgctgtgacaagccaatgtgaatttctaccaaatagtagagcataccacttgaagaaggaaagaaccgaagagcaaacaaaagttctgcgtaatgagactcaccttttctcgctgaaagcactaagaggtgggaggaggcctgcacaggctggaggagggtttgggcagagcgaagacccggccaggaccttggtgagatggggtgccgcccacctcctgcggatactcttggagagttgttcccccagggggctctgccccacctggagaaggaagctgcctggtgtggagtgactcaaatcagtatacctatctgctgcaccttcactctccagggtacatgctttaaaaccgacccgcaacaagtattggaaaaatgtatccagtctgaagatgtttgtgtatctgtttacatccagagttctgtgacacatgccccccagattgctgcaaagatcccaaggcattgattgcacttgattaagcttttgtctgtaggtgaaagaacaagtttaggtcgaggactggcccctaggctgctgctgtgacccttgtcccatgtggcttgtttgcctgtccgggactcttcgatgtgcccaggggagcgtgttcctgtctcttccatgccgtcctgcagtccttatctgctcgcctgagggaagagtagctgtagctacaagggaagcctgcctggaagagccgagcacctgtgcccatggcttctggtcatgaaacgagttaatgatggcagaggagcttcctccccacttcgcagcgccacattatccatcctctgagataagtaggctggtttaaccattggaatggacctttcagtggaaaccctgagagtctgagaacccccagaccaacccttccctccctttccccacctcttacagtgtttggacaggagggtatggtgctgctctgtgtagcaagtactttggcttatgaaagaggcagccacgcattttgcactaggaagaatcagtaatcacttttcagaagacttctatggaccacaaatatattacggaggaacagattttgctaagacataatctagttttataactcaatcatgaatgaaccatgtgtggcaaacttgcagtttaaaggggtcccatcagtgaaagaaactgattttttttaacggactgcttttagttaaattgaagaaagtcagctcttgtcaaaaggtctaaactttcccgcctcaatcctaaaagcatgtcaacaatccacatcagatgccataaatatgaactgcaggataaaatggtacaatcttagtgaatgggaattggaatcaaaagagtttgctgtccttcttagaatgttctaaaatgtcaaggcagttgcttgtgtttaactgtgaacaaataaaaatttattgttttgcact

SEQ ID NO: 195806 - DNA, 8310 bp, Homo sapiens
  Payload ID: 18643
  Gene Name: tuberous sclerosis 1
  Uniprot ID: Q92574
  ENST ID: ENST00000545250
  CDS Start-End: 84-3425
cagtttggtagtggccccaatgaagaaccttcagaacctgtagcacacgtcctggagccagcacagcgccttcgagcgagagaatggcccaacaagcaaatgtcggggagcttcttgccatgctggactcccccatgctgggtgtgcgggacgacgtgacagctgtctttaaagagaacctcaattctgaccgtggccctatgcttgtaaacaccttggtggattattacctggaaaccagctctcagccggcattgcacatcctgaccaccttgcaagagccacatgacaagatggacactgacgtcgttgtcctcacaacaggcgtcttggtgttgataaccatgctaccaatgattccacagtctgggaaacagcatcttcttgatttctttgacatttttggccgtctgtcatcatggtgcctgaagaaaccaggccacgtggcggaagtctatctcgtccatctccatgccagtgtgtacgcactctttcatcgcctttatggaatgtacccttgcaacttcgtctcctttttgcgttctcattacagtatgaaagaaaacctggagacttttgaagaagtggtcaagccaatgatggagcatgtgcgaattcatccggaattagtgactggatccaaggaccatgaactggaccctcgaaggtggaagagattagaaactcatgatgttgtgatcgagtgtgccaaaatctctctggatcccacagaagcctcatatgaagatggctattctgtgtctcaccaaatctcagcccgctttcctcatcgttcagccgatgtcaccaccagcccttatgctgacacacagaatagctatgggtgtgctacttctaccccttactccacgtctcggctgatgttgttaaatatgccagggcagctacctcagactctgagttccccatcgacacggctgataactgaaccaccacaagctactctttggagcccatctatggtttgtggtatgaccactcctccaacttctcctggaaatgtcccacctgatctgtcacacccttacagtaaagtctttggtacaactgcaggtggaaaaggaactcctctgggaaccccagcaacctctcctcctccagccccactctgtcattcggatgactacgtgcacatttcactcccccaggccacagtcacaccccccaggaaggaagagagaatggattctgcaagaccatgtctacacagacaacaccatcttctgaatgacagaggatcagaagagccacctggcagcaaaggttctgtcactctaagtgatcttccagggtttttaggtgatctggcctctgaagaagatagtattgaaaaagataaagaagaagctgcaatatctagagaactttctgagatcaccacagcagaggcagagcctgtggttcctcgaggaggctttgactctcccttttaccgagacagtctcccaggttctcagcggaagacccactcggcagcctccagttctcagggcgccagcgtgaaccctgagcctttacactcctccctggacaagcttgggcctgacacaccaaagcaagcctttactcccatagacctgccctgcggcagtgctgatgaaagccctgcgggagacagggaatgccagacttctttggagaccagtatcttcactcccagtccttgtaaaattccacctccgacgagagtgggctttggaagcgggcagcctcccccgtatgatcatctttttgaggtggcattgccaaagacagcccatcattttgtcatcaggaagactgaggagctgttaaagaaagcaaaaggaaacacagaggaagatggtgtgccctctacctccccaatggaagtgctggacagactgatacagcagggagcagacgcgcacagcaaggagctgaacaagttgcctttacccagcaagtctgtcgactggacccactttggaggctctcctccttcagatgagatccgcaccctccgagaccagttgcttttactgcacaaccagttactctatgagcgttttaagaggcagcagcatgccctccggaacaggcggctcctccgcaaggtgatcaaagcagcagctctggaggaacataatgctgccatgaaagatcagttgaagttacaagagaaggacatccagatgtggaaggttagtctgcagaaagaacaagctagatacaatcagctccaggagcagcgtgacactatggtaaccaagctccacagccagatcagacagctgcagcatgaccgagaggaattctacaaccagagccaggaattacagacgaagctggaggactgcaggaacatgattgcggagctgcggatagaactgaagaaggccaacaacaaggtgtgtcacactgagctgctgctcagtcaggtttcccaaaagctctcaaacagtgagtcggtccagcagcagatggagttcttgaacaggcagctgttggttcttggggaggtcaacgagctctatttggaacaactgcagaacaagcactcagataccacaaaggaagtagaaatgatgaaagccgcctatcggaaagagctagaaaaaaacagaagccatgttctccagcagactcagaggcttgatacctcccaaaaacggattttggaactggaatctcacctggccaagaaagaccaccttcttttggaacagaagaaatatctagaggatgtcaaactccaggcaagaggacagctgcaggccgcagagagcaggtatgaggctcagaaaaggataacccaggtgtttgaattggagatcttagatttatatggcaggttggagaaagatggcctcctgaaaaaacttgaagaagaaaaagcagaagcagctgaagcagcagaagaaaggcttgactgttgtaatgacgggtgctcagattccatggtagggcacaatgaagaggcatctggccacaacggtgagaccaagacccccaggcccagcagcgcccggggcagtagtggaagcagaggtggtggaggcagcagcagcagcagcagcgagctttctaccccagagaaacccccacaccagagggcaggcccattcagcagtcggtgggagacgactatgggagaagcgtctgccagcatccccaccactgtgggctcacttcccagttcaaaaagcttcctgggtatgaaggctcgagagttatttcgtaataagagcgagagccagtgtgatgaggacggcatgaccagtagcctttctgagagcctaaagacagaactgggcaaagacttgggtgtggaagccaagattcccctgaacctagatggccctcacccgtctcccccgaccccggacagtgttggacagctacatatcatggactacaatgagactcatcatgaacacagctaaggaatgatggtcaatcagtgttaacttgcatattgttggcacagaacaggaggtgtgaatgcacgtttcaaagctttcctgtttccagggtctgagtgcaagttcatgtgtggaaatgggacggaggtcctttggacagctgactgaatgcagaacggtttttggatctggcattgaaatgcctcttgaccttcccctccacccgccctaaccccctctcatttacctcgcagtgtgttctaatccaagggccagttggtgttcctcagtagctttactttcttcctttcccccccaaatggttgcgtcctttgaacctgtgcaatatgaggccaaatttaatctttgagtctaacacaccactttctgctttcccgaagttcagataactgggttggctctcaattagaccaggtagtttgttgcattgcaggtaagtctggttttgtcccttccaggaggacatagcctgcaaagctggttgtctttacatgaaagcgtttacatgagactttccgactgcttttttgattctgaagttcagcatctaaagcagcaggtctagaagaacaacggtttattcatacttgcattcttttggcagttctgataagcttcctagaaagttctgtgtaaacagaagcctgtttcagaaatctggagctggcactgtggagaccacacaccctttgggaaagctcttgtctcttcttcccccactacctcttatttatttggtgtttgcttgaatgctggtactattgtgaccacaggctggtgtgtaggtggtaaaacctgttctccataggagggaaggagcagtcactgggagaggttacccgagaagcacttgagcatgaggaactgcacctttaggccatctcagcttgctgggccttttgttaaacccttctgtctactggcctccctttgtgtgcatacgcctcttgttcatgtcagcttatatgtgacactgcagcagaaaggctctgaaggtccaaagagtttctgcaaagtgtatgtgaccatcatttcccaggccattagggttgcctcactgtagcaggttctaggctaccagaagaggggcagctttttcataccaattccaactttcaggggctgactctccagggagctgatgtcatcacactctccatgttagtaatggcagagcagtctaaacagagtccgggagaatgctggcaaaggctggctgtgtatacccactaggctgccccacgtgctcccgagagatgacactagtcagaaaattggcagtggcagagaatccaaactcaacaagtgctcctgaaagaaacgctagaagcctaagaactgtggtctggtgttccagctgaggcagggggatttggtaggaaggagccagtgaacttggctttcctgtttctatctttcattaaaaagaatagaaggattcagtcataaagaggtaaaaaactgtcacggtacgaaatcttagtgcccacggaggcctcgagcagagagaatgaaagtcttttttttttttttttttttttagcatggcaataaatattctagcatccctaactaaaggggactagacagttagagactctgtcaccctagctataccagcagaaaacctgttcaggcaggctttctgggtgtgactgattcccagcctgtggcagggcgtggtcccaactactcagcctagcacaggctggcagttggtactgaattgtcagatgtggagtattagtgacaccacacatttaattcagctttgtccaaaggaaagcttaaaacccaatacagtctagtttcctggttccgttttagaaaaggaaaacgtgaacaaacttagaaagggaaggaaatcccatcagtgaatcctgaaactggttttaagtgctttccttctcctcatgcccaagagatctgtgccatagaacaagataccaggcacttaaagccttttcctgaattggaaaggaaaagaggcccaagtgcaaaagaaaaaacattttagaaacggacagcttataaaaataaagggaagaaaggaggcagcatggagagaggcctgtgctagaagctccatggacgtgtctgcacagggtcctcagctcatccatgcggcctgggtgtccttttactcagctttataacaaatgtggctccaagctcaggtgcctttgagttctaggaggctgtgggttttattcaactacggttgggagaatgagacctggagtcatgttgaaggtgcccaacctaaaaatgtaggctttcatgttgcaaagaactccagagtcagtagttaggtttggtttggttttggacatgataaacctgccaagagtcaacaggtcacttgatcatgctgcagtgggtagttctaaggatggaaaggtgacagtattactctcgagaggcaattcagtcctgggcaaaggtattagtacaataagcgttaagggcagagtctaccttgaaaccaattaagcagcttggtattcataaatattgggattggatggcctccatccagaaatcactatgggtgagcatacctgtctcagctgtttggccaatgtgcataacctactcggatccccacctgacactaaccagagtcagcacaggccccgaggagcccgaagtctgctgctgtgcagcatggaattcctttaaaaaggtgcactacagttttagcggggagggggataggaagacgcagagcaaatgagctccggagtccctgcaggtgaataaacacacagatctgcatctgatagaactttgatggattttcaaaaagccgttgacaaggctctgctatacagtctataaaaattgttattatgggattggaagaaacacgtggtcatgaatagaaaaaaaacaaacccaaaggtaggaaggtcaaggtcatttcttagatggagaagttgtgaaagatgtccttggagatgagttttaggaccagcattactaaggcaggtgggcagacagtgacctctctaggtgtgtccacagagtttttcaggagagaaaactgcctgacctttgggactaagctgcggaatcttcttactaagcttgaagagtggagaggcgagaggtgagctactttgtgagccaaagcttatgtgacatggttggggaaacagtccaaactgttctgagaaggtgaactgttacgacccaggacaattagaaaaattcacccaccatgccgcacattactgggtaaaagcagggcagcagggaacaaaactccagactcttgggccgtccccatttgcaacagcacacatagtttctggtatatttgttgggaaagataaaactctagcagttgttgaggggaggatgtataaaatggtcatggggatgaaaggatctctgagaccacagaggctcagactcactgttaagaatagaaaactgggtatgcgtttcatgtagccagcagaactgaagtgtgctgtgacaagccaatgtgaatttctaccaaatagtagagcataccacttgaagaaggaaagaaccgaagagcaaacaaaagttctgcgtaatgagactcaccttttctcgctgaaagcactaagaggtgggaggaggcctgcacaggctggaggagggtttgggcagagcgaagacccggccaggaccttggtgagatggggtgccgcccacctcctgcggatactcttggagagttgttcccccagggggctctgccccacctggagaaggaagctgcctggtgtggagtgactcaaatcagtatacctatctgctgcaccttcactctccagggtacatgctttaaaaccgacccgcaacaagtattggaaaaatgtatccagtctgaagatgtttgtgtatctgtttacatccagagttctgtgacacatgccccccagattgctgcaaagatcccaaggcattgattgcacttgattaagcttttgtctgtaggtgaaagaacaagtttaggtcgaggactggcccctaggctgctgctgtgacccttgtcccatgtggcttgtttgcctgtccgggactcttcgatgtgcccaggggagcgtgttcctgtctcttccatgccgtcctgcagtccttatctgctcgcctgagggaagagtagctgtagctacaagggaagcctgcctggaagagccgagcacctgtgcccatggcttctggtcatgaaacgagttaatgatggcagaggagcttcctccccacttcgcagcgccacattatccatcctctgagataagtaggctggtttaaccattggaatggacctttcagtggaaaccctgagagtctgagaacccccagaccaacccttccctccctttccccacctcttacagtgtttggacaggagggtatggtgctgctctgtgtagcaagtactttggcttatgaaagaggcagccacgcattttgcactaggaagaatcagtaatcacttttcagaagacttctatggaccacaaatatattacggaggaacagattttgctaagacataatctagttttataactcaatcatgaatgaaccatgtgtggcaaacttgcagtttaaaggggtcccatcagtgaaagaaactgattttttttaacggactgcttttagttaaattgaagaaagtcagctcttgtcaaaaggtctaaactttcccgcctcaatcctaaaagcatgtcaacaatccacatcagatgccataaatatgaactgcaggataaaatggtacaatcttagtgaatgggaattggaatcaaaagagtttgctgtccttcttagaatgttctaaaatgtcaaggcagttgcttgtgtttaactgtgaacaaataaaaatttattgttttgcact

SEQ ID NO: 195807 - DNA, 6156 bp, Homo sapiens
  Payload ID: 18644
  Gene Name: tuberous sclerosis 2
  Uniprot ID: P49815
  ENST ID: ENST00000219476
  CDS Start-End: 631-6054
cgttttcttgcttggggcgaaagggggcagcggagcggagcgcccgaaacccagcccctgcggaccgcaatctttgggaaaaaggcgcaaggtgggaacgcagggccgcacgtgggaaccgttcgcggctgccgggtttgcagcccctgcccgcgcagctgggagccgcaggaggcggcccgggactccagcctgcagcccctatcccgcctcctcccacgctccagccacggcgcggcgctacctgctgcagcctctcttctccggagaggcccgggctcctccctacacccccgcggcccagccccgggtcccaggctccggctccgggtcagcatcctcgcgctcaaggcggtcatgccggactcctgcggactacacatcccggcggcccatgcggccccgtcacgtgatgcaaggatcgccggcctttccgccagagggcggcacagaactacaactcccagcaagctcccaaggcggccctccgcgcaatgccgctaccggaagtgcgggtcgcgcttccggcggcgtcccggggccaggggggtgcgcctttctccgcgtcggggcggcccggagcgcggtggcgcggcgcgggaggggttttctggtgcgtcctggtccaccatggccaaaccaacaagcaaagattcaggcttgaaggagaagtttaagattctgttgggactgggaacaccgaggccaaatcccaggtctgcagagggtaaacagacggagtttatcatcaccgcggaaatactgagagaactgagcatggaatgtggcctcaacaatcgcatccggatgatagggcagatttgtgaagtcgcaaaaaccaagaaatttgaagagcacgcagtggaagcactctggaaggcggtcgcggatctgttgcagccggagcggccgctggaggcccggcacgcggtgctggctctgctgaaggccatcgtgcaggggcagggcgagcgtttgggggtcctcagagccctcttctttaaggtcatcaaggattacccttccaacgaagaccttcacgaaaggctggaggttttcaaggccctcacagacaatgggagacacatcacctacttggaggaagagctggctgactttgtcctgcagtggatggatgttggcttgtcctcggaattccttctggtgctggtgaacttggtcaaattcaatagctgttacctcgacgagtacatcgcaaggatggttcagatgatctgtctgctgtgcgtccggaccgcgtcctctgtggacatagaggtctccctgcaggtgctggacgccgtggtctgctacaactgcctgccggctgagagcctcccgctgttcatcgttaccctctgtcgcaccatcaacgtcaaggagctctgcgagccttgctggaagctgatgcggaacctccttggcacccacctgggccacagcgccatctacaacatgtgccacctcatggaggacagagcctacatggaggacgcgcccctgctgagaggagccgtgttttttgtgggcatggctctctggggagcccaccggctctattctctcaggaactcgccgacatctgtgttgccatcattttaccaggccatggcatgtccgaacgaggtggtgtcctatgagatcgtcctgtccatcaccaggctcatcaagaagtataggaaggagctccaggtggtggcgtgggacattctgctgaacatcatcgaacggctccttcagcagctccagaccttggacagcccggagctcaggaccatcgtccatgacctgttgaccacggtggaggagctgtgtgaccagaacgagttccacgggtctcaggagagatactttgaactggtggagagatgtgcggaccagaggcctgagtcctccctcctgaacctgatctcctatagagcgcagtccatccacccggccaaggacggctggattcagaacctgcaggcgctgatggagagattcttcaggagcgagtcccgaggcgccgtgcgcatcaaggtgctggacgtgctgtcctttgtgctgctcatcaacaggcagttctatgaggaggagctgattaactcagtggtcatctcgcagctctcccacatccccgaggataaagaccaccaggtccgaaagctggccacccagttgctggtggacctggcagagggctgccacacacaccacttcaacagcctgctggacatcatcgagaaggtgatggcccgctccctctccccacccccggagctggaagaaagggatgtggccgcatactcggcctccttggaggatgtgaagacagccgtcctggggcttctggtcatccttcagaccaagctgtacaccctgcctgcaagccacgccacgcgtgtgtatgagatgctggtcagccacattcagctccactacaagcacagctacaccctgccaatcgcgagcagcatccggctgcaggcctttgacttcctgttgctgctgcgggccgactcactgcaccgcctgggcctgcccaacaaggatggagtcgtgcggttcagcccctactgcgtctgcgactacatggagccagagagaggctctgagaagaagaccagcggccccctttctcctcccacagggcctcctggcccggcgcctgcaggccccgccgtgcggctggggtccgtgccctactccctgctcttccgcgtcctgctgcagtgcttgaagcaggagtctgactggaaggtgctgaagctggttctgggcaggctgcctgagtccctgcgctataaagtgctcatctttacttccccttgcagtgtggaccagctgtgctctgctctctgctccatgctttcaggcccaaagacactggagcggctccgaggcgccccagaaggcttctccagaactgacttgcacctggccgtggttccagtgctgacagcattaatctcttaccataactacctggacaaaaccaaacagcgcgagatggtctactgcctggagcagggcctcatccaccgctgtgccagccagtgcgtcgtggccttgtccatctgcagcgtggagatgcctgacatcatcatcaaggcgctgcctgttctggtggtgaagctcacgcacatctcagccacagccagcatggccgtcccactgctggagttcctgtccactctggccaggctgccgcacctctacaggaactttgccgcggagcagtatgccagtgtgttcgccatctccctgccgtacaccaacccctccaagtttaatcagtacatcgtgtgtctggcccatcacgtcatagccatgtggttcatcaggtgccgcctgcccttccggaaggattttgtccctttcatcactaagggcctgcggtccaatgtcctcttgtcttttgatgacacccccgagaaggacagcttcagggcccggagtactagtctcaacgagagacccaagagtctgaggatagccagaccccccaaacaaggcttgaataactctccacccgtgaaagaattcaaggagagctctgcagccgaggccttccggtgccgcagcatcagtgtgtctgaacatgtggtccgcagcaggatacagacgtccctcaccagtgccagcttggggtctgcagatgagaactccgtggcccaggctgacgatagcctgaaaaacctccacctggagctcacggaaacctgtctggacatgatggctcgatacgtcttctccaacttcacggctgtcccgaagaggtctcctgtgggcgagttcctcctagcgggtggcaggaccaaaacctggctggttgggaacaagcttgtcactgtgacgacaagcgtgggaaccgggacccggtcgttactaggcctggactcgggggagctgcagtccggcccggagtcgagctccagccccggggtgcatgtgagacagaccaaggaggcgccggccaagctggagtcccaggctgggcagcaggtgtcccgtggggcccgggatcgggtccgttccatgtcggggggccatggtcttcgagttggcgccctggacgtgccggcctcccagttcctgggcagtgccacttctccaggaccacggactgcaccagccgcgaaacctgagaaggcctcagctggcacccgggttcctgtgcaggagaagacgaacctggcggcctatgtgcccctgctgacccagggctgggcggagatcctggtccggaggcccacagggaacaccagctggctgatgagcctggagaacccgctcagccctttctcctcggacatcaacaacatgcccctgcaggagctgtctaacgccctcatggcggctgagcgcttcaaggagcaccgggacacagccctgtacaagtcactgtcggtgccggcagccagcacggccaaaccccctcctctgcctcgctccaacacagtggcctctttctcctccctgtaccagtccagctgccaaggacagctgcacaggagcgtttcctgggcagactccgccgtggtcatggaggagggaagtccgggcgaggttcctgtgctggtggagcccccagggttggaggacgttgaggcagcgctaggcatggacaggcgcacggatgcctacagcaggtcgtcctcagtctccagccaggaggagaagtcgctccacgcggaggagctggttggcaggggcatccccatcgagcgagtcgtctcctcggagggtggccggccctctgtggacctctccttccagccctcgcagcccctgagcaagtccagctcctctcccgagctgcagactctgcaggacatcctcggggaccctggggacaaggccgacgtgggccggctgagccctgaggttaaggcccggtcacagtcagggaccctggacggggaaagtgctgcctggtcggcctcgggcgaagacagtcggggccagcccgagggtcccttgccttccagctccccccgctcgcccagtggcctccggccccgaggttacaccatctccgactcggccccatcacgcaggggcaagagagtagagagggacgccttaaagagcagagccacagcctccaatgcagagaaagtgccaggcatcaaccccagtttcgtgttcctgcagctctaccattcccccttctttggcgacgagtcaaacaagccaatcctgctgcccaatgagtcacagtcctttgagcggtcggtgcagctcctcgaccagatcccatcatacgacacccacaagatcgccgtcctgtatgttggagaaggccagagcaacagcgagctcgccatcctgtccaatgagcatggctcctacaggtacacggagttcctgacgggcctgggccggctcatcgagctgaaggactgccagccggacaaggtgtacctgggaggcctggacgtgtgtggtgaggacggccagttcacctactgctggcacgatgacatcatgcaagccgtcttccacatcgccaccctgatgcccaccaaggacgtggacaagcaccgctgcgacaagaagcgccacctgggcaacgactttgtgtccattgtctacaatgactccggtgaggacttcaagcttggcaccatcaagggccagttcaactttgtccacgtgatcgtcaccccgctggactacgagtgcaacctggtgtccctgcagtgcaggaaagacatggagggccttgtggacaccagcgtggccaagatcgtgtctgaccgcaacctgcccttcgtggcccgccagatggccctgcacgcaaatatggcctcacaggtgcatcatagccgctccaaccccaccgatatctacccctccaagtggattgcccggctccgccacatcaagcggctccgccagcggatctgcgaggaagccgcctactccaaccccagcctacctctggtgcaccctccgtcccatagcaaagcccctgcacagactccagccgagcccacacctggctatgaggtgggccagcggaagcgcctcatctcctcggtggaggacttcaccgagtttgtgtgaggccggggccctccctcctgcactggccttggacggtattgcctgtcagtgaaataaataaagtcctgaccccagtgcacagacatagaggcacagattgca

SEQ ID NO: 195808 - DNA, 5532 bp, Homo sapiens
  Payload ID: 18644
  Gene Name: tuberous sclerosis 2
  Uniprot ID: P49815
  ENST ID: ENST00000350773
  CDS Start-End: 76-5430
ctttctccgcgtcggggcggcccggagcgcggtggcgcggcgcgggaggggttttctggtgcgtcctggtccaccatggccaaaccaacaagcaaagattcaggcttgaaggagaagtttaagattctgttgggactgggaacaccgaggccaaatcccaggtctgcagagggtaaacagacggagtttatcatcaccgcggaaatactgagagaactgagcatggaatgtggcctcaacaatcgcatccggatgatagggcagatttgtgaagtcgcaaaaaccaagaaatttgaagagcacgcagtggaagcactctggaaggcggtcgcggatctgttgcagccggagcggccgctggaggcccggcacgcggtgctggctctgctgaaggccatcgtgcaggggcagggcgagcgtttgggggtcctcagagccctcttctttaaggtcatcaaggattacccttccaacgaagaccttcacgaaaggctggaggttttcaaggccctcacagacaatgggagacacatcacctacttggaggaagagctggctgactttgtcctgcagtggatggatgttggcttgtcctcggaattccttctggtgctggtgaacttggtcaaattcaatagctgttacctcgacgagtacatcgcaaggatggttcagatgatctgtctgctgtgcgtccggaccgcgtcctctgtggacatagaggtctccctgcaggtgctggacgccgtggtctgctacaactgcctgccggctgagagcctcccgctgttcatcgttaccctctgtcgcaccatcaacgtcaaggagctctgcgagccttgctggaagctgatgcggaacctccttggcacccacctgggccacagcgccatctacaacatgtgccacctcatggaggacagagcctacatggaggacgcgcccctgctgagaggagccgtgttttttgtgggcatggctctctggggagcccaccggctctattctctcaggaactcgccgacatctgtgttgccatcattttaccaggccatggcatgtccgaacgaggtggtgtcctatgagatcgtcctgtccatcaccaggctcatcaagaagtataggaaggagctccaggtggtggcgtgggacattctgctgaacatcatcgaacggctccttcagcagctccagaccttggacagcccggagctcaggaccatcgtccatgacctgttgaccacggtggaggagctgtgtgaccagaacgagttccacgggtctcaggagagatactttgaactggtggagagatgtgcggaccagaggcctgagtcctccctcctgaacctgatctcctatagagcgcagtccatccacccggccaaggacggctggattcagaacctgcaggcgctgatggagagattcttcaggagcgagtcccgaggcgccgtgcgcatcaaggtgctggacgtgctgtcctttgtgctgctcatcaacaggcagttctatgaggaggagctgattaactcagtggtcatctcgcagctctcccacatccccgaggataaagaccaccaggtccgaaagctggccacccagttgctggtggacctggcagagggctgccacacacaccacttcaacagcctgctggacatcatcgagaaggtgatggcccgctccctctccccacccccggagctggaagaaagggatgtggccgcatactcggcctccttggaggatgtgaagacagccgtcctggggcttctggtcatccttcagaccaagctgtacaccctgcctgcaagccacgccacgcgtgtgtatgagatgctggtcagccacattcagctccactacaagcacagctacaccctgccaatcgcgagcagcatccggctgcaggcctttgacttcctgttgctgctgcgggccgactcactgcaccgcctgggcctgcccaacaaggatggagtcgtgcggttcagcccctactgcgtctgcgactacatggagccagagagaggctctgagaagaagaccagcggccccctttctcctcccacagggcctcctggcccggcgcctgcaggccccgccgtgcggctggggtccgtgccctactccctgctcttccgcgtcctgctgcagtgcttgaagcaggagtctgactggaaggtgctgaagctggttctgggcaggctgcctgagtccctgcgctataaagtgctcatctttacttccccttgcagtgtggaccagctgtgctctgctctctgctccatgctttcaggcccaaagacactggagcggctccgaggcgccccagaaggcttctccagaactgacttgcacctggccgtggttccagtgctgacagcattaatctcttaccataactacctggacaaaaccaaacagcgcgagatggtctactgcctggagcagggcctcatccaccgctgtgccagccagtgcgtcgtggccttgtccatctgcagcgtggagatgcctgacatcatcatcaaggcgctgcctgttctggtggtgaagctcacgcacatctcagccacagccagcatggccgtcccactgctggagttcctgtccactctggccaggctgccgcacctctacaggaactttgccgcggagcagtatgccagtgtgttcgccatctccctgccgtacaccaacccctccaagtttaatcagtacatcgtgtgtctggcccatcacgtcatagccatgtggttcatcaggtgccgcctgcccttccggaaggattttgtccctttcatcactaagggcctgcggtccaatgtcctcttgtcttttgatgacacccccgagaaggacagcttcagggcccggagtactagtctcaacgagagacccaagagtctgaggatagccagaccccccaaacaaggcttgaataactctccacccgtgaaagaattcaaggagagctctgcagccgaggccttccggtgccgcagcatcagtgtgtctgaacatgtggtccgcagcaggatacagacgtccctcaccagtgccagcttggggtctgcagatgagaactccgtggcccaggctgacgatagcctgaaaaacctccacctggagctcacggaaacctgtctggacatgatggctcgatacgtcttctccaacttcacggctgtcccgaagaggtctcctgtgggcgagttcctcctagcgggtggcaggaccaaaacctggctggttgggaacaagcttgtcactgtgacgacaagcgtgggaaccgggacccggtcgttactaggcctggactcgggggagctgcagtccggcccggagtcgagctccagccccggggtgcatgtgagacagaccaaggaggcgccggccaagctggagtcccaggctgggcagcaggtgtcccgtggggcccgggatcgggtccgttccatgtcggggggccatggtcttcgagttggcgccctggacgtgccggcctcccagttcctgggcagtgccacttctccaggaccacggactgcaccagccgcgaaacctgagaaggcctcagctggcacccgggttcctgtgcaggagaagacgaacctggcggcctatgtgcccctgctgacccagggctgggcggagatcctggtccggaggcccacagggaacaccagctggctgatgagcctggagaacccgctcagccctttctcctcggacatcaacaacatgcccctgcaggagctgtctaacgccctcatggcggctgagcgcttcaaggagcaccgggacacagccctgtacaagtcactgtcggtgccggcagccagcacggccaaaccccctcctctgcctcgctccaacacagactccgccgtggtcatggaggagggaagtccgggcgaggttcctgtgctggtggagcccccagggttggaggacgttgaggcagcgctaggcatggacaggcgcacggatgcctacagcaggtcgtcctcagtctccagccaggaggagaagtcgctccacgcggaggagctggttggcaggggcatccccatcgagcgagtcgtctcctcggagggtggccggccctctgtggacctctccttccagccctcgcagcccctgagcaagtccagctcctctcccgagctgcagactctgcaggacatcctcggggaccctggggacaaggccgacgtgggccggctgagccctgaggttaaggcccggtcacagtcagggaccctggacggggaaagtgctgcctggtcggcctcgggcgaagacagtcggggccagcccgagggtcccttgccttccagctccccccgctcgcccagtggcctccggccccgaggttacaccatctccgactcggccccatcacgcaggggcaagagagtagagagggacgccttaaagagcagagccacagcctccaatgcagagaaagtgccaggcatcaaccccagtttcgtgttcctgcagctctaccattcccccttctttggcgacgagtcaaacaagccaatcctgctgcccaatgagtcacagtcctttgagcggtcggtgcagctcctcgaccagatcccatcatacgacacccacaagatcgccgtcctgtatgttggagaaggccagagcaacagcgagctcgccatcctgtccaatgagcatggctcctacaggtacacggagttcctgacgggcctgggccggctcatcgagctgaaggactgccagccggacaaggtgtacctgggaggcctggacgtgtgtggtgaggacggccagttcacctactgctggcacgatgacatcatgcaagccgtcttccacatcgccaccctgatgcccaccaaggacgtggacaagcaccgctgcgacaagaagcgccacctgggcaacgactttgtgtccattgtctacaatgactccggtgaggacttcaagcttggcaccatcaagggccagttcaactttgtccacgtgatcgtcaccccgctggactacgagtgcaacctggtgtccctgcagtgcaggaaagacatggagggccttgtggacaccagcgtggccaagatcgtgtctgaccgcaacctgcccttcgtggcccgccagatggccctgcacgcaaatatggcctcacaggtgcatcatagccgctccaaccccaccgatatctacccctccaagtggattgcccggctccgccacatcaagcggctccgccagcggatctgcgaggaagccgcctactccaaccccagcctacctctggtgcaccctccgtcccatagcaaagcccctgcacagactccagccgagcccacacctggctatgaggtgggccagcggaagcgcctcatctcctcggtggaggacttcaccgagtttgtgtgaggccggggccctccctcctgcactggccttggacggtattgcctgtcagtgaaataaataaagtcctgaccccagtgcacagacatagaggcacagattgca

SEQ ID NO: 195809 - DNA, 5264 bp, Homo sapiens
  Payload ID: 18644
  Gene Name: tuberous sclerosis 2
  Uniprot ID: P49815
  ENST ID: ENST00000382538
  CDS Start-End: 96-5174
gtcgcgcttccggcggcgtcccggggccaggggggtgcgcctttctccgcgtcggggcggcccggagcgcggtggcgcggcgcggggaactgagcatggaatgtggcctcaacaatcgcatccggatgatagggcagatttgtgaagtcgcaaaaaccaagaaatttgaagagcacgcagtggaagcactctggaaggcggtcgcggatctgttgcagccggagcggccgctggaggcccggcacgcggtgctggctctgctgaaggccatcgtgcaggggcagggcgagcgtttgggggtcctcagagccctcttctttaaggtcatcaaggattacccttccaacgaagaccttcacgaaaggctggaggttttcaaggccctcacagacaatgggagacacatcacctacttggaggaagagctggctgactttgtcctgcagtggatggatgttggcttgtcctcggaattccttctggtgctggtgaacttggtcaaattcaatagctgttacctcgacgagtacatcgcaaggatggttcagatgatctgtctgctgtgcgtccggaccgcgtcctctgtggacatagaggtctccctgcaggtgctggacgccgtggtctgctacaactgcctgccggctgagagcctcccgctgttcatcgttaccctctgtcgcaccatcaacgtcaaggagctctgcgagccttgctggaagctgatgcggaacctccttggcacccacctgggccacagcgccatctacaacatgtgccacctcatggaggacagagcctacatggaggacgcgcccctgctgagaggagccgtgttttttgtgggcatggctctctggggagcccaccggctctattctctcaggaactcgccgacatctgtgttgccatcattttaccaggccatggcatgtccgaacgaggtggtgtcctatgagatcgtcctgtccatcaccaggctcatcaagaagtataggaaggagctccaggtggtggcgtgggacattctgctgaacatcatcgaacggctccttcagcagctccagaccttggacagcccggagctcaggaccatcgtccatgacctgttgaccacggtggaggagctgtgtgaccagaacgagttccacgggtctcaggagagatactttgaactggtggagagatgtgcggaccagaggcctgagtcctccctcctgaacctgatctcctatagagcgcagtccatccacccggccaaggacggctggattcagaacctgcaggcgctgatggagagattcttcaggagcgagtcccgaggcgccgtgcgcatcaaggtgctggacgtgctgtcctttgtgctgctcatcaacaggcagttctatgaggaggagctgattaactcagtggtcatctcgcagctctcccacatccccgaggataaagaccaccaggtccgaaagctggccacccagttgctggtggacctggcagagggctgccacacacaccacttcaacagcctgctggacatcatcgagaaggtgatggcccgctccctctccccacccccggagctggaagaaagggatgtggccgcatactcggcctccttggaggatgtgaagacagccgtcctggggcttctggtcatccttcagaccaagctgtacaccctgcctgcaagccacgccacgcgtgtgtatgagatgctggtcagccacattcagctccactacaagcacagctacaccctgccaatcgcgagcagcatccggctgcaggcctttgacttcctgttgctgctgcgggccgactcactgcaccgcctgggcctgcccaacaaggatggagtcgtgcggttcagcccctactgcgtctgcgactacatggagccagagagaggctctgagaagaagaccagcggccccctttctcctcccacagggcctcctggcccggcgcctgcaggccccgccgtgcggctggggtccgtgccctactccctgctcttccgcgtcctgctgcagtgcttgaagcaggagtctgactggaaggtgctgaagctggttctgggcaggctgcctgagtccctgcgctataaagtgctcatctttacttccccttgcagtgtggaccagctgtgctctgctctctgctccatgctttcaggcccaaagacactggagcggctccgaggcgccccagaaggcttctccagaactgacttgcacctggccgtggttccagtgctgacagcattaatctcttaccataactacctggacaaaaccaaacagcgcgagatggtctactgcctggagcagggcctcatccaccgctgtgccagccagtgcgtcgtggccttgtccatctgcagcgtggagatgcctgacatcatcatcaaggcgctgcctgttctggtggtgaagctcacgcacatctcagccacagccagcatggccgtcccactgctggagttcctgtccactctggccaggctgccgcacctctacaggaactttgccgcggagcagtatgccagtgtgttcgccatctccctgccgtacaccaacccctccaagtttaatcagtacatcgtgtgtctggcccatcacgtcatagccatgtggttcatcaggtgccgcctgcccttccggaaggattttgtccctttcatcactaagggcctgcggtccaatgtcctcttgtcttttgatgacacccccgagaaggacagcttcagggcccggagtactagtctcaacgagagacccaagagcaggatacagacgtccctcaccagtgccagcttggggtctgcagatgagaactccgtggcccaggctgacgatagcctgaaaaacctccacctggagctcacggaaacctgtctggacatgatggctcgatacgtcttctccaacttcacggctgtcccgaagaggtctcctgtgggcgagttcctcctagcgggtggcaggaccaaaacctggctggttgggaacaagcttgtcactgtgacgacaagcgtgggaaccgggacccggtcgttactaggcctggactcgggggagctgcagtccggcccggagtcgagctccagccccggggtgcatgtgagacagaccaaggaggcgccggccaagctggagtcccaggctgggcagcaggtgtcccgtggggcccgggatcgggtccgttccatgtcggggggccatggtcttcgagttggcgccctggacgtgccggcctcccagttcctgggcagtgccacttctccaggaccacggactgcaccagccgcgaaacctgagaaggcctcagctggcacccgggttcctgtgcaggagaagacgaacctggcggcctatgtgcccctgctgacccagggctgggcggagatcctggtccggaggcccacagggaacaccagctggctgatgagcctggagaacccgctcagccctttctcctcggacatcaacaacatgcccctgcaggagctgtctaacgccctcatggcggctgagcgcttcaaggagcaccgggacacagccctgtacaagtcactgtcggtgccggcagccagcacggccaaaccccctcctctgcctcgctccaacacagactccgccgtggtcatggaggagggaagtccgggcgaggttcctgtgctggtggagcccccagggttggaggacgttgaggcagcgctaggcatggacaggcgcacggatgcctacagcaggtcgtcctcagtctccagccaggaggagaagtcgctccacgcggaggagctggttggcaggggcatccccatcgagcgagtcgtctcctcggagggtggccggccctctgtggacctctccttccagccctcgcagcccctgagcaagtccagctcctctcccgagctgcagactctgcaggacatcctcggggaccctggggacaaggccgacgtgggccggctgagccctgaggttaaggcccggtcacagtcagggaccctggacggggaaagtgctgcctggtcggcctcgggcgaagacagtcggggccagcccgagggtcccttgccttccagctccccccgctcgcccagtggcctccggccccgaggttacaccatctccgactcggccccatcacgcaggggcaagagagtagagagggacgccttaaagagcagagccacagcctccaatgcagagaaagtgccaggcatcaaccccagtttcgtgttcctgcagctctaccattcccccttctttggcgacgagtcaaacaagccaatcctgctgcccaatgagtcacagtcctttgagcggtcggtgcagctcctcgaccagatcccatcatacgacacccacaagatcgccgtcctgtatgttggagaaggccagagcaacagcgagctcgccatcctgtccaatgagcatggctcctacaggtacacggagttcctgacgggcctgggccggctcatcgagctgaaggactgccagccggacaaggtgtacctgggaggcctggacgtgtgtggtgaggacggccagttcacctactgctggcacgatgacatcatgcaagccgtcttccacatcgccaccctgatgcccaccaaggacgtggacaagcaccgctgcgacaagaagcgccacctgggcaacgactttgtgtccattgtctacaatgactccggtgaggacttcaagcttggcaccatcaagggccagttcaactttgtccacgtgatcgtcaccccgctggactacgagtgcaacctggtgtccctgcagtgcaggaaagacatggagggccttgtggacaccagcgtggccaagatcgtgtctgaccgcaacctgcccttcgtggcccgccagatggccctgcacgcaaatatggcctcacaggtgcatcatagccgctccaaccccaccgatatctacccctccaagtggattgcccggctccgccacatcaagcggctccgccagcggatctgcgaggaagccgcctactccaaccccagcctacctctggtgcaccctccgtcccatagcaaagcccctgcacagactccagccgagcccacacctggctatgaggtgggccagcggaagcgcctcatctcctcggtggaggacttcaccgagtttgtgtgaggccggggccctccctcctgcactggccttggacggtattgcctgtcagtgaaataaataaagtcctgaccccagtgcacagacatagag

SEQ ID NO: 195810 - DNA, 5421 bp, Homo sapiens
  Payload ID: 18644
  Gene Name: tuberous sclerosis 2
  Uniprot ID: P49815
  ENST ID: ENST00000401874
  CDS Start-End: 107-5329
ccggcggcgtcccggggccaggggggtgcgcctttctccgcgtcggggcggcccggagcgcggtggcgcggcgcgggaggggttttctggtgcgtcctggtccaccatggccaaaccaacaagcaaagattcaggcttgaaggagaagtttaagattctgttgggactgggaacaccgaggccaaatcccaggtctgcagagggtaaacagacggagtttatcatcaccgcggaaatactgagagaactgagcatggaatgtggcctcaacaatcgcatccggatgatagggcagatttgtgaagtcgcaaaaaccaagaaatttgaagagcacgcagtggaagcactctggaaggcggtcgcggatctgttgcagccggagcggccgctggaggcccggcacgcggtgctggctctgctgaaggccatcgtgcaggggcagggcgagcgtttgggggtcctcagagccctcttctttaaggtcatcaaggattacccttccaacgaagaccttcacgaaaggctggaggttttcaaggccctcacagacaatgggagacacatcacctacttggaggaagagctggctgactttgtcctgcagtggatggatgttggcttgtcctcggaattccttctggtgctggtgaacttggtcaaattcaatagctgttacctcgacgagtacatcgcaaggatggttcagatgatctgtctgctgtgcgtccggaccgcgtcctctgtggacatagaggtctccctgcaggtgctggacgccgtggtctgctacaactgcctgccggctgagagcctcccgctgttcatcgttaccctctgtcgcaccatcaacgtcaaggagctctgcgagccttgctggaagctgatgcggaacctccttggcacccacctgggccacagcgccatctacaacatgtgccacctcatggaggacagagcctacatggaggacgcgcccctgctgagaggagccgtgttttttgtgggcatggctctctggggagcccaccggctctattctctcaggaactcgccgacatctgtgttgccatcattttaccaggccatggcatgtccgaacgaggtggtgtcctatgagatcgtcctgtccatcaccaggctcatcaagaagtataggaaggagctccaggtggtggcgtgggacattctgctgaacatcatcgaacggctccttcagcagctccagaccttggacagcccggagctcaggaccatcgtccatgacctgttgaccacggtggaggagctgtgtgaccagaacgagttccacgggtctcaggagagatactttgaactggtggagagatgtgcggaccagaggcctgagtcctccctcctgaacctgatctcctatagagcgcagtccatccacccggccaaggacggctggattcagaacctgcaggcgctgatggagagattcttcaggagcgagtcccgaggcgccgtgcgcatcaaggtgctggacgtgctgtcctttgtgctgctcatcaacaggcagttctatgaggaggagctgattaactcagtggtcatctcgcagctctcccacatccccgaggataaagaccaccaggtccgaaagctggccacccagttgctggtggacctggcagagggctgccacacacaccacttcaacagcctgctggacatcatcgagaaggtgatggcccgctccctctccccacccccggagctggaagaaagggatgtggccgcatactcggcctccttggaggatgtgaagacagccgtcctggggcttctggtcatccttcagaccaagctgtacaccctgcctgcaagccacgccacgcgtgtgtatgagatgctggtcagccacattcagctccactacaagcacagctacaccctgccaatcgcgagcagcatccggctgcaggcctttgacttcctgttgctgctgcgggccgactcactgcaccgcctgggcctgcccaacaaggatggagtcgtgcggttcagcccctactgcgtctgcgactacatggagccagagagaggctctgagaagaagaccagcggccccctttctcctcccacagggcctcctggcccggcgcctgcaggccccgccgtgcggctggggtccgtgccctactccctgctcttccgcgtcctgctgcagtgcttgaagcaggagtctgactggaaggtgctgaagctggttctgggcaggctgcctgagtccctgcgctataaagtgctcatctttacttccccttgcagtgtggaccagctgtgctctgctctctgctccatgctttcaggcccaaagacactggagcggctccgaggcgccccagaaggcttctccagaactgacttgcacctggccgtggttccagtgctgacagcattaatctcttaccataactacctggacaaaaccaaacagcgcgagatggtctactgcctggagcagggcctcatccaccgctgtgccagccagtgcgtcgtggccttgtccatctgcagcgtggagatgcctgacatcatcatcaaggcgctgcctgttctggtggtgaagctcacgcacatctcagccacagccagcatggccgtcccactgctggagttcctgtccactctggccaggctgccgcacctctacaggaactttgccgcggagcagtatgccagtgtgttcgccatctccctgccgtacaccaacccctccaagtttaatcagtacatcgtgtgtctggcccatcacgtcatagccatgtggttcatcaggtgccgcctgcccttccggaaggattttgtccctttcatcactaagggcctgcggtccaatgtcctcttgtcttttgatgacacccccgagaaggacagcttcagggcccggagtactagtctcaacgagagacccaagaggatacagacgtccctcaccagtgccagcttggggtctgcagatgagaactccgtggcccaggctgacgatagcctgaaaaacctccacctggagctcacggaaacctgtctggacatgatggctcgatacgtcttctccaacttcacggctgtcccgaagaggtctcctgtgggcgagttcctcctagcgggtggcaggaccaaaacctggctggttgggaacaagcttgtcactgtgacgacaagcgtgggaaccgggacccggtcgttactaggcctggactcgggggagctgcagtccggcccggagtcgagctccagccccggggtgcatgtgagacagaccaaggaggcgccggccaagctggagtcccaggctgggcagcaggtgtcccgtggggcccgggatcgggtccgttccatgtcggggggccatggtcttcgagttggcgccctggacgtgccggcctcccagttcctgggcagtgccacttctccaggaccacggactgcaccagccgcgaaacctgagaaggcctcagctggcacccgggttcctgtgcaggagaagacgaacctggcggcctatgtgcccctgctgacccagggctgggcggagatcctggtccggaggcccacagggaacaccagctggctgatgagcctggagaacccgctcagccctttctcctcggacatcaacaacatgcccctgcaggagctgtctaacgccctcatggcggctgagcgcttcaaggagcaccgggacacagccctgtacaagtcactgtcggtgccggcagccagcacggccaaaccccctcctctgcctcgctccaacacagactccgccgtggtcatggaggagggaagtccgggcgaggttcctgtgctggtggagcccccagggttggaggacgttgaggcagcgctaggcatggacaggcgcacggatgcctacagcaggtcgtcctcagtctccagccaggaggagaagtcgctccacgcggaggagctggttggcaggggcatccccatcgagcgagtcgtctcctcggagggtggccggccctctgtggacctctccttccagccctcgcagcccctgagcaagtccagctcctctcccgagctgcagactctgcaggacatcctcggggaccctggggacaaggccgacgtgggccggctgagccctgaggttaaggcccggtcacagtcagggaccctggacggggaaagtgctgcctggtcggcctcgggcgaagacagtcggggccagcccgagggtcccttgccttccagctccccccgctcgcccagtggcctccggccccgaggttacaccatctccgactcggccccatcacgcaggggcaagagagtagagagggacgccttaaagagcagagccacagcctccaatgcagagaaagtgccaggcatcaaccccagtttcgtgttcctgcagctctaccattcccccttctttggcgacgagtcaaacaagccaatcctgctgcccaatgagtcacagtcctttgagcggtcggtgcagctcctcgaccagatcccatcatacgacacccacaagatcgccgtcctgtatgttggagaaggccagagcaacagcgagctcgccatcctgtccaatgagcatggctcctacaggtacacggagttcctgacgggcctgggccggctcatcgagctgaaggactgccagccggacaaggtgtacctgggaggcctggacgtgtgtggtgaggacggccagttcacctactgctggcacgatgacatcatgcaagccgtcttccacatcgccaccctgatgcccaccaaggacgtggacaagcaccgctgcgacaagaagcgccacctgggcaacgactttgtgtccattgtctacaatgactccggtgaggacttcaagcttggcaccatcaagggccagttcaactttgtccacgtgatcgtcaccccgctggactacgagtgcaacctggtgtccctgcagtgcaggaaagacatggagggccttgtggacaccagcgtggccaagatcgtgtctgaccgcaacctgcccttcgtggcccgccagatggccctgcacgcaaatatggcctcacaggtgcatcatagccgctccaaccccaccgatatctacccctccaagtggattgcccggctccgccacatcaagcggctccgccagcggatctgcgaggaagccgcctactccaaccccagcctacctctggtgcaccctccgtcccatagcaaagcccctgcacagactccagccgagcccacacctggctatgaggtgggccagcggaagcgcctcatctcctcggtggaggacttcaccgagtttgtgtgaggccggggccctccctcctgcactggccttggacggtattgcctgtcagtgaaataaataaagtcctgaccccagtgcacagacatagaggc

SEQ ID NO: 195811 - DNA, 374 bp, Homo sapiens
  Payload ID: 18644
  Gene Name: tuberous sclerosis 2
  ENST ID: ENST00000432909
  CDS Start-End: 1-374
aggccatcgtgcaggggcaggtaaggcccagggcgacgctgggatgggtgacgtcaggctgcccactgactgtcctgtccctgctgggccgtgtttggactcctgcctcgggcgagcgtttgggggtcctcagagccctcttctttaaggtcatcaaggattacccttccaacgaagaccttcacgaaaggctggaggttttcaaggccctcacagacaatgggagacacatcacctacttggaggaagagctggctgactttgtcctgcagtggatggatgttggcttgtcctcggaattccttctggtgctggtgaacttggtcaaattcaatagctgttacctcgacgagtacatcgcaaggatggttcag

SEQ ID NO: 195812 - DNA, 5287 bp, Homo sapiens
  Payload ID: 18644
  Gene Name: tuberous sclerosis 2
  Uniprot ID: P49815
  ENST ID: ENST00000439673
  CDS Start-End: 82-5196
gtgcgcctttctccgcgtcggggcggcccggagcgcggtggcgcggcgcgggaggggttttctggtgcgtcctggtccaccatggccaaaccaacaagcaaagattcaggcttgaaggagaagtttaagattctgttgggactgggaacaccgaggccaaatcccaggtctgcagagggtaaacagacggagtttatcatcaccgcggaaatactgagagaactgagcatggaatgtggcctcaacaatcgcatccggatgatagggcagatttgtgaagtcgcaaaaaccaagaaatttgaagagggcgagcgtttgggggtcctcagagccctcttctttaaggtcatcaaggattacccttccaacgaagaccttcacgaaaggctggaggttttcaaggccctcacagacaatgggagacacatcacctacttggaggaagagctggctgactttgtcctgcagtggatggatgttggcttgtcctcggaattccttctggtgctggtgaacttggtcaaattcaatagctgttacctcgacgagtacatcgcaaggatggttcagatgatctgtctgctgtgcgtccggaccgcgtcctctgtggacatagaggtctccctgcaggtgctggacgccgtggtctgctacaactgcctgccggctgagagcctcccgctgttcatcgttaccctctgtcgcaccatcaacgtcaaggagctctgcgagccttgctggaagctgatgcggaacctccttggcacccacctgggccacagcgccatctacaacatgtgccacctcatggaggacagagcctacatggaggacgcgcccctgctgagaggagccgtgttttttgtgggcatggctctctggggagcccaccggctctattctctcaggaactcgccgacatctgtgttgccatcattttaccaggccatggcatgtccgaacgaggtggtgtcctatgagatcgtcctgtccatcaccaggctcatcaagaagtataggaaggagctccaggtggtggcgtgggacattctgctgaacatcatcgaacggctccttcagcagctccagaccttggacagcccggagctcaggaccatcgtccatgacctgttgaccacggtggaggagctgtgtgaccagaacgagttccacgggtctcaggagagatactttgaactggtggagagatgtgcggaccagaggcctgagtcctccctcctgaacctgatctcctatagagcgcagtccatccacccggccaaggacggctggattcagaacctgcaggcgctgatggagagattcttcaggagcgagtcccgaggcgccgtgcgcatcaaggtgctggacgtgctgtcctttgtgctgctcatcaacaggcagttctatgaggaggagctgattaactcagtggtcatctcgcagctctcccacatccccgaggataaagaccaccaggtccgaaagctggccacccagttgctggtggacctggcagagggctgccacacacaccacttcaacagcctgctggacatcatcgagaaggtgatggcccgctccctctccccacccccggagctggaagaaagggatgtggccgcatactcggcctccttggaggatgtgaagacagccgtcctggggcttctggtcatccttcagaccaagctgtacaccctgcctgcaagccacgccacgcgtgtgtatgagatgctggtcagccacattcagctccactacaagcacagctacaccctgccaatcgcgagcagcatccggctgcaggcctttgacttcctgttgctgctgcgggccgactcactgcaccgcctgggcctgcccaacaaggatggagtcgtgcggttcagcccctactgcgtctgcgactacatggagccagagagaggctctgagaagaagaccagcggccccctttctcctcccacagggcctcctggcccggcgcctgcaggccccgccgtgcggctggggtccgtgccctactccctgctcttccgcgtcctgctgcagtgcttgaagcaggagtctgactggaaggtgctgaagctggttctgggcaggctgcctgagtccctgcgctataaagtgctcatctttacttccccttgcagtgtggaccagctgtgctctgctctctgctccatgctttcaggcccaaagacactggagcggctccgaggcgccccagaaggcttctccagaactgacttgcacctggccgtggttccagtgctgacagcattaatctcttaccataactacctggacaaaaccaaacagcgcgagatggtctactgcctggagcagggcctcatccaccgctgtgccagccagtgcgtcgtggccttgtccatctgcagcgtggagatgcctgacatcatcatcaaggcgctgcctgttctggtggtgaagctcacgcacatctcagccacagccagcatggccgtcccactgctggagttcctgtccactctggccaggctgccgcacctctacaggaactttgccgcggagcagtatgccagtgtgttcgccatctccctgccgtacaccaacccctccaagtttaatcagtacatcgtgtgtctggcccatcacgtcatagccatgtggttcatcaggtgccgcctgcccttccggaaggattttgtccctttcatcactaagggcctgcggtccaatgtcctcttgtcttttgatgacacccccgagaaggacagcttcagggcccggagtactagtctcaacgagagacccaagagcaggatacagacgtccctcaccagtgccagcttggggtctgcagatgagaactccgtggcccaggctgacgatagcctgaaaaacctccacctggagctcacggaaacctgtctggacatgatggctcgatacgtcttctccaacttcacggctgtcccgaagaggtctcctgtgggcgagttcctcctagcgggtggcaggaccaaaacctggctggttgggaacaagcttgtcactgtgacgacaagcgtgggaaccgggacccggtcgttactaggcctggactcgggggagctgcagtccggcccggagtcgagctccagccccggggtgcatgtgagacagaccaaggaggcgccggccaagctggagtcccaggctgggcagcaggtgtcccgtggggcccgggatcgggtccgttccatgtcggggggccatggtcttcgagttggcgccctggacgtgccggcctcccagttcctgggcagtgccacttctccaggaccacggactgcaccagccgcgaaacctgagaaggcctcagctggcacccgggttcctgtgcaggagaagacgaacctggcggcctatgtgcccctgctgacccagggctgggcggagatcctggtccggaggcccacagggaacaccagctggctgatgagcctggagaacccgctcagccctttctcctcggacatcaacaacatgcccctgcaggagctgtctaacgccctcatggcggctgagcgcttcaaggagcaccgggacacagccctgtacaagtcactgtcggtgccggcagccagcacggccaaaccccctcctctgcctcgctccaacacagactccgccgtggtcatggaggagggaagtccgggcgaggttcctgtgctggtggagcccccagggttggaggacgttgaggcagcgctaggcatggacaggcgcacggatgcctacagcaggtcgtcctcagtctccagccaggaggagaagtcgctccacgcggaggagctggttggcaggggcatccccatcgagcgagtcgtctcctcggagggtggccggccctctgtggacctctccttccagccctcgcagcccctgagcaagtccagctcctctcccgagctgcagactctgcaggacatcctcggggaccctggggacaaggccgacgtgggccggctgagccctgaggttaaggcccggtcacagtcagggaccctggacggggaaagtgctgcctggtcggcctcgggcgaagacagtcggggccagcccgagggtcccttgccttccagctccccccgctcgcccagtggcctccggccccgaggttacaccatctccgactcggccccatcacgcaggggcaagagagtagagagggacgccttaaagagcagagccacagcctccaatgcagagaaagtgccaggcatcaaccccagtttcgtgttcctgcagctctaccattcccccttctttggcgacgagtcaaacaagccaatcctgctgcccaatgagtcacagtcctttgagcggtcggtgcagctcctcgaccagatcccatcatacgacacccacaagatcgccgtcctgtatgttggagaaggccagagcaacagcgagctcgccatcctgtccaatgagcatggctcctacaggtacacggagttcctgacgggcctgggccggctcatcgagctgaaggactgccagccggacaaggtgtacctgggaggcctggacgtgtgtggtgaggacggccagttcacctactgctggcacgatgacatcatgcaagccgtcttccacatcgccaccctgatgcccaccaaggacgtggacaagcaccgctgcgacaagaagcgccacctgggcaacgactttgtgtccattgtctacaatgactccggtgaggacttcaagcttggcaccatcaagggccagttcaactttgtccacgtgatcgtcaccccgctggactacgagtgcaacctggtgtccctgcagtgcaggaaagacatggagggccttgtggacaccagcgtggccaagatcgtgtctgaccgcaacctgcccttcgtggcccgccagatggccctgcacgcaaatatggcctcacaggtgcatcatagccgctccaaccccaccgatatctacccctccaagtggattgcccggctccgccacatcaagcggctccgccagcggatctgcgaggaagccgcctactccaaccccagcctacctctggtgcaccctccgtcccatagcaaagcccctgcacagactccagccgagcccacacctggctatgaggtgggccagcggaagcgcctcatctcctcggtggaggacttcaccgagtttgtgtgaggccggggccctccctcctgcactggccttggacggtattgcctgtcagtgaaataaataaagtcctgaccccagtgcacagacatagagg

SEQ ID NO: 195813 - DNA, 5073 bp, Homo sapiens
  Payload ID: 18644
  Gene Name: tuberous sclerosis 2
  ENST ID: ENST00000439117
  CDS Start-End: 63-389
ggggcggcccggagcgcggtggcgcggcgcgggaggggttttctggtgcgtcctggtccaccatggccaaaccaacaagcaaagattcaggcttgaaggagaagtttaagattctgttgggactgggaacaccgaggccaaatcccaggtctgcagagggtaaacagacggagtttatcatcaccgcggaaatactgagagaactgagcatggaatgtggcctcaacaatcgcatccggatgatagggcagatttgtgaagtcgcaaaaaccaagaaatttgaagaggatgatctgtctgctgtgcgtccggaccgcgtcctctgtggacatagaggtctccctgcaggtgctggacgccgtggtctgctacaactgcctgccggctgagagcctcccgctgttcatcgttaccctctgtcgcaccatcaacgtcaaggagctctgcgagccttgctggaagctgatgcggaacctccttggcacccacctgggccacagcgccatctacaacatgtgccacctcatggaggacagagcctacatggaggacgcgcccctgctgagaggagccgtgttttttgtgggcatggctctctggggagcccaccggctctattctctcaggaactcgccgacatctgtgttgccatcattttaccaggccatggcatgtccgaacgaggtggtgtcctatgagatcgtcctgtccatcaccaggctcatcaagaagtataggaaggagctccaggtggtggcgtgggacattctgctgaacatcatcgaacggctccttcagcagctccagaccttggacagcccggagctcaggaccatcgtccatgacctgttgaccacggtggaggagctgtgtgaccagaacgagttccacgggtctcaggagagatactttgaactggtggagagatgtgcggaccagaggcctgagtcctccctcctgaacctgatctcctatagagcgcagtccatccacccggccaaggacggctggattcagaacctgcaggcgctgatggagagattcttcaggagcgagtcccgaggcgccgtgcgcatcaaggtgctggacgtgctgtcctttgtgctgctcatcaacaggcagttctatgaggaggagctgattaactcagtggtcatctcgcagctctcccacatccccgaggataaagaccaccaggtccgaaagctggccacccagttgctggtggacctggcagagggctgccacacacaccacttcaacagcctgctggacatcatcgagaaggtgatggcccgctccctctccccacccccggagctggaagaaagggatgtggccgcatactcggcctccttggaggatgtgaagacagccgtcctggggcttctggtcatccttcagaccaagctgtacaccctgcctgcaagccacgccacgcgtgtgtatgagatgctggtcagccacattcagctccactacaagcacagctacaccctgccaatcgcgagcagcatccggctgcaggcctttgacttcctgttgctgctgcgggccgactcactgcaccgcctgggcctgcccaacaaggatggagtcgtgcggttcagcccctactgcgtctgcgactacatggagccagagagaggctctgagaagaagaccagcggccccctttctcctcccacagggcctcctggcccggcgcctgcaggccccgccgtgcggctggggtccgtgccctactccctgctcttccgcgtcctgctgcagtgcttgaagcaggagtctgactggaaggtgctgaagctggttctgggcaggctgcctgagtccctgcgctataaagtgctcatctttacttccccttgcagtgtggaccagctgtgctctgctctctgctccatgctttcaggcccaaagacactggagcggctccgaggcgccccagaaggcttctccagaactgacttgcacctggccgtggttccagtgctgacagcattaatctcttaccataactacctggacaaaaccaaacagcgcgagatggtctactgcctggagcagggcctcatccaccgctgtgccagccagtgcgtcgtggccttgtccatctgcagcgtggagatgcctgacatcatcatcaaggcgctgcctgttctggtggtgaagctcacgcacatctcagccacagccagcatggccgtcccactgctggagttcctgtccactctggccaggctgccgcacctctacaggaactttgccgcggagcagtatgccagtgtgttcgccatctccctgccgtacaccaacccctccaagtttaatcagtacatcgtgtgtctggcccatcacgtcatagccatgtggttcatcaggtgccgcctgcccttccggaaggattttgtccctttcatcactaagggcctgcggtccaatgtcctcttgtcttttgatgacacccccgagaaggacagcttcagggcccggagtactagtctcaacgagagacccaagaggatacagacgtccctcaccagtgccagcttggggtctgcagatgagaactccgtggcccaggctgacgatagcctgaaaaacctccacctggagctcacggaaacctgtctggacatgatggctcgatacgtcttctccaacttcacggctgtcccgaagaggtctcctgtgggcgagttcctcctagcgggtggcaggaccaaaacctggctggttgggaacaagcttgtcactgtgacgacaagcgtgggaaccgggacccggtcgttactaggcctggactcgggggagctgcagtccggcccggagtcgagctccagccccggggtgcatgtgagacagaccaaggaggcgccggccaagctggagtcccaggctgggcagcaggtgtcccgtggggcccgggatcgggtccgttccatgtcggggggccatggtcttcgagttggcgccctggacgtgccggcctcccagttcctgggcagtgccacttctccaggaccacggactgcaccagccgcgaaacctgagaaggcctcagctggcacccgggttcctgtgcaggagaagacgaacctggcggcctatgtgcccctgctgacccagggctgggcggagatcctggtccggaggcccacagggaacaccagctggctgatgagcctggagaacccgctcagccctttctcctcggacatcaacaacatgcccctgcaggagctgtctaacgccctcatggcggctgagcgcttcaaggagcaccgggacacagccctgtacaagtcactgtcggtgccggcagccagcacggccaaaccccctcctctgcctcgctccaacacagtggcctctttctcctccctgtaccagtccagctgccaaggacagctgcacaggagcgtttcctgggcagactccgccgtggtcatggaggagggaagtccgggcgaggttcctgtgctggtggagcccccagggttggaggacgttgaggcagcgctaggcatggacaggcgcacggatgcctacagcaggtcgtcctcagtctccagccaggaggagaagtcgctccacgcggaggagctggttggcaggggcatccccatcgagcgagtcgtctcctcggagggtggccggccctctgtggacctctccttccagccctcgcagcccctgagcaagtccagctcctctcccgagctgcagactctgcaggacatcctcggggaccctggggacaaggccgacgtgggccggctgagccctgaggttaaggcccggtcacagtcagggaccctggacggggaaagtgctgcctggtcggcctcgggcgaagacagtcggggccagcccgagggtcccttgccttccagctccccccgctcgcccagtggcctccggccccgaggttacaccatctccgactcggccccatcacgcaggggcaagagagtagagagggacgccttaaagagcagagccacagcctccaatgcagagaaagtgccaggcatcaaccccagtttcgtgttcctgcagctctaccattcccccttctttggcgacgagtcaaacaagccaatcctgctgcccaatgagtcacagtcctttgagcggtcggtgcagctcctcgaccagatcccatcatacgacacccacaagatcgccgtcctgtatgttggagaaggccagagcaacagcgagctcgccatcctgtccaatgagcatggctcctacaggtacacggagttcctgacgggcctgggccggctcatcgagctgaaggactgccagccggacaaggtgtacctgggaggcctggacgtgtgtggtgaggacggccagttcacctactgctggcacgatgacatcatgcaagccgtcttccacatcgccaccctgatgcccaccaaggacgtggacaagcaccgctgcgacaagaagcgccacctgggcaacgactttgtgtccattgtctacaatgactccggtgaggacttcaagcttggcaccatcaagggccagttcaactttgtccacgtgatcgtcaccccgctggactacgagtgcaacctggtgtccctgcagtgcaggaaagacatggagggccttgtggacaccagcgtggccaagatcgtgtctgaccgcaacctgcccttcgtggcccgccagatggccctgcacgcaaatatggcctcacaggtgcatcatagccgctccaaccccaccgatatctacccctccaagtggattgcccggctccgccacatcaagcggctccgccagcggatctgcgaggaagccgcctactccaaccccagcctacctctggtgcaccctccgtcccatagcaaagcccctgcacagactccagccgagcccacacctggctatgaggtgggccagcggaagcgcctcatctcctcggtggaggacttcaccgagtttgtgtgaggccggggccctccctcctgcactggccttggacggtattgcctgtcagtgaaataaataaagtcctgaccccagtgcacagacatagaggca

SEQ ID NO: 195814 - DNA, 5434 bp, Homo sapiens
  Payload ID: 18644
  Gene Name: tuberous sclerosis 2
  ENST ID: ENST00000568454
  CDS Start-End: 69-5324
agttttaagtcatggcgggtgcgaacgggtctctgctgcaggcggctccgtgacagctcctgcttcacatggaggggttttctggtgcgtcctggtccaccatggccaaaccaacaagcaaagattcaggcttgaaggagaagtttaagattctgttgggactgggaacaccgaggccaaatcccaggtctgcagagggtaaacagacggagtttatcatcaccgcggaaatactgagagaactgagcatggaatgtggcctcaacaatcgcatccggatgatagggcagatttgtgaagtcgcaaaaaccaagaaatttgaagagcacgcagtggaagcactctggaaggcggtcgcggatctgttgcagccggagcggccgctggaggcccggcacgcggtgctggctctgctgaaggccatcgtgcaggggcagggcgagcgtttgggggtcctcagagccctcttctttaaggtcatcaaggattacccttccaacgaagaccttcacgaaaggctggaggttttcaaggccctcacagacaatgggagacacatcacctacttggaggaagagctggctgactttgtcctgcagtggatggatgttggcttgtcctcggaattccttctggtgctggtgaacttggtcaaattcaatagctgttacctcgacgagtacatcgcaaggatggttcagatgatctgtctgctgtgcgtccggaccgcgtcctctgtggacatagaggtctccctgcaggtgctggacgccgtggtctgctacaactgcctgccggctgagagcctcccgctgttcatcgttaccctctgtcgcaccatcaacgtcaaggagctctgcgagccttgctggaagctgatgcggaacctccttggcacccacctgggccacagcgccatctacaacatgtgccacctcatggaggacagagcctacatggaggacgcgcccctgctgagaggagccgtgttttttgtgggcatggctctctggggagcccaccggctctattctctcaggaactcgccgacatctgtgttgccatcattttaccaggccatggcatgtccgaacgaggtggtgtcctatgagatcgtcctgtccatcaccaggctcatcaagaagtataggaaggagctccaggtggtggcgtgggacattctgctgaacatcatcgaacggctccttcagcagctccagaccttggacagcccggagctcaggaccatcgtccatgacctgttgaccacggtggaggagctgtgtgaccagaacgagttccacgggtctcaggagagatactttgaactggtggagagatgtgcggaccagaggcctgagtcctccctcctgaacctgatctcctatagagcgcagtccatccacccggccaaggacggctggattcagaacctgcaggcgctgatggagagattcttcaggagcgagtcccgaggcgccgtgcgcatcaaggtgctggacgtgctgtcctttgtgctgctcatcaacaggcagttctatgaggaggagctgattaactcagtggtcatctcgcagctctcccacatccccgaggataaagaccaccaggtccgaaagctggccacccagttgctggtggacctggcagagggctgccacacacaccacttcaacagcctgctggacatcatcgagaaggtgatggcccgctccctctccccacccccggagctggaagaaagggatgtggccgcatactcggcctccttggaggatgtgaagacagccgtcctggggcttctggtcatccttcagaccaagctgtacaccctgcctgcaagccacgccacgcgtgtgtatgagatgctggtcagccacattcagctccactacaagcacagctacaccctgccaatcgcgagcagcatccggctgcaggcctttgacttcctgttgctgctgcgggccgactcactgcaccgcctgggcctgcccaacaaggatggagtcgtgcggttcagcccctactgcgtctgcgactacatggagccagagagaggctctgagaagaagaccagcggccccctttctcctcccacagggcctcctggcccggcgcctgcaggccccgccgtgcggctggggtccgtgccctactccctgctcttccgcgtcctgctgcagtgcttgaagcaggagtctgactggaaggtgctgaagctggttctgggcaggctgcctgagtccctgcgctataaagtgctcatctttacttccccttgcagtgtggaccagctgtgctctgctctctgctccatgctttcaggcccaaagacactggagcggctccgaggcgccccagaaggcttctccagaactgacttgcacctggccgtggttccagtgctgacagcattaatctcttaccataactacctggacaaaaccaaacagcgcgagatggtctactgcctggagcagggcctcatccaccgctgtgccagccagtgcgtcgtggccttgtccatctgcagcgtggagatgcctgacatcatcatcaaggcgctgcctgttctggtggtgaagctcacgcacatctcagccacagccagcatggccgtcccactgctggagttcctgtccactctggccaggctgccgcacctctacaggaactttgccgcggagcagtatgccagtgtgttcgccatctccctgccgtacaccaacccctccaagtttaatcagtacatcgtgtgtctggcccatcacgtcatagccatgtggttcatcaggtgccgcctgcccttccggaaggattttgtccctttcatcactaagggcctgcggtccaatgtcctcttgtcttttgatgacacccccgagaaggacagcttcagggcccggagtactagtctcaacgagagacccaagaggatacagacgtccctcaccagtgccagcttggggtctgcagatgagaactccgtggcccaggctgacgatagcctgaaaaacctccacctggagctcacggaaacctgtctggacatgatggctcgatacgtcttctccaacttcacggctgtcccgaagaggtctcctgtgggcgagttcctcctagcgggtggcaggaccaaaacctggctggttgggaacaagcttgtcactgtgacgacaagcgtgggaaccgggacccggtcgttactaggcctggactcgggggagctgcagtccggcccggagtcgagctccagccccggggtgcatgtgagacagaccaaggaggcgccggccaagctggagtcccaggctgggcagcaggtgtcccgtggggcccgggatcgggtccgttccatgtcggggggccatggtcttcgagttggcgccctggacgtgccggcctcccagttcctgggcagtgccacttctccaggaccacggactgcaccagccgcgaaacctgagaaggcctcagctggcacccgggttcctgtgcaggagaagacgaacctggcggcctatgtgcccctgctgacccagggctgggcggagatcctggtccggaggcccacagggaacaccagctggctgatgagcctggagaacccgctcagccctttctcctcggacatcaacaacatgcccctgcaggagctgtctaacgccctcatggcggctgagcgcttcaaggagcaccgggacacagccctgtacaagtcactgtcggtgccggcagccagcacggccaaaccccctcctctgcctcgctccaacacagactccgccgtggtcatggaggagggaagtccgggcgaggttcctgtgctggtggagcccccagggttggaggacgttgaggcagcgctaggcatggacaggcgcacggatgcctacagcaggtcgtcctcagtctccagccaggaggagaagtcgctccacgcggaggagctggttggcaggggcatccccatcgagcgagtcgtctcctcggagggtggccggccctctgtggacctctccttccagccctcgcagcccctgagcaagtccagctcctctcccgagctgcagactctgcaggacatcctcggggaccctggggacaaggccgacgtgggccggctgagccctgaggttaaggcccggtcacagtcagggaccctggacggggaaagtgctgcctggtcggcctcgggcgaagacagtcggggccagcccgagggtcccttgccttccagctccccccgctcgcccagtggcctccggccccgaggttacaccatctccgactcggccccatcacgcaggggcaagagagtagagagggacgccttaaagagcagagccacagcctccaatgcagagaaagtgccaggcatcaaccccagtttcgtgttcctgcagctctaccattcccccttctttggcgacgagtcaaacaagccaatcctgctgcccaatgagtcacagtcctttgagcggtcggtgcagctcctcgaccagatcccatcatacgacacccacaagatcgccgtcctgtatgttggagaaggccagagcaacagcgagctcgccatcctgtccaatgagcatggctcctacaggtacacggagttcctgacgggcctgggccggctcatcgagctgaaggactgccagccggacaaggtgtacctgggaggcctggacgtgtgtggtgaggacggccagttcacctactgctggcacgatgacatcatgcaagccgtcttccacatcgccaccctgatgcccaccaaggacgtggacaagcaccgctgcgacaagaagcgccacctgggcaacgactttgtgtccattgtctacaatgactccggtgaggacttcaagcttggcaccatcaagggccagttcaactttgtccacgtgatcgtcaccccgctggactacgagtgcaacctggtgtccctgcagtgcaggaaagacatggagggccttgtggacaccagcgtggccaagatcgtgtctgaccgcaacctgcccttcgtggcccgccagatggccctgcacgcaaatatggcctcacaggtgcatcatagccgctccaaccccaccgatatctacccctccaagtggattgcccggctccgccacatcaagcggctccgccagcggatctgcgaggaagccgcctactccaaccccagcctacctctggtgcaccctccgtcccatagcaaagcccctgcacagactccagccgagcccacacctggctatgaggtgggccagcggaagcgcctcatctcctcggtggaggacttcaccgagtttgtgtgaggccggggccctccctcctgcactggccttggacggtattgcctgtcagtgaaataaataaagtcctgaccccagtgcacagacatagaggcacagattgcagtcagaca

SEQ ID NO: 195815 - DNA, 590 bp, Homo sapiens
  Payload ID: 18644
  Gene Name: tuberous sclerosis 2
  ENST ID: ENST00000467949
  CDS Start-End: 1-590
agtgctgccgggactgagctcggtgctccctgcaggatgatctgtctgctgtgcgtccggaccgcgtcctctgtggacatagaggtctccctgcaggtgctggacgccgtggtctgctacaactgcctgccggctgagagcctcccgctgttcatcgttaccctctgtcgcaccatcaacgtcaaggagctctgcgagccttgctggaagctgatgcggaacctccttggcacccacctgggccacagcgccatctacaacatgtgccacctcatggaggacagagcctacatggaggacgcgcccctgctgagaggagccgtgttttttgtgggcatggctctctggggagcccaccggctctattctctcaggaactcgccgacatctgtgttgccatcattttaccaggagtcctccctcctgaacctgatctcctatagagcgcagtccatccacccggccaaggacggctggattcagaacctgcaggcgctgatggagagattcttcaggagcgagtcccgaggcgccgtgcgcatcaaggtgctggacgtgctgtcctttgtgctgctcatcaacaggcagtt

SEQ ID NO: 195816 - DNA, 1687 bp, Homo sapiens
  Payload ID: 18644
  Gene Name: tuberous sclerosis 2
  ENST ID: ENST00000569110
  CDS Start-End: 1-1606
gctttgggacctcccaccctctctccttagcgtccccagctgtgggtctggcttggagttggaggactccgccgtggtcatggaggagggaagtccgggcgaggttcctgtgctggtggagcccccagggttggaggacgttgaggcagcgctaggcatggacaggcgcacggatgcctacagcaggtcgtcctcagtctccagccaggaggagaagtcgctccacgcggaggagctggttggcaggggcatccccatcgagcgagtcgtctcctcggagggtggccggccctctgtggacctctccttccagccctcgcagcccctgagcaagtccagctcctctcccgagctgcagactctgcaggacatcctcggggaccctggggacaaggccgacgtgggccggctgagccctgaggttaaggcccggtcacagtcagggaccctggacggggaaagtgctgcctggtcggcctcgggcgaagacagtcggggccagcccgagggtcccttgccttccagctccccccgctcgcccagtggcctccggccccgaggttacaccatctccgactcggccccatcacgcaggggcaagagagtagagagggacgccttaaagagcagagccacagcctccaatgcagagaaagtgccaggcatcaaccccagtttcgtgttcctgcagctctaccattcccccttctttggcgacgagtcaaacaagccaatcctgctgcccaatgagtcacagtcctttgagcggtcggtgcagctcctcgaccagatcccatcatacgacacccacaagatcgccgtcctgtatgttggagaaggccagagcaacagcgagctcgccatcctgtccaatgagcatggctcctacaggtacacggagttcctgacgggcctgggccggctcatcgagctgaaggactgccagccggacaaggtgtacctgggaggcctggacgtgtgtggtgaggacggccagttcacctactgctggcacgatgacatcatgcaagccgtcttccacatcgccaccctgatgcccaccaaggacgtggacaagcaccgctgcgacaagaagcgccacctgggcaacgactttgtgtccattgtctacaatgactccggtgaggacttcaagcttggcaccatcaagggccagttcaactttgtccacgtgatcgtcaccccgctggactacgagtgcaacctggtgtccctgcagtgcaggaaagacatggagggccttgtggacaccagcgtggccaagatcgtgtctgaccgcaacctgcccttcgtggcccgccagatggccctgcacgcaaatatggcctcacaggtgcatcatagccgctccaaccccaccgatatctacccctccaagtggattgcccggctccgccacatcaagcggctccgccagcggatctgcgaggaagccgcctactccaaccccagcctacctctggtgcaccctccgtcccatagcaaagcccctgcacagactccagccgagcccacacctggctatgaggtgggccagcggaagcgcctcatctcctcggtggaggacttcaccgagtttgtgtgaggccggggccctccctcctgcactggccttggacggtattgcctgtcagtgaaataaataaagtcctgaccccagtgcaca

SEQ ID NO: 195817 - DNA, 542 bp, Homo sapiens
  Payload ID: 18644
  Gene Name: tuberous sclerosis 2
  ENST ID: ENST00000568566
  CDS Start-End: 1-93
atctcctatagagcgcagtccatccacccggccaaggacggctggattcagaacctgcaggcgctgatggagagattcttcaggaggagctgattaactcagtggtcatctcgcagctctcccacatccccgaggataaagaccaccaggtccgaaagctggccacccagttgctggtggacctggcagagggctgccacacacaccacttcaacagcctgctggacatcatcgagaaggtgatggcccgctccctctccccacccccggagctggaagaaagggatgtggccgcatactcggcctccttggaggatgtgaagacagccgtcctggggcttctggtcatccttcagaccaagctgtacaccctgcctgcaagccacgccacgcgtgtgtatgagatgctggtcagccacattcagctccactacaagcacagctacaccctgccaatcgcgagcagcatccggctgcaggcctttgacttcctgttgctgctgcgggccgactcactgcaccgcctgggcctgcccaacaag

SEQ ID NO: 195818 - DNA, 577 bp, Homo sapiens
  Payload ID: 18644
  Gene Name: tuberous sclerosis 2
  ENST ID: ENST00000471143
  CDS Start-End: 1-97
tttcatcactaaggtgggctcagggccggtgaaggctgtgtctctcggtaggccagggcttgctttgcccttggctgtccatggtcgggcagagtgacagggcctgcggtccaatgtcctcttgtcttttgatgacacccccgagaaggacagcttcagggcccggagtactagtctcaacgagagacccaagaggatacagacgtccctcaccagtgccagcttggggtctgcagatgagaactccgtggcccaggctgacgatagcctgaaaaacctccacctggagctcacggaaacctgtctggacatgatggctcgatacgtcttctccaacttcacggctgtcccgaagaggtctcctgtgggcgagttcctcctagcgggtggcaggaccaaaacctggctggttgggaacaagcttgtcactgtgacgacaagcgtgggaaccgggacccggtcgttactaggcctggactcgggggagctgcagtccggcccggagtcgagctccagccccggggtgcatgtgagacagaccaaggaggcgccggccaagctggagtcccaggctggg

SEQ ID NO: 195819 - DNA, 563 bp, Homo sapiens
  Payload ID: 18644
  Gene Name: tuberous sclerosis 2
  ENST ID: ENST00000483020
  CDS Start-End: 1-108
gattttgtccctttcatcactaaggtgggctcagggccggtgaaggctgtgtctctcggtaggccagggcttgctttgcccttggctgtccatggtcgggcagagtgacagggcctgcggtccaatgtcctcttgtcttttgatgacacccccgagaaggacagcttcagggcccggagtactagtctcaacgagagacccaagagcaggatacagacgtccctcaccagtgccagcttggggtctgcagatgagaactccgtggcccaggctgacgatagcctgaaaaacctccacctggagctcacggaaacctgtctggacatgatggctcgatacgtcttctccaacttcacggctgtcccgaagaggtctcctgtgggcgagttcctcctagcgggtggcaggaccaaaacctggctggttgggaacaagcttgtcactgtgacgacaagcgtgggaaccgggacccggtcgttactaggcctggactcgggggagctgcagtccggcccggagtcgagctccagccccggggtgcatgtgagacagaccaaggaggc

SEQ ID NO: 195820 - DNA, 2301 bp, Homo sapiens
  Payload ID: 18645
  Gene Name: tubulin folding cofactor A
  Uniprot ID: O75347
  ENST ID: ENST00000306388
  CDS Start-End: 31-420
gcccctccttctcgcggcgctcgagggaccatggccgatcctcgcgtgagacagatcaagatcaagaccggcgtggtgaagcggttggtcaaagaaaaagtgatgtatgaaaaagaggcaaaacaacaagaagaaaagattgaaaaaatgagagctgaagacggtgaaaattatgacattaaaaagcaggcagagatcctacaagaatccaggatgatgatcccagattgccagcgcaggttggaagccgcatatttggatcttcaacggatactagtaagcaaagacttctgtgtcatgtttaaattttttttttcaatccaatacatggaaagccaaaagtttaaatatttaacactgagaactagttggcagtatttcttattcacttgccctttataccgctatattttaaaataattaatggagtttaaattgtgttttgaattatgcctccagtaaaagtactgttttctagcatgtttgttcagtttattaaaatttagctagttaaatttatttaagttatgatagtaccagtattgtccagcaatgtcttgattatttggttttcatacataaagatcttttgagacattgaggatgagttgactgattaaaattttaaaagatctaatgtttcaaaagaatttgggatcttattaaaaggatcttgaattctttcacattcaaacctagatcagtttgagagggggaaaaaacctggtaatctatgtagtcccctcatactaacttggagctgaataacacttatacttgctggtataaatgccttgtgatacagaaggtagataaagcaggaaataataactgttaaaatactatctaagacaggaagcatcatttgtatttcttgacagtttaaatgcttttttctctcatgaatctagtagctgagaaagtaatagaaattgcttggaaaaaaataatgttggccgccaggtgcagtggctcatgcctgtaatcccagcactttgggaggctgaggtgggtggatcacgagtcaggagttcaagaccagcctgaccaacatggtgaaatcctgtctctactaaaaataccaaaataataataataataataatgtatttggatgatatatttgtatgtgaagatgtattcaacaatatctctgcccttgaagagcttgtatttactaacagagaacaaagatgtgtttaaggtataacatggaggtttaagaaattcttacgtatagtttgagctaagcaaattctcagtcgttttgctttcagttttcatattaaatacacacatactttatttcctctactgtttgtatatctccatcttttattgacctgacataaattgctaaccatagcttcatttaaaaatcaaacaaaatttcctgtgtactttagataatattatttcatttgtctgttatcattacaatatattagtaaaagttgcctgtatatcagtattatggaaaaactcaatctttaaatatcagaaaatgaaagatgtattttgtttcctttagtgtagggtatgtaatacccattagcaagcaggcaattcatttgtttaattcaaagattatatttaactctgttgtgacatcagaagccttctttgtcattgtgaatagtcagtggattattttggcctgaatgctgtcatatatgtaacatgttagtaaatcttcctttttacttttctcttttgtatgatgatgatgggtcaacaaaatgagaataaactttttctgaggtttttatttaattaatgctggtagctttagaagactgttattcacttattttatgagaatatatacagtgaaacaaaaccaccagttatttcttcctttccttgtaaagaaggaacagaatgtgggaaacctgtggaattacaatatatttagatgaggcttgggattttttacttttaattttttagttattaacattaatggtttgtaatatttgagtaaataacaaagtactgaaacttgaaaaggataaacttaatttttattgtatttcattttaggaaaatgaaaaagacttggaagaagctgaggaatataaagaagcacgtttagtactggattcagtgaagttagaagcctgaaacttttctcgtatggggtggtttttgcattaaatcctggggtccattttacaatccattatttttgaccactgctatgtgttcaagtagtatgagaatgtgattgtttttatctggttacatatatatttctttgtctaatttaatatgtcaaataaatgagttcatctaataaaa

SEQ ID NO: 195821 - DNA, 683 bp, Homo sapiens
  Payload ID: 18645
  Gene Name: tubulin folding cofactor A
  Uniprot ID: O75347
  ENST ID: ENST00000380377
  CDS Start-End: 105-431
gcatgcgcgccggcgaccacgcctaaatagccgcagcctctgcgcgtcgccctccacggttaccccggctctccgcccctccttctcgcggcgctcgagggaccatggccgatcctcgcgtgagacagatcaagatcaagaccggcgtggtgaagcggttggtcaaagaaaaagtgatgtatgaaaaagaggcaaaacaacaagaagaaaagattgaaaaaatgagagctgaagacggtgaaaattatgacattaaaaagcaggcagagatcctacaagaatccaggatgatgatcccagattgccagcgcaggttggaagccgcatatttggatcttcaacggatactagaaaatgaaaaagacttggaagaagctgaggaatataaagaagcacgtttagtactggattcagtgaagttagaagcctgaaacttttctcgtatggggtggtttttgcattaaatcctggggtccattttacaatccattatttttgaccactgctatgtgttcaagtagtatgagaatgtgattgtttttatctggttacatatatatttctttgtctaatttaatatgtcaaataaatgagttcatctaataaaattgtttattttatactttacaaaatttttaaattaaccttttatcattaaaccacatagactttatgacagagaa

SEQ ID NO: 195822 - DNA, 157 bp, Homo sapiens
  Payload ID: 18645
  Gene Name: tubulin folding cofactor A
  ENST ID: ENST00000520039
  CDS Start-End: 18-98
gcggcgctcgagggaccatggccgatcctcgcgtgagacagatcaagatcaagaccggcgtggtgaagcggcagagatcctacaagaatccaggatgatgatcccagattgccagcgcaggttggaagccgcatatttggatcttcaacggatacta

SEQ ID NO: 195823 - DNA, 545 bp, Homo sapiens
  Payload ID: 18645
  Gene Name: tubulin folding cofactor A
  ENST ID: ENST00000517679
  CDS Start-End: 9-368
tagggattatgttgacaaggacttcctggtttcatggcttcttttcttggttttcgtcttcaatttgctggagtacattaagtaaatttctcaggttggtcaaagaaaaagtgatgtatgaaaaagaggcaaaacaacaagaagaaaagattgaaaaaatgagagctgaagacggtgaaaattatgacattaaaaagcaggcagagatcctacaagaatccaggatgatgatcccagattgccagcgcaggttggaagccgcatatttggatcttcaacggatactagaaaatgaaaaagacttggaagaagctgaggaatataaagaagcacgtttagtactggattcagtgaagttagaagcctgaaacttttctcgtatggggtggtttttgcattaaatcctggggtccattttacaatccattatttttgaccactgctatgtgttcaagtagtatgagaatgtgattgtttttatctggttacatatatatttctttgtctaatttaatatgtcaaataaatgagttcatctaataaaa

SEQ ID NO: 195824 - DNA, 446 bp, Homo sapiens
  Payload ID: 18645
  Gene Name: tubulin folding cofactor A
  ENST ID: ENST00000520361
  CDS Start-End: 37-276
ctctccgcccctccttctcgcggcgctcgagggaccatggccgatcctcgcgtgagacagatcaagatcaagaccggcgtggtgaagcggttggtcaaagaaaaagtgatgtatgaaaaagaggcaaaacaacaagaagaaaagattgaaaaaatgagagctgaagacggtgaaaattatgacattaaaaagcaggaaaatgaaaaagacttggaagaagctgaggaatataaagaagcacgtttagtactggattcagtgaagttagaagcctgaaacttttctcgtatggggtggtttttgcattaaatcctggggtccattttacaatccattatttttgaccactgctatgtgttcaagtagtatgagaatgtgattgtttttatctggttacatatatatttctttgtctaatttaatatgtcaaataaatgagttcatct

SEQ ID NO: 195825 - DNA, 435 bp, Homo sapiens
  Payload ID: 18645
  Gene Name: tubulin folding cofactor A
  ENST ID: ENST00000522370
  CDS Start-End: 167-421
aggtgcgcaagtttatttcagcctgcaaacgtgcttctgtggccctcagcgggacggagaaccaggcggttgcggcaaaaagagcttgggatttcaaggcaggattttctccaggcctagaaaggagaagcctctgcccagagaaaggttggtcaaagaaaaagtgatgtatgaaaaagaggcaaaacaacaagaagaaaagattgaaaaaatgagagctgaagacggtgaaaattatgacattaaaaagcaggcagagatcctacaagaatccaggatgatgatcccagattgccagcgcaggttggaagccgcatatttggatcttcaacggatactagaaaatgaaaaagacttggaagaagctgaggaatataaagaagcacgtttagtactggattcagtgaagttagaagcctgaaacttttctcgtat

SEQ ID NO: 195826 - DNA, 551 bp, Homo sapiens
  Payload ID: 18645
  Gene Name: tubulin folding cofactor A
  ENST ID: ENST00000518338
  CDS Start-End: 5-400
gaccatggccgatcctcgcgtgagacagatcaagatcaagaccggcgtggtgaagcggttggtcaaagaaaaagtgatgtatgaaaaagaggcaaaacaacaagaagaaaagattgaaaaaatgagagctgaagacggtgaaaattatgacattaaaaagcaggctggtcttcaactcctggcctccagtgatcctcccaccccagcctctcagagtcctgggatgataagcgcagagatcctacaagaatccaggatgatgatcccagattgccagcgcaggttggaagccgcatatttggatcttcaacggatactagaaaatgaaaaagacttggaagaagctgaggaatataaagaagcacgtttagtactggattcagtgaagttagaagcctgaaacttttctcgtatggggtggtttttgcattaaatcctggggtccattttacaatccattatttttgaccactgctatgtgttcaagtagtatgagaatgtgattgtttttatctggttacatatatatttctttgtctaatttaatatgt

SEQ ID NO: 195827 - DNA, 1473 bp, Homo sapiens
  Payload ID: 18646
  Gene Name: tubulin folding cofactor B
  Uniprot ID: Q99426
  ENST ID: ENST00000221855
  CDS Start-End: 576-1310
gccgcctcgggctcggctctctccgcgcagaggtttcatggcttgcttcaatcttttgatatcttagagtaattgcttccaatttttgggcatcgccgcctcagtttacagaatagtatggatctggtgccagagccgggaaaacgatgcgcatcgtaaaccgcaaaacactgagcatccaggacagaagccaaggcgcttggcttggttgaaggccagtgcgcatgcgcgagtttacccttcgcggactgggcgagctcttgccactcctacctccgggcttcagtcttcgccgcctgttctggtcctttcccgggccgctattggaagaaccgtgaactatggaaggcccctctggattggctgggctggcccaagagtaaggagagccctcttcctggcggtggggaagggacggcggcgattggcggacgctcctggcaggagagcgcggattggtcaggcacggagcaggaggcggggctgatagcccagcagcagcagcggcggcggcggctgcggagcgggtgtgaggcggctggaccgcgctgcaggcatccgcagggcgcggcaagatggaggtgacgggggtgtcggcacccacggtgaccgttttcatcagcagctccctcaacaccttccgctccgagaagcgatacagccgcagcctcaccatcgctgagttcaagtgtaaactggagttgctggtgggcagccctgcttcctgcatggaactggagctgtatggagttgacgacaagttctacagcaagctggatcaagaggatgcgctcctgggctcctaccctgtagatgacggctgccgcatccacgtcattgaccacagtggcgcccgccttggtgagtatgaggacgtgtcccgggtggagaagtacacgatctcacaagaagcctacgaccagaggcaagacacggtccgctctttcctgaagcgcagcaagctcggccggtacaacgaggaggagcgggctcagcaggaggccgaggccgcccagcgcctggccgaggagaaggcccaggccagctccatccccgtgggcagccgctgtgaggtgcgggcggcgggacaatcccctcgccggggcaccgtcatgtatgtaggtctcacagatttcaagcctggctactggattggtgtccgctatgatgagccactggggaaaaatgatggcagtgtgaatgggaaacgctacttcgaatgccaggccaagtatggcgcctttgtcaagccagcagtcgtgacggtgggggacttcccggaggaggactacgggttggacgagatatgacacctaaggaattcccctgcttcagctcctagctcagccactgactgcccctcctgtgtgtgcccatggcccttttctcctgaccccattttaattttattcattttttcctttgccattgatttttgagactcatgcattaaattcactagaaacccagaaa

SEQ ID NO: 195828 - DNA, 724 bp, Homo sapiens
  Payload ID: 18646
  Gene Name: tubulin folding cofactor B
  ENST ID: ENST00000589996
  CDS Start-End: 43-618
ggcggctggaccgcgctgcaggcatccgcagggcgcggcaagatggaggtgacgggggtgtcggcacccacggtgaccgttttcatcagcagctccctcaacaccttccgctccgagaagcgatacagccgcagcctcaccatcgctgagttcaagtgtaaactggagttgctggtgggcagccctgcttcctgcatggaactggagctgtatggagttgacgacaagttctacagcaagctggatcaagaggatgcgctcctgggctcctaccctgtagatgacggctgccgcatccacgtcattgaccacagtggcgcccgccttggtgagtatgaggacgtgtcccgggtggagaagtacacgatctcacaagaagcctacgaccagaggcaagacacggtccgctctttcctgaagcgcagcaagctcggccggtacaacgaggaggagcgggctcagcaggaggccgaggccgcccagcgcctggccgaggagaaggcccaggccagctccatccccgtgggcagccgctgtgaggtctcacagatttcaagcctggctactggattggtgtccgctatgatgagccactggggaaaaatgatggcagtgtgaatgggaaacgctacttcgaatgccaggccaagtatggcgcctttgtcaagccagcagtcgtgacggtgggggacttcccggaggaggactacgggttggacgagat

SEQ ID NO: 195829 - DNA, 399 bp, Homo sapiens
  Payload ID: 18646
  Gene Name: tubulin folding cofactor B
  ENST ID: ENST00000591296
  CDS Start-End: 1-399
tccctcaacaccttccgctccgagaagcgatacagccgcagcctcaccatcgctgagttcaagtgtaaactggagttgctggtgggcagccctgcttcctgcatggaactggagctgtatggagttgacgacaagttctacagcaagctggatcaagaggatgcgctcctgggctcctaccctgtagatgacggctgccgcatccacagtcttgctctgtctcccaggctggcgtgcagtggcatgatctcggctcactgcaacctccgcctccccggttcaagcgattctcctgcctcagcctcccgagtaggtgggattacagatgcccgccactacaccagggtcattgaccacagtggcgcccgccttggtgagtatgaggacgtgtcccgggtg

SEQ ID NO: 195830 - DNA, 776 bp, Homo sapiens
  Payload ID: 18646
  Gene Name: tubulin folding cofactor B
  ENST ID: ENST00000588385
  CDS Start-End: 268-776
cgcggcggggcgggtccggagagaactcgagagtgcagagatgagggccgggtccagcgaaaaatccgacggtccagagggcgggggcaagaggcgaggggctggattgcggccccgtgcgtcctgactggggggtcttttggaggaaaagggacgtggcgatggtcattgatgcaaggggcggggcctccgtggcctccttcttctcaccctgcctcctcctcacagtgtaaactggagttgctggtgggcagccctgcttcctgcatggaactggagctgtatggagttgacgacaagttctacagcaagctggatcaagaggatgcgctcctgggctcctaccctgtagatgacggctgccgcatccacgtcattgaccacagtggcgcccgccttggtgagtatgaggacgtgtcccgggtggagaagtacacgatctcacaagaagcctacgaccagaggcaagacacggtccgctctttcctgaagcgcagcaagctcggccggtacaacgaggaggagcgggctcagcaggaggccgaggccgcccagcgcctggccgaggagaaggcccaggccagctccatccccgtgggcagccgctgtgaggtgcgggcggcgggacaatcccctcgccggggcaccgtcatgtatgtaggtctcacagatttcaagcctggctactggattggtgtccgctatgatgagccactggggaaaaatgatggcagtgtgaatgggaaacgctacttcgaatgccaggccaagtatgg

SEQ ID NO: 195831 - DNA, 875 bp, Homo sapiens
  Payload ID: 18646
  Gene Name: tubulin folding cofactor B
  Uniprot ID: Q99426
  ENST ID: ENST00000585746
  CDS Start-End: 131-712
ctcgagagtgcagagatgagggccgggtccagcgaaaaatccgacggtccagagggcgggggcaagaggcgaggggctggattgcggcccctgtaaactggagttgctggtgggcagccctgcttcctgcatggaactggagctgtatggagttgacgacaagttctacagcaagctggatcaagaggatgcgctcctgggctcctaccctgtagatgacggctgccgcatccacgtcattgaccacagtggcgcccgccttggtgagtatgaggacgtgtcccgggtggagaagtacacgatctcacaagaagcctacgaccagaggcaagacacggtccgctctttcctgaagcgcagcaagctcggccggtacaacgaggaggagcgggctcagcaggaggccgaggccgcccagcgcctggccgaggagaaggcccaggccagctccatccccgtgggcagccgctgtgaggtgcgggcggcgggacaatcccctcgccggggcaccgtcatgtatgtaggtctcacagatttcaagcctggctactggattggtgtccgctatgatgagccactggggaaaaatgatggcagtgtgaatgggaaacgctacttcgaatgccaggccaagtatggcgcctttgtcaagccagcagtcgtgacggtgggggacttcccggaggaggactacgggttggacgagatatgacacctaaggaattcccctgcttcagctcctagctcagccactgactgcccctcctgtgtgtgcccatggcccttttctcctgaccccattttaattttattcattttttcctttgccattgatttttgagactcatgcattaaattcactagaaacccagaaa

SEQ ID NO: 195832 - DNA, 597 bp, Homo sapiens
  Payload ID: 18646
  Gene Name: tubulin folding cofactor B
  ENST ID: ENST00000589624
  CDS Start-End: 259-396
gcgggtccggagagaactcgagagtgcagagatgagggccgggtccagcgaaaaatccgacggtccagagggcgggggcaagaggcgaggggctggattgcggccccgtgcgtcctgactggggggtcttttggaggaaaagggacgtggcgatggtcattgatgcaaggggcggggcctccgtggcctccttcttctcaccctgcctcctcctcacagtgtaaactggagttgctggtgggcagccctgcttcctgcatggaactggagctgtatggagttgacgacaagttctacagcaagctggatcaagaggatgcgctcctgggctcctaccctgtagatgacggctgccgcatccacaaattagctgggcgtggtggcagatgcctgtaatcctagctactcaggaggctgaggcaggaggatcacttgaacccaggagctggaagttgcagtgagctgagatcacaccactgcactccagtttggatgatagagtcattgaccacagtggcgcccgccttggtgagtatgaggacgtgtcccgggtggagaagtacacgatctcacaagaagcctacgaccagaggcaag

SEQ ID NO: 195833 - DNA, 466 bp, Homo sapiens
  Payload ID: 18646
  Gene Name: tubulin folding cofactor B
  ENST ID: ENST00000586868
  CDS Start-End: 9-191
cttcctgcatggaactggagctgtatggagttgacgacaagttctacagcaagctggatcaagaggatgcgctcctgggctcctaccctgtagatgacggctgccgcatccacgtctcacagatttcaagcctggctactggattggtgtccgctatgatgagccactggggaaaaatgatggcagtgtgaatgggaaacgctacttcgaatgccaggccaagtatggcgcctttgtcaagccagcagtcgtgacggtgggggacttcccggaggaggactacgggttggacgagatatgacacctaaggaattcccctgcttcagctcctagctcagccactgactgcccctcctgtgtgtgcccatggcccttttctcctgaccccattttaattttattcattttttcctttgccattgatttttgagactcatgcattaaattcactagaaacccagaaagt

SEQ ID NO: 195834 - DNA, 413 bp, Homo sapiens
  Payload ID: 18646
  Gene Name: tubulin folding cofactor B
  ENST ID: ENST00000629269
  CDS Start-End: 276-413
gattggtcaggcacggagcaggaggcggggctgatagcccagcagcagcagcggcggcggcggctgcggagcgggtgtgaggcggctggaccgcgctgcaggcatccgcagggcgcggcaagatggaggtgacgggggtgtcggcacccacggtgaccgttttcatcagcagctccctcaacaccttccgctccgagaagcgatacagccgcagcctcaccatcgctgagttcaagtgtaaactggagttgctggtgggcagccctgcttcctgcatggaactggagctgtatggagttgacgacaagttctacagcaagctggatcaagaggatgcgctcctgggctcctaccctgtagatgacggctgccgcatccacaaattagctgggcgtggtggcagatgcctgtaa

SEQ ID NO: 195835 - DNA, 1616 bp, Homo sapiens
  Payload ID: 18647
  Gene Name: tubulin folding cofactor C
  Uniprot ID: Q15814
  ENST ID: ENST00000372876
  CDS Start-End: 24-1064
gagagaggaagcttgaagccaatatggagtccgtcagttgctccgctgctgctgtcaggaccggagacatggagtcccagcgggacctgagcctggtgcctgagcggcttcagagacgcgaacaagaacggcagctggaagttgaaaggcggaaacaaaagcggcagaaccaggaggtagagaaggagaacagccactttttcgtcgccacctttgttcgggagcgagcggccgtggaagagcttctggagcgcgcggagtcggtcgagcggctggaggaggcggcctctcggctccaggggctgcagaaactaatcaacgactcagtttttttcctagccgcttacgacctgcggcagggacaagaggcgctggcgcggctgcaggcggccttggccgagcggcgccgggggctgcagcccaagaagcgtttcgctttcaagacccggggaaaggatgctgcttcgtctaccaaagtagacgcggctcctggcatccccccggcagttgaaagcatacaggactccccgctgcccaagaaggcggaaggagacctcggccccagctgggtctgcggtttctccaacctggagtcccaagtcttggagaagagagccagcgagttgcaccagcgcgacgttcttttgaccgaactgagcaactgcacggtcagactgtatggaaatcccaacaccctgcggctaaccaaggcccacagctgcaagctgctctgcggtccggtgtctacctctgttttcctggaggactgcagtgactgcgtgctggcagtggcctgccaacagctccgcatacacagtacgaaagacacccgcatcttcctgcaggtgaccagcagggccatcgtggaggactgcagtgggatccagttcgccccttacacctggagctacccggagatcgacaaggacttcgagagctctggtttagataggagcaaaaataactggaacgatgttgacgattttaactggctggcccgggatatggcctccccaaactggagtattcttcctgaagaggagcgaaatatccagtgggactaagcagttgtcactctgttcttcactcctaccaaatactttccacgttggactttcccccttattgggtctcgaagtttacttattgtcacactgtgtatgttttcagcattttaaggctagagattgtaatgggctcctacttgtaatttccattaaattcgtaacaggtataacactaaagcatttttgctattttcgtcatgcctttgagactgagtcttactccgtcccccagcgtggtggcgcgctgggattacaggcgcgcgccaccacgcgaacttgtatttttagtagagacggggtttcgccatgttgtccgggctgctctcgaactcctgacctcaggtgatccacccgcttcagcttcccaaagtgctggcattacaggcgtgagccaccacgccagggctttatttatttatttttaccacaatagtttgaagcagtaagggggaaggagggtgattatattgctttgtaatggtttgtgatacttgaaacatcacggtgcataataaagtaggtctgcagtaaatacatgggtttgtttgg

SEQ ID NO: 195836 - DNA, 7168 bp, Homo sapiens
  Payload ID: 18648
  Gene Name: tubulin folding cofactor D
  Uniprot ID: Q9BTW9
  ENST ID: ENST00000355528
  CDS Start-End: 131-3709
ggccagcgtcggttgccgccttagcgggcgcctccttttcatccctcatccttcatccctggctttcgcgctctagcggagtgggatctgcgaacacgtgaggcgggggcgcggtccccaggctgccgagatggccctgagcgacgaaccggccgcgggcggccccgaggaggaggcggaggacgagacactggcctttggcgcggcgctggaagcgttcggcgagagcgcggagacccgggcgctgctgggccgcctgcgggaggtgcacggcggcggcgcggagcgcgaggtggccctggagcggttccgcgtaataatggacaaataccaggagcagcctcatctgttggacccgcaccttgaatggatgatgaacttgttgttggacatagtgcaagatcagacatctccagcttcccttgtacatctggcttttaaatttctttacatcatcaccaaggttcgaggctataaaacatttcttcgtttatttcctcatgaagttgccgatgtagagcctgttttagatttggtcacaattcagaatcccaaggaccatgaagcttgggaaacccgctacatgcttttgctctggctctccgtgacctgcctgatcccttttgatttttctcgccttgacgggaacctcctcacccagcctgggcaagcacgaatgtccataatggaccgtattctccaaatagcagagtcctacttgattgtcagtgacaaggcccgagatgcagctgctgtccttgtgtccagatttatcacacgtcctgatgtcaagcaaagcaagatggctgagttcctggactggagcctgtgcaatctggcccgttcctccttccagaccatgcagggggtcatcaccatggatgggacgctgcaggccctggcacaaatatttaaacatggaaaacgtgaagactgtttgccctatgctgccactgtcctcaggtgcctcgatggctgcagactccctgagagcaaccagaccctgctgcggaagctgggggtgaagcttgtgcagcgactggggctgacattcctgaagccgaaggtggcagcatggaggtaccagcgtggctgccgatctttggctgcaaatctgcagctcctcactcagggtcagagtgagcagaagccactcatcctgaccgaagatgacgacgaagatgacgacgtcccagagggggtggagcgtgtgatagagcagctgctggtcgggctgaaggacaaggacacggtcgtgcggtggtctgcagccaagggcatcggtaggatggctggcaggcttcccagagccctggcggatgatgtggtcgggtctgtgctggactgcttcagtttccaggagactgacaaggcgtggcatgggggatgtctggcgctggcagagctgggcaggagaggcctgttgctgccgtctcgactcgtggatgttgtcgccgtgatcctgaaggcgctgacctacgacgagaagcggggtgcctgcagcgtgggcaccaacgtcagggacgccgcctgctacgtgtgctgggccttcgcgcgtgcctatgagcctcaggagctgaagccctttgtgactgcaatctcgagtgcactggtgattgctgcggtgtttgaccgagacataaactgcagaagagcagcctctgccgccttccaggagaatgtggggagacagggcactttccctcatggtattgatattttgaccacagctgactattttgccgtcggtaacagatccaactgtttcctggttataagtgtgtttattgccggctttcctgagtacacgcagccaatgatagaccacctggttaccatgaagatcagccactgggatggggtcatccgagagttggctgcgagggcgctgcacaacctggcccagcaggcacccgagttcagcgccacgcaagtcttcccgaggctgctgtccatgacactgagtccagatcttcacatgaggcatgggtcgattctcgcctgcgcagaagttgcttacgccttgtacaaacttgcagcccaagagaacaggcccgtcacggaccatctggacgagcaggcagtgcagggcctgaagcagattcaccagcagctctatgatcgtcagttatacaggggtctgggaggacagctcatgagacaagcagtgtgtgttttaatagaaaagttgtcactttccaaaatgccctttagaggtgacaccgtaattgatggttggcaatggctgataaatgacactttgagacatctccatctcatctcaagtcactcccgccagcagatgaaggatgcagcagtctcggccctggctgctctatgcagtgaatattacatgaaggagccgggggaggcagatcccgcaattcaggaggagctgatcacgcagtacctggctgagcttcggaaccccgaggagatgactcgctgtggcttctcgttggccttgggcgcccttccaggcttccttctgaaaggccggctccagcaggttctcacaggtttaagagcagttacccacacttcccccgaggacgtaagttttgctgagtccaggagagacggcttgaaggccattgcgaggatttgccagactgttggtgtgaaagcaggagccccagacgaagctgtgtgcggagagaatgtttcccagatttactgtgcgctgctgggctgcatggacgactacaccacggacagcagaggggacgtgggcacctgggtccgcaaggccgccatgaccagtctgatggatctgacacttctgctggctcggagccagcctgagctgatcgaggcccatacctgtgagcgcatcatgtgctgtgtggcccagcaggccagtgagaagattgaccgtttccgtgctcacgccgccagcgtgttcctgacgctcctgcactttgacagccctcccatcccccacgtgccccaccgaggagaactggaaaagctgtttcccaggtccgatgtggcctccgtgaactggagtgcaccttcccaggccttcccacgcatcacccagctccttgggctgcccacctaccgctaccacgtcctgctggggctagtcgtgtccctgggcggcttgacggagtcgacgatccggcactccacccagagcctctttgagtacatgaagggcattcagagcgacccgcaggccctgggcagcttcagcgggacccttctgcagatctttgaggacaaccttctgaatgagagggtgtccgtgccgctgctgaagacgctggaccacgtgctcacccacggctgcttcgacatcttcaccacggaggaggaccacccctttgctgtgaagttgcttgcgctctgtaagaaagaaatcaagaattcaaaagatatccagaagctcctgtcaggcatcgcagtgttctgcgagatggtgcagttccccggcgacgtgaggaggcaggccctcctgcagctgtgtctgctcctctgccaccgtttcccgctgatccggaagaccacggccagccaggtgtacgagacattgctcacctacagtgacgtcgtgggcgcggatgtgctggacgaggtggtgactgtgctcagtgacactgcgtgggacgcggagcttgcagtggtgagagagcagcgcaaccgtctgtgtgaccttctgggcgtacccaggccccagctggtgccccagcctggtgcctgctgaagccagtcctggagcccatacctcacccctgcctggtgaggatgtcttgttcctgagggaggccggtgtggaaagcctcgcacagtggtgcctccagctgttgaagggtagcgctggcccttggaggctggcactagctgacagcttttcctctctgcacctgcgctctggtgacttggggtggacgcctctgccttcacttgaacacaaatgtgcttcctataaaatcatgtaccaagaagttcctgccttttgtctctgagcctgatgtgtgtaggggtgatggaaaggctcactgcccaggggtcagccagaggggaggtgggctgcactcctcctgcctggagaccaggcccccttcttgcctggtgctgtccctgctgtgggagacgtctggccacaggcagtgccccacccagtcttggagagagatgaatgttaaatcagaggttcaaatgctagagaactgagaagccctggtggcaggcatggtctggagtgctgggcagatgctgtttctgggcccgtctgcctggtgggggtgctgtcctcccccctgtgcacacgtgagcatcgtgcatgtggcccctctgcagtgcaggagtcactgattgatgggtgtgccgaccagcagcttcacaaatgtctgctgcaaggggaatcgtcagagtccaatgtgtgcctctacagtaatgtcggaaataaataccattcttgaaataattacactgtcttaggagagcctgggcagagtccacacttgggtttttaggcaaagggcaggaggctacctttgtctctgtgtctgagctcgtgctgatccatcccaaagctggtgaggggaacgtgtataaaaatttcactgtggtagcaacccacacccatctctgggacctgtgctgtgctcatagggcttgaggtgcagaaccacggccagcagcaccaaagcagccccaggtgtggccactcagaggcccaagggcttgggtgagcaaccctttccctatgtgaggagcccaggggtgccatgtgcgtggtgtagattagggtggctccctggcctgctctcaggtggggatggggcctggacacaggaacatgggcaggccgagaactgggaggtgccaccgcatctgtgaggcttgtgaggtcaccaggaccacaagaccaggactgtgacagtccgtgctgtgtgtttagcagacagctcttcacgggatgtgtgtgacgacctggccacacaggagtgtggggttaacacactactgttgttgtgtttgacctggtggccaatggtctttataccctaaaagagccttgggttacatttttacgagatttaaatattttattccaacctgtgtaataggggtctcctcctccttgaactgtcccgattggctggggtcacgtggtgagggtcctgggtgaccaggcctagccttggccacatgagtccacacagtggaaaaggcttggctcctgtggtcggcacacacgagactctggttgcgcctgctgggtgtggaacaggcgcaccatcgccatgcctgcagctcacaaagctcctgctggcctgggatgcactgaggatggaaggaacaagtggcttctgagaaaaacatgatgaactgttcttagtgcaattaaaagaagattccagataaatggcattttaagacatggaggcaggtcgattacccacccagacccatcagtgacactatgtggcaaagcagttcttcttttaatgtcggtctaacttagcaacccgaggaaagtggatcactccactggccactgcctctttcccactggatcccatccatcactggggcacttgtgctcaccagacacctggtggcctggaaagccctctttcagcagccgtttctggagcccaccagggtccaggtgatagagtttggcaaggaaccccttgctcacatgatagctggggcagacaatagcaaatgaacaagcaagcaccatcaaggcaggcaacactgagtgctatgaacaaagataaagtgggcaatggaatggcatgttgggtgttgactccgagaaggtgttcagaaaacctctctgaaggggcagcatttgggcagaggtccagactgtgtccaatggcagaaaagagaatgcttgtggtcccagaagtggagcaagctttgtgagtttagagagcagcaagaagccagtatccctgggaccggggagctgatgtgggatttgtgtacccacaaacacgttctaggtgctaaccagaaaccctccatgtgagagcagagaccttggagatcctgagggtttctgctgagccctggaatctagtcacgctattttgatagcagaatggatgagagaatttaaggcccagggccagatctaatggaccactatataaagctgggaccctaaataagtctttttcaaaggaacagcagcaagactcttatctcaatctatctcccctgaagtggcctgaattaatactacctgtatgatccccaaaactcctaaagtggaaaatttgattgacttggccctgaccagtggtattcccagacaagggcagaagatgcaaatacaaaacctctctggtagaatgtaggctataatatgagtacatttttgaaaagggctagaaatgatcaagaagagattagaaaaaaacagagcccctagaaatgtaagaagtgaaatgaaaagctcaatggatagcttagacacagctgaagagagaattagaaaactggaagatctgaaaacattatccagagaactggaagatatgacagcaacatcaagagacattgaagaatgtctaacctttgggtaattggggtctcagaatgaaatgaaatgatgcagatattccatactgacatgcaacagtccccagatacagaagcctaacagtctcacatttagacctgccacagtgaaactgcagaactgtaagaaggacagagtgatataaacgactaccaatttcccagcagcagcactggagttgagcagtgagtagaccaaggtcttcattatgctgagagaaaatagctgtcaagttgcttgaattgtgcccacagcataacattaaagaagagaacaaaattaagtcatttagataaaaatatgccattcttatctgtttggttttttaatcttggcttaatatttggggttgagtcatttgttttgagagctgtcctgtttattgcagggtgttcagcaacatcccagatggaagcagcatccccctacccagctgtgacaaaaagaaaaaaaaatgtctccagacactgccaaatatcttctgggggtgcccctggttgagaaccactgctttagtggataaactttaggcaggagggaaatgatcgcagttggatagttggaggaatgtggagcaagggaagcaataaactgtgaccataaaaacatagaaagatg

SEQ ID NO: 195837 - DNA, 3975 bp, Homo sapiens
  Payload ID: 18648
  Gene Name: tubulin folding cofactor D
  ENST ID: ENST00000539345
  CDS Start-End: 37-3729
cacgtgaggcgggggcgcggtccccaggctgccgagatggccctgagcgacgaaccggccgcgggcggccccgaggaggaggcggaggacgagacactggcctttggcgcggcgctggaagcgttcggcgagagcgcggagacccgggcgctgctgggccgcctgcgggaggtgcacggcggcggcgcggagcgcgaggtggccctggagcggttccgcgtaataatggacaaataccaggagcagcctcatctgttggacccgcaccttgaatggatgatgaacttgttgttggacatagtgcaagatcagacatctccagcttcccttgtacatctggcttttaaatttctttacatcatcaccaaggttcgaggctataaaacatttcttcgtttatttcctcatgaagttgccgatgtagagcctgttttagatttggtcacaattcagaatcccaaggaccatgaagcttgggaaacccgctacatgcttttgctctggctctccgtgacctgcctgatcccttttgatttttctcgccttgacgggaacctcctcacccagcctgggcaagcacgaatgtccataatggaccgtattctccaaatagcagagtcctacttgattgtcagtgacaaggcccgagatgcagctgctgtccttgtgtccagatttatcacacgtcctgatgtcaagcaaagcaagatggctgagttcctggactggagcctgtgcaatctggcccgttcctccttccagaccatgcagggggtcatcaccatggatgggacgctgcaggccctggcacaaatatttaaacatggaaaacgtgaagactgtttgccctatgctgccactgtcctcaggtgcctcgatggctgcagactccctgagagcaaccagaccctgctgcggaagctgggggtgaagcttgtgcagcgactggggctgacattcctgaagccgaaggtggcagcatggaggtaccagcgtggctgccgatctttggctgcaaatctgcagctcctcactcagggtcagagtgagcagaagccactcatcctgaccgaagatgacgacgaagatgacgacgtcccagagggggtggagcgtgtgatagagcagctgctggtcgggctgaaggacaaggacacggtcgtgcggtggtctgcagccaagggcatcggtaggatggctggcaggcttcccagagccctggcggatgatgtggtcgggtctgtgctggactgcttcagtttccaggagactgacaaggcgtggcatgggggatgtctggcgctggcagagctgggcaggagaggcctgttgctgccgtctcgactcgtggatgttgtcgccgtgatcctgaaggcgctgacctacgacgagaagcggggtgcctgcagcgtgggcaccaacgtcagggacgccgcctgctacgtgtgctgggccttcgcgcgtgcctatgagcctcaggagctgaagccctttgtgactgcaatctcgagtgcactggtgattgctgcggtgtttgaccgagacataaactgcagaagagcagcctctgccgccttccaggagaatgtggggagacagggcactttccctcatggtattgatattttgaccacagctgactattttgccgtcggtaacagatccaactgtttcctggttataagtgtgtttattgccggctttcctgagtacacgcagccaatgatagaccacctggttaccatgaagatcagccactgggatggggtcatccgagagttggctgcgagggcgctgcacaacctggcccagcaggcacccgagttcagcgccacgcaagtcttcccgaggctgctgtccatgacactgagtccagatcttcacatgaggcatgggtcgattctcgcctgcgcagaagttgcttacgccttgtacaaacttgcagcccaagagaacaggcccgtcacggaccatctggacgagcaggcagtgcagggcctgaagcagattcaccagcagctctatgatcgtcagttatacaggggtctgggaggacagctcatgagacaagcagtgtgtgttttaatagaaaagttgtcactttccaaaatgccctttagaggtgacaccgtaattgatggttggcaatggctgataaatgacactttgagacatctccatctcatctcaagtcactcccgccagcagatgaaggatgcagcagtctcggccctggctgctctatgcagtgaatattacatgaaggagccgggggaggcagatcccgcaattcaggaggagctgatcacgcagtacctggctgagcttcggaaccccgaggagatgactcgctgtggcttctcgttggccttgggcgcccttccaggcttccttctgaaaggccggctccagcaggttctcacaggtttaagagcagttacccacacttcccccgaggacgtaagttttgctgagtccaggagagacggcttgaaggccattgcgaggatttgccagactgttggtgtgaaagcaggagccccagacgaagctgtgtgcggagagaatgtttcccagatttactgtgcgctgctgggctgcatggacgactacaccacggacagcagaggggacgtgggcacctgggtccgcaaggccgccatgaccagtctgatggatctgacacttctgctggctcggagccagcctgagctgatcgaggcccatacctgtgagcgcatcatgtgctgtgtggcccagcaggccagtgagaagattgaccgtttccgtgctcacgccgccagcgtgttcctgacgctcctgcactttgacagccctcccatcccccacgtgccccaccgaggagaactggaaaagctgtttcccaggtccgatgtggcctccgtgaactggagtgcaccttcccaggccttcccacgcatcacccagctccttgggctgcccacctaccgctaccacgtcctgctggggctagtcgtgtccctgggcggcttgacggagtcgacgatccggcactccacccagagcctctttgagtacatgaagggcattcagagcgacccgcaggccctgggcagcttcagcgggacccttctgcagatctttgaggacaaccttctgaatgagagggtgtccgtgccgctgctgaagacgctggaccacgtgctcacccacggctgcttcgacatcttcaccacggaggaggaccacccctttgctgtgaagttgcttgcgctctgtaagaaagaaatcaagaattcaaaagatatccagaagctcctgtcaggcatcgcagttgactttccaagtgcgacactcgtgtgtgtaggcacagtgcagatgtacgcacacacacacctccggcttggggccccaggcccgcactgtgctcacggatctgctctgcccaggttctgcgagatggtgcagttccccggcgacgtgaggaggcaggccctcctgcagctgtgtctgctcctctgccaccgtttcccgctgatccggaagaccacggccagccaggtgtacgagacattgctcacctacagtgacgtcgtgggcgcggatgtgctggacgaggtggtgactgtgctcagtgacactgcgtgggacgcggagcttgcagtggtgagagagcagcgcaaccgtctgtgtgaccttctgggcgtacccaggccccagctggtgccccagcctggtgcctgctgaagccagtcctggagcccatacctcacccctgcctggtgaggatgtcttgttcctgagggaggccggtgtggaaagcctcgcacagtggtgcctccagctgttgaagggtagcgctggcccttggaggctggcactagctgacagcttttcctctctgcacctgcgctctggtgacttggggtggacgcctctgccttcacttgaacacaaatgtgcttcctataaaatcatgtaccaagaagttcc

SEQ ID NO: 195838 - DNA, 1509 bp, Homo sapiens
  Payload ID: 18648
  Gene Name: tubulin folding cofactor D
  ENST ID: ENST00000571316
  CDS Start-End: 1-714
gtgattgctgcggtgtttgaccgagacataaactgcagaagagcagcctctgccgccttccaggagaatgtggggagacagggcactttccctcatggtattgatattttgaccacagctgactattttgccgtcggtaacagatccaactgtttcctggttataagtgtgtttattgccggctttcctgagtacacgcagccaatgatagaccacctggttaccatgaagatcagccactgggatggggtcatccgagagttggctgcgagggcgctgcacaacctggcccagcaggcacccgagttcagcgccacgcaagtcttcccgaggctgctgtccatgacactgagtccagatcttcacatgaggcatgggtcgattctcgcctgcgcagaagttgcttacgccttgtacaaacttgcagcccaagagaacaggcccgtcacggaccatctggacgagcaggcagtgcagggcctgaagcagattcaccagcagctctatgatcgtcagttatacaggggtctgggaggacagctcatgagacaagcagacttggtcattgtccctcagatgcctccagagcacacggtgcaggggtgtcacctttccgacgtacccatgggtgcccggagttgcctccttagtgggatcaagaccatcccccacatgtcatggacagctggtgacctggtcgctcttggtgtttgagcagtaagtctgcacaggagccactgcccaccatgaaaggggggagttaaaggcgttccgaatccctttggccaacgacggagttgaaggtgttccgagtccccgtggccggcggcgacagagttgaaggcgtttggagtccccgtggctggcggtgatggagttgaaggcgttccgaatccccgtggccggtggtgacggagttgaaggcgttccgagtccctgtagctggcggcgatggagttgaatgcgttccgagtccccaggacgccattttggctgaatttcctttaccctcctgctccgtgaagcggggcccattggggaggtgctgctctgtaatctgctcttcttcttgaatgtgtggttagggcagccacattgatgtcccccaggctccagagtgaccgccccttaggggtcctgctgggcgttggccgctgttggccgcagggcaccgttggcctgtgcattgctgccacctacccatgatgggcagaattgtcacgagctcaggaggaaaccatggaaaaaccgcaggtcctggagcctccgtgtggttgtcgtgggcagctttccacgcgacgtgccctccctgggcgtgaggctgcatttgcacttagcggggagagggggaatgttgtgggttctagttgggctttttgatgatgatatttggaaagacttgagacaaagtagccaccctgtcctgtcccttcctcacccaccacacccactgctccccgctggcaggcactgcaggctgcacaagtaaccgtggaacctaaacactga

SEQ ID NO: 195839 - DNA, 979 bp, Homo sapiens
  Payload ID: 18648
  Gene Name: tubulin folding cofactor D
  ENST ID: ENST00000577051
  CDS Start-End: 1-783
gcccagcaggccagtgagaagattgaccgtttccgtgctcacgccgccagcgtgttcctgacgctcctgcactttgacagccctcccatcccccacgtgccccaccgaggagaactggaaaagctgtttcccaggtccgatgtggcctccgtgaactggagtgcaccttcccaggccttcccacgcatcacccagctccttgggctgcccacctaccgctaccacgtcctgctggggctagtcgtgtccctgggcggcttgacggagtcgacgatccggcactccacccagagcctctttgagtacatgaagggcattcagagcgacccgcaggccctgggcagcttcagcgggacccttctgcagatctttgaggacaaccttctgaatgagagccacccctttgctgtgaagttgcttgcgctctgtaagaaagaaatcaagaattcaaaagatatccagaagctcctgtcaggcatcgcagtgttctgcgagatggtgcagttccccggcgacgtgaggaggcaggccctcctgcagctgtgtctgctcctctgccaccgtttcccgctgatccggaagaccacggccagccaggtgtacgagacattgctcacctacagtgacgtcgtgggcgcggatgtgctggacgaggtggtgactgtgctcagtgacactgcgtgggacgcggagcttgcagtggtgagagagcagcgcaaccgtctgtgtgaccttctgggcgtacccaggccccagctggtgccccagcctggtgcctgctgaagccagtcctggagcccatacctcacccctgcctggtgaggatgtcttgttcctgagggaggccggtgtggaaagcctcgcacagtggtgcctccagctgttgaagggtagcgctggcccttggaggctggcactagctgacagcttttcctctctgcacctgcgctctggtgacttggggtggacgcctctgcct

SEQ ID NO: 195840 - DNA, 942 bp, Homo sapiens
  Payload ID: 18648
  Gene Name: tubulin folding cofactor D
  ENST ID: ENST00000576160
  CDS Start-End: 518-942
atcccagttgacttgaaattcaggttttgcttgtgaaagtagctggctggggcttctgttgatgacagtgctgtgtggacggcctggttcgctgggtgtgcctcacagacacaggacactttttagggttgcttttgaatgtgcctgagttgtcgccgtgatcctgaaggcgctgacctacgacgagaagcggggtgcctgcagcgtgggcaccaacgtcagggacgccgcctgctacgtgtgctgggccttcgcgcgtgcctatgagcctcaggagctgaagccctttgtgactgcaatctcgagtgcactggtgattgctgcggtgtttgaccgagacataaactgcagaagagcagcctctgccgccttccaggagaatgtggggagacagggcactttccctcatggtattgatattttgaccacagctgactattttgccgtcggtaacagatccaactgtttcctggttataagtgtgtttattgccggctttcctgagtacacgcagccaatgatagaccacctggttaccatgaagatcagccactgggatggggtcatccgagagttggctgcgagggcgctgcacaacctggcccagcaggcacccgagttcagcgccacgcaagtcttcccgaggctgctgtccatgacactgagtccagatcttcacatgaggcatgggtcgattctcgcctgcgcagaagttgcttacgccttgtacaaacttgcagcccaagagaacaggcccgtcacggaccatctggacgagcaggcagtgcagggcctgaagcagattcaccagcagctctatgatcgtcagttatacaggggtctgggaggacagctcatgagacaagcagtgtgtgttttaatagaaaagttgtcactttccaaaatgccctttagaggtgacaccgtaattgatggttggca

SEQ ID NO: 195841 - DNA, 702 bp, Homo sapiens
  Payload ID: 18648
  Gene Name: tubulin folding cofactor D
  ENST ID: ENST00000572953
  CDS Start-End: 69-702
ccccgacctgacccaggcctgctcgctctggtgtgcaccgacctgccagctttgtggcactttgtggcatggggctcaggccgatggagggcactttccctcatggtattgatattttgaccacagctgactattttgccgtcggtaacagatccaactgtttcctggttataagtgtgtttattgccggctttcctgagtacacgcagccaatgatagaccacctggttaccatgaagatcagccactgggatggggtcatccgagagttggctgcgagggcgctgcacaacctggcccagcaggcacccgagttcagcgccacgcaagtcttcccgaggctgctgtccatgacactgagtccagatcttcacatgaggcatgggtcgattctcgcctgcgcagaagttgcttacgccttgtacaaacttgcagcccaagagaacaggcccgtcacggaccatctggacgagcaggcagtgcagggcctgaagcagattcaccagcagctctatgatcgtcagttatacaggggtctgggaggacagctcatgagacaagcagtgtgtgttttaatagaaaagttgtcactttccaaaatgccctttagaggtgacaccgtaattgatggttggcaatggctgataaatgacactttgagacatctccatctcatctcaagtcactcccgccagcagatga

SEQ ID NO: 195842 - DNA, 879 bp, Homo sapiens
  Payload ID: 18648
  Gene Name: tubulin folding cofactor D
  ENST ID: ENST00000574422
  CDS Start-End: 147-879
gaagaaatgggcaaactggttttgaaagtaactgtgctgaattcccacccacaggcagtgagttctcgttcttccgcgtctcaccacctctccatgctgtcttttccagtgtgtttattgccggctttcctgagtacacgcagccaatgatagaccacctggttaccatgaagatcagccactgggatggggtcatccgagagttggctgcgagggcgctgcacaacctggcccagcaggcacccgagttcagcgccacgcaagtcttcccgaggctgctgtccatgacactgagtccagatcttcacatgaggcatgggtcgattctcgcctgcgcagaagttgcttacgccttgtacaaacttgcagcccaagagaacaggcccgtcacggaccatctggacgagcaggcagtgcagggcctgaagcagattcaccagcagctctatgatcgtcagttatacaggggtctgggaggacagctcatgagacaagcagtgtgtgttttaatagaaaagttgtcactttccaaaatgccctttagaggtgacaccgtaattgatggttggcaatggctgataaatgacactttgagacatctccatctcatctcaagtcactcccgccagcagatgaaggatgcagcagtctcggccctggctgctctatgcagtgaatattacatgaaggagccgggggaggcagatcccgcaattcaggaggagctgatcacgcagtacctggctgagcttcggaaccccgaggagatgactcgctgtggcttctcgttggccttgggcgcccttccaggcttccttctgaaaggccggctccagcaggttctcacaggtttaagagcagttacccacacttcccccg

SEQ ID NO: 195843 - DNA, 1380 bp, Homo sapiens
  Payload ID: 18648
  Gene Name: tubulin folding cofactor D
  ENST ID: ENST00000572794
  CDS Start-End: 1-206
cattgctcacctacagtgacgtcgtgggcgcggatgtgctggacgaggtggtgactgtgctcagtgacactgcgtgggacgcggagcttgcagtggtgagagagcagcgcaaccgtctgtgtgaccttctgggcgtacccaggccccagctggtgccccaggtaaccctgtcaccttcacagcatgaggtgcctgtgcttccctgagctctggaatgttctggggccagcggctgtgcttagcttctgccagcacgtccacacggcccgttccctcgtctcatgtcaggacccctgggattacgggaccagcagagctgccttctctggccactgcccacacctgtgggcccctgtggcatccaggccacttgctctggggcgtttggggggccggggagtgggtggagctggcaccagcttgatccaggctcctcatgcctggccctggggtctgtttgtgctccaagtgccaagagtgccaccctacccctcctcatctgcttcccatgagtggggccggggctgggtgagaggcccccagaagctgcccctgtgcacctcaccagcccgtcactcttctaaagtaacaaaaacaagtacctcagttctctcgggggctggggcccagggttgctgtgctgtctctctagttaccagggttggctccttcctctcagcctccttccggcaggaggttatatctgagagggaggaggagaaccatgtctagatacatgggggcagtggggatgggctgagcatcaggacacagcctcccccatttctgtgtgtgtaaaggctgaactcaacagcagactttggaattaaatgtgctttttacatttttattaggaaaaatttcaaacgtgtgaatgcaggttaagagcagtgcagtgaacctcccttcccgctccccagatggggtgcccttccgaggacacgttagtcatgagcacctgtcagccacatagctcaggctgccgggtgtgtgggaaacggcacaaatggtttcctgcaggaaccgtgtcagtccccacacagggcccagaggggtgagggtcccctggctgggaatggtgtgtgttggagctgaccagcctgagcttgtcttgtctcttcttcagcctggtgcctgctgaagccagtcctggagcccatacctcacccctgcctggtgaggatgtcttgttcctgagggaggccggtgtggaaagcctcgcacagtggtgcctccagctgttgaagggtagcgctggcccttggaggctggcactagctgacagcttttcctctctgcacctgcgctctggtgacttggggtggacgcctctgccttcacttgaacacaaatgtgcttcctataaaatcatgtaccaag

SEQ ID NO: 195844 - DNA, 850 bp, Homo sapiens
  Payload ID: 18648
  Gene Name: tubulin folding cofactor D
  ENST ID: ENST00000571712
  CDS Start-End: 498-850
gacggcctggttcgctgggtgtgcctcacagacacaggacactttttagggttgcttttgaatgtgcctgagttgtcgccgtgatcctgaaggcgctgacctacgacgagaagcggggtgcctgcagcgtgggcaccaacgtcagggacgccgcctgctacgtgtgctgggccttcgcgcgtgcctatgagcctcaggagctgaagccctttgtgactgcaatctcgagtgcactggtgattgctgcggtgtttgaccgagacataaactgcagaagagcagcctctgccgccttccaggagaatgtggggagacagggcactttccctcatggtattgatattttgaccacagctgactattttgccgtcggtaacagatccaactgtttcctggttataagggtcatccgagagttggctgcgagggcgctgcacaacctggcccagcaggcacccgagttcagcgccacgcaagtcttcccgaggctgctgtccatgacactgagtccagatcttcacatgaggcatgggtcgattctcgcctgcgcagaagttgcttacgccttgtacaaacttgcagcccaagagaacaggcccgtcacggaccatctggacgagcaggcagtgcagggcctgaagcagattcaccagcagctctatgatcgtcagttatacaggggtctgggaggacagctcatgagacaagcagtgtgtgttttaatagaaaagttgtcactttccaaaatgccctttagaggtgacaccgtaattgatggttggcaatggctgataaatgacactttgagacatctccatctcatctcaagtcactcccgccagcagatgaa

SEQ ID NO: 195845 - DNA, 827 bp, Homo sapiens
  Payload ID: 18648
  Gene Name: tubulin folding cofactor D
  ENST ID: ENST00000576996
  CDS Start-End: 425-827
ctcgggtggcagtgagcggacagcgagggggacagacacaggtggaaggaaccacgttgtcgccgtgatcctgaaggcgctgacctacgacgagaagcggggtgcctgcagcgtgggcaccaacgtcagggacgccgcctgctacgtgtgctgggccttcgcgcgtgcctatgagcctcaggagctgaagccctttgtgactgcaatctcgagtgcactggtgattgctgcggtgtttgaccgagacataaactgcagaagagcagcctctgccgccttccaggagaatgtggggagacagggcactttccctcatggtattgatattttgaccacagctgactattttgccgtcggtaacagatccaactgtttcctggttataagtgtgtttattgccggctttcctgagtacacgcagccaatgatagaccacctggttaccatgaagatcagccactgggatggggtcatccgagagttggctgcgagggcgctgcacaacctggcccagcaggcacccgagttcagcgccacgcaagtcttcccgaggctgctgtccatgacactgagtccagatcttcacatgaggcatgggtcgattctcgcctgcgcagaagttgcttacgccttgtacaaacttgcagcccaagagaacaggcccgtcacggaccatctggacgagcaggcagtgcagggcctgaagcagattcaccagcagctctatgatcgtcagttatacaggggtctgggaggacagctcatgagacaagcagtgtgtgttttaatagaaaagttgtcactttccaaaatgccctttagaggtg

SEQ ID NO: 195846 - DNA, 1059 bp, Homo sapiens
  Payload ID: 18648
  Gene Name: tubulin folding cofactor D
  ENST ID: ENST00000576760
  CDS Start-End: 290-1059
ttggctcagagctgggctggagtgaggcctgtgtctcttgggaccacagagagcggacagttgagacggtggaccagtctcaagataagagtctttatttcagatacagataagacgctgaacacgttttaagagggccgccttccaggagaatgtggggagacagggcactttccctcatggtattgatattttgaccacagctgactattttgccgtcggtaacagatccaactgtttcctggttataagtgtgtttattgccggctttcctgagtacacgcagccaatgatagaccacctggttaccatgaagatcagccactgggatggggtcatccgagagttggctgcgagggcgctgcacaacctggcccagcaggcacccgagttcagcgccacgcaagtcttcccgaggctgctgtccatgacactgagtccagatcttcacatgaggcatgggtcgattctcgcctgcgcagaagttgcttacgccttgtacaaacttgcagcccaagagaacaggcccgtcacggaccatctggacgagcaggcagtgcagggcctgaagcagattcaccagcagctctatgatcgtcagttatacaggggtctgggaggacagctcatgagacaagcagtgtgtgttttaatagaaaagttgtcactttccaaaatgccctttagaggtgacaccgtaattgatggttggcaatggctgataaatgacactttgagacatctccatctcatctcaagtcactcccgccagcagatgaaggatgcagcagtctcggccctggctgctctatgcagtgaatattacatgaaggagccgggggaggcagatcccgcaattcaggaggagctgatcacgcagtacctggctgagcttcggaaccccgaggagatgactcgctgtggcttctcgttggccttgggcgcccttccaggcttccttctgaaaggccggctccagcaggttctcacaggtttaagagcagttacccacacttcccccgaggacgtaagttttgctgagtccaggagagacggctt

SEQ ID NO: 195847 - DNA, 682 bp, Homo sapiens
  Payload ID: 18648
  Gene Name: tubulin folding cofactor D
  ENST ID: ENST00000572984
  CDS Start-End: 355-682
gaagtcctgtccctccttggggctggacacggtcccttgcccctgaactctagacgccctgcattgccctggtgctcccatgtcaagactggccgcggtcgtccatcccatggtttgtgaccctcccagcaacgctgtgaggaaggtgctgcagctggttctcagcattggcaggagcatggcgactcaggcagtcagtgtgccgccttccaggagaatgtggggagacagggcactttccctcatggtattgatattttgaccacagctgactattttgccgtcggtaacagatccaactgtttcctggttataagtgtgtttattgccggctttcctgagtacacgcagccaatgatagaccacctggttaccatgaagatcagccactgggatggggtcatccgagagttggctgcgagggcgctgcacaacctggcccagcaggcacccgagttcagcgccacgcaagtcttcccgaggctgctgtccatgacactgagtccagatcttcacatgaggcatgggtcgattctcgcctgcgcagaagttgcttacgccttgtacaaacttgcagcccaagagaacaggcccgtcacggaccatctggacgagcaggcagtgcagggcctgaagcagattcaccagcagctctatgatcgtcagttatacaggggtctgg

SEQ ID NO: 195848 - DNA, 867 bp, Homo sapiens
  Payload ID: 18648
  Gene Name: tubulin folding cofactor D
  ENST ID: ENST00000574975
  CDS Start-End: 113-867
ctgggctctggtccaggctttgtagaccgtgcaggcggctgcatccccgacctgacccaggcctgctcgctctggtgtgcaccgacctgccagctttgtggcactttgtggcatggggctcaggccgatggagggcactttccctcatggtattgatattttgaccacagctgactattttgccgtcggtaacagatccaactgtttcctggttataagggtcatccgagagttggctgcgagggcgctgcacaacctggcccagcaggcacccgagttcagcgccacgcaagtcttcccgaggctgctgtccatgacactgagtccagatcttcacatgaggcatgggtcgattctcgcctgcgcagaagttgcttacgccttgtacaaacttgcagcccaagagaacaggcccgtcacggaccatctggacgagcaggcagtgcagggcctgaagcagattcaccagcagctctatgatcgtcagttatacaggggtctgggaggacagctcatgagacaagcagtgtgtgttttaatagaaaagttgtcactttccaaaatgccctttagaggtgacaccgtaattgatggttggcaatggctgataaatgacactttgagacatctccatctcatctcaagtcactcccgccagcagatgaaggatgcagcagtctcggccctggctgctctatgcagtgaatattacatgaaggagccgggggaggcagatcccgcaattcaggaggagctgatcacgcagtacctggctgagcttcggaaccccgaggagatgactcgctgtggcttctcgttggccttgggcgcccttccaggcttccttctgaaaggccggctccagca

SEQ ID NO: 195849 - DNA, 1761 bp, Homo sapiens
  Payload ID: 18648
  Gene Name: tubulin folding cofactor D
  ENST ID: ENST00000633032
  CDS Start-End: 1-1515
gatgcagcagtctcggccctggctgctctatgcagtgaatattacatgaaggagccgggggaggcagatcccgcaattcaggaggagctgatcacgcagtacctggctgagcttcggaaccccgaggagatgactcgctgtggcttctcgttggccttgggcgcccttccaggcttccttctgaaaggccggctccagcaggttctcacaggtttaagagcagttacccacacttcccccgaggacgtaagttttgctgagtccaggagagacggcttgaaggccattgcgaggatttgccagactgttggtgtgaaagcaggagccccagacgaagctgtgtgcggagagaatgtttcccagatttactgtgcgctgctgggctgcatggacgactacaccacggacagcagaggggacgtgggcacctgggtccgcaaggccgccatgaccagtctgatggatctgacacttctgctggctcggagccagcctgagctgatcgaggcccatacctgtgagcgcatcatgtgctgtgtggcccagcaggccagtgagaagattgaccgtttccgtgctcacgccgccagcgtgttcctgacgctcctgcactttgacagccctcccatcccccacgtgccccaccgaggagaactggaaaagctgtttcccaggtccgacgtggcctccgtgaactggagtgcaccttcccaggccttcccacgcatcacccagctccttgggctgcccacctaccgctaccacgtcctgctggggctagtcgtgtccctgggcggcttgacggagtcgacgatccggcactccacccagagcctctttgagtacatgaagggcattcagagcgacccgcaggccctgggcagcttcagcgggacccttctgcagatctttgaggacaaccttctgaatgagagggtgtccgtgccgctgctgaagacgctggaccacgtgctcacccacggctgcttcgacatcttcaccacggaggaggaccacccctttgctgtgaagttgcttgcgctctgtaagaaagaaatcaagaattcaaaagatatccagaagctcctgtcaggcatcgcagttgactttccaagtgcgacactcgcgtgtgtaggcacagtgcagatgtgcgcacacacacacctccggcttggggccccaggcccgcactgtgctcacggatctgctctgcccaggttctgcgggatggtgcagttccccggcgacgtgaggaggcaggccctcctgcagctgtgtctgctcctctgccaccgtttcccgctgatccggaagaccacggccagccaggtgtacgagacattgctcacctacagtgacgtcgtgggcgcggatgtgctggacgaggtggtgactgtgctcagtgacactgcgtgggacgcggagcttgcagtggtgagagagcagcgcaaccgtctgtgtgaccttctgggcgtacccaggccccagctggtgccccagcctggtgcctgctgaagccagtcctggagcccatacctcacccctgcctggtgaggatgtcttgttcctgagggaggccggtgtggaaagcctcgcacagtggtgcctccagctgttgaagggtagcgctggcccttggaggctggcactagctgacagcttttcctctctgcacctgcgctctggtgacttggggtggacgcctctgccttcacttgaacacaaatgtgcttcctataaaatcatgtaccaagaagttcc

SEQ ID NO: 195850 - DNA, 278 bp, Homo sapiens
  Payload ID: 18648
  Gene Name: tubulin folding cofactor D
  ENST ID: ENST00000632081
  CDS Start-End: 1-278
gatgcagcagtctcggccctggctgctctatgcagtgaatattacatgaaggagccgggggaggcagatcccgcaattcaggaggagctgatcacgcagtacctggctgagcttcggaaccccgaggagatgactcgctgtggcttctcgttggccttgggcgcccttccaggcttccttctgaaaggccggctccagcaggttctcacaggtttaagagcagttacccacacttcccccgaggacgtaagttttgctgagtccaggagagacggctt

SEQ ID NO: 195851 - DNA, 4860 bp, Homo sapiens
  Payload ID: 18648
  Gene Name: tubulin folding cofactor D
  ENST ID: ENST00000633825
  CDS Start-End: 1-1401
gatgcagcagtctcggccctggctgctctatgcagtgaatattacatgaaggagccgggggaggcagatcccgcaattcaggaggagctgatcacgcagtacctggctgagcttcggaaccccgaggagatgactcgctgtggcttctcgttggccttgggcgcccttccaggcttccttctgaaaggccggctccagcaggttctcacaggtttaagagcagttacccacacttcccccgaggacgtaagttttgctgagtccaggagagacggcttgaaggccattgcgaggatttgccagactgttggtgtgaaagcaggagccccagacgaagctgtgtgcggagagaatgtttcccagatttactgtgcgctgctgggctgcatggacgactacaccacggacagcagaggggacgtgggcacctgggtccgcaaggccgccatgaccagtctgatggatctgacacttctgctggctcggagccagcctgagctgatcgaggcccatacctgtgagcgcatcatgtgctgtgtggcccagcaggccagtgagaagattgaccgtttccgtgctcacgccgccagcgtgttcctgacgctcctgcactttgacagccctcccatcccccacgtgccccaccgaggagaactggaaaagctgtttcccaggtccgacgtggcctccgtgaactggagtgcaccttcccaggccttcccacgcatcacccagctccttgggctgcccacctaccgctaccacgtcctgctggggctagtcgtgtccctgggcggcttgacggagtcgacgatccggcactccacccagagcctctttgagtacatgaagggcattcagagcgacccgcaggccctgggcagcttcagcgggacccttctgcagatctttgaggacaaccttctgaatgagagggtgtccgtgccgctgctgaagacgctggaccacgtgctcacccacggctgcttcgacatcttcaccacggaggaggaccacccctttgctgtgaagttgcttgcgctctgtaagaaagaaatcaagaattcaaaagatatccagaagctcctgtcaggcatcgcagtgttctgcgggatggtgcagttccccggcgacgtgaggaggcaggccctcctgcagctgtgtctgctcctctgccaccgtttcccgctgatccggaagaccacggccagccaggtgtacgagacattgctcacctacagtgacgtcgtgggcgcggatgtgctggacgaggtggtgactgtgctcagtgacactgcgtgggacgcggagcttgcagtggtgagagagcagcgcaaccgtctgtgtgaccttctgggcgtacccaggccccagctggtgccccagcctggtgcctgctgaagccagtcctggagcccatacctcacccctgcctggtgaggatgtcttgttcctgagggaggccggtgtggaaagcctcgcacagtggtgcctccagctgttgaagggtagcgctggcccttggaggctggcactagctgacagcttttcctctctgcacctgcgctctggtgacttggggtggacgcctctgccttcacttgaacacaaatgtgcttcctataaaatcatgtaccaagaagttcctgccttttgtctctgagcctgatgtgtgtaggggtgatggaaaggctcactgcccaggggtcagccagaggggaggtgggctgcactcctcctgcctggagaccaggcccccttcttgcctggtgctgtccctgctgtgggagacgtctggccacaggcagtgccccacccagtcttggagagagatgaatgttaaatcagaggttcaaatgctagagaactgagaagccctggtggcaggcatggtctggagtgctgggcagatgctgtttctgggcccgtctgcctggtgggggtgctgtcctcccccctgtgcacacgtgagcatcgtgcatgtggcccctctgcagtgcaggagtcactgattgatgggtgtgccgaccagcagcttcacaaatgtctgctgcaaggggaatcgtcagagtccaatgtgtgcctctacagtaatgtgggaaataaataccattcttgaaataattacactgtcttaggagagcctgggcagagtccacacttgggtttttaggcaaagggcaggaggctacctttgtctctgtgtctgagctcgtgctgatccatcccaaagctggtgaggggaacgtgtataaaaatttcactgtggtagcaacccacacccatctctgggacctgtgctgtgctcatagggcttgaggtgcagaaccacggccagcagcaccaaagcagccccaggtgtggccactcagaggcccaagggcttgggtgagcaaccctttccctatgtgaggagcccaggggtgccatgtgcgtggtgtagattagggtggctccctggcctgctctcaggtggggatggggcctggacacaggaacatgggcaggccaagaactgggaggtgccaccgcatctgtgaggcttgtgaggtcaccaggaccacaagaccaggactgtgacagtccgtgctgtgtgtttagcagacagctcttcacgggatgtgtgtgacgacctggccacacaggagtgtggggttaacacactactgttgttgtgtttgacctggtggccaatggtctttataccctaaaagagccttgggttacatttttacgagatttaaatattttattccaacctgtgtaataggggtctcctcctccttgaactgtcccgattggctggggtcacgtggtgagggtcctgggtgaccaggcctagccttggccacatgagtccacacagtggaaaaggcttggctcctgtggtcggcacacatgagactctggttgcgcctgctgggtgtggaacaggcgcaccatcgccatgcctgcagctcacaaagctcctgctggcctgggatgcactgaggatggaaggaacaagtggcttctgagaaaaacatgatgaactgttcttagtgcaattaaaagaagattccagataaatggcattttaagacatggaggcaggtcgattacccacccagacccatcagtgacactatgtggcaaagcagttcttcttttaatgtcggtctaacttagcaacccgaggaaagtggatcactccactggccactgcctctttcccactggatcccatccatcactggggcacttgtgctcaccagacacctggtggcctggaaagccctctttcagcagccgtttctggagcccaccagggtccaggtgatagagtttggcaaggaaccccttgctcacatgatagctggggcagacaatagcaaatgaacaagcaagcaccatcaaggcaggcaacactgagtgctatgaacaaagataaagtgggcaatggaatggcatgttgggtgttgactccgagaaggtgttcagaaaacctctctgaaggggcagcatttgggcagaggtccagactgtgtccaatggcagaaaagagaatgcttgtggtcccagaagtggagcaagctttgtgagtttagagagcagcaagaagccagtatccctgggaccggggagctgatgtgggatttgtgtacccacaaacacgttctaggtgctaaccagaaaccctccatgtgagagcagagaccttggagatcctgagggtttctgctgagccctggaatctagtcacgctattttgatagcagaatggatgagagaatttaaggcccagggccagatctaatggaccgctatataaagctgggaccctaaataagtctttttcaaaggaacagcagcaagactcttatctcaatctatctcccctgaagtggcctgaattaatactacctgtatgatccccaaaactcctaaagtggaaaatttgattgacttggccctgaccagtggtattcccagacaagggcagaagatgcaaatacaaaacctctctggtagaatgtaggctataatatgagtacatttttgaaaagggctagaaatgatcaagaagagattagaaaaaaacagagcccctagaaatgtaagaagtgaaatgaaaagctcaatggatagcttagacacagctgaagagagaattagaaaactggaagatctgaaaacattatccagagaactggaagatataacagcaacatcaagagacattgaagaatgtctaacctttgggtaattggggtctcagaatgaaatgaagtgatgcagatattccatactgacatgcaacagtccccagatacagaagcctaacagtctcacatttagacctgccacagtgaaactgcagaactgtaagaaggacagagtgatataaacgactaccaatttcccagcagcagcactggagttgagcagtgagtagaccaaggtcttcattatgctgagagaaaatagctgtcaagttgcttgaattgtgcccacagcataacattaaagaagagaacacaattaagtcatttagataaaaatatgccattcttatctgtttggttttttaatcttggcttaatatttggggttgagtcatttgttttgagagctgtcctgtttattgcagggtgttcagcaacatcccagatggaagcagcatccccctacccagctgtgacaaaaagaaaaaaaaatgtctccagacactgccaaatatcttctgggggtgcccctggttgagaaccactgctttagtggataaactttaggcaggagggaaatgatcgcagttggatagttggaggaatgtggagcaagggaagcaataaactgtgaccataaaaacatagaaagatg

SEQ ID NO: 195852 - DNA, 1383 bp, Homo sapiens
  Payload ID: 18648
  Gene Name: tubulin folding cofactor D
  ENST ID: ENST00000633959
  CDS Start-End: 1-206
cattgctcacctacagtgacgtcgtgggcgcggatgtgctggacgaggtggtgactgtgctcagtgacactgcgtgggacgcggagcttgcagtggtgagagagcagcgcaaccgtctgtgtgaccttctgggcgtacccaggccccagctggtgccccaggtaaccctgtcaccttcacagcatgaggtgcctgtgcttccctgagctctggaatgttctggggccagcggctgtgcttagcttctgccagcacgtccacacggcccgttccctcgtctcatgtcaggacccctgggattacgggaccagcagagctgccttctctggccactgcccacacctgtgggcccctgtggcatccaggccacttgctctggggcgtttggggggccggggagtgggtggagctggcaccagcttgatccaggctcctcatgcctggccctggggtctgtttgtgctccaagtgccaagagtgccaccctacccctcctcatctgcttcccatgagtggggccggggctgggtgagaggcccccagaagctgcccctgtgcacctcaccagcccgtcactcttcttctaaagtaacaaaaacaagtacctcagttctcacgggggctggggcccagggttgctgtgctgtctctctagttaccagggttggctccttcctctcagcctccttccggcaggaggttatatctgagagggaggaggagaaccatgtccagatacatgggggcagtggggatgggctgagcatcaggacacagcctcccccatttctgtgtgtgtaaaggctgaactcaacagcagactttggaattaaatgtgctttttacatttttattaggaaaaatttcaaacgtgtgaatgcaggttaagagcagtgcagtgaacctcccttcccgctccccagatggggtgcccttccgaggacacgttagtcatgagcacctgtcagccacatagctcaggctgccgggtgtgtgggaaacggcacaaatggtttcctgcaggaaccgtgtcagtccccacacagggcccagaggggtgagggtcccctggctgggaatggtgtgtgttggagctgaccagcctgagcttgtcttgtctcttcttcagcctggtgcctgctgaagccagtcctggagcccatacctcacccctgcctggtgaggatgtcttgttcctgagggaggccggtgtggaaagcctcgcacagtggtgcctccagctgttgaagggtagcgctggcccttggaggctggcactagctgacagcttttcctctctgcacctgcgctctggtgacttggggtggacgcctctgccttcacttgaacacaaatgtgcttcctataaaatcatgtaccaag

SEQ ID NO: 195853 - DNA, 979 bp, Homo sapiens
  Payload ID: 18648
  Gene Name: tubulin folding cofactor D
  ENST ID: ENST00000631706
  CDS Start-End: 1-783
gcccagcaggccagtgagaagattgaccgtttccgtgctcacgccgccagcgtgttcctgacgctcctgcactttgacagccctcccatcccccacgtgccccaccgaggagaactggaaaagctgtttcccaggtccgacgtggcctccgtgaactggagtgcaccttcccaggccttcccacgcatcacccagctccttgggctgcccacctaccgctaccacgtcctgctggggctagtcgtgtccctgggcggcttgacggagtcgacgatccggcactccacccagagcctctttgagtacatgaagggcattcagagcgacccgcaggccctgggcagcttcagcgggacccttctgcagatctttgaggacaaccttctgaatgagagccacccctttgctgtgaagttgcttgcgctctgtaagaaagaaatcaagaattcaaaagatatccagaagctcctgtcaggcatcgcagtgttctgcgggatggtgcagttccccggcgacgtgaggaggcaggccctcctgcagctgtgtctgctcctctgccaccgtttcccgctgatccggaagaccacggccagccaggtgtacgagacattgctcacctacagtgacgtcgtgggcgcggatgtgctggacgaggtggtgactgtgctcagtgacactgcgtgggacgcggagcttgcagtggtgagagagcagcgcaaccgtctgtgtgaccttctgggcgtacccaggccccagctggtgccccagcctggtgcctgctgaagccagtcctggagcccatacctcacccctgcctggtgaggatgtcttgttcctgagggaggccggtgtggaaagcctcgcacagtggtgcctccagctgttgaagggtagcgctggcccttggaggctggcactagctgacagcttttcctctctgcacctgcgctctggtgacttggggtggacgcctctgcct

SEQ ID NO: 195854 - DNA, 200 bp, Homo sapiens
  Payload ID: 18648
  Gene Name: tubulin folding cofactor D
  ENST ID: ENST00000634094
  CDS Start-End: 1-200
gatgcagcagtctcggccctggctgctctatgcagtgaatattacatgaaggagccgggggaggcagatcccgcaattcaggaggagctgatcacgcagtacctggctgagcttcggaaccccgaggagatgactcgctgtggcttctcgttggccttgggcgcccttccaggcttccttctgaaaggccggctccagca

SEQ ID NO: 195855 - DNA, 241 bp, Homo sapiens
  Payload ID: 18648
  Gene Name: tubulin folding cofactor D
  ENST ID: ENST00000632123
  CDS Start-End: 1-241
gatgcagcagtctcggccctggctgctctatgcagtgaatattacatgaaggagccgggggaggcagatcccgcaattcaggaggagctgatcacgcagtacctggctgagcttcggaaccccgaggagatgactcgctgtggcttctcgttggccttgggcgcccttccaggcttccttctgaaaggccggctccagcaggttctcacaggtttaagagcagttacccacacttcccccg

SEQ ID NO: 195856 - DNA, 1966 bp, Homo sapiens
  Payload ID: 18649
  Gene Name: tubulin folding cofactor E
  Uniprot ID: Q15813
  ENST ID: ENST00000366601
  CDS Start-End: 177-1760
attctcgtctatgctccagcagccgtacctcactccggtggaggcgggacttcctacagcacttccggccagagcctcaagcttcgctgctgggcagttggctggaggggctgctgctgggaacacctggagtctccgcgggcagatctcatattttggattctggatatattataatgagtgacactttgacagcggatgtcattggtcgaagagttgaagttaatggagaacatgcaacagtacgttttgctggtgttgtccctcccgtggcaggaccctggttaggagtagaatgggacaatcccgagagaggaaagcatgatgggagccacgaagggactgtgtattttaaatgcaggcacccgacaggaggatcctttattcgtccgaacaaggtaaattttggaacagactttcttactgcaattaagaaccgctatgtgttagaagatggaccagaggaagatagaaaagagcaaattgttacaattggaaataaacctgtggagactatcggttttgactctattatgaaacagcaaagtcagctgagcaagttgcaagaagtttctctgaggaactgtgcagtaagttgtgctggtgaaaaaggaggagttgctgaagcatgtcctaatatcagaaaggtagatttgtcaaaaaacctgttgtcatcatgggatgaagtgatacacattgctgatcagctcagacacctggaagtccttaatgtcagtgaaaataaactaaaatttccctccggttcagtattaactggaacgctttctgtactgaaggttttagtcctcaatcaaacaggaataacgtgggctgaggtgctgcggtgtgtcgcggggtgcccaggcctggaggaactctaccttgagtctaacaacattttcatttccgaaaggccaacagatgttctccagacagtcaagttattagatctttcctctaatcaattaattgatgaaaatcagctgtatctgatagcccacctgcccaggttagaacaattaatcctctctgacactggaatttcttctctacattttccggatgctggaattgggtgcaaaacgtccatgttcccatccttgaagtacctggtagtaaacgacaatcagatatcacaatggtcgtttttcaatgagctagagaagttaccaagtctacgggctttgtcctgcctaagaaaccccctgaccaaagaggacaaagaagcagagacggcgcgactactcattatcgccagcattggccagctgaagacgctgaacaaatgtgagattctccccgaggagaggcggagagctgagcttgactaccgaaaagcttttggaaatgagtggaaacaggctggtggacataaggatccggaaaaaaacagactcagcgaagaattcctcacagcccatcccagataccagttcctctgcctgaaatatggtgcacctgaagattgggaactcaaaacacagcaaccacttatgctgaaaaaccagctactaacactgaagataaaataccctcatcaacttgatcagaaagtcctggagaaacaactgccgggctccatgacaattcaaaaggtgaagggattgctgtcacgtcttctcaaagttcctgtgtcagaccttctgttgtcctatgaaagtcccaaaaagccgggcagagaaatcgagctggaaaatgacctaaagtcattacagttttattctgtggaaaatggagattgtctattagtgcgatggtgacaaccaactaataaaatttaaagaccacactgcttatcgtgtctggggttcaccggaaataaatgattcactggaacaattctactgtcaaaacaaagggggtttacaacttgtcctaagtataacaagggatgtattttttgttgggaagtgaccatttctaggcttatacataatagcaataataaaggctttgaacctactaa

SEQ ID NO: 195857 - DNA, 2012 bp, Homo sapiens
  Payload ID: 18649
  Gene Name: tubulin folding cofactor E
  Uniprot ID: Q15813
  ENST ID: ENST00000406207
  CDS Start-End: 225-1808
attctcgtctatgctccagcagccgtacctcactccggtggaggcgggacttcctacagcacttccggccagagcctcaagcttcgctgctgggcagttggctggaggggctgctgctgggaacacctggagtctccgcgggcaggtgagcttcagaggttcggggagctttcggaacgagcattcctggccgatctcatattttggattctggatatattataatgagtgacactttgacagcggatgtcattggtcgaagagttgaagttaatggagaacatgcaacagtacgttttgctggtgttgtccctcccgtggcaggaccctggttaggagtagaatgggacaatcccgagagaggaaagcatgatgggagccacgaagggactgtgtattttaaatgcaggcacccgacaggaggatcctttattcgtccgaacaaggtaaattttggaacagactttcttactgcaattaagaaccgctatgtgttagaagatggaccagaggaagatagaaaagagcaaattgttacaattggaaataaacctgtggagactatcggttttgactctattatgaaacagcaaagtcagctgagcaagttgcaagaagtttctctgaggaactgtgcagtaagttgtgctggtgaaaaaggaggagttgctgaagcatgtcctaatatcagaaaggtagatttgtcaaaaaacctgttgtcatcatgggatgaagtgatacacattgctgatcagctcagacacctggaagtccttaatgtcagtgaaaataaactaaaatttccctccggttcagtattaactggaacgctttctgtactgaaggttttagtcctcaatcaaacaggaataacgtgggctgaggtgctgcggtgtgtcgcggggtgcccaggcctggaggaactctaccttgagtctaacaacattttcatttccgaaaggccaacagatgttctccagacagtcaagttattagatctttcctctaatcaattaattgatgaaaatcagctgtatctgatagcccacctgcccaggttagaacaattaatcctctctgacactggaatttcttctctacattttccggatgctggaattgggtgcaaaacgtccatgttcccatccttgaagtacctggtagtaaacgacaatcagatatcacaatggtcgtttttcaatgagctagagaagttaccaagtctacgggctttgtcctgcctaagaaaccccctgaccaaagaggacaaagaagcagagacggcgcgactactcattatcgccagcattggccagctgaagacgctgaacaaatgtgagattctccccgaggagaggcggagagctgagcttgactaccgaaaagcttttggaaatgagtggaaacaggctggtggacataaggatccggaaaaaaacagactcagcgaagaattcctcacagcccatcccagataccagttcctctgcctgaaatatggtgcacctgaagattgggaactcaaaacacagcaaccacttatgctgaaaaaccagctactaacactgaagataaaataccctcatcaacttgatcagaaagtcctggagaaacaactgccgggctccatgacaattcaaaaggtgaagggattgctgtcacgtcttctcaaagttcctgtgtcagaccttctgttgtcctatgaaagtcccaaaaagccgggcagagaaatcgagctggaaaatgacctaaagtcattacagttttattctgtggaaaatggagattgtctattagtgcgatggtgacaaccaactaataaaatttaaagaccacactgcttatcgtgtctggggttcaccggaaataaatgattcactggaacaattctactgtcaaaacaaagggggtttacaacttgtcctaagtataacaagggatgtattttttgttgggaagtgaccatttctaggcttatacataatagcaataataaaggctttgaacctact

SEQ ID NO: 195858 - DNA, 2117 bp, Homo sapiens
  Payload ID: 18649
  Gene Name: tubulin folding cofactor E
  Uniprot ID: Q15813
  ENST ID: ENST00000543662
  CDS Start-End: 177-1913
attctcgtctatgctccagcagccgtacctcactccggtggaggcgggacttcctacagcacttccggccagagcctcaagcttcgctgctgggcagttggctggaggggctgctgctgggaacacctggagtctccgcgggcagatctcatattttggattctggatatattataatgagtgacactttgacagcggatgtcattggtcgaagagttgaagttaatggagaacatgcaacagtacgttttgctggtgttgtccctcccgtggcaggaccctggttaggagtagaatgggacaatcccgagagaggaaagcatgatgggagccacgaagggactgtgtattttaaatgcaggcacccgacaggaggatcctttattcgtccgaacaaggtaaattttggaacagactttcttactgcaattaagaaccgctatgtgttagaagatggaccagaggaagatagaaaagagcaaattgttacaattggaaataaacctgtggagactatcggttttgactctattatgaaacagcaaagtcagctgagcaagttgcaagaagtttctctgaggaactgtgcagtaagttgtgctggtgaaaaaggaggagttgctgaagcatgtcctaatatcagaaaggtagatttgtcaaaaaacctgttgtcatcatgggatgaagtgatacacattgctgatcagctcagacacctggaagtccttaatgtcagtgaaaataaactaaaatttccctccggttcagtattaactggaacgctttctgtactgaaggttttagtcctcaatcaaacaggaataacgtgggctgaggctcatgcgcagtgtggtggcagcaggcacggtctcgacatgcagaaagacgccagcaagttcgtggatctgtgcgtgctgcagaaatgctccaccagcaactgcatcatcagtgccaaggaccacacatccatgcggatgaacgtggccaaggtgctgcggtgtgtcgcggggtgcccaggcctggaggaactctaccttgagtctaacaacattttcatttccgaaaggccaacagatgttctccagacagtcaagttattagatctttcctctaatcaattaattgatgaaaatcagctgtatctgatagcccacctgcccaggttagaacaattaatcctctctgacactggaatttcttctctacattttccggatgctggaattgggtgcaaaacgtccatgttcccatccttgaagtacctggtagtaaacgacaatcagatatcacaatggtcgtttttcaatgagctagagaagttaccaagtctacgggctttgtcctgcctaagaaaccccctgaccaaagaggacaaagaagcagagacggcgcgactactcattatcgccagcattggccagctgaagacgctgaacaaatgtgagattctccccgaggagaggcggagagctgagcttgactaccgaaaagcttttggaaatgagtggaaacaggctggtggacataaggatccggaaaaaaacagactcagcgaagaattcctcacagcccatcccagataccagttcctctgcctgaaatatggtgcacctgaagattgggaactcaaaacacagcaaccacttatgctgaaaaaccagctactaacactgaagataaaataccctcatcaacttgatcagaaagtcctggagaaacaactgccgggctccatgacaattcaaaaggtgaagggattgctgtcacgtcttctcaaagttcctgtgtcagaccttctgttgtcctatgaaagtcccaaaaagccgggcagagaaatcgagctggaaaatgacctaaagtcattacagttttattctgtggaaaatggagattgtctattagtgcgatggtgacaaccaactaataaaatttaaagaccacactgcttatcgtgtctggggttcaccggaaataaatgattcactggaacaattctactgtcaaaacaaagggggtttacaacttgtcctaagtataacaagggatgtattttttgttgggaagtgaccatttctaggcttatacataatagcaataataaaggctttgaacctact

SEQ ID NO: 195859 - DNA, 1966 bp, Homo sapiens; identical to SEQ ID NO: 195856
  Payload ID: 18649
  Gene Name: Tubulin folding cofactor E
  ENST ID: ENST00000634780
  CDS Start-End: 177-1760

SEQ ID NO: 195860 - DNA, 2012 bp, Homo sapiens; identical to SEQ ID NO: 195857
  Payload ID: 18649
  Gene Name: Tubulin folding cofactor E
  ENST ID: ENST00000634751
  CDS Start-End: 225-1808

SEQ ID NO: 195861 - DNA, 2117 bp, Homo sapiens; identical to SEQ ID NO: 195858
  Payload ID: 18649
  Gene Name: Tubulin folding cofactor E
  ENST ID: ENST00000635692
  CDS Start-End: 177-1913

SEQ ID NO: 195862 - DNA, 3923 bp, Homo sapiens
  Payload ID: 18650
  Gene Name: tubulin folding cofactor E-like
  ENST ID: ENST00000284259
  CDS Start-End: 217-573
gggaaagctgcttccgggtcaatgcaggacactgggctccggcggccagagtgggggactaggtgaagcggcgccgggccggggctggccgggaccaggcccgaggctgagcggcggcgacagcggtggccgggaggggggaggagaggcgcagccagaggagccgccgcagtagctcccccgcctcccgggctgagggcattttaagaaagaaagatggatcaacctagtggaagaagtttcatgcaagtattatgtgaaaaatatagtcctgaaaattttccttatcgccgtggcccggggatgggagtccatgtcccagccacacctcagggctctcctatgaaagatcgcctcaacctcccaagtgtactagtgttgaacagctgtggaataacctgtgcaggagatgaaaaagaaattgctgctttctgcgctcatgtgtcggaactagatctttctgacaacaaactcgaagactggcatgagaaagaacatgtgctgggtccttctctggggttcgcaaacttgtcctcaacaacagcaaagcttcttgggagacggtccacatgatactacaggagttaccagatttggaggagctcttcctgtgccttaatgactatgaaacagtgtcttgtccttctatttgctgtcattctcttaagctactacatataacagacaataacctccaagactggactgaaatacgaaagttaggagttatgtttccttcactggataccctcgtcctggccaacaatcatttgaatgctattgaggagcctgatgattcattggccaggttgtttcctaatcttcgatccatcagcctccacaagtcaggtttgcagtcctgggaagacattgataaactaaattcatttcccaaactggaagaagtgagattgttaggaattcctcttctgcagccatataccaccgaggagcgaaggaaattggtaatagccagattgccatcagtttccaaacttaatggcagcgttgttactgatggtgaacgagaagattctgagagattttttattcgttactatgtggatgttccacaggaagaagtgccattcaggtatcatgaactgatcactaaatatgggaagttggagcctttggcagaagtggacctaagaccccagagcagtgcaaaagtagaagtccactttaacgatcaggtggaagaaatgagcattcgtctggaccaaacagtggcagaactaaagaaacagttaaaaactctagtacaattacccacaagcaacatgcttctctactattttgaccatgaagcaccctttggcccagaggaaatgaagtacagctctcgggcattgcattcctttggcattagggatggagataaaatttacgtggaatccaaaacaaaataacctctaccagccttgtgaaaaacatacacataaggacttgttgcagggcatttgtttttaatgtggttttctttaggagggagaggttgtttttgttttgttttgttctgtttaggtttgggaaggattttgtatatttttccccctggagtgagtaggggccatttttgggtgttttctaccacagattgatttggctcagccagcggaattggccacatttccagtgtatgtgccctctctaaggaaagatgacaaagaaatcaccgacttcttactgtgttcactgggatttgcctgccacttggttatcattactgttgggtgaacctgtgaagataacatgaacactgtagccccttagaagggtctcatagagaatttaaacagggtgacaaggaatcttcacaggaagggccagaacttctctctcccagttcttccttccgctaccctccctccttggcttttttggttcagttccatttttttttcattttgacatgtggtttacctaatagttttgttctgttcataattcttatttctcaacctgggtgatttttttgttctcatttctcccttttgaaataattgaaagtgttttaagcatttttaacctgattctaatctcaggtacgcagtaagaagctataactctgttagaacctcgaagagtagatgtagaatgaaaactccaggaaaacttgcagttattctggaagcaccggcagaacagtctgatctctttgtatgttactaactcacttttaatgtccctgtacattatgtcagccattactttcataacatgaaatatgtcagattccagagttcttttatttttgcttattgaatgtatttcctcatatctttctttttcattactttaaactattgggaattgaggcctgacttcataaataattcaatagagtcctggatacgtgcaccaggagagttgagaattagctcataaactatctgtggtgtgtgtggggaatgaagttgggggatgtgggggaagagcttatgactttcccacctgtgtcatccattggaagcccttgctcttgcactttgcattaaaagtgggaaacattaatcaaagggagattttattcccaggttttccctgggactttgtgatatcataattgaacagttcttttgttttacatttcaatttagttgcctcatagaagtataactgcccaatctatgagtaaagtgtaagtgtcaaaactttacaattgcctccaagtcatattttttgcagaagcacatttaaagcacttttctgtaaaagctagttccttacctgcttggaaatctttttgtttgttcttctattcctttgttaatcagatgtaatccctttctttaatgtgtatttttcttggtccaccatgtttacagatgggagacttgagagatacttagcataactggggcagaaagtgtgtaagtgaagtatttttcaaagaatgcagttattatctgattgcatttgaccttttgacctttgttacataattctacccctcctacaaatttaatttttttatgaaatttttaggtgacttgtaaattcttcatgtatgaggagttgtgtttattaatgctactttttaaattttcctgtgccatgtggcagatgtttattctcttaatgcacttcaggtttgctatctgtaaagcctttgacccaggcctactgagtcaaatctacattcagtgtaacattaaaggtggaaaccaaagggtttgagaaagacgaataaggcctattctccttctgctgcagactttatctttcaaaatcataaaaatgagcaatggagatccaggctgggtatagacaagaataattattttgcaaacacattttcctgacagatttttggaagtaggaaaaaagtatggcaacagtgtcatgaagattgaaactgtaggtgctttgtgtatgtatgcatgagtgcagatgagtttgagagagaaaaagtgtaattgagccctttgcttttgtcagcctgggaaacagatgcgttcttattttttgaagttgtgtgaccctggactgtcccacagcagaaggcagaacaaacacttatgttatgctttaatcataagtggaatggtcacaattaataagatattttatatatggcaaagttttatgaaatgcttttttactattagagacctgtttcttctgttattacagaacacagtgtttatcaactgcggacataattcttttattatacagttgcatgtaaagggagcttctcatttaattcagcggatgtgggtatttttagggcattgtaattgatggttttaataattgctgaataatttttgattaagagaaaaatgtaatacaattactggtctgagttacagaacagaagttaatgaaaaaggctatttgagcatgtgtacttatagattcatttgggtggctgagaaaagatgctgcttttgaaataaaattggtgctgtgta

SEQ ID NO: 195863 - DNA, 5142 bp, Homo sapiens
  Payload ID: 18650
  Gene Name: tubulin folding cofactor E-like
  Uniprot ID: Q5QJ74
  ENST ID: ENST00000422003
  CDS Start-End: 189-1463
acactgggctccggcggccagagtgggggactaggtgaagcggcgccgggccggggctggccgggaccaggcccgaggctgagcggcggcgacagcggtggccgggaggggggaggagaggcgcagccagaggagccgccgcagtagctcccccgcctcccgggctgagggcattttaagaaagaaagatggatcaacctagtggaagaagtttcatgcaagtattatgtgaaaaatatagtcctgaaaattttccttatcgccgtggcccggggatgggagtccatgtcccagccacacctcagggctctcctatgaaagatcgcctcaacctcccaagtgtactagtgttgaacagctgtggaataacctgtgcaggagatgaaaaagaaattgctgctttctgcgctcatgtgtcggaactagatctttctgacaacaaactcgaagactggcatgaggtcagtaaaattgtgtcaaatgttcctcagttggagtttctaaacctgagttccaaccctctgaatttgtcggttttagaaagaacatgtgctgggtccttctctggggttcgcaaacttgtcctcaacaacagcaaagcttcttgggagacggtccacatgatactacaggagttaccagatttggaggagctcttcctgtgccttaatgactatgaaacagtgtcttgtccttctatttgctgtcattctcttaagctactacatataacagacaataacctccaagactggactgaaatacgaaagttaggagttatgtttccttcactggataccctcgtcctggccaacaatcatttgaatgctattgaggagcctgatgattcattggccaggttgtttcctaatcttcgatccatcagcctccacaagtcaggtttgcagtcctgggaagacattgataaactaaattcatttcccaaactggaagaagtgagattgttaggaattcctcttctgcagccatataccaccgaggagcgaaggaaattggtaatagccagattgccatcagtttccaaacttaatggcagcgttgttactgatggtgaacgagaagattctgagagattttttattcgttactatgtggatgttccacaggaagaagtgccattcaggtatcatgaactgatcactaaatatgggaagttggagcctttggcagaagtggacctaagaccccagagcagtgcaaaagtagaagtccactttaacgatcaggtggaagaaatgagcattcgtctggaccaaacagtggcagaactaaagaaacagttaaaaactctagtacaattacccacaagcaacatgcttctctactattttgaccatgaagcaccctttggcccagaggaaatgaagtacagctctcgggcattgcattcctttggcattagggatggagataaaatttacgtggaatccaaaacaaaataacctctaccagccttgtgaaaaacatacacataaggacttgttgcagggcatttgtttttaatgtggttttctttaggagggagaggttgtttttgttttgttttgttctgtttaggtttgggaaggattttgtatatttttccccctggagtgagtaggggccatttttgggtgttttctaccacagattgatttggctcagccagcggaattggccacatttccagtgtatgtgccctctctaaggaaagatgacaaagaaatcaccgacttcttactgtgttcactgggatttgcctgccacttggttatcattactgttgggtgaacctgtgaagataacatgaacactgtagccccttagaagggtctcatagagaatttaaacagggtgacaaggaatcttcacaggaagggccagaacttctctctcccagttcttccttccgctaccctccctccttggcttttttggttcagttccatttttttttcattttgacatgtggtttacctaatagttttgttctgttcataattcttatttctcaacctgggtgatttttttgttctcatttctcccttttgaaataattgaaagtgttttaagcatttttaacctgattctaatctcaggtacgcagtaagaagctataactctgttagaacctcgaagagtagatgtagaatgaaaactccaggaaaacttgcagttattctggaagcaccggcagaacagtctgatctctttgtatgttactaactcacttttaatgtccctgtacattatgtcagccattactttcataacatgaaatatgtcagattccagagttcttttatttttgcttattgaatgtatttcctcatatctttctttttcattactttaaactattgggaattgaggcctgacttcataaataattcaatagagtcctggatacgtgcaccaggagagttgagaattagctcataaactatctgtggtgtgtgtggggaatgaagttgggggatgtgggggaagagcttatgactttcccacctgtgtcatccattggaagcccttgctcttgcactttgcattaaaagtgggaaacattaatcaaagggagattttattcccaggttttccctgggactttgtgatatcataattgaacagttcttttgttttacatttcaatttagttgcctcatagaagtataactgcccaatctatgagtaaagtgtaagtgtcaaaactttacaattgcctccaagtcatattttttgcagaagcacatttaaagcacttttctgtaaaagctagttccttacctgcttggaaatctttttgtttgttcttctattcctttgttaatcagatgtaatccctttctttaatgtgtatttttcttggtccaccatgtttacagatgggagacttgagagatacttagcataactggggcagaaagtgtgtaagtgaagtatttttcaaagaatgcagttattatctgattgcatttgaccttttgacctttgttacataattctacccctcctacaaatttaatttttttatgaaatttttaggtgacttgtaaattcttcatgtatgaggagttgtgtttattaatgctactttttaaattttcctgtgccatgtggcagatgtttattctcttaatgcacttcaggtttgctatctgtaaagcctttgacccaggcctactgagtcaaatctacattcagtgtaacattaaaggtggaaaccaaagggtttgagaaagacgaataaggcctattctccttctgctgcagactttatctttcaaaatcataaaaatgagcaatggagatccaggctgggtatagacaagaataattattttgcaaacacattttcctgacagatttttggaagtaggaaaaaagtatggcaacagtgtcatgaagattgaaactgtaggtgctttgtgtatgtatgcatgagtgcagatgagtttgagagagaaaaagtgtaattgagccctttgcttttgtcagcctgggaaacagatgcgttcttattttttgaagttgtgtgaccctggactgtcccacagcagaaggcagaacaaacacttatgttatgctttaatcataagtggaatggtcacaattaataagatattttatatatggcaaagttttatgaaatgcttttttactattagagacctgtttcttctgttattacagaacacagtgtttatcaactgcggacataattcttttattatacagttgcatgtaaagggagcttctcatttaattcagcggatgtgggtatttttagggcattgtaattgatggttttaataattgctgaataatttttgattaagagaaaaatgtaatacaattactggtctgagttacagaacagaagttaatgaaaaaggctatttgagcatgtgtacttatagattcatttgggtggctgagaaaagatgctgcttttgaaataaaattggtgctgtgtagacacttgtaaccaaaattatttttataacagaactaaaagaaggagagaagaggccatggacctttgagtttacatgttatacctaattgattgtctgcagcttatctgtattttaatattgactttgtccagattcagtgagaacatagtattgacattatgaggcaaaatgctgtcatagccagtattactgatatgttgctacagacacaatgtatagaacataccttttctaaaataggaattatttccagttatgaaaaaggaaaagagtaataaagaaaaccaaatcaaaaccaagggatcctttctacatgtgggtgaacggctgctaaagccacagtagaaaccaatttttgaatttgaattgttgaaatatcctagattgctttaatggaaaaaatccagagtcacatatcttttttattatcaagtttttgcagccttttgccagcattgccataaatacgtaagaaagcagcagatagtataagcccctagttattaagacttctcagttaatattaaggccaaaatataacttgagctaggtataacagggctgaatgctacagtgttgtttttaaagattttgcttatttttaaagacaggaaaattcagttctaaccagatgttccagctatgttactcaaccagcagtggtaggagcagagagcacttgcactaagagctgatcaccatttgagatacgcggcttaacgcacatgtgagtgtagcttgctacatgaaaatgctaggctctagggcatgtaaaacatgaatacagaatactagattgttctaagtaatgtcatttcggtttgtgaatttgatttttcccttcatttcatgtcatattgaaaatgcaaacaaactgctctcaagaacacccagaagctatctgtgttaccagatgtgttgtgaacactctactatttttcataggtgcttccttgaaatatatgtccattgtagtggtggagagggactggactctctcaggctctttacttgccagttgtctcccgcagttaatggaaatatatatacatatatatatatattttatttagaatataatttaaacatgaaggtctattctttgcactttttattaatatatatatagataatctttaaaaaaattaaaattcaagtccatttt

SEQ ID NO: 195864 - DNA, 947 bp, Homo sapiens
  Payload ID: 18650
  Gene Name: tubulin folding cofactor E-like
  ENST ID: ENST00000533712
  CDS Start-End: 166-522
tgggggactaggtgaagcggcgccgggccggggctggccgggaccaggcccgaggctgagcggcggcgacagcggtggccgggaggggggaggagaggcgcagccagaggagccgccgcagtagctcccccgcctcccgggctgagggcattttaagaaagaaagatggatcaacctagtggaagaagtttcatgcaagtattatgtgaaaaatatagtcctgaaaattttccttatcgccgtggcccggggatgggagtccatgtcccagccacacctcagggctctcctatgaaagatcgcctcaacctcccaagtgtactagtgttgaacagctgtggaataacctgtgcaggagatgaaaaagaaattgctgctttctgcgctcatgtgtcggaactagatctttctgacaacaaactcgaagactggcatgagaaagaacatgtgctgggtccttctctggggttcgcaaacttgtcctcaacaacagcaaagcttcttgggagacggtccacatgatactacaggagttaccagagtttgcagtcctgggaagacattgataaactaaattcatttcccaaactggaagaagtgagattgttaggaattcctcttctgcagccatataccaccgaggagcgaaggaaattggtaatagccagattgccatcagtttccaaacttaatggcagcgttgttactgatggtgaacgagaagattctgagagattttttattcgttactatgtggatgttccacaggaagaagtgccattcaggtatcatgaactgatcactaaatatgggaagttggagcctttggcagaagtggacctaagaccccagagcagtgcaaaagtagaagtccactttaacgatcaggtggaagaaatgagcattcgtctggaccaaacagtggcagaactaaagaaacagttaaa

SEQ ID NO: 195865 - DNA, 553 bp, Homo sapiens
  Payload ID: 18650
  Gene Name: tubulin folding cofactor E-like
  ENST ID: ENST00000528512
  CDS Start-End: 305-553
aatgcaggacactgggctccggcggccagagtgggggactaggtgaagcggcgccgggccggggctggccgggaccaggcccgaggctgagcggcggcgacagcggtggccgggaggggggaggagaggcgcagccagaggagccgccgcagtagctcccccgcctcccgggctgagggaatgtctaatttaatagggatatagacagttggtttaaaccaacatttttggacgaggagaggctatggaaatgaagaaagaagtgtttagaaatatcacacaaacagcattttaagaaagaaagatggatcaacctagtggaagaagtttcatgcaagtattatgtgaaaaatatagtcctgaaaattttccttatcgccgtggcccggggatgggagtccatgtcccagccacacctcagggctctcctatgaaagatcgcctcaacctcccaagtgtactagtgttgaacagctgtggaataacctgtgcaggagatgaaaaagaaattgctgctttctgcgctcatgtgtcggaactagatctttctgac

SEQ ID NO: 195866 - DNA, 1913 bp, Homo sapiens
  Payload ID: 18650
  Gene Name: tubulin folding cofactor E-like
  ENST ID: ENST00000524726
  CDS Start-End: 1200-1913
gtaaccctatgagctaggagttacaggctactaccccttcctgtgagtgaagaggggtagacttagagaacttaagtaacttgcccacagttacacagagtagtggaatcagtcaggatttacatacccagggcgtttagttttagaaccagtacttactaccattgggcagtattgccatagcactaaatgtaggaggagctagtgaaaaaaaaaacaaaaacaaacgtggatttttttttttttaatgacctgcagacttttgcaacctttatgcgtgattgatgtttcaacattctggcaatccctggttattagccagggtggtttgtaaactgctctggaaggctgtagagtgatgaactagtggtctgttcctaatgaggcttttccttaacatgatggcttctgtagctgctcaagagcacagataatgggggtaatctgttctgtaaacagctaagtaatgaccttaaacttgtgtgttcacagcggaaagaaaacatgcatatatgattttcttctgatgaaacctaatgtattcaagaaaaagaatcttgctttttggaaggatggaaaaattgggaataattttttcccctttgataattagaccactcagtactgttgcttagttttttggttcagttactttgatgtggttacaagaggaattttggctgtaatggatttcatacatttttgtaagttatgtttccatgtctcgtgtgtgatgttgtgtactgttgacatgaaatactccttttttggtaaagatggattggcttaacagattagagctacagaaagtatgacttagcacgctggtaaggccacaaaaacccaagcaagttcccccagtttcgtatcctgtaaatagagataagttagtttttctgtttcagagagtggttatggaaaactactaggctttaaaatgattgttaatctcagtgtggggacatttggtttggggacatcagttcaggagtaaatgtatctgatcctgctttgaataaatgcaacttgaaagccttggaattttaccagatcgaatctgggccaaatagaaagaatgtctaatttaatagggatatagacagttggtttaaaccaacatttttggacgaggagaggctatggaaatgaagaaagaagtgtttagaaatatcacacaaacagcattttaagaaagaaagatggatcaacctagtggaagaagtttcatgcaagtattatgtgaaaaatatagtcctgaaaattttccttatcgccgtggcccggggatgggagtccatgtcccagccacacctcagggctctcctatgaaagatcgcctcaacctcccaagtgtactagtgttgaacagctgtggaataacctgtgcaggagatgaaaaagaaattgctgctttctgcgctcatgtgtcggaactagatctttctgacaacaaactcgaagactggcatgaggtcagtaaaattgtgtcaaatgttcctcagttggagtttctaaacctgagttccaaccctctgaatttgtcggttttagaaagaacatgtgctgggtccttctctggggttcgcaaacttgtcctcaacaacagcaaagcttcttgggagacggtccacatgatactacaggagttaccagatttggaggagctcttcctgtgccttaatgactatgaaacagtgtcttgtccttctatttgctgtcattctcttaagctactacatataacagacaataacctccaagactggactgaaatacgaaagttaggagttatgtttccttcactggataccctcgtcctggccaacaatcatttgaatgctattgaggagcctgatgattcattggccaggttgtttcctaatcttcgatccatcagcctccacaagtcaggt

SEQ ID NO: 195867 - DNA, 2593 bp, Homo sapiens
  Payload ID: 18650
  Gene Name: tubulin folding cofactor E-like
  ENST ID: ENST00000531148
  CDS Start-End: 509-814
acactgggctccggcggccagagtgggggactaggtgaagcggcgccgggccggggctggccgggaccaggcccgaggctgagcggcggcgacagcggtggccgggaggggggaggagaggcgcagccagaggagccgccgcagtagctcccccgcctcccgggctgagggcggaaagaaaacatgcatatatgattttcttctgatgaaacctaatgtattcaagaaaaagaatcttgctttttggaaggatggaaaaattgggaataattttttcccctttgataattagaccactcagtactgttgcttagttttttggttcagttactttgatgtggttacaagaggaattttggctgtaatggatttcatacatttttaatgtctaatttaatagggatatagacagttggtttaaaccaacatttttggacgaggagaggctatggaaatgaagaaagaagtgtttagaaatatcacacaaacagcattttaagaaagaaagatggatcaacctagtggaagaagtttcatgcaagtattatgtgaaaaatatagtcctgaaaattttccttatcgccgtggcccggggatgggagtccatgtcccagccacacctcagggctctcctatgaaagatcgcctcaacctcccaagtgtactagtgttgaacagctgtggaataacctgtgcaggagatgaaaaagaaattgctgctttctgcgctcatgtgtcggaactagatctttctgacaacaaactcgaagactggcatgaggtttgcagtcctgggaagacattgataaactaaattcatttcccaaactggaagaagtgagattgttaggaattcctcttctgcagccatataccaccgaggagcgaaggaaattggtaatagccagattgccatcagtttccaaacttaatggcagcgttgttactgatggtgaacgagaagattctgagagattttttattcgttactatgtggatgttccacaggaagaagtgccattcaggtatcatgaactgatcactaaatatgggaagttggagcctttggcagaagtggacctaagaccccagagcagtgcaaaagtagaagtccactttaacgatcaggtggaagaaatgagcattcgtctggaccaaacagtggcagaactaaagaaacagttaaaaactctagtacaattacccacaagcaacatgcttctctactattttgaccatgaagcaccctttggcccagaggaaatgaagtacagctctcgggcattgcattcctttggcattagggatggagataaaatttacgtggaatccaaaacaaaataacctctaccagccttgtgaaaaacatacacataaggacttgttgcagggcatttgtttttaatgtggttttctttaggagggagaggttgtttttgttttgttttgttctgtttaggtttgggaaggattttgtatatttttccccctggagtgagtaggggccatttttgggtgttttctaccacagattgatttggctcagccagcggaattggccacatttccagtgtatgtgccctctctaaggaaagatgacaaagaaatcaccgacttcttactgtgttcactgggatttgcctgccacttggttatcattactgttgggtgaacctgtgaagataacatgaacactgtagccccttagaagggtctcatagagaatttaaacagggtgacaaggaatcttcacaggaagggccagaacttctctctcccagttcttccttccgctaccctccctccttggcttttttggttcagttccatttttttttcattttgacatgtggtttacctaatagttttgttctgttcataattcttatttctcaacctgggtgatttttttgttctcatttctcccttttgaaataattgaaagtgttttaagcatttttaacctgattctaatctcaggtacgcagtaagaagctataactctgttagaacctcgaagagtagatgtagaatgaaaactccaggaaaacttgcagttattctggaagcaccggcagaacagtctgatctctttgtatgttactaactcacttttaatgtccctgtacattatgtcagccattactttcataacatgaaatatgtcagattccagagttcttttatttttgcttattgaatgtatttcctcatatctttctttttcattactttaaactattgggaattgaggcctgacttcataaataattcaatagagtcctggatacgtgcaccaggagagttgagaattagctcataaactatctgtggtgtgtgtggggaatgaagttgggggatgtgggggaagagcttatgactttcccacctgtgtcatccattggaagcccttgctcttgcactttgcattaaaagtgggaaacattaatcaaagggagattttattcccaggttttccctgggactttgtgatatcataattgaacagttcttttgttttacatttcaatttagttgcctcatagaagtataactgcccaatctatgagtaaagtgtaagtgtcaaaacttt

SEQ ID NO: 195868 - DNA, 966 bp, Homo sapiens
  Payload ID: 18650
  Gene Name: tubulin folding cofactor E-like
  ENST ID: ENST00000533134
  CDS Start-End: 638-966
ggagtccatgtcccagccacacctcagggctctcctatgaaagatcgcctcaacctcccaagtgtactagtgttgaacagctgtggaataacctgtgcaggagatgaaaaagaaattgctgctttctgcgctcatgtgtcggaactagatctttctgacaacaaactcgaagactggcatgagaaagaacatgtgctgggtccttctctggggttcgcaaacttgtcctcaacaacagcaaagcttcttgggagacggtccacatgatactacaggagttaccagatttggaggagctcttcctgtgccttaatgactatgaaacagtgtcttgtccttctatttgctgtcattctcttaagctactacatataacagacaataacctccaagactggactgaaatacgaaagttaggagttatgtttccttcactggataccctcgtcctggccaacaatcatttgaatgctattgaggagcctgatgattcattggccaggttgtttcctaatcttcgatccatcagcctccacaagtcagatccatctctcctgtcaccaaattgataatacagtcaaccctccatattcatggacttcatccatgcattcaaccaactgcagattgaaaatacatggggaagaagggtttgcagtcctgggaagacattgataaactaaattcatttcccaaactggaagaagtgagattgttaggaattcctcttctgcagccatataccaccgaggagcgaaggaaattggtaatagccagattgccatcagtttccaaacttaatggcagcgttgttactgatggtgaacgagaagattctgagagattttttattcgttactatgtggatgttccacaggaagaagtgccattcaggtatcatgaactgatcactaaatatgggaagttggagcctttggcagaagtggacctaagaccccagagcag

SEQ ID NO: 195869 - DNA, 1375 bp, Homo sapiens
  Payload ID: 18650
  Gene Name: tubulin folding cofactor E-like
  Uniprot ID: Q5QJ74
  ENST ID: ENST00000529397
  CDS Start-End: 101-1375
gtcacgtgttgttgttgggccgggaaagctgcttccgggtcaatgcaggacactgggctccggcggccagagtgggggactagcattttaagaaagaaagatggatcaacctagtggaagaagtttcatgcaagtattatgtgaaaaatatagtcctgaaaattttccttatcgccgtggcccggggatgggagtccatgtcccagccacacctcagggctctcctatgaaagatcgcctcaacctcccaagtgtactagtgttgaacagctgtggaataacctgtgcaggagatgaaaaagaaattgctgctttctgcgctcatgtgtcggaactagatctttctgacaacaaactcgaagactggcatgaggtcagtaaaattgtgtcaaatgttcctcagttggagtttctaaacctgagttccaaccctctgaatttgtcggttttagaaagaacatgtgctgggtccttctctggggttcgcaaacttgtcctcaacaacagcaaagcttcttgggagacggtccacatgatactacaggagttaccagatttggaggagctcttcctgtgccttaatgactatgaaacagtgtcttgtccttctatttgctgtcattctcttaagctactacatataacagacaataacctccaagactggactgaaatacgaaagttaggagttatgtttccttcactggataccctcgtcctggccaacaatcatttgaatgctattgaggagcctgatgattcattggccaggttgtttcctaatcttcgatccatcagcctccacaagtcaggtttgcagtcctgggaagacattgataaactaaattcatttcccaaactggaagaagtgagattgttaggaattcctcttctgcagccatataccaccgaggagcgaaggaaattggtaatagccagattgccatcagtttccaaacttaatggcagcgttgttactgatggtgaacgagaagattctgagagattttttattcgttactatgtggatgttccacaggaagaagtgccattcaggtatcatgaactgatcactaaatatgggaagttggagcctttggcagaagtggacctaagaccccagagcagtgcaaaagtagaagtccactttaacgatcaggtggaagaaatgagcattcgtctggaccaaacagtggcagaactaaagaaacagttaaaaactctagtacaattacccacaagcaacatgcttctctactattttgaccatgaagcaccctttggcccagaggaaatgaagtacagctctcgggcattgcattcctttggcattagggatggagataaaatttacgtggaatccaaaacaaaataa

SEQ ID NO: 195870 - DNA, 1114 bp, Homo sapiens
  Payload ID: 18651
  Gene Name: tubulin polyglutamylase complex subunit 1
  Uniprot ID: Q6ZTW0
  ENST ID: ENST00000359315
  CDS Start-End: 11-883
ctcagcgaagatggcggcagtggagaagcggcggcaagcggtaccaccgccggccggtttcacggacagcggccgccagtcggtatcccgggcggcgggggcggccgagagcgaggaggacttcctgcggcaggtcggcgtgacggaaatgctacgtgcggccctgctgaaggtgctggaggcgcggcccgaggagccgatcgccttcctggctcactacttcgagaacatgggcctgcgctcgcctgtaaacggcggcgccggggagcccccgggccagctcctgctgcagcagcagcgcctgggccgcgcgctatggcaccttcgcctggcccaccactcccagagggccgccttcaacaacaacgtgagcgtggcctacgagtgcctgagcgccggcgggcgcaggaagaggccggggctggacgggcgcacctacagcgagctgctcaggcgcatctgccgggacggccaagcccccgaggaggtggtggcgccgctgctgcgcaaggtgcagtgccgtgaccacgaggcggtgccgctgagcgtcttccgcgcgggcacactcacctgcttcgtgctgctggagttcgtggcgcgcgccggcgcgctcttccagctgctggaggactcggccgccgccgtggccgaccgccgcgtgggccaggccgtgctggacaccctggagggcgcgctgcaggccagcgacgccgccgcgcccgcgcgcttcctggaggccggctcgcgcttggggcccgacagcctggcgctggcgctggaccgcgccgtcggggggcggcggcccagcgcgcccatgacccgcgaggagtttctggagagggccgccgcgctcttcatcgcgaaggtcaagccggtgggctgaggcccgtgggccgcgcggatccgggatctgcgctggggggtccccgcgtgcggggcgcgcggagccttcccttcgccctggtgaggccctgccataaccaggcgcccagccctgcggaggaggccggggctcccaggaagcggacgcccggtccccacacagcgccgcggccgcccctccacccccgcgggagcccctgccccacgctaataaaatgtgttgcgaggctga

SEQ ID NO: 195871 - DNA, 4030 bp, Homo sapiens
  Payload ID: 18652
  Gene Name: tubulin polyglutamylase complex subunit 2
  Uniprot ID: Q68CL5
  ENST ID: ENST00000334295
  CDS Start-End: 429-1331
gtcccggctccagaacgccgcggcactggggcgggaggggcccgccacgtccgccatcttgaaacaaccgccactcggggcgtcgcgcctgggccgccacgcctcggcctgcaggctcggtccccattggccgcaccacgcagaggcccgcccccgcctgcgcggccggcccctgcggggcgagagggtgggggcgaaggggaagctacgtcccggaggtgcggtgtggggcaccgggcggggccgcgggaaccggcgccccacggagctgctgctgtcagaccaaccccgggcccccatcatcactgcgccgcgctttcaggcgccgagaactaccgttcccggcatgccatgaaattggcctcggcgctgaggcggggtccggccctccacccgctcccgccgcgcgcgaatcgcggtcgcgagccatggaggaggaggcatcgtccccggggctgggctgcagcaagccgcacctggagaagctgaccctgggcatcacgcgcatcctagaatcttccccaggtgtgactgaggtgaccatcatagaaaagcctcctgctgaacgtcatatgatttcttcctgggaacaaaagaataactgtgtgatgcctgaagatgtgaagaacttttacctgatgaccaatggcttccacatgacatggagtgtgaagctggatgagcacatcattccactgggaagcatggcaattaacagcatctcaaaactgactcagctcacccagtcttccatgtattcacttcctaatgcacccactctggcagacctggaggacgatacacatgaagccagtgatgatcagccagagaagcctcactttgactctcgcagtgtgatatttgagctggattcatgcaatggcagtgggaaagtttgccttgtctacaaaagtgggaaaccagcattagcagaagacactgagatctggttcctggacagagcgttatactggcattttctcacagacacctttactgcctattaccgcctgctcatcacccacctgggcctgccccagtggcaatatgccttcaccagctatggcattagcccacaggccaagcaatggttcagcatgtataaacctatcacctacaacacaaacctgctcacagaagagaccgactcctttgtgaataagctagatcccagcaaagtgtttaagagcaagaacaagatcgtaatcccaaaaaagaaagggcctgtgcagcctgcaggtggccagaaagggccctcaggaccctccggtccctccacttcctccacttctaaatcctcctctggctctggaaaccccacccggaagtgagcacccctccctccaactccctaccagctccagagtggtggtttccatgcacagatggccctaggggtgacctccagttttgcgtgtggaccgtaggcctctttctagttgaatgaccaaaattgtaaggcttttagtcccaccgacattagccaggctcgtagtgaggcctccagagcaggttgtgctgtcccctgcctctggaagcaatggggaatttggaatcttgtgtaagtgcccaaataagtctgagtgctttcctcttcttcaacactcaaccctcaatcccttagcactgattgattagagaggtcccccaaagaaaccactggttttgacccatgaagcattagaactgcattgttcattcaggagccactagtcacatatgactatttaaatttaaagtaaattgtatgaaaaattcatttcttcaattgcattagccacattttgagtattcatgtggctggtagattctgtattagcacaaagatatggaacatttccatcaccacagaaagttctgttggacagcactgcattagaatattttcatactgctcttcctcaattaatttttgttgttaatgttgatgtcttcattggatgggtcataatgttccatgaaacctctcaagtacacaattgtatgttctttgtatcccttaccacaaatatctcgctctgctcatttcttttgcagcttcctataaagtttgtcttcctcatcagtttccagtgaagtttcttgcttccagttttgtgttatgatgtttgtacacgttccacaattatcttccttattaactttttaaagaaggtgtacttctgctatactttattcttaccatttaaaaacaaaaaattcccaaacattgttttgcacaactcttcataaagaaagagttttaatggtgccagacactgttaacagaagctttccacctgctctgcctgcctcttcacagctctgagttgtccagcctcactttgcctggtccctggccatccttaggacaagcagtctcctgcttagaacagggtgggcttccaagagttcctttggaagcaagttgcctgtaattcagaaatcattttcccattgacatatgggggaacctctagcccacatatgcttaatatttgacacaagataaatctgacatacctactacatttaatgaaatttttacagagaaggttgctcagattttcaattaggaatgcctatttatttcctccctctacagtcctggctgtgggcagaagcaaggccttcaccctgcttcccaacagggaaagtggggagtcacccacctagccccaagttctttgggtggctgcagtttttgtactgaagtcccagaggttagagaattaggagttttgaggaatgaggtgcaggggcctctaccatctgcacacttcagtcccagctggctcattctctttcctgacttctctctaccccggtgattggccagacttccttcctttgcactgtctacctgctaatcgacccagggtttccctcttccaaacccactggggaactaagagcagtccacaggattctccacatgcacttttgctctgaaacatgtttattttgattgttgacaatagtgatagatattcatgagaaagcgccttcgatatctcctccacctaccactttccatagcccctgaggaaaaccaaggtgaagagttagccttcaaggatcagggcaagctctaactggctgcttccccatatttgtaatagttcaaagtcttgaaatatcagcgcttaagagtctttgggagcataaactgagcttcgtattaacagcttcttcatttgctttaaaatagcgagacctcttaccttttcaatcccaaaactaaccacttataattcagtgtggtcatttaaacgtgtgtgtgtgtgtgtgtgtgtgtgtgtgtgtgtgtgtgtgtgtgtgtgttttaaccataacatgactgtcacatattctctaggagacattttggcccttttagttgtttaggttattatacttcaaggatttataaatgtgcaacaattcatggagtggcagaaaaggatatagagagaccaagttgttgaggacaatagctggagtttagtcttccagaagtatttttcttgccagaattgatcaaaggaagagccaacggcactggataggagattctagcatttggctgcttctccaagacaagcgaggttagaagggagttgagaagttatgtcatcttccactgcagcagataccccttttttagtacttggagatcccccgaatcacagcatttctaaatcagccctggattccacaagtgaagcagcggaggaaccaggaggtcagcggtgtcactcaaatctgtggcaatcaagtgggagttctcaaaaggctatcaaaggaagggggttatgataaggaaaggctcaagacctgcctcagaaggagtgagcagggaagagcaggactgactccactcagtgcaggatccagtacaaaatgaagatgtgaggcttttgtgcaaacagcaggaaaacattacctttacaggtactaaaatgtaatgtttttcctttcttccatagtgtctttctcaacttgttatggctgtgttttttatttgctacttaatgctgttctaactaaaaacttaaatgttaaattccta

SEQ ID NO: 195872 - DNA, 1726 bp, Homo sapiens
  Payload ID: 18652
  Gene Name: tubulin polyglutamylase complex subunit 2
  Uniprot ID: Q68CL5
  ENST ID: ENST00000383056
  CDS Start-End: 220-993
gtcccggaggtgcggtgtggggcaccgggcggggccgcgggaaccggcgccccacggagctgctgctgtcagaccaaccccgggcccccatcatcactgcgccgcgctttcaggcgccgagaactaccgttcccggcatgccatgaaattggcctcggcgctgaggcggggtccggccctccacccgctcccgccgcgcgcgaatcgcggtcgcgagccatggaggaggaggcatcgtccccggggctgggctgcagcaagccgcacctggagaagctgaccctgggcatcacgcgcatcctagaatcttccccaggtgtgactgaggtgaccatcatagaaaagcctcctgctgaacgtcatatgatttcttcctgggaacaaaagaataactgtgtgatgcctgaagatgtgaagaacttttacctgatgaccaatggcttccacatgacatggagtgtgaagctggatgccagtgatgatcagccagagaagcctcactttgactctcgcagtgtgatatttgagctggattcatgcaatggcagtgggaaagtttgccttgtctacaaaagtgggaaaccagcattagcagaagacactgagatctggttcctggacagagcgttatactggcattttctcacagacacctttactgcctattaccgcctgctcatcacccacctgggcctgccccagtggcaatatgccttcaccagctatggcattagcccacaggccaagcaatggttcagcatgtataaacctatcacctacaacacaaacctgctcacagaagagaccgactcctttgtgaataagctagatcccagcaaagtgtttaagagcaagaacaagatcgtaatcccaaaaaagaaagggcctgtgcagcctgcaggtggccagaaagggccctcaggaccctccggtccctccacttcctccacttctaaatcctcctctggctctggaaaccccacccggaagtgagcacccctccctccaactccctaccagctccagagtggtggtttccatgcacagatggccctaggggtgacctccagttttgcgtgtggaccgtaggcctctttctagttgaatgaccaaaattgtaaggcttttagtcccaccgacattagccaggctcgtagtgaggcctccagagcaggttgtgctgtcccctgcctctggaagcaatggggaatttggaatcttgtgtaagtgcccaaataagtctgagtgctttcctcttcttcaacactcaaccctcaatcccttagcactgattgattagagaggtcccccaaagaaaccactggttttgacccatgaagcattagaactgcattgttcattcaggagccactagtcacatatgactatttaaatttaaagtaaattgtatgaaaaattcatttcttcaattgcattagccacattttgagtattcatgtggctggtagattctgtattagcacaaagatatggaacatttccatcaccacagaaagttctgttggacagcactgcattagaatattttcatactgctcttcctcaattaatttttgttgttaatgttgatgtcttcattggatgggtcataatgttccatgaaacctctcaagtacacaattgtatgttctttgtatcccttaccacaaatatctcgctctgctcatttcttttgcagcttcctataaagtttgtcttcctcatc

SEQ ID NO: 195873 - DNA, 1239 bp, Homo sapiens
  Payload ID: 18652
  Gene Name: tubulin polyglutamylase complex subunit 2
  Uniprot ID: Q68CL5
  ENST ID: ENST00000590842
  CDS Start-End: 76-990
gaaattggcctcggcgctgaggcggggtccggccctccacccgctcccgccgcgcgcgaatcgcggtcgcgagccatggaggaggaggcatcgtccccggggctgggctgcagcaagccgcacctggagaagctgaccctgggcatcacgcgcatcctagaatcttccccaggtgtgactgaggtgaccatcatagaaaagcctcctgctgaacgtcatatgatttcttcctgggaacaaaagaataactgtgtgatgcctgaagatgtgaagaacttttacctgatgaccaatggcttccacatgacatggagtgtgaagctggatgagcacatcattccactgggaagcatggcaattaacagcatctcaaaactgactcagctcacccagtcttccatgtattcacttcctaatgcacccactctggcagacctggaggacgatacacatgaagccagtgatgatcagccagagaagcctcactttgactctcgcagtgtgatatttgagctggattcatgcaatggcagtgggaaagtttgccttgtctacaaaagtgggaaaccagcattagcagaagacactgagatctggttcctggacagagcgttatactggcattttctcacagacacctttactgcctattaccgcctgctcatcacccacctgggcctgccccagtggcaatatgccttcaccagctatggcattagcccacaggccaagataacttataatatcaaaatgaatagaagaaaatgtgttcactggaaactggctgttgagcccctccaatgggagctgaggagctgtgtctctgcaggcatggggactggccacaagcaaagagtcagcagcatgaagccccggagctgtagcgtgtgcagcaggcgccaatccaacagcatgggaacaacagtgtcgcaatcattcctcagttatggcaagaatgtgctatttttcactgttaggtgttgcttctgagaactacaaataaaactctccaaccaagtgaacagactctctgctggccaaggggactccagagaaccttagaaactgagtttctgaccataacaggatgggaggtcagacacacctcatcataccccctcccttttgtggttttagacacaacaactgatcagcattgatattaaaagagagatcataagactgacggaacaactttgtgacaataagataccaaataataaacaggatctaaagcca

SEQ ID NO: 195874 - DNA, 348 bp, Homo sapiens
  Payload ID: 18652
  Gene Name: tubulin polyglutamylase complex subunit 2
  ENST ID: ENST00000588909
  CDS Start-End: 220-348
gtcccggaggtgcggtgtggggcaccgggcggggccgcgggaaccggcgccccacggagctgctgctgtcagaccaaccccgggcccccatcatcactgcgccgcgctttcaggcgccgagaactaccgttcccggcatgccatgaaattggcctcggcgctgaggcggggtccggccctccacccgctcccgccgcgcgcgaatcgcggtcgcgagccatggaggaggaggcatcgtccccggggctgggctgcagcaagccgcacctggagaagctgaccctgggcatcacgcgcatcctagaaaagcctcctgctgaacgtcatatgatttcttcctgggaacaa

SEQ ID NO: 195875 - DNA, 687 bp, Homo sapiens
  Payload ID: 18652
  Gene Name: tubulin polyglutamylase complex subunit 2
  ENST ID: ENST00000587207
  CDS Start-End: 258-485
cctgcggggcgagagggtgggggcgaaggggaagctacgtcccggaggtgcggtgtggggcaccgggcggggccgcgggaaccggcgccccacggagctgctgctgtcagaccaaccccgggcccccatcatcactgcgccgcgctttcaggcgccgagaactaccgttcccggcatgccatgaaattggcctcggcgctgaggcggggtccggccctccacccgctcccgccgcgcgcgaatcgcggtcgcgagccatggaggaggaggcatcgtccccggggctgggctgcagcaagccgcacctggagaagctgaccctgggcatcacgcgcatcctagaatcttccccaggtgtgactgaggtgaccatcatagaaaagcctcctgctgaacgtcatatgatttcttcctgggaacaaatgaagaaacagaggctgaaagagtttaaagaatttggccggcacagtggctcatgcttgtaatctcagtgttttggaaggccagggcagaggattgcttgaggccaggagttcaagacaagcctggacaacatggcaatactccagctctacaaaacaataatgttaattagccagaagaataactgtgtgatgcctgaagatgtgaagaacttttacctgatgaccaatggcttccacatgacatggagtgtgaagctggatg

SEQ ID NO: 195876 - DNA, 841 bp, Homo sapiens
  Payload ID: 18652
  Gene Name: tubulin polyglutamylase complex subunit 2
  ENST ID: ENST00000587129
  CDS Start-End: 38-784
acccgctcccgccgcgcgcgaatcgcggtcgcgagccatggaggaggaggcatcgtccccggggctgggctgcagcaagccgcacctggagaagctgaccctgggcatcacgcgcatcctagaatcttccccaggtgtgactgaggtgaccatcatagaaaagcctcctgctgaacgtcatatgatttcttcctgggaacaaaagaataactgtgtgatgcctgaagatgtgaagaacttttacctgatgaccaatggcttccacatgacatggagtgtgaagctggatgagcacatcattccactgggaagcatggcaattaacagcatctcaaaactgactcagctcacccagtcttccatgtattcacttcctaatgcacccactctggcagacctggaggacgatacacatgaagccagtgatgatcagccagagaagcctcactttgactctcgcagtgtgatatttgagctggattcatgcaatggcagtgggaaagtttgccttgtctacaaaagtgggaaaccagcattagcagaagacactgagatctggttcctggacagagcgttatactggcattttctcacagacacctttactgcctattaccgcctgctcatcacccacctgggcctgccccagtggcaatatgccttcaccagctatggcattagcccacaggccaaggctcttttaggcctttttgatggatctagtcctccggtggatttaaataatccaagaggaagaacaggaatccggagcagaaggttctagagctcccgggactcactggcacaccccgactgctccttgacatttgtggacagggct

SEQ ID NO: 195877 - DNA, 1070 bp, Homo sapiens
  Payload ID: 18652
  Gene Name: tubulin polyglutamylase complex subunit 2
  ENST ID: ENST00000585635
  CDS Start-End: 270-419
gcgcggccggcccctgcggggcgagagggtgggggcgaaggggaagctacgtcccggaggtgcggtgtggggcaccgggcggggccgcgggaaccggcgccccacggagctgctgctgtcagaccaaccccgggcccccatcatcactgcgccgcgctttcaggcgccgagaactaccgttcccggcatgccatgaaattggcctcggcgctgaggcggggtccggccctccacccgctcccgccgcgcgcgaatcgcggtcgcgagccatggaggaggaggcatcgtccccggggctgggctgcagcaagccgcacctggagaagctgaccctgggcatcacgcgcatcctagggcaaggcactcacaggccaactccaaactcaagaagttggagaaatagactcacctctcaatgagaagtgctatgggcatgcagggaaggaaggaattgacagcacccacctttggagtaagctaccacagagagttttaatccacggcatatctaaagataatcttccccaggtgtgactgaggtgaccatcatagaaaagcctcctgctgaacgtcatatgatttcttcctgggaacaaaagaataactgtgtgatgcctgaagatgtgaagaacttttacctgatgaccaatggcttccacatgacatggagtgtgaagctggatgagcacatcattccactgggaagcatggcaattaacagcatctcaaaactgactcagctcacccagtcttccatgtattcacttcctaatgcacccactctggcagacctggaggacgatacacatgaagccagtgatgatcagccagagaagcctcactttgactctcgcagtgtgatatttgagctggattcatgcaatggcagtgggaaagtttgccttgtctacaaaagtgggaaaccagcattagcagaagacactgagatctggttcctggacagagcgttatactggcattttctcacagacacctttactgcctattaccgcctgctcatcacccacctgggcctgccccagtggcaatatgccttcaccagctatggc

SEQ ID NO: 195878 - DNA, 579 bp, Homo sapiens
  Payload ID: 18652
  Gene Name: tubulin polyglutamylase complex subunit 2
  ENST ID: ENST00000590337
  CDS Start-End: 222-579
acgtcccggaggtgcggtgtggggcaccgggcggggccgcgggaaccggcgccccacggagctgctgctgtcagaccaaccccgggcccccatcatcactgcgccgcgctttcaggcgccgagaactaccgttcccggcatgccatgaaattggcctcggcgctgaggcggggtccggccctccacccgctcccgccgcgcgcgaatcgcggtcgcgagccatggaggaggaggcatcgtccccggggctgggctgcagcaagccgcacctggagaagctgaccctgggcatcacgcgcatcctagaatcttccccaggtgtgactgaggtgaccatcatagaaaagcctcctgctgaacgtcatatgatttcttcctgggaacaaaagaataactgtgtgatgcctgaagatgtgaagaacttttacctgatgaccaatggcttccacatgacatggagtgtgaagctggatgttttttcagcaaataaagaaaacatggagcttcctagtctgtatttacaccctaatcacagaagactagaaccaagcaagaagactgccaaattctcatcactga

SEQ ID NO: 195879 - DNA, 1102 bp, Homo sapiens
  Payload ID: 18652
  Gene Name: tubulin polyglutamylase complex subunit 2
  Uniprot ID: Q68CL5
  ENST ID: ENST00000589049
  CDS Start-End: 15-698
cgcggtcgcgagccatggaggaggaggcatcgtccccggggctgggctgcagcaagccgcacctggagaagctgaccctgggcatcacgcgcatcctagaatcttccccaggtgtgactgaggtgaccatcatagaaaagcctcctgctgaacgtcatatgatttcttcctgggaacaaaagaataactgtgtgatgcctgaagatgtgaagaacttttacctgatgaccaatggcttccacatgacatggagtgtgaagctggatgagcacatcattccactgggaagcatggcaattaacagcatctcaaaactgactcagctcacccagtcttccatgtattcacttcctaatgcacccactctggcagacctggaggacgatacacatgaagccagtgatgatcagccagagaagcctcactttgactctcgcagtgtgatatttgagctggattcatgcaatggcagtgggaaagtttgccttgtctacaaaagtgggaaaccagcattagcagaagacactgagatctggttcctggacagagcgttatactggcattttctcacagacacctttactgcctattaccgcctgctcatcacccacctgggcctgccccagtggcaatatgccttcaccagctatggcattagcccacaggccaaggtaagggaggaacacctgccattgtaaactatggtatattccaaaatctactgaggaaatggttacattgcaggttcccaacttccctatctgattcaggagatctagggtggggcccaggaacctgcattttcaataagcaagacagatgattccaatggacagcctcactttactcatctagttaagtggttcccaaacttgactgattctcagaattaactggggagttttatttttaatgaaattctgttggatagtttatgtcccatgacttgttctgggttggcagtacatgcacccaggaagagtgaaaagtcagattctcactcccctgttctccaagtgtgcatccccagtggcagctgctattacgagtttcctgtacgcccttcccaagatactcattgcacataaagcatgcatgcaca

SEQ ID NO: 195880 - DNA, 803 bp, Homo sapiens
  Payload ID: 18652
  Gene Name: tubulin polyglutamylase complex subunit 2
  ENST ID: ENST00000591823
  CDS Start-End: 7-99
cgagccatggaggaggaggcatcgtccccggggctgggctgcagcaagccgcacctggagaagctgaccctgggcatcacgcgcatcctaggactgtgaagatgatgagataccacaccttgattatgttacattaaatggcaaaagcaagattatccagaatcttccccaggtgtgactgaggtgaccatcatagaaaagcctcctgctgaacgtcatatgatttcttcctgggaacaaaagaataactgtgtgatgcctgaagatgtgaagaacttttacctgatgaccaatggcttccacatgacatggagtgtgaagctggatgagcacatcattccactgggaagcatggcaattaacagcatctcaaaactgactcagctcacccagtcttccatgtattcacttcctaatgcacccactctggcagacctggaggacgatacacatgaagccagtgatgatcagccagagaagcctcactttgactctcgcagtgtgatatttgagctggattcatgcaatggcagtgggaaagtttgccttgtctacaaaagtgggaaaccagcattagcagaagacactgagatctggttcctggacagagcgttatactggcattttctcacagacacctttactgcctattaccgcctgctcatcacccacctgggcctgccccagtggcaatatgccttcaccagctatggcattagcccacaggccaaggtaagggaggaacacctgccattgtaaactatggtatattccaaaatctactgaggaaatggttacattgc

SEQ ID NO: 195881 - DNA, 2079 bp, Homo sapiens
  Payload ID: 18652
  Gene Name: tubulin polyglutamylase complex subunit 2
  ENST ID: ENST00000587382
  CDS Start-End: 1-626
gcaagccgcacctggagaagctgaccctgggcatcacgcgcatcctagaatcttccccaggtgtgactgaggtgaccatcatagaaaagcctcctgctgaacgtcatatgatttcttcctgggaacaaaagaataactgtgtgatgcctgaagatgtgaagaacttttacctgatgaccaatggcttccacatgacatggagtgtgaagctggatgagcacatcattccactgggaagcatggcaattaacagcatctcaaaactgactcagctcacccagtcttccatgtattcacttcctaatgcacccactctggcagacctggaggacgatacacatgaagccagtgatgatcagccagagaagcctcactttgactctcgcagtgtgatatttgagctggattcatgcaatggcagtgggaaagtttgccttgtctacaaaagtgggaaaccagcattagcagaagacactgagatctggttcctggacagagcgttatactggcattttctcacagacacctttactgcctattaccgcctgctcatcacccacctgggcctgccccagtggcaatatgccttcaccagctatggcattagcccacaggccaaggtctgatgtggactctgctgaggagagactgtatcttctaggtgggatatgtcaagagagaagagtgtatatttgacagtattgacttcacatagaattctcctttgtggacaagaattcccaagactcagagcacaatgtagacatagtgtattagtccattttcacgctgctgataaagacatacccaagactgggtaatttttttaagaaaaaggtttaatggacttacagtttcacgtggctggagaggcctcacaatcacggcagaaggcgaaaggcacatcttacatggtggcaggcaaagagagaatgagagccaggtgaaaggggaaacccccttataaaatcagcagatcttgtgagacttattaactaccatgagaacagtagggtggaaaccatccccatgattcagttatctcccactgggtccctcccacaacatacgggaattatgggagccacaattcaagatgagatttgggtagggacacagccaaaccatatcacatagtttcttagacattgtttgatcatcttgatggaggaaactgcagtccaaagcaattttatacaaaactaaatttaacataaaacttcctgtgtacaaaatgaataaacagcaacaaagtacatataaaggtatattctctcagacctgtgctaatacatagccataaactaaaataaaaatttaaaattcattcctcaatctccagccacatttcaagtattcagtaatcacatatgtctagtggctaccatattagttatatatagaacatttccatcatcacagaacgttccaccaggcagccttagttagagcaagcacggcttgttttatattataattttcagaataattctggtgaaaagccattttatactatgctatagtcaacaaagaataaggatatttacctaatcttaagacttttttttaacctaaaacacaacatccttttctactttacatattacttttgcagccatggctcataggaaaagccaaggatgagttagcctgctgctacccattttagctgcagagtgggctgtgcaggttctgagctttccccatgtgatagtcaaagaccccaaggcagccccagcctctctaggtctctgcacagtctccagtgtggaaagctgtgggaaaggaaggagcaggttctaggtcttcaggattttctgcatcttaaagcagctcatctcctttgccctcctagggagcaggggggcctagctttgggatcgtcctcctagcctcagaaataattgttcaagaaataacatttctcacacaaaggataaatgtttgaggggatggataccccatcttccatgatttgattattacacattgcatgcctgtatcaaaaatctcatatatacacctactatgtacccacaaaaatttaaaatttaaaattaaaaacaaaacaaaacaaaa

SEQ ID NO: 195882 - DNA, 1727 bp, Homo sapiens
  Payload ID: 18652
  Gene Name: tubulin polyglutamylase complex subunit 2
  Uniprot ID: Q68CL5
  ENST ID: ENST00000593035
  CDS Start-End: 197-994
accgggcggggccgcgggaaccggcgccccacggagctgctgctgtcagaccaaccccgggcccccatcatcactgcgccgcgctttcaggcgccgagaactaccgttcccggcatgccatgaaattggcctcggcgctgaggcggggtccggccctccacccgctcccgccgcgcgcgaatcgcggtcgcgagccatggaggaggaggcatcgtccccggggctgggctgcagcaagccgcacctggagaagctgaccctgggcatcacgcgcatcctagaatcttccccaggtgtgactgaggtgaccatcatagaaaagcctcctgctgaacgtcatatgatttcttcctgggaacaaaagaataactgtgtgatgcctgaagatgtgaagaacttttacctgatgaccaatggcttccacatgacatggagtgtgaagctggatgacctggaggacgatacacatgaagccagtgatgatcagccagagaagcctcactttgactctcgcagtgtgatatttgagctggattcatgcaatggcagtgggaaagtttgccttgtctacaaaagtgggaaaccagcattagcagaagacactgagatctggttcctggacagagcgttatactggcattttctcacagacacctttactgcctattaccgcctgctcatcacccacctgggcctgccccagtggcaatatgccttcaccagctatggcattagcccacaggccaagcaatggttcagcatgtataaacctatcacctacaacacaaacctgctcacagaagagaccgactcctttgtgaataagctagatcccagcaaagtgtttaagagcaagaacaagatcgtaatcccaaaaaagaaagggcctgtgcagcctgcaggtggccagaaagggccctcaggaccctccggtccctccacttcctccacttctaaatcctcctctggctctggaaaccccacccggaagtgagcacccctccctccaactccctaccagctccagagtggtggtttccatgcacagatggccctaggggtgacctccagttttgcgtgtggaccgtaggcctctttctagttgaatgaccaaaattgtaaggcttttagtcccaccgacattagccaggctcgtagtgaggcctccagagcaggttgtgctgtcccctgcctctggaagcaatggggaatttggaatcttgtgtaagtgcccaaataagtctgagtgctttcctcttcttcaacactcaaccctcaatcccttagcactgattgattagagaggtcccccaaagaaaccactggttttgacccatgaagcattagaactgcattgttcattcaggagccactagtcacatatgactatttaaatttaaagtaaattgtatgaaaaattcatttcttcaattgcattagccacattttgagtattcatgtggctggtagattctgtattagcacaaagatatggaacatttccatcaccacagaaagttctgttggacagcactgcattagaatattttcatactgctcttcctcaattaatttttgttgttaatgttgatgtcttcattggatgggtcataatgttccatgaaacctctcaagtacacaattgtatgttctttgtatcccttaccacaaatatctcgctctgctcatttcttttgcagcttcctataaagtttgtcttcctcatc

SEQ ID NO: 195883 - DNA, 572 bp, Homo sapiens
  Payload ID: 18652
  Gene Name: tubulin polyglutamylase complex subunit 2
  ENST ID: ENST00000590692
  CDS Start-End: 16-108
tcgcggtcgcgagccatggaggaggaggcatcgtccccggggctgggctgcagcaagccgcacctggagaagctgaccctgggcatcacgcgcatcctaggactgtgaagatgatgagataccacaccttgattatgttacattaaatggcaaaagcaagattatccagactcttttttctcttccagaatcttccccaggtgtgactgaggtgaccatcatagaaaagcctcctgctgaacgtcatatgatttcttcctgggaacaaaagaataactgtgtgatgcctgaagatgtgaagaacttttacctgatgaccaatggcttccacatgacatggagtgtgaagctggatgagcacatcattccactgggaagcatggcaattaacagcatctcaaaactgactcagctcacccagtcttccatgtattcacttcctaatgcacccactctggcagacctggaggacgatacacatgaagccagtgatgatcagccagagaagcctcactttgactctcgcagtgtgatatttgagctggattcatgcaatggcagtgggaaagttt

SEQ ID NO: 195884 - DNA, 936 bp, Homo sapiens
  Payload ID: 18652
  Gene Name: tubulin polyglutamylase complex subunit 2
  ENST ID: ENST00000591906
  CDS Start-End: 1-565
tgctgaacgtcatatgatttcttcctgggaacaaaagaataactgtgtgatgcctgaagatgtgaagaacttttacctgatgaccaatggcttccacatgacatggagtgtgaagctggatgagcacatcattccactgggaagcatggcaattaacagcatctcaaaactgactcagctcacccagtcttccatgtattcacttcctaatgcacccactctggcagacctggaggacgatacacatgaagccagtgatgatcagccagagaagcctcactttgactctcgcagtgtgatatttgagctggattcatgcaatggcagtgggaaagtttgccttgtctacaaaagtgggaaaccagcattagcagaagacactgagatctggttcctggacagagcgttatactggcattttctcacagacacctttactgcctattaccgcctgctcatcacccacctgggcctgccccagtggcaatatgccttcaccagctatggcattagcccacaggccaaggcatggggactggccacaagcaaagagtcagcagcatgaagccccggagctgtagcgtgtgcagcaggcgccaatccaacagcatgggaacaacagtgtcgcaatcattcctcagttatggcaagaatgtgctatttttcactgttaggtgttgcttctgagaactacaaataaaactctccaaccaagtgaacagactctctgctggccaaggggactccagagaaccttagaaactgagtttctgaccataacaggatgggaggtcagacacacctcatcataccccctcccttttgtggttttagacacaacaactgatcagcattgatattaaaagagagatcataagactgacggaacaactttgtgacaataagataccaaataataaacaggatctaaagcca

SEQ ID NO: 195885 - DNA, 1268 bp, Homo sapiens
  Payload ID: 18652
  Gene Name: tubulin polyglutamylase complex subunit 2
  ENST ID: ENST00000614939
  CDS Start-End: 450-1148
gtcaggcgggcaaaggatacagtcccggctccagaacgccgcggcactggggcgggaggggcccgccacgtccgccatcttgaaacaaccgccactcggggcgtcgcgcctgggccgccacgcctcggcctgcaggctcggtccccattggccgcaccacgcagaggcccgcccccgcctgcgcggccggcccctgcggggcgagagggtgggggcgaaggggaagctacgtcccggaggtgcggtgtggggcaccgggcggggccgcgggaaccggcgccccacggagctgctgctgtcagaccaaccccgggcccccatcatcactgcgccgcgctttcaggcgccgagaactaccgttcccggcatgccatgaaattggcctcggcgctgaggcggggtccggccctccacccgctcccgccgcgcgcgaatcgcggtcgcgagccatggaggaggaggcatcgtccccggggctgggctgcagcaagccgcacctggagaagctgaccctgggcatcacgcgcatcctagaatcttccccaggtgtgactgaggtgaccatcatagaaaagcctcctgctgaacgtcatatgatttcttcctgggaacaaaagaataactgtgtgatgcctgaagatgtgaagaacttttacctgatgaccaatggcttccacatgacatggagtgtgaagctggatgagcacatcattccactgggaagcatggcaattaacagcatctcaaaactgactcagctcacccagtcttccatgtattcacttcctaatgcacccactctggcagacctggaggacgatacacatgaagccagtgatgatcagccagagaagcctcactttgactctcgcagtgtgatatttgagctggattcatgcaatggcagtgggaaagtttgccttgtctacaaaagtgggaaaccagcattagcagaagacactgagatctggttcctggacagagcgttatactggcattttctcacagacacctttactgcctattaccgcctgctcatcacccacctgggcctgccccagtggcaatatgccttcaccagctatggcattagcccacaggccaagcccaaaggatctgaaggccgttccaagcgagggtgcttctgaggacactgagaagagttttgccattctgaagaggcgagcctgtggaactgtttaaggtcctgttcccagaagaataaaagtttctcattatggcattaaactctatttatttagtatttg

SEQ ID NO: 195886 - DNA, 515 bp, Homo sapiens
  Payload ID: 18652
  Gene Name: tubulin polyglutamylase complex subunit 2
  ENST ID: ENST00000590652
  CDS Start-End: 1-250
atttgagctggattcatgcaatggcagtgggaaagtttgccttgtctacaaaagtgggaaaccagcattagcagaagacactgagatctggttcctggacagagcgttatactggcattttctcacagacacctttactgcctattaccgcctgctcatcacccacctgggcctgccccagtggcaatatgccttcaccagctatggcattagcccacaggccaaggtgattaaacacaaccgtctataatgtacagacccaactctcgcaagttccaggctctcctggggtgttcacatccatcatgtactatttgacaaatgtctgcttcaacaagctccctgtctcccccaaaggatctgaaggccgttccaagcgagggtgcttctgaggacactgagaagagttttgccattctgaagaggcgagcctgtggaactgtttaaggtcctgttcccagaagaataaaagtttctcattatggcattaaactctatttatttagtatttgaaa

SEQ ID NO: 195887 - DNA, 488 bp, Homo sapiens
  Payload ID: 18652
  Gene Name: tubulin polyglutamylase complex subunit 2
  ENST ID: ENST00000590500
  CDS Start-End: 1-488
aagaataactgtgtgatgcctgaagatgtgaagaacttttacctgatgaccaatggcttccacatgacatggagtgtgaagctggatgccagtgatgatcagccagagaagcctcactttgactctcgcagtgtgatatttgagctggattcatgcaatggcagtgggaaagtttgccttgtctacaaaagtgggaaaccagcattagcagaagacactgagatctggttcctggacagagcgttatactggcattttctcacagacacctttactgcctattaccgcctgctcatcacccacctgggcctgccccagtggcaatatgccttcaccagctatggcattagcccacaggccaagcaatggttcagcatgtataaacctatcacctacaacacaaacctgctcacagaagagaccgactcctttgtgaataagctagatcccagcaaagtgtttaagagcaagaacaagatcgtaatccc

SEQ ID NO: 195888 - DNA, 2679 bp, Homo sapiens
  Payload ID: 18652
  Gene Name: tubulin polyglutamylase complex subunit 2
  ENST ID: ENST00000590258
  CDS Start-End: 1-179
ggttcctggacagagcgttatactggcattttctcacagacacctttactgcctattaccgcctgctcatcacccacctgggcctgccccagtggcaatatgccttcaccagctatggcattagcccacaggccaagcccaaaggatctgaaggccgttccaagcgagggtgcttctgaggacactgagaagagttttgccattctgaagaggcgagcctgtggaactgtttaaggtcctgttcccagaagaataaaagtttctcattatggcattaaactctatttatttagtatttgaaacatggtgtacatgtatgtatttgtataaacatttgttacatctaaaatccacaacaggtaaacaatctgtgctttcttttgtgtacaagtttggggtttacatctggatattttggtgttgtggagactcagtctgtgaagctaatcagattgcctcatattaccataataactgtgacagaagtgatttgctccttaaaggggctgttccttgcccagaaaaggtgtcacacttttgaactaataaaccgggtgtcacggaatcaagagaaacacagctgacacgatggagaaggtatgtgcaggggactcctggagatccaagtcaatgcgtagcaggcaacacaagccatggggtgacgctgggaattgagctctcccttttcaaactgttggatgtgaatatcaagtctccccaaccccacctggaggggtttcatccagcaagagcttgccttctgctcagcacactcctgggagtaacctatgagtgtcacagctgcaactccgaggtgccaaccaagcccagggctctggcttcttctggggtcaggccgctcttcagggttcttcgcactgcagtggtggtgcaggtcacacccaaagggatgagaagaaaaggaagtatgagcagcaaggcacagggcagtcaagactccagtccccccttctccccagggacttccagagaagccagagggttcacactctgtaccttcctgctcttgctgaagtgccctgcagtctgtctgccaggacaaaagtttggggctacacaggctggcctaacaatgccacaggtgctgatttggagggccgagaggagtgatgcgggcacttataaagaggagagaaaggaggagaggctcaccctcacgaggcttctgagaagggggtgaactgcagaagtgcagagggcaggagagacctcagcatctacccagtatgaggagtgtatcagagctgggaaggtgattccagagcaggggaaaatgcaagctccactaatacaaatgaggtgaggcaaccagtgcacagcgaggggttccacaagacccaacaacctcacaaatccaacagacgaccaacaatagctggggacatgctcaagacccacagagcaagtgcatgaagccagggcaaggggcagcagtgaggacaaatctctccatgagtactgtgggtcttagcctcaactcactaaaaggcctctagagacaataattaaaataaccagtggctcctcgaggaatggaggctaaggagcaaactgccaaacttattctggctggaattggtggctgttttctatggaacacacaagactcaagaatggccaatgaccactctcactggggggttgcagttggcaactggagggatgctcatatttaactgacttagaattggcttgtgtttagcttggcatgatggtattcccattgtttagtatttcaatttcaacatcaaaataaaggctggataagggtgaatgaggaggtagctgcctcacccaagacaagtcttcatttgaaagggtggctaattacattttccttaatttacaaattgtatttgacccactgtgtatttctttaaagttcgcacagagtttggggtattcattttcagaagagaaacgttatggatctgccttcaccctaaatccctaaatcagccagagttcctgagatgaccagggcaggctgttgatcaaagttcagagaaagtaagctcaccttaatgtctccccagttcctttgccaactcccctcatctactccccagaggccagggcccacctcatgcatctgcaggccacaccccatggtctatgccttcccatcatcccctaaatataagctcactcagcctgtggacaaaagatctgaaagacctatgtccatggcagaatcaatggggactaatacctattatgaaaataaagggctccttctcttccaggaatcagcacttggaacaggggtcaacataatatccatcaattggtcaaccaacaaatgatttattgagaacccattgtgtgctcagcatttaactcaaagaatcaaaacacagacatcaagtatgggtttttagagagacatgggatatgtggtgaggggttctctcaaatcgtgttactgcaactactgtatttccaagcctacctttgggccctgaagcaatctatctgtagctgttcttgcactagctcctctttcccccacccctgatcccttggcctccagactgaatgtttggctcaacaagacaaaatgtttggctcctaagtctcagctggagacagattacattcaactgagcaacagaatttgttctatggggcagcaataaaaatactagtttgtaataa

SEQ ID NO: 195889 - DNA, 1426 bp, Homo sapiens
  Payload ID: 18652
  Gene Name: tubulin polyglutamylase complex subunit 2
  ENST ID: ENST00000610723
  CDS Start-End: 450-842
gtcaggcgggcaaaggatacagtcccggctccagaacgccgcggcactggggcgggaggggcccgccacgtccgccatcttgaaacaaccgccactcggggcgtcgcgcctgggccgccacgcctcggcctgcaggctcggtccccattggccgcaccacgcagaggcccgcccccgcctgcgcggccggcccctgcggggcgagagggtgggggcgaaggggaagctacgtcccggaggtgcggtgtggggcaccgggcggggccgcgggaaccggcgccccacggagctgctgctgtcagaccaaccccgggcccccatcatcactgcgccgcgctttcaggcgccgagaactaccgttcccggcatgccatgaaattggcctcggcgctgaggcggggtccggccctccacccgctcccgccgcgcgcgaatcgcggtcgcgagccatggaggaggaggcatcgtccccggggctgggctgcagcaagccgcacctggagaagctgaccctgggcatcacgcgcatcctagaatcttccccaggtgtgactgaggtgaccatcatagaaaagcctcctgctgaacgtcatatgatttcttcctgggaacaaaagaataactgtgtgatgcctgaagatgtgaagaacttttacctgatgaccaatggcttccacatgacatggagtgtgaagctggatgagcacatcattccactgggaagcatggcaattaacagcatctcaaaactgactcagctcacccagtcttccatgtattcacttcctaatgcacccactctggcagacctggaggacgatacacatgaagataacttataatatcaaaatgaatagaagaaaatgtgttcactggaaactggctgttgagcccctccaatgggagctgaggagctgtgtctctgcaggcatggggactggccacaagcaaagagtcagcagcatgaagccccggagctgtagcgtgtgcagcaggcgccaatccaacagcatgggaacaacagtgtcgcaatcattcctcagttatggcaagaatgtgctatttttcactgttaggtgttgcttctgagaactacaaataaaactctccaaccaagtgaacagactctctgctggccaaggggactccagagaaccttagaaactgagtttctgaccataacaggatgggaggtcagacacacctcatcataccccctcccttttgtggttttagacacaacaactgatcagcattgatattaaaagagagatcataagactgacggaacaactttgtgacaataagataccaaataataaacaggatctaaagccatgtcagccaagggttaagtcatgcacccctccctacacttaaagaataaaacaattggccaggcgcagtggctcaggcctgtaatcgc

SEQ ID NO: 195890 - DNA, 6022 bp, Homo sapiens
  Payload ID: 18653
  Gene Name: tubulin polymerization promoting protein
  Uniprot ID: O94811
  ENST ID: ENST00000360578
  CDS Start-End: 123-782
gggcggtgctgggcgggacgggcgggcgcggggcggcggctggagagctccgctgagcaccgggtcgcgcgcggccgagtcgcggaggcgcctccgctgcagtcgctgcgtctccaagcaacatggctgacaaggccaagcctgccaaagctgccaacaggacgccccccaagtccccgggggacccctcgaaggaccgggcagccaagaggctgtcgctggaatcggagggtgctggtgagggggcagccgcatcccctgagctcagtgccctggaggaggccttccggcgctttgccgtgcacggggacgccagggccaccgggagggagatgcacggcaagaactggtcgaagctgtgcaaggactgccaggtgatcgacggcaggaacgtgaccgtcactgacgtggacatcgtcttcagcaagatcaaagggaagtcttgccggaccatcacctttgagcagttccaggaggcgctggaggagctcgccaagaagcgattcaaagacaagagcagcgaggaggccgttcgcgaggtgcacaggctcatcgagggcaaggcgcccatcatctcaggggtgacgaaagccatctcgtcgcccacagtgtcgaggctcacggacaccaccaagttcacgggctcccacaaggagcgcttcgacccctctggcaagggcaagggcaaggctggccgcgtggatctggtggacgagtcaggctatgtgtccggctacaagcacgcaggcacctacgaccagaaggtgcaagggggcaagtagcccccgctccatgcctcgcggcactgccggtgtccccagagcagggactctgtcacctcgcacttcattacattcctgtactaactggggcagaactcagacgggtgccccagagggggctggggggcggccaggcccaggcctccctcctgcccctcctcctaccggatgcccccagcactcccctctcaaaccaggtttgggccccagttcgctgaccctcctaatacacctgcctcgtcctcagccatttccaaagtgtctcgcggatcacaccacactgggcacgtggtttgcaggtcaaaggggcgttttaaagcagctggctgtcatggcaacaggaggctgtgctgacctcctgagcggcagacaccttccaggagccctgagggtggcaggagctaaccccaaccagcaggcaactaacacggaattggccccacaccggacgtgggaggtgtctgtggggcccgaggcctgtcctgtgtgcagcggacaccacggggccttcctgctttcctgggcagagggcagagtgaggccacctggcgggggtgctgggcgcctggcacatgtgtggggaagccggtcacatggacacacctgtgcacacatgcctacaggccagctctgtgccaagggcaacctaggtaaaacgaaagccgtcaggggcagtgggcggcttcccggctgaccacagtggcttggactgtgagggtagagtaggctcgctttgctttcctgagaagatgcggtggctgcctatgttctcagagcgggtctgggaagattcagaatgtccggtccctgtggtgttgccaggcaagagacacgaagtgccgagacactcctcgcctcaccgcgtgacagagcctctgcccggccctcccgttcgcccgtcctcactagctgcaccctgtttgctcgcagacctcccattgccacagcccaagcaccttcttcaactctcccaaaatggctcagcctaacctctcctggccaatcccccccgccggagagcaggacactagggaggacccccagtcctgcagtgtctgtgggggtttctctgccagcagggggctgagcagagcccatccaggacactccacactgccaggacacacccaggcggcccgcccttgcctgtctgcacctggggagaagccggcgctcctgctccctcctggggaggctgacgggtgtggccacccgctgtcacaatggcacactgccactgtcccttggcacgcacacagccacagccacacgtgtgacctgctgggccgtggttctggagtctacctgcggatgagcctgcggcagtcctggggaaacttttccagagcctgttagcccgtggctacggtcaggctctggccagggcagagggctgcccagggccaggctcacagtacaggagggtggcgaggcccctccctcactggcacgcatgagcaccacccgcctccccgactcccaagagtgcacctgctgcggccacagctccgtggaaggactccccctacctgagcagagcagaagccccagggcggagctcccagccagcatggtccgctgagggctggggggcggtctccgaggcccctcaacagagaagcctccacctgaggatggggaggacctggcaggcagcttccacggcagggctgggaagttcagtgcctggaaataaagagcaaggaaaaatggacctcaggcttcgtggctcctttaggatgtcacctcaccggcctggggaaggcggggggtgcccaagcccagccctgtgcccccgctgaacctggctggaccgcgtgtgaaaggcagaactaacgtgcggaaacatttgaaaacaactctgaatgtgcggttcggaatcacccgatcacagacgagcggtcaccggaatcgcccggtcacagacgagcagtcatcggactcacccgatcacagacgagcggtcaccggaatcgcccgatcacagacgagcggccaccggaatcgcccaatcacagacaagcagtcatcggaatcacccgatcacagacgagcagtcatcggactcacccgatcacagacgagcggtcaccagactcgcccgatcacagacgagcagtcatcggaatcacccgatcacagacgagcagtcatcggactcacccgatcacagacgagcggtcaccagaatcgcccgatcacagacgagcagtcatcggaatcacccgatcacagacgagtggccaccggaatcacccgataacagcccatcacaactccaaagcccttgtgttgaaaaggccgaggacgagtggtcaccaaacagggtggctccccaggtcccgaagcctgagacccggaaggccctggcacccttacaccctcggactcctgccctcctcggcctccctggccccagcgcggctccaccctgggctgcgtctcctggtcacaggctgcgtttctcctttctgtccgtgggcagcccagtccccacagtcacggccaagccacgcagaacgaacatgactccagaggacctcgccctggagctgagcctggcgccgggtcaggacggagggaagggcgggttggggtccgcgggtcctcacaccgcacggcaggcacagaggctcgccaggccctgatccggtctgtggggacgagggacactgaggagaggtgctgggcaccaggacgctgcctcctggtccctggttggcctcagacaagcacggcctcgagaaaagagccaagcgcatcgggagcacaccagaaaccggccctgagcacgagaagagcctccgcccggcccgggcaccacccgacctcgcagggagcaggccctgtcaccgacgggtcacctcgcccacacggccagcaccgactcaccacagcccttcccagacctggctggagtggccggagcggcggggctcatggctcccatcttggcccctggaggtgagctcattcacagaagtggtcccttcactctgagagagaaaatcgtggcgtgcatcccaaaccctaggccacgcctgtgggtttcgtgaatgagatcgaggctgctgtggcaccctgcccgtcctggcctggagcaccctgggatcctggagggagaggccccacgcccccactctccctccacacttccagggttggtgcccacgagttagaggcacgccctcccccagcggccctcaggcttttctcagacatgcgggagccaggagagcacccttctccactcagctccaaagcgaatctttgaaaacacccactcggctcccatctctgtcacctagccaggaggggtagcaaaaataaagtcacgaggacatagtggtcaccactgtcagttacaacttgtctgtggaatccgtaattgcatctgtgtgccgcctccgaacacagaacattgtttggacggcagccccactgcacataacagacccgtgcatcttcctcagtcagtttctgaatattgtgaattcaggcaggtgtgtgttctcttctgcatgtttttatgcactgccaattagcttctactaaccacggttcaacagaaaataaatgtgtatttgtgaataacaaactgcacaacctgcaaaccaggagagagggacaggttctgtcaggggtgacaccaggacacagggacaggttctgtcgggggtgacaccaggacacagggacaggttctgtcatgggtgacacgaggacacagggacaggttctatcatgggtgacaccaggagagagggacaggttctgttgggggtgacaagaggagacagggacaggttctgtcgggggtgacaccaggagagagggacaggttctgtcaggggtgacaccaggagagagggacaggttctgttgggggtgacaccaggacacaggaataggttctgtcgggaggacagtgctgatcgtgtctcagcatcaggaaaggagaaaggcagagggagagcgctgagaagactgttcacgccagagtgcttatttatttttaatttactgctataggataagcaaccaggtagtgttcctaacaattagcgttaccaaaattaaagttcaaattatatgtttaaaatattgtagaagatatatatttatactggactacttttacaccttctaatatcctgtccaagtttgggcgcagatggtggagttgggctggcatcatgtcctgtggccgccccacttgcctgttggtgccactccatcccgggccccagggatgccagctcagggctgaccacagcagccctgcgtgggcatcacctcctaccccagcccccatcctgggctgctgcggccgcctgcttttgtgaatggtgttttgttggcacagggcctgtcctgtgttttcacacaggcctgtggctcctgctgtacaagtggagtggggaggagttgagatggagatgccttggccctggacacttacctgtccctctactggcccagctcatctcctcctgtgggcaatcacgcgtgcactggccaccctcccaccccacagcacacaccacgaggggatggcacagggggaagatgaggctggaccgtgatgttatcaataggctagaacgtccttcaaacactgaacctgcatctttcctcctcttactactgaacactttgtgagctctggtggtccagggtgcagcgtttgtccctgggcatgtgatggggagtcctgggcacatcgagatgctttacttctttctttcgacctcttaaaaaactaaaccaagccaaaccacaaaggaaatctgcacaacttaagagaaacttgaaagggatcgtgtaactactagtttgtactaagtttttttcaagaaagggaaacaaatttatatatatatatatatatatatatgtgcaatatatttttacactgtgtgattaacattagggagtactgagtgcatcactttatcagtgtgacgggtgatgtccacgtcatggctgttctgactctgaaagccacttctgctgatgtctaaaccgcactcaccgcggacgtccgcggggtggggtggccctgctgttcctcctgcaggtgagaggtgtggtgttgcctgttggacttgctgttgagcctggcttgcaaacctgtagtgaaacagctcgtgtctgtgtgcacactgctcctgtgtctgctgtcgttaacattgtgtgtcaagttggtaaagtgacaaataaaggtgttaaaacatgga

SEQ ID NO: 195891 - DNA, 752 bp, Homo sapiens
  Payload ID: 18654
  Gene Name: tubulin polymerization-promoting protein family member 2
  Uniprot ID: P59282
  ENST ID: ENST00000321760
  CDS Start-End: 149-661
gccaaccggctcccacatatctgcacacacttaaatacaaaggccgggaagggtcagaccaccatccgggtactctaagtcctccctcccccttctccttcacccccaagtgtctcccacgactgccctccccgacctctagctgaccatggcatcagaggcagaaaaaacattccatcggtttgctgcgtttggagaatcatcaagcagtggcactgaaatgaacaacaagaacttctccaagctgtgcaaagactgtggcatcatggatggcaagacagtcacctccacggacgtggacatcgtgttcagcaaagtcaaggccaagaacgcccgaaccatcacgtttcaacagttcaaagaggcagtgaaggaactgggccagaagcgcttcaaagggaagagtccagatgaagtcctggagaacatttatggactcatggagggcaaagacccagccaccactggcgctactaaagcaacaacagtgggtgcagtggaccgtttgacagacaccagcaagtacaccggcacccacaaggagcgctttgatgagagtggcaagggcaagggcattgcgggacgggaagagatgactgacaacacaggctatgtgagtggttacaagggttctggcacctacgataagaagaccaagtagagaggagcttcatctcagcctgctagccccctgaccctgcatgtttaacaccagggagcttggaaaacaataaacatctgtgtgtgcagca

SEQ ID NO: 195892 - DNA, 457 bp, Homo sapiens
  Payload ID: 18654
  Gene Name: tubulin polymerization-promoting protein family member 2
  ENST ID: ENST00000481535
  CDS Start-End: 1-360
gaaaaaacattccatcggtttgctgcgtttggagaatcatcaagcagtggcactgaaatgaacaacaagaacttctccaagctgtgcaaagactgtggcatcatggatggcaagacagtcacctccacggacgtggacatcgtgttcagcaaagtcaaggccaagaacgcccgaaccatcacgtttcaacagttcaaagaggcagtgaaggaactgggccagaagcgcttcaaagggaagagtccagatgaagtcctggagaacatttatggactcatggagggcaaagacccagccaccactggcgctactctgcttccaagaacaggatggaagaatatatttggagtaaagagatgaaccagatgtggagtggatgctctcgtctcgcctggacagcacacacactccaactccagtaagactcaactcaaatatatctcttatacaacttcaa

SEQ ID NO: 195893 - DNA, 514 bp, Homo sapiens
  Payload ID: 18654
  Gene Name: tubulin polymerization-promoting protein family member 2
  ENST ID: ENST00000472458
  CDS Start-End: 104-514
gggaagggtcagaccaccatccgggtactctaagtcctccctcccccttctccttcacccccaagtgtctcccacgactgccctccccgacctctagctgaccatggcatcagaggcagaaaaaacattccatcggtttgctgcgtttggagaatcatcaagcagtggcactgaaatgaacaacaagaacttctccaagctgtgcaaagactgtggcatcatggatggcaagacagtcacctccacggacgtggacatcgtgttcagcaaagtcaaggccaagaacgcccgaaccatcacgtttcaacagttcaaagaggcagtgaaggaactgggccagaagcgcttcaaagggaagagtccagatgaagtcctggagaacatttatggactcatggagggcaaagacccagccaccactggcgctacttggatgctctcgtctcgcctggacagcacacacactccaactccagtaagactcaactcaaatatatctcttatacaacttcaa

SEQ ID NO: 195894 - DNA, 568 bp, Homo sapiens
  Payload ID: 18654
  Gene Name: tubulin polymerization-promoting protein family member 2
  ENST ID: ENST00000460647
  CDS Start-End: 125-538
acacacttaaatacaaaggccgggaagggtcagaccaccatccgggtactctaagtcctccctcccccttctccttcacccccaagtgtctcccacgactgccctccccgacctctagctgaccatggcatcagaggcagaaaaaacattccatcggtttgctgcgtttggagaatcatcaagcagtggcactgaaatgaacaacaagaacttctccaagctgtgcaaagactgtggcatcatggatggcaagacagtcacctccacggacgtggacatcgtgttcagcaaagtcaaggccaagaacgcccgaaccatcacgtttcaacagttcaaagaggcagtgaaggaactgggccagaagcgcttcaaagggaagagtccagatgaagtcctggagaacatttatggactcatggagggcaaagacccagccaccactggcgctactgtgagtgacagccttcatccccttgaccctacttccctaaatccccattgttccagtctaccctccctaaccctgccaactgtgtgactgtagagacagggccgaaacagactttag

SEQ ID NO: 195895 - DNA, 703 bp, Homo sapiens
  Payload ID: 18654
  Gene Name: tubulin polymerization-promoting protein family member 2
  Uniprot ID: P59282
  ENST ID: ENST00000530140
  CDS Start-End: 117-629
gggaagggtcagaccaccatccgggtactctaaggtacataaaagagtcctccctcccccttctccttcacccccaagtgtctcccacgactgccctccccgacctctagctgaccatggcatcagaggcagaaaaaacattccatcggtttgctgcgtttggagaatcatcaagcagtggcactgaaatgaacaacaagaacttctccaagctgtgcaaagactgtggcatcatggatggcaagacagtcacctccacggacgtggacatcgtgttcagcaaagtcaaggccaagaacgcccgaaccatcacgtttcaacagttcaaagaggcagtgaaggaactgggccagaagcgcttcaaagggaagagtccagatgaagtcctggagaacatttatggactcatggagggcaaagacccagccaccactggcgctactaaagcaacaacagtgggtgcagtggaccgtttgacagacaccagcaagtacaccggcacccacaaggagcgctttgatgagagtggcaagggcaagggcattgcgggacgggaagagatgactgacaacacaggctatgtgagtggttacaagggttctggcacctacgataagaagaccaagtagagaggagcttcatctcagcctgctagccccctgaccctgcatgtttaacaccagggagcttggaaaacaataaa

SEQ ID NO: 195896 - DNA, 687 bp, Homo sapiens
  Payload ID: 18654
  Gene Name: tubulin polymerization-promoting protein family member 2
  ENST ID: ENST00000495665
  CDS Start-End: 1-332
tccatcggtttgctgcgtttggagaatcatcaagcagtggcactgaaatgaacaacaagaacttctccaagctgtgcaaagactgtggcatcatggatggcaagacagtcacctccacggacgtggacatcgtgttcagcaaagtcaaggccaagaacgcccgaaccatcacgtttcaacagttcaaagaggcagtgaaggaactgggccagaagcgcttcaaagggaagagtccagatgaagtcctggagaacatttatggactcatggagggcaaagacccagccaccactggcgctacttttccctggttacctatgcaagaaacctgaaagtgatcctagacccctccacctccccaatcccagctacggggaggcggtcctgcatggtggttaagatcaaggcttttgagtgaaacagaccaggaattgaatcctgcctctgcagcttacaaactgcacaccatctatctgtttacgaaaccactgaaagcttccttgtttcatctgttcatgaggatagtattttttacctcacggcagtatgaggatccattaagatgtatatcaagagtttttagaccagtgcccggcacatgtggatgctctcgtctcgcctggacagcacacacactccaactccagtaagactcaactcaaatatatctcttatacaacttcaaga

SEQ ID NO: 195897 - DNA, 488 bp, Homo sapiens
  Payload ID: 18654
  Gene Name: tubulin polymerization-promoting protein family member 2
  ENST ID: ENST00000555751
  CDS Start-End: 1-191
cccgaaccatcacgtttcaacagttcaaagaggcagtgaaggaactgggccagaagcgcttcaaagggaagagtccagatgaagtcctggagaacatttatggactcatggagggcaaagacccagccaccactggcgctactctgcttccaagaacaggatggaagaatatatttggagtaaagagatgaaccagatgtggagtttccctggttacctatgcaagaaacctgaaagtgatcctagacccctccacctccccaatcccagctacggggaggcggtcctgcatggtggttaagatcaaggcttttgagtgaaacagaccaggaattgaatcctgcctctgcagcttacaaactgcacaccatctatctgtttacgaaaccactgaaagcttccttgtttcatctgttcatgaggatagtattttttacctcacggcagtatgaggatccattaagatgtatatcaagagtttttagacc

SEQ ID NO: 195898 - DNA, 1116 bp, Homo sapiens
  Payload ID: 18655
  Gene Name: tubulin polymerization-promoting protein family member 3
  Uniprot ID: Q9BW30
  ENST ID: ENST00000290942
  CDS Start-End: 237-767
ggcggagccgcctgggctgcagtcccacccgggagccggcagggagcggagctgcggagccgcctggtctcccgcgtccatcggtccattcctgcgtcgttctgtccttccgaacgcacacttcaggagcagccgcgaggagtgagcactgcacgcaggatccgcccagtgcttgggccaagcaccctgtggcatccaagctcccctggacgttacccttggtgaaccaaggtggcatggcagcgagcacagacatggctgggctggaggagagcttccgcaagtttgccatccatggtgaccccaaggccagtgggcaagagatgaatggcaagaactgggccaagctgtgcaaggactgcaaggtggctgacggaaagtccgtgacagggaccgatgtggacatcgtcttctccaaagtcaaggggaagtctgctcgggtcatcaactatgaggagttcaagaaggccctggaagagctggcgaccaagagattcaaggggaagagcaaggaggaggccttcgatgccatctgccagctggtggcaggcaaagagccagccaatgtgggcgtcactaaagcaaaaacagggggtgctgtagaccggctgacggacaccagcagatacacgggctcccacaaggagcgcttcgatgagagcggcaagggcaagggcattgcgggacggcaggacatcctggacgacagtggctacgtgagcgcctacaagaatgcaggcacctacgatgccaaggtgaagaagtgaggcttgggaagaccgccctgccaagtgcggctgcccctgccagaggctcaggcctgggtctaaggggcacgtggagcaagagatcctggtcccctccctgctggacctgccacccagagcttcctgcctagtcccactgggctggcccaccaggcctctgacccaggctgctctgcggccccttcctcctcctcttcctgctccaacttctgtccacctggggacagtctgtgcctgtagcctcatgaccccaacccagccccaggcatggctaacccctgactgcttgcctcatatttaagctgctgctctggccaagtgcctaattttaacccagacctcaataaag

SEQ ID NO: 195899 - DNA, 1058 bp, Homo sapiens
  Payload ID: 18655
  Gene Name: tubulin polymerization-promoting protein family member 3
  Uniprot ID: Q9BW30
  ENST ID: ENST00000393957
  CDS Start-End: 163-693
gaaacaggggataatacggcggagccgcctgggctgcagtcccacccgggagccggcagggagcggagctgcggagccgcctggtctcccgcgtccatcggtccattcctgcgtcgttctgtccttccgaacgcacacttcaggagcagccgcgagggtggcatggcagcgagcacagacatggctgggctggaggagagcttccgcaagtttgccatccatggtgaccccaaggccagtgggcaagagatgaatggcaagaactgggccaagctgtgcaaggactgcaaggtggctgacggaaagtccgtgacagggaccgatgtggacatcgtcttctccaaagtcaaggggaagtctgctcgggtcatcaactatgaggagttcaagaaggccctggaagagctggcgaccaagagattcaaggggaagagcaaggaggaggccttcgatgccatctgccagctggtggcaggcaaagagccagccaatgtgggcgtcactaaagcaaaaacagggggtgctgtagaccggctgacggacaccagcagatacacgggctcccacaaggagcgcttcgatgagagcggcaagggcaagggcattgcgggacggcaggacatcctggacgacagtggctacgtgagcgcctacaagaatgcaggcacctacgatgccaaggtgaagaagtgaggcttgggaagaccgccctgccaagtgcggctgcccctgccagaggctcaggcctgggtctaaggggcacgtggagcaagagatcctggtcccctccctgctggacctgccacccagagcttcctgcctagtcccactgggctggcccaccaggcctctgacccaggctgctctgcggccccttcctcctcctcttcctgctccaacttctgtccacctggggacagtctgtgcctgtagcctcatgaccccaacccagccccaggcatggctaacccctgactgcttgcctcatatttaagctgctgctctggccaagtgcctaattttaacccagacctcaataaagacaccttttgtaccaa

SEQ ID NO: 195900 - DNA, 1410 bp, Homo sapiens
  Payload ID: 18655
  Gene Name: tubulin polymerization-promoting protein family member 3
  Uniprot ID: Q9BW30
  ENST ID: ENST00000562206
  CDS Start-End: 552-1082
cccgggagccggcagggagcggagctgcggagccgcctggtctcccgcgtccatcggtccattcctgcgtcgttctgtccttccgaacgcacacttcaggagcagccgcgaggtagaagcccataggagacccagatgcccgccaccccaatcagtatcctgcacgatgagggttggggggagcagcctggaaagggtcccaacctccggcggtcccagccgaggagccagctgagcggccctgccctggccccaagcattccacctcgcagcccccacctcctggtccggctgattgatgactccagctgtcccagtgggagcgggacgggtggctccagttcacgggtgtggccactccatccatggcctgcagacccatggggctgcggcctgcaacccagcgccacctgaccgcgctgagatgaccaagaatccatctttccacggacaggagtgagcactgcacgcaggatccgcccagtgcttgggccaagcaccctgtggcatccaagctcccctggacgttacccttggtgaaccaaggtggcatggcagcgagcacagacatggctgggctggaggagagcttccgcaagtttgccatccatggtgaccccaaggccagtgggcaagagatgaatggcaagaactgggccaagctgtgcaaggactgcaaggtggctgacggaaagtccgtgacagggaccgatgtggacatcgtcttctccaaagtcaaggggaagtctgctcgggtcatcaactatgaggagttcaagaaggccctggaagagctggcgaccaagagattcaaggggaagagcaaggaggaggccttcgatgccatctgccagctggtggcaggcaaagagccagccaatgtgggcgtcactaaagcaaaaacagggggtgctgtagaccggctgacggacaccagcagatacacgggctcccacaaggagcgcttcgatgagagcggcaagggcaagggcattgcgggacggcaggacatcctggacgacagtggctacgtgagcgcctacaagaatgcaggcacctacgatgccaaggtgaagaagtgaggcttgggaagaccgccctgccaagtgcggctgcccctgccagaggctcaggcctgggtctaaggggcacgtggagcaagagatcctggtcccctccctgctggacctgccacccagagcttcctgcctagtcccactgggctggcccaccaggcctctgacccaggctgctctgcggccccttcctcctcctcttcctgctccaacttctgtccacctggggacagtctgtgcctgtagcctcatgaccccaacccagccccaggcatggctaacccctgactgcttgcctcatatttaagctgctgctctggccaagtgcctaatt

SEQ ID NO: 195901 - DNA, 1736 bp, Homo sapiens
  Payload ID: 18655
  Gene Name: tubulin polymerization-promoting protein family member 3
  Uniprot ID: Q9BW30
  ENST ID: ENST00000564104
  CDS Start-End: 843-1373
agtgggaggttacagcaccagtcggtggcaaggggccaggaagccacggttatgccctaggcgcagggagtgctggcgtgccccacccgtgggccccagcttcccagcccagcccagcccctcagcactgggagcttctccctgagctgccctgacaccatcctgcccttagcaacattctccaagcagcaccaccctcccttagcaaccgtctccaggcttcacaaactgtggccaggccagccccaagctcccctcatgtttttgtttaacagcaaatagtaacaaggccttgctggaccagctgcacccctgcccagggcatgcacccgtgcccagactggctcttgctgggtcctcatgacccttacagagatgctgtcctcactgaatgcctgcccgaccagcagcctggcctggccccaagccagcttggcatggagcttccagggagggggcctgctctgccaccctcacttccacccaagcaaggccttgtgccagggccagacaaagccagggccccagctgctgccctaacagtctttctggacagtgccactctgttccctgtgggcatcattatttcatctgctgaaccctgctgagagccagggctggcattagtgacaagaccgtgcctcccggggctcttccttggggctctgtggcccagggcgacagtgacgggcccctctccccaggcagctccagcaccaactctgtagcagaacctgcccaggtcttgcaggtttgaggtagaggctgggatgttctgggcttgggggaggggaagggcagattggctgggagatgacccaggtgggtctctatagggtggcatggcagcgagcacagacatggctgggctggaggagagcttccgcaagtttgccatccatggtgaccccaaggccagtgggcaagagatgaatggcaagaactgggccaagctgtgcaaggactgcaaggtggctgacggaaagtccgtgacagggaccgatgtggacatcgtcttctccaaagtcaaggggaagtctgctcgggtcatcaactatgaggagttcaagaaggccctggaagagctggcgaccaagagattcaaggggaagagcaaggaggaggccttcgatgccatctgccagctggtggcaggcaaagagccagccaatgtgggcgtcactaaagcaaaaacagggggtgctgtagaccggctgacggacaccagcagatacacgggctcccacaaggagcgcttcgatgagagcggcaagggcaagggcattgcgggacggcaggacatcctggacgacagtggctacgtgagcgcctacaagaatgcaggcacctacgatgccaaggtgaagaagtgaggcttgggaagaccgccctgccaagtgcggctgcccctgccagaggctcaggcctgggtctaaggggcacgtggagcaagagatcctggtcccctccctgctggacctgccacccagagcttcctgcctagtcccactgggctggcccaccaggcctctgacccaggctgctctgcggccccttcctcctcctcttcctgctccaacttctgtccacctggggacagtctgtgcctgtagcctcatgaccccaacccagccccaggcatggctaacccctgactgcttgcctcatatttaagctgctgctctggccaagtgcctaattttaacccagacctcaataaagacaccttttgtacc

SEQ ID NO: 195902 - DNA, 14269 bp, Homo sapiens
  Payload ID: 18656
  Gene Name: tubulin tyrosine ligase
  Uniprot ID: Q8NG68
  ENST ID: ENST00000233336
  CDS Start-End: 192-1325
gcgctttcctctccggcacccggcgggcgcccgggcgcggcgccgccggcacccgagaggcgcggtagccggcgcgggcggcgggggccgggccgcggcgggcgcccgggcggggtccgcgctgagccgccttctcggccgcctggtccctgcggcggctgcccggcggcccgggcgcgcggcgcttcgccatgtacaccttcgtggtacgcgatgagaacagcagcgtctacgccgaggtctcccggctgctcctcgccaccggccactggaagaggctgcggcgagacaaccccagattcaacctgatgctgggagagaggaatcggctgcccttcgggagactgggtcacgagcccgggctggtacagttggtgaattactacaggggtgctgacaaactgtgtcgcaaagcttctttagtgaagctaatcaagacaagccctgaactggctgagtcctgcacatggttccctgaatcttatgtgatttatccaaccaatctcaagactccagttgctccagcacagaatggaattcagccaccaatcagtaactcaaggacagatgaaagagaattctttctcgcctcttataacagaaagaaagaggatggagagggcaacgtttggattgcaaagtcatcagccggtgccaaaggtgaaggcattctcatctcctcagaggcttcagagcttctcgatttcatagacaaccagggccaagtgcacgtgatccagaaatatcttgagcaccctctgctgcttgagccaggtcatcgcaagtttgacatccgaagctgggtcttggtggatcatcagtataatatctacctctatagagagggtgtgcttcggactgcttcagaaccatatcatgttgataatttccaagacaaaacctgccatttgaccaatcactgcattcaaaaagagtattcaaagaactacgggaagtatgaagaaggaaatgaaatgttcttcaaggagttcaatcagtacctaacaagtgctttgaacattaccctagaaagtagtatcttactacaaatcaaacatataataaggaactgcctcctgagcgtggagcctgccattagcaccaagcacctcccttaccagagcttccagctcttcggctttgacttcatggtcgatgaggagctgaaggtgtggctcattgaggtcaacggtgcccctgcatgtgctcagaagctctatgcagaactgtgccaaggcatcgtggacatagccatttccagtgtcttcccacccccagatgtggagcaacctcagacccagccagctgccttcatcaagctgtgacagagggcactccctgctgccttggaaaaagcacggggtcctgctccagggaatggtgaaatgactggattgctctttatccagcccacagcaggggaaagaaaggcaactcgcaaagatgagatggaagaaggcacgtgagcagaggaggcagctcccaaagagagggctgctcagggggcttcccagatgtagctctcagcagtgctgttgagacttttgaaaacaactttggtacacaaaggcagctttgtgagcagagctccttcccctctccccgggaacggcagggcactgggacctctggtcggtgcctcccacccactgcagccctagtgccttagctccatgcccggctgcagccccactgctctggactatggattggacgtcagagcatattggaggttgcctgtgtgttccccacccatcccttcggtaacactctgccacactaagctctgtacaagcatgcaccaacagtccttagttttgtgctgtgcactggcctctcggcaaaggtggtttccctcatcaccttcctgatggtgtttggtcagtcacctgtcagggtttgtgcgggttgggccccaaaacagcatatgctgctctaagtctgctctctgcatgttttagaaacaaagtggcaagtctgccctgaacctgtaagcatcaaataagcatgagagagaaaaaaacatgatatattgctttacttaataggttgaatatggtaggtctttgaaaatatgatgattcaattttctcaattttctttgctttaaccaaaattctaaatgcagttttgcctagttccctttttttttctttttttacttttttttaaacgtttgtaaaaacctctttgaggatgaggagtcagtaaaattccactccccaagtggccctgccccagacaaaggttgctttccccctttttgttctttttatgcccccaagcactttctgcagtagctagagggacaggtttccttccaggaaggattcgagttcctgtgcctgtgggtattaggagagtatatatcctgcctgaatggggaagtcttctaaaatgggaaagaagtggtttcatctccacacagtgtcttgtaaatctcaacaaatgtgtactgttagaagtggcttccgcttactggattaactaatactttataggcttttcaggaggccacatcactagcagtagggagaacaagatgtcatttgtgttcagtgtaagctgagtaaacaggcccttcctagagtgtcctggaaatcacagcaacccattgaaaactgccctccccaccagaacgtgctacgttctttcttcatgcctatgtgtgctccattcctcatttctacttggctcaagaaaacatttctgcagtcaggtgagacttttacaaaagaggagaaaatcaatgcctccttgaacatgatgagatgtgagaacttacaatgaaaaaggcaataatgatagaaattatttcttaggtacagcaatagttgataggatgtgagggtgttaccttggggtgaagtggagaaggtcccaggtgaattggctctcatggaaatttggaattacaaaataaacgtcctgggggttacccagaatacagatttaaaagtttgcctgtagagcaaaataaaacagtcagttgtagtcattaatccttgaggcccaacgcagccgatgggttggtgtttgggaaattctgagatgggagtgagatctgatcggatcctgggaagatgtatacccagttagaacgtgtagggttctgggtccctggcaagtctaggtgggcgggtgacagggaaagcatgggcatttttgtattgctgtcacatgctaacagaggtttgtaattatcttttggacccaaattatagagacattcacgagttttctagccctcacagtaacagagctaagaattcagatgtcaggaagtctgtgaatcttgatggattttctgagaaacctgactcaatggcatatataagagggaagtaagacttttaagaaaagaaaaagttatgcctcattcctcatgtggcttccaataagtatcttaggaacttatttcctttttaaaaaatattttttaaatttttaaaatttgattttaaatttcaaataaatttaaataaattttaaataaattttaaataaaattttacagagacgtggtctcactgtgttgcccaggctggattgcagtggctattcgcagttgtaatcatagcacactgcagcctcgaatttctgggcttgagcagtcctcccgtctcagcctcctgagtagctgagactacaggtgcacaccaccaagcctggctttatgtatttatttctgttcatgcggaatgattggttcagaactgttcctttcccttccatgatgtccttgacacagaaggttatgcctggctcccagtcaggcttcatacttttggtccatgtaagtgctacccgttgctgggggaggagtcatggtttatttggaaatgtcagttgcaatcatggttctgtcatttgactgcacagtatcagaggagcctgttaacctctctgtgccttagtttcttagcccatgaaagagatcattgcctgacccagggactacctcaagggcttttgatgaggacaagtgacagtaggaagatgcaagagcctttagtaccaaggttctcaacactgactacatgctggaatgactgtgaagcttttaaaaaatgttagtgcccactcttcccctgtacccccggacagttaaatcagaacctcagacagcaatatgccttgagatgccttgaaccatgcttgagaaggaaggacaaacacattattatcttggaagaattgcataaggcttatgacttaaaaaaaaaaattctttttggaaacacaagcatttctttaaggatgaccggatgttgccgtatgtatttatggcacaagcaggtgttgtctaagcagtttctctgtttgcttgtcatagcagcatttggaaactcaaacatgctttcatttacataaatagtttatgaagctttgacaacaaatgtaaacagacacgaaattataaatctgctaaatatgtattaagggtattaattattgaaagtccctttccccaaaactcaactcctatggcaattatgaactccattttaccaagaacatttaagtgcctcagcatctgtatgatatagtggagcaggtgctgacataggtaccagctgacatgatgtgtcactagctctgtgggatgattgccacatacatggaacacctgggagtgctggaaatgtactgtgatcgaagtgacaaagtgtgttttcattcacagtggaggctacatcaagcaaggggaggtccagccctcttgcaagtgtggtgagaggctctactagcaaagacatgggcaccggagtaggtcccgtgtagcatgcgggtgctgtagagaaaattcagtgacgtacatggctctggttctggacacaaaatctgtactggagaggaaatgactgctgaaataaggcgattgtatgaatatttaaaatgcctggaacactaaagtaaagtaatgatatttcaagtgtttttgtgctctttggttcttgttgtaggtattgactgtcctgggatatcactggtcatttaaattcaccatataattagccgggcatggtggcatgtggtggtggctgaggtgggaggatcgcttgaggctgaggtgtgaggctgcagtgaaccatgttcacaccactgtactctagcttgagcaacagagcaagaccctgtctcaaaagtaaataaataataaagtaaatataaatccatgatgccgttactcaggggtagacagactttctgtaaaaggccagataataaatctgctaggctttgcaaaccatgtagggccttttttgcatactttttgtttttttctccaactcttagctcataggccgtataaaagcaggccagatgtgcagtaatttgctgaccccaggatgttacccaatacataagccaacagattgtccttcaaaactgatgagcttctcagtgaagcactgagactatttcagctgccaaagtcccagcccatcgtttcttacgtgtcttgtgtatcgagttcttgtaaagcatttcaccaaggccaggtttttaaatacctataaacctcacacacctgagatgcttagtcttgtggatagaaagagtttcattaatgcaaattgttattaacttgtaacttcttgtgcaataaggctgaatgctttggacatctttcctttgtatggctggcctgccttctgtggctgcttccacttcataaatatacctctggcacagaggaggtttccatgccagaagccctgtgtaggcactccactccaaacaggtttcacatacactatgacacattcccagtggactcagcagagattgcatgggcagggtgcagggtgcagggtgcaagcagacatggatccaggcaggcacctacttaggaccctgagagtggacaggcccaaagcctttggaagacttctcttaaagactggtcccacttcctgtcagtagctacacctccttcttaacctgaagttctcccataacccatattttagaagtgttttccccaaagcatccctccatatcttagtctattttgtattgccataacagaatgttacagagaagtgtatgtggctcacggttctggaggatgagaagtccaatatcaaggggctatatctggtgagggccttcttgctgcctcagcatggcagaaggcatcacatggcaagagaggaatggagtctaactcaccctttaactagcaacccattcctgtgataactaacccactcctggcataacatcattaatttattcatgagggtagagctctcgtgacctaacctcttacaggtcccacctctcaacactattgcagtagagattaagtttccaacacatttactttggggaacacattcaaaccatagcagtccctgaaggcaaaggaaaatgaacccctctccaatgcaatacatagtagcagaacttgaagattgttgcaagcataattcctttcaaaaattatgagaggacatcagtgggcataatagagtaacaacctctgaaaaccctctcttccataaaagcaatgagaacactagcaaaactgtctagacattaaccagaggcttgcagcaatccatttattcaagaaaaggcctgtaatcccagcacttcgggaggccaaggcgggcgatcacgaggtcaggagatggagaccatcctggctaacacagtgaaaccccatctctactaaaaatacaaaaaattagccgggcgcggtggcaggtgcctgtagtcccagctacttgggaggctgaggcaggagaatggcgtgaacctaggaggcagagcttgcagtgagccgagatcacgccactgcactccatccagcctgggtgacagtgcgagactctgtctcaaaaaaaaaaaaaaaaaaaaaaggaaagggttgcatctgggtaagaaaagcaagctttctgacattttaatgtaccctattcccactccccctttccccagctccacaacagcctcggccacacaatcatgctgacatccagcagcagagcagccaccgtagggctcagaaggggattggaactcctccaaagcttcattaccagagaattgccatttggcctttttggtagttccatgtaagtccctactcctaggtcttgtctttatttgatgtgactaagaggttacccagtgtgaacaaccttttccctgggtgcatttgtcaaaaaaaatcaacagcaattgttgaacatctcagcttcctaaggtggctgtaacagttggaacaaacaaactgaccaaaagacttagaaggaaaaactgggaatgagatttctataggacgttttgaaaagcttcaacctattcctaagaatgcagaaggccacacacatgtgtaggactgtgcacatgcccagaagagacctgagaattccccagctctttcgtctgaccttaagtgtctgcacaaacagagaggacagaggcagaaggagggaaagagggagggaggaaaggtaggaaggggagaaagagagaggaagaaagagaaaggaaagaaaggcaggcagaaagaaggagaaagggagggagggagggaaaggagggagggaagaaaagagaaagattgagaaagaaaaaagagaaagaagaaagaaaagaaaaaaggaaagaaagttagtttataaaatagaaccaagtagaaattttagagttgcaaagtacaaaaatgcaaatgaaagatttacttgagaagtttaaaaaatgtgtgaactggtaaaagaagtaatcagcaaattagaagtcatttgagattatccagtctgtggaacagaaaaaaaaaatcagcaaagaaaaatgatcagtgcttcagacacccgtcagacaccatcaaacataccaacatacacataataggagtcctagaatagataagtgagagagagggaaggggataaaacatatactggaagaaatagtggccaaaacctttcccactttgaggaaaaacattaaagtgaatccaagaagctcaacaaattctaagcaggaaagactcaaagagtccacctcaagacacaccagccactaagtaaataattttaaatatatagtaaaaaatgacaaggaaacagaaatgttacactagaaaatatataagaaaagagaaggaagtaatgaaaaatagaggagaaaaaaaaggcaagaggcctaaagaaaccaacagtaaaatggtagataaatcctgccttatcagtaatttcattaaatgcaaatgaattaaatactccaatcagaaggtagagattggcaaattgattttttttaaaaatcatgatccaactatatgctatctacaaaaaacacacttcattttatttttatttttattatttagagacagagtcttgctctgttgcctaggttggagtctagtggtgtaatgatagctcactgcagcctcaaacttctggtttcaagtaatcttcccaccttagccacccaagtagctggaactataggtgcctgccaccatacttggctaatttaaaacaatttttttagagataggacctggcttacttcaaaacttacctggctaatttcacttcacataacgatcttcagttccatccatgttgttggaagtgacaggatctcactctttatggctgaacagtactccattgtgtataagcaatatattttctttatccattcatctgctgatggacacttaggtcgcttccaaatcttggctattgcaaacaaggctgcagtaaacatgggagtgcagatatctctccaaaaaaaatttttttttttttagagatagggtcgtactgtgtttcccaagctggtcttgaactcccgtcctcaggcaatcctcctgcctcagtctcccctaagcagctgggattacaggcatcagccaatgcacctggcaaaacacactttagattcaaaaacacaaacaggttgaaagtaaaatgatggaaaaagatataccatgcaaacagtaactcaaagagaagtggagtagctatactaatgttagacaacataaactttaagaaaaaaattgtttctatagacaaagaaggacttttttttaatagttccaacttttattttaaattctggaggtacatacacaggtttgttacatgggtcctgaggttggggtacagatcccattacccaagtagtaagcatagtacctaatggttagctttccaatccttgcacccctccctcccttctccctcttgtcatctttagtgtctcttgttgccatttttgtgtccatgtgtatctaatgtttggctcccacttatgagactgtgcaatatttggttttctgttcctgtgttatttcacttaggataatggcctccagcagcatccatgttactgcaaaggacatgatttcattcttttttatggctgcatagtattccatggtatatatgtactatattttctttatccaatccactgttgatgggcacctaggttgattccatgtctttgctcttgtgaatagcactgtgataaacatataggtgcatgtgtctttctggtagaatgaattgttttcttttggatatatacccagtaatgggaggctatgttgaatggtagctctgtttttgtttgtttgtttgtttgtttggtggagtctctctctgtcacccaggctggagtgcagtggtgtgatctgtgctcactgcaacctccgcctcctgggtttaagcgattctcctgcctcagcctcccaagtagctgggactacaggcgtgtgccgccatgcccagctaatttctgtatttttagcagagacagggtttcaccatgttggctaggctggtcttgaactcctgacctcaggtgatcgacctgcctcagcctcccaaagtgctgggattacaggcatgagccaccatgcccagctgctctgttttaaattctttgagaaatctccaaacttctttccacagtggttcaaccaatttacattcctgccagcagtgtataagcattctctttttttccttagcctcttcagcatctgttattttttgactttttaatatagctattctgactggcgtgagatgatatcttattgtggttgtgatttccatttctctgttgattagtgatgatgaacattgtctcatatgtttcttggccacttgtatgccaaggacattttatattgataaaagggtcagtccattaggaaaatatgacaattataaacatatgtacctagcaatacagcctaaagatacatgacataaaaacttagagaattgaaggaagaaacagacaatttaactacaatagttggaaccctcaaaactccatttcaataatagctagagcaactaggcagaagatcaacaagaaaatagaaaacactataaaccaactagacttgacaaatatctacaaggcactccacccaacagcagcaaaatacacatccttctcaagtgcacatggaacattctctggggtagatcacatgctaggccataaaacaagtctcagtaaatttaaaagaattgaaattatactacatatgttctctgaccatgttggaataaaatcagaaatcagtaacaaattttgttaatttctgtattaatgaagaaatatacaagtaaagaggttggactaataataattcttttaaaacttcccacagggaaaagcccaggaccagattgtaagccagatggtaaggaattaacaccaatatttcatagagtctcctaaaaaatagaagagaagaaaatactcctcaattgagaagagtgtcctcaactttatgaggtcactcttaataccctgataccaaaaccagacaaagatgtcacaagaaaagcaaatagcagaccaataatctcttgggaatacaaacggaaaaaatcttcaacaaaatactagtaaaccaaatccagcaacatagaaaaaggattatacattatgactaagtgggacttatcctaagattacaaagtttggaataactcatgttctcttgtaagtggaagctaggctgagcacggtggctcactcctataatctcagcacttttaggaggccaaggtgggcagatcaaatgaggccaggagtttgagtccagcctgggcaacatgattaaatctggtctctataaaaaatacaagaattagccaggcatggtggtgcatgcctgtaatcccagctactctgatggctgaggcacaagaatcgcttgaacctgagaagaggaggttgcagtgagcagagatcgcacaactgctctctgtcctaggtgacagagcaagtcctgtctcaaaaaaattaaaaagtgggagctaaacattgggtacacatggacataaagttgggaagaggccagtcgcggtggctcacgcctgtcatcccagcactttgggaggccaaggcgggcggatcatgaggtccggagatcaagaccatcctggctaatatggtgaaaccccgtctccactaaaaatacaaaaaattagccgggcgtggtagcaggcgcctgtaatcccagctactcaggaggctgaagcaggggaatcacttgaacctggaaggcggaggttgcagtgagccgagattgcgccactgcactccagcctgggtgacagagactctgtctaaaaaaaaaaaaaaaaaaaaaaaagatgggaacagcagacactggggactactagagccaggagagaaggaggggagcaaagattgaaaactacctattggatactgtgctcgctacctgggtgacaggttcaaccataccccagacctcagcatcacccaatatacctttgtaacaaattcgcacatgtacccccctgattctaaaataaacgttgagaaggggaaaagaaagaatgcaaggtttttttaacatacaaaatttacttaatataatataccactttaatagaaaaaagaggacaaaaagcacatgatcatttcaatatacactgaaaaagcatttggcaatacacaacactctttcttggaaaaaacctttcaacaaactagaaataaattacttcctcaacatgataaagagcatctttggaaaaacccacagcctacatcatattaatggtgatgtgaaagctccagttgggagctttcttcccaatatcaggcacaaaacaagtatatttattcttgtcacttcaacattgtattaaatgttctagacagagcaattcgacaaaaggaaggaaagaagactgcgcattcagattggaaagggagaagtatgatgatctctctttgcagacgacaagataccatatagaaaaagtcctaagaaatccacttacgctgttagaactaataaagagtttagcaagattgccagacacaagatcaatatacaaaactcaatggtatttctacatattacaaacaatttgaagttaagaaaacaattccatttatatcaacaccaaaaagaatgaaatacttaggaataaatttaacaaaagttcatttctacaccaaatactacaaaacatctctgaaagaaattaaagaacacctaaataaatggaaagacatcccatgtttatggattgggagataattattgttaggatgaaaataggccccaaattgatctaccaattgaacacaatcctgatcaagaatctcagccttctttgcagaaattgacaagctgggccgggtgtggtggctcacacctgtaatcccagcactttgggcggccaaggcagatggattacttgaggtcaggaattcaagaccagcttggccaacatggtaaaaccctgtctctattaaaaatacaaaattagccaggcatggtggtgcatgcctgtaatctcagctatttgggaggctgaggcaggaggtagaggttgcagtgagccaagatcatgccactgcactccatcctcagcaacaagagcaaaactctgtctcaaaaaaacaaaaaacaaaaaaaaaaaaaaaagagaaagaaattgacaagctaagctgacgctaaaatccatattgaaatacaaaggatcaaataaatctggagaaagaagaacaaagttggaggatgtgcacttcctgatttcaaaatttattacaaagctgtattaatcaaatctgtgtagtttgtagacagatatacagataaatgtagatagacatacagatcaagagaatagaactgagagtcaaaaataaacccttgcatctatagtgaactgattttcgacaaggaggccaagacaatttgatgagggaaagaatagtctttttaacaaatggtgttaggacaactggatatccacatgcaaaggaataaagtgatatgcctttctcacaccatatacaaaaattagctcagaatgagtcaaagacttaaatgtaagagttgaaactacaaaactcttagtagaaaatataggtgaaaatccccatgattgaaaaatatctagtatttgatagcacaacagggtgactgcagtcagcaataatttgttgtaccttcaaaaataactgaggaagtacaattggaatgttcatgacagaaatgatgaatgcttgaggtgatggaaaccccatctaccctcctgtgatgattacatcgtatgcctatatgaaaacatctcatatacctcataaatatgctaattatgtacccataaatttttttttaaatcctcatgaccttggattacacaatgatgtcttagatatgatataaaaagacaggcaacaaaagaaaaaaactacacttcaaaattaaaacgttttgcttcaaaggacaccagcaagaaagtaaaaacccacagaatgggagaaaaatatttgcaaatcatggatctgacaaggactagtataggctatataaagaactacaactactcagttggccgggcgcgcgcggtggctcatgcctgtaatcccagcatttagggaggcaaggcgagaggatcactagaggccggaagttcaagaccagcctgtgcaacagactcccggctcgaattttttataaaaagtgatataggaatgaaaagtaccagctgaactaggaaaggggaagttgacagtaaggagggactatcaggggcaggaggatactgggtagtggtggtttaattcattgttttaattgtggtgatggctgcatggttgtatacataggtcaaaacttaacgcgtacactttaaatgtgtggtttattgtatgccagttataacgcaatatagctgttaaacacaaacacaataaagttgaaaaacca

SEQ ID NO: 195903 - DNA, 1645 bp, Homo sapiens
  Payload ID: 18657
  Gene Name: tubulin tyrosine ligase-like family member 1
  Uniprot ID: O95922
  ENST ID: ENST00000266254
  CDS Start-End: 242-1513
agtgcagcgcggggcggggcgggccggtgcgcctggcagtcggctgcgtactcctgcgagcgccggagaggggctggaggcggggcgagggcgcggctcgaggcatccctgcagggcgctcctccgagtccctcggcgctctgagcccacagggaagaaggaggggccggcgtcagtgacgtcagcgagaccgaggtgagcgtgggcgttgccagtggtgctctgtcagtgcctatggattatggcagggaaagtaaaatgggtcactgatatcgagaagtcagtgctgatcaataactttgaaaagagaggatgggtccaagtgacagaaaacgaggactggaatttttactggatgagtgtgcaaaccatccgaaatgtgttcagcgttgaagctggatatcggctctcagatgaccaaatagtcaaccattttccaaaccactatgaactgacccggaaggacctgatggtgaagaacatcaaaagatacaggaaggagctggagaaagaagggagtcctctggcagaaaaagatgaaaatggaaaatacctctatctggactttgttccagtcacctatatgctgcccgctgactacaacctgtttgtagaggagttccggaagagcccgtccagcacctggatcatgaagccttgtggcaaggcccagggaaagggcatcttccttatcaacaagctctcacagatcaaaaagtggtcccgggacagcaagacatcttcgtttgtgtctcaatctaataaggaagcctacgtgatctctctctatattaacaacccgttactaattggcgggaggaagttcgacctgcgcttgtacgttctggtgtccacgtaccgtccactgcgctgttacatgtacaagcttgggttttgccggttctgcacagtgaaatacaccccgagtaccagtgagctggacaacatgttcgttcatctcaccaacgtcgccatccagaaacacggggaggactacaaccacatccatgggggcaagtggacagtgagtaacctgcggctctacctggagagcacccgcggcaaggaggtgaccagcaagctgttcgacgagatccactggatcatcgtgcagtccctgaaggctgtggcgccggtgatgaacaatgacaagcactgctttgaatgctatggctacgacatcatcatcgacgacaagctgaagccctggctgatcgaggtgaatgcgtccccgtctctcacgtccagcactgccaatgaccgaatcctcaagtacaacctgattaatgacaccctcaacatcgccgtcccgaatggtgaaatcccagactgcaaatggaacaagtcgccacctaaggaagtcctcggcaattacgagattctgtatgatgaagaattggcccagggtgacggggctgaccgggagctgagaagccgtcagggtcagtctctggggcccagagcaggccgatcgagagactcggggagagcggtcctcaccacctggaagtgagtcccacctggaccttatcaaaactactcactccacctgggcccctgctgaagccctattttgaaatttcccttttgtagagcttttttcctttcctaagccctgtaaataaacgaaggcacttctttggaa

SEQ ID NO: 195904 - DNA, 1185 bp, Homo sapiens
  Payload ID: 18657
  Gene Name: tubulin tyrosine ligase-like family member 1
  Uniprot ID: O95922
  ENST ID: ENST00000331018
  CDS Start-End: 1-1185
atggcagggaaagtaaaatgggtcactgatatcgagaagtcagtgctgatcaataactttgaaaagagaggatgggtccaagtgacagaaaacgaggactggaatttttactggatgagtgtgcaaaccatccgaaatgtgttcagcgttgaagctggatatcggctctcagatgaccaaatagtcaaccattttccaaaccactatgaactgacccggaaggacctgatggtgaagaacatcaaaagatacaggaaggagctggagaaagaagggagtcctctggcagaaaaagatgaaaatggaaaatacctctatctggactttgttccagtcacctatatgctgcccgctgactacaacctgtttgtagaggagttccggaagagcccgtccagcacctggatcatgaagccttgtggcaaggcccagggaaagggcatcttccttatcaacaagctctcacagatcaaaaagtggtcccgggacagcaagacatcttcgtttgtgtctcaatctaataaggaagcctacgtgatctctctctatattaacaacccgttactaattggcgggaggaagttcgacctgcgcttgtacgttctggtgtccacgtaccgtccactgcgctgttacatgtacaagcttgggttttgccggttctgcacagtgaaatacaccccgagtaccagtgagctggacaacatgttcgttcatctcaccaacgtcgccatccagaaacacggggaggactacaaccacatccatgggggcaagtggacagtgagtaacctgcggctctacctggagagcacccgcggcaaggaggtgaccagcaagctgttcgacgagatccactggatcatcgtgcagtccctgaaggctgtggcggtgaatgcgtccccgtctctcacgtccagcactgccaatgaccgaatcctcaagtacaacctgattaatgacaccctcaacatcgccgtcccgaatggtgaaatcccagactgcaaatggaacaagtcgccacctaaggaagtcctcggcaattacgagattctgtatgatgaagaattggcccagggtgacggggctgaccgggagctgagaagccgtcagggtcagtctctggggcccagagcaggccgatcgagagactcggggagagcggtcctcaccacctggaagtga

SEQ ID NO: 195905 - DNA, 1659 bp, Homo sapiens
  Payload ID: 18657
  Gene Name: tubulin tyrosine ligase-like family member 1
  Uniprot ID: O95922
  ENST ID: ENST00000439248
  CDS Start-End: 152-331
gcgcggctcgaggcatccctgcagggcgctcctccgagtccctcggcgctctgagcccacagggaagaaggaggggccggcgtcagtgacgtcagcgagaccgaggtgagcgtgggcgttgccagtggtgctctgtcagtgcctatggattatggcagggaaagtaaaatgggtcactgatatcgagaagtcagtgctgatcaataactttgaaaagagaggatgggtccaagtgacagaaaacgaggactggaatttttactggctccttgaccttcctgaatttcggtacagatcctgtttaaatgagtttcctgacttcagagtctgaaaagggatgagtgtgcaaaccatccgaaatgtgttcagcgttgaagctggatatcggctctcagatgaccaaatagtcaaccattttccaaaccactatgaactgacccggaaggacctgatggtgaagaacatcaaaagatacaggaaggagctggagaaagaagggagtcctctggcagaaaaagatgaaaatggaaaatacctctatctgggtttgtgcgtcttccaccggctcatgttttcaactttgttccagtcacctatatgctgcccgctgactacaacctgtttgtagaggagttccggaagagcccgtccagcacctggatcatgaagccttgtggcaaggcccagggaaagggcatcttccttatcaacaagctctcacagatcaaaaagtggtcccgggacagcaagacatcttcgtttgtgtctcaatctaataaggaagcctacgtgatctctctctatattaacaacccgttactaattggcgggaggaagttcgacctgcgcttgtacgttctggtgtccacgtaccgtccactgcgctgttacatgtacaagcttgggttttgccggttctgcacagtgaaatacaccccgagtaccagtgagctggacaacatgttcgttcatctcaccaacgtcgccatccagaaacacggggaggactacaaccacatccatgggggcaagtggacagtgagtaacctgcggctctacctggagagcacccgcggcaaggaggtgaccagcaagctgttcgacgagatccactggatcatcgtgcagtccctgaaggctgtggcgccggtgatgaacaatgacaagcactgctttgaatgctatggctacgacatcatcatcgacgacaagctgaagccctggctgatcgaggtgaatgcgtccccgtctctcacgtccagcactgccaatgaccgaatcctcaagtacaacctgattaatgacaccctcaacatcgccgtcccgaatggtgaaatcccagactgcaaatggaacaagtcgccacctaaggaagtcctcggcaattacgagattctgtatgatgaagaattggcccagggtgacggggctgaccgggagctgagaagccgtcagggtcagtctctggggcccagagcaggccgatcgagagactcggggagagcggtcctcaccacctggaagtgagtcccacctggaccttatcaaaactactcactccacctgggcccctgctgaagccctattttgaaatttcccttttgtagagcttttttcctttcctaagccctgtaaataaacgaaggcacttctttggaa

SEQ ID NO: 195906 - DNA, 1683 bp, Homo sapiens
  Payload ID: 18657
  Gene Name: tubulin tyrosine ligase-like family member 1
  Uniprot ID: O95922
  ENST ID: ENST00000440761
  CDS Start-End: 233-412
cggggcggggcgggccggtgcgcctggcagtcggctgcgtactcctgcgagcgccggagaggggctggaggcggggcgagggcgcggctcgaggcatccctgcagggcgctcctccgagtccctcggcgctctgagcccacagggaagaaggaggggccggcgtcagtgacgtcagcgagaccgaggtgagcgtgggcgttgccagtggtgctctgtcagtgcctatggattatggcagggaaagtaaaatgggtcactgatatcgagaagtcagtgctgatcaataactttgaaaagagaggatgggtccaagtgacagaaaacgaggactggaatttttactggctccttgaccttcctgaatttcggtacagatcctgtttaaatgagtttcctgacttcagagtctgaaaagggatgagtgtgcaaaccatccgaaatgtgttcagcgttgaagctggatatcggctctcagatgaccaaatagtcaaccattttccaaaccactatgaactgacccggaaggacctgatggtgaagaacatcaaaagatacaggaaggagctggagaaagaagggagtcctctggcagaaaaagatgaaaatggaaaatacctctatctggactttgttccagtcacctatatgctgcccgctgactacaacctgtttgtagaggagttccggaagagcccgtccagcacctggatcatgaagccttgtggcaaggcccagggaaagggcatcttccttatcaacaagctctcacagatcaaaaagtggtcccgggacagcaagacatcttcgtttgtgtctcaatctaataaggaagcctacgtgatctctctctatattaacaacccgttactaattggcgggaggaagttcgacctgcgcttgtacgttctggtgtccacgtaccgtccactgcgctgttacatgtacaagcttgggttttgccggttctgcacagtgaaatacaccccgagtaccagtgagctggacaacatgttcgttcatctcaccaacgtcgccatccagaaacacggggaggactacaaccacatccatgggggcaagtggacagtgagtaacctgcggctctacctggagagcacccgcggcaaggaggtgaccagcaagctgttcgacgagatccactggatcatcgtgcagtccctgaaggctgtggcgccggtgatgaacaatgacaagcactgctttgaatgctatggctacgacatcatcatcgacgacaagctgaagccctggctgatcgaggtgaatgcgtccccgtctctcacgtccagcactgccaatgaccgaatcctcaagtacaacctgattaatgacaccctcaacatcgccgtcccgaatggtgaaatcccagactgcaaatggaacaagtcgccacctaaggaagtcctcggcaattacgagattctgtatgatgaagaattggcccagggtgacggggctgaccgggagctgagaagccgtcagggtcagtctctggggcccagagcaggccgatcgagagactcggggagagcggtcctcaccacctggaagtgagtcccacctggaccttatcaaaactactcactccacctgggcccctgctgaagccctattttgaaatttcccttttgtagagcttttttcctttcctaagccctgta

SEQ ID NO: 195907 - DNA, 2114 bp, Homo sapiens
  Payload ID: 18658
  Gene Name: tubulin tyrosine ligase-like family member 10
  Uniprot ID: Q6ZVT0
  ENST ID: ENST00000379288
  CDS Start-End: 178-1392
acagcccggcccctgccctgcaccaggccactgccctgttggtgaggagggtcggaggggcgacctccctgccccctgctccaagctccccacccccacctggaacctgccggcaggaagcctggccctggagggtggtcacggcccctccccagatgcccggcccacgagaggccaatggggagcagccaggaggagggactccggtgtcagccaagccagccagaccacgacgcagatggacactgtgggccggacctggagggggcagaaagagcctctgccacacccggaccccctgggctcctgaacagccaccggcctgcagactcggatgacactaacgccgccgggccctcagctgccctcctggaggggctcctgctggggggtgggaagccatcgccccacagcacccggccggggcccttcttctacattggaggcagcaacggggccacaatcatcagctcctactgcaaaagcaagggctggcagcgcatccatgacagccgccgggacgactacacgctgaagtggtgtgaggtcaagagccgagacagctacggcagcttccgggaaggagagcagctgctgtaccagcttcccaacaacaagctcctcaccaccaagatcgggctgctcagcacccttcggggacgggcacgggccatgagcaaggccagcaaggtgccggggggggtccaggccaggctggaaaaggacgcagcagcgcccgccctggaggacctcccgtggacaagcccaggatacctcaggccacagagggtcctgagaatggaagagtttttcccagagacctaccgcctggacctcaaacacgagagagaggcctttttcaccttgtttgatgaaacccagatatggatctgcaagcccacagcctccaaccagggcaaaggcatcttcctgctccggaaccaggaggaagttgccgccctgcaggccaagacccggagcatggaggacgaccccatccaccacaagacgccgttccgggggcctcaggcgcgggtggtgcagaggtacatccagaacccgctgctggtggacgggagaaagtttgacgtgcgctcctacctgctcattgcctgcaccacaccctacatgatcttctttggccacggctatgctcgcctcacccttagcctttacgacccccattccagcgacctcggcggccacttgaccaaccagttcatgcagaagaagagccctctgtacatgctgctgaaggagcacacggtgtggagcatggaacacctcaaccgctacatcagtgacacgttctggaaggcccggggcctcgccaaggactgggtcttcaccaccctcaaggtgcgtccactgtgccctccagtctgggagtgagatccctcggggcgggggtgtgtggtcaggctgggcaccaggcacacagatgtccgtggcgtgcgtgggcggctgcgctgaagtgtgacctgaccgtgtggaaccaaacccttccagcgtctctgctcacttagctggcagtgcctgtccccagcagccagcaaaggcccggacggaaagcccagtcgggggtctgtcggcacgagtcccgcgggcagcctcgccgtagggtcaggggacagctcggcttcagtgacagccaccatgtgaagagtctttgttcctttcagatcctccacttggcaggcagggccaacagcagcccccgggccaggtgtcctggagcagcagcagctgcccgtgcaggcccggactctccctagctaagggccatgtgcggtggagtgtcctaattttgcagggttcctttctgtgggggtacctgtggggtacttcaaacagccctagcagcaaaggcccttgagcagcgcggtgtgaaactgggataaaaacggggcttggccgaaggacttttatctgtcttggtcaccccggccaggccccggaagcagcagccagggatggtccttcctcacccacaggcgtgtgtcactgtggctgggacggcagcgctcagaggagcctccagttactttcctcacatctcccaaactctctcttaattgcgataattcacagaacataaaattcacgatcttaaa

SEQ ID NO: 195908 - DNA, 2259 bp, Homo sapiens
  Payload ID: 18658
  Gene Name: tubulin tyrosine ligase-like family member 10
  Uniprot ID: Q6ZVT0
  ENST ID: ENST00000379289
  CDS Start-End: 152-2173
aggaccttgtgggctgggcagcggcctccggccgggaggcaccagctcttcgaacaatgtttaaaagtctcttctgttcatcctaccggggtgccgtctcctgccggtcttttcatctcaccagggccctcgcccgggcaccccccggccaatggaccacagctgcacccggttcatccaccgccggggaccacccactcggacccgagccggcttcaagaggggcaagaggccaaggatccagcagaggcctcgggctcgagtctcagggaccatccctgcgtcacgtctgcacccagcaccggcctcacagcccggcccctgccctgcaccaggccactgccctgttggcccggcccacgagaggccaatggggagcagccaggaggagggactccggtgtcagccaagccagccagaccacgacgcagatggacactgtgggccggacctggagggggcagaaagagcctctgccacacccggaccccctgggctcctgaacagccaccggcctgcagactcggatgacactaacgccgccgggccctcagctgccctcctggaggggctcctgctggggggtgggaagccatcgccccacagcacccggccggggcccttcttctacattggaggcagcaacggggccacaatcatcagctcctactgcaaaagcaagggctggcagcgcatccatgacagccgccgggacgactacacgctgaagtggtgtgaggtcaagagccgagacagctacggcagcttccgggaaggagagcagctgctgtaccagcttcccaacaacaagctcctcaccaccaagatcgggctgctcagcacccttcggggacgggcacgggccatgagcaaggccagcaaggtgccggggggggtccaggccaggctggaaaaggacgcagcagcgcccgccctggaggacctcccgtggacaagcccaggatacctcaggccacagagggtcctgagaatggaagagtttttcccagagacctaccgcctggacctcaaacacgagagagaggcctttttcaccttgtttgatgaaacccagatatggatctgcaagcccacagcctccaaccagggcaaaggcatcttcctgctccggaaccaggaggaagttgccgccctgcaggccaagacccggagcatggaggacgaccccatccaccacaagacgccgttccgggggcctcaggcgcgggtggtgcagaggtacatccagaacccgctgctggtggacgggagaaagtttgacgtgcgctcctacctgctcattgcctgcaccacaccctacatgatcttctttggccacggctatgctcgcctcacccttagcctttacgacccccattccagcgacctcggcggccacttgaccaaccagttcatgcagaagaagagccctctgtacatgctgctgaaggagcacacggtgtggagcatggaacacctcaaccgctacatcagtgacacgttctggaaggcccggggcctcgccaaggactgggtcttcaccaccctcaagaagcggatgcagcagatcatggcccactgctttctggccgccaagcccaagctggactgcaagctgggttactttgacctcattggctgtgacttcctgattgatgacaacttcaaggtatggctgctggagatgaattctaacccagccctgcacaccaactgcgaggtcctgaaggaggtcatcccaggtgtggtcatcgagaccctggacctggtgctcgagaccttccggaagagcctgcgcggccagaagatgttgcctctgctgtcccagcgccgcttcgtgctcctgcacaacggtgaggccgacccgcggccgcacctggggggctcgtgcagcctccgccgctggccgcccctgcccacccgccaggccaagtcctccgggccacccatgccgcatgccccagaccagccgggcgcccgcaggcctgcgccacctcccttggtgccgcagcgtccccggccacccggccccgacctggacagcgcccacgatggggagccccaggccccgggcacggagcagtcgggcacaggcaacaggcacccggcgcaagagccttccccggggacagccaaggaggaacgcgaggagcctgagaacgcgaggccctaggggcagccacccgcgcccagcgccccgcgccccgcgccccagccgtgctgcctgccctcagggacctataaagcccactttgctac

SEQ ID NO: 195909 - DNA, 2283 bp, Homo sapiens
  Payload ID: 18658
  Gene Name: tubulin tyrosine ligase-like family member 10
  Uniprot ID: Q6ZVT0
  ENST ID: ENST00000379290
  CDS Start-End: 174-2195
cccaggaccttgtgggctgggcaggtcgtgcgtcctttgacagcggcctccggccgggaggcaccagctcttcgaacaatgtttaaaagtctcttctgttcatcctaccggggtgccgtctcctgccggtcttttcatctcaccagggccctcgcccgggcaccccccggccaatggaccacagctgcacccggttcatccaccgccggggaccacccactcggacccgagccggcttcaagaggggcaagaggccaaggatccagcagaggcctcgggctcgagtctcagggaccatccctgcgtcacgtctgcacccagcaccggcctcacagcccggcccctgccctgcaccaggccactgccctgttggcccggcccacgagaggccaatggggagcagccaggaggagggactccggtgtcagccaagccagccagaccacgacgcagatggacactgtgggccggacctggagggggcagaaagagcctctgccacacccggaccccctgggctcctgaacagccaccggcctgcagactcggatgacactaacgccgccgggccctcagctgccctcctggaggggctcctgctggggggtgggaagccatcgccccacagcacccggccggggcccttcttctacattggaggcagcaacggggccacaatcatcagctcctactgcaaaagcaagggctggcagcgcatccatgacagccgccgggacgactacacgctgaagtggtgtgaggtcaagagccgagacagctacggcagcttccgggaaggagagcagctgctgtaccagcttcccaacaacaagctcctcaccaccaagatcgggctgctcagcacccttcggggacgggcacgggccatgagcaaggccagcaaggtgccggggggggtccaggccaggctggaaaaggacgcagcagcgcccgccctggaggacctcccgtggacaagcccaggatacctcaggccacagagggtcctgagaatggaagagtttttcccagagacctaccgcctggacctcaaacacgagagagaggcctttttcaccttgtttgatgaaacccagatatggatctgcaagcccacagcctccaaccagggcaaaggcatcttcctgctccggaaccaggaggaagttgccgccctgcaggccaagacccggagcatggaggacgaccccatccaccacaagacgccgttccgggggcctcaggcgcgggtggtgcagaggtacatccagaacccgctgctggtggacgggagaaagtttgacgtgcgctcctacctgctcattgcctgcaccacaccctacatgatcttctttggccacggctatgctcgcctcacccttagcctttacgacccccattccagcgacctcggcggccacttgaccaaccagttcatgcagaagaagagccctctgtacatgctgctgaaggagcacacggtgtggagcatggaacacctcaaccgctacatcagtgacacgttctggaaggcccggggcctcgccaaggactgggtcttcaccaccctcaagaagcggatgcagcagatcatggcccactgctttctggccgccaagcccaagctggactgcaagctgggttactttgacctcattggctgtgacttcctgattgatgacaacttcaaggtatggctgctggagatgaattctaacccagccctgcacaccaactgcgaggtcctgaaggaggtcatcccaggtgtggtcatcgagaccctggacctggtgctcgagaccttccggaagagcctgcgcggccagaagatgttgcctctgctgtcccagcgccgcttcgtgctcctgcacaacggtgaggccgacccgcggccgcacctggggggctcgtgcagcctccgccgctggccgcccctgcccacccgccaggccaagtcctccgggccacccatgccgcatgccccagaccagccgggcgcccgcaggcctgcgccacctcccttggtgccgcagcgtccccggccacccggccccgacctggacagcgcccacgatggggagccccaggccccgggcacggagcagtcgggcacaggcaacaggcacccggcgcaagagccttccccggggacagccaaggaggaacgcgaggagcctgagaacgcgaggccctaggggcagccacccgcgcccagcgccccgcgccccgcgccccagccgtgctgcctgccctcagggacctataaagcccactttgctacaa

SEQ ID NO: 195910 - DNA, 426 bp, Homo sapiens
  Payload ID: 18658
  Gene Name: tubulin tyrosine ligase-like family member 10
  ENST ID: ENST00000486379
  CDS Start-End: 1-137
tcaaccgctacatcagtgacacgttctggaaggcccggggcctcgccaaggactgggtcttcaccaccctcaagtgcctgacacaggacaggagctgcacgagtttgttgagtgagtttctggctgtgaacctgtgaggctgagtgcacgaacgtgtgggcaggtgtggctgtacagaagcggatgcagcagatcatggcccactgctttctggccgccaagcccaagctggactgcaagctgggttactttgacctcattggctgtgacttcctgattgatgacaacttcaaggtatggctgctggagatgaattctaacccagccctgcacaccaactgcgaggtcctgaaggaggtcatcccaggtgtggtcatcgagaccctggacctggtgctcgagaccttccggaagagcctgcgcggc

SEQ ID NO: 195911 - DNA, 3250 bp, Homo sapiens
  Payload ID: 18659
  Gene Name: tubulin tyrosine ligase-like family member 11
  Uniprot ID: Q8NHH1
  ENST ID: ENST00000321582
  CDS Start-End: 189-2591
cgagtgttggcggggactgagcctcctgcttgaggtagttgtttttactcccagtccccaggctcacgagccccacgcgcgctcaatctgccctcccgcttctcctcgccactccgagttctgcgccctcgagatccagcgcatccgcggggtgggcgggtcctggcggctctttgccctcttccaacatggccgccgctgcctctgtgacaggcagggtcacgtgggcagcctcgcctatgaggtcgctggggctcggccggcgattgtcccttcccggaccccgtctcgatgcggtgactgccgctgtcaacccgagcctgagcgatcatggcaacgggctcgggcggggaacgcgtggcagcggctgcagcggcggcagtttggtggcggactggggcggcggagcggcggcggcggcggcggtggcactggcactggccccggccctgagcaccatgcggcggggcagctccgagagcgagctggcggcccggtgggaggcggaggcggtggctgcggccaaagcggcggccaaagctgaggccgaggccacagcggagacggtggcggaacaggtccgcgtggacgcgggcgcggccggggaaccggagtgcaaggcaggggaggagcagcccaaggtcctggccccggccccggcgcagcccagtgcggctgaggaggggaacacccaggtccttcagcggccgccgcccacgctgcccccgtccaagccgaagccggtgcagggcctctgcccgcacgggaagccccgggacaagggccgaagctgcaagcggagctcgggccacggttccggcgagaacggctcccagcggccggtcaccgtggacagctccaaggccaggacctccctggatgccctgaagatcagcatccgccagctcaagtggaaggagttcccatttggccggcgcttgccttgtgacatctactggcatggagtttcatttcacgacaatgacatattctccggtcaagtgaacaagtttccaggcatgacggagatggtgcgtaaaattactctgagcagagcagtgagaaccatgcagaatctctttcctgaggagtacaacttctaccctcgctcatggattctgcctgacgagttccagctctttgttgctcaggttcaaatggtgaaagacgatgacccctcctggaagcccacttttatcgtgaaacctgatggtggttgtcagggtgatggaatctacctcattaaagaccccagtgacatccgcctggcagggaccctccagagcaggccagcggtggtccaggagtacatctgcaaacctctccttatcgacaagctcaagtttgatattcgtctgtatgtcttactcaagtccttagaccccttagagatttatatagccaaagacggactctctaggttttgtaccgagccatatcaggagcccacccccaaaaacctgcaccgcatctttatgcacttaaccaactattcactgaacatccacagcggcaacttcatccactcggacagtgctagcactggcagcaaaaggactttttccagcatcctttgtagactgtcttccaaaggcgttgacatcaagaaggtctggtctgacatcatctccgtggtgattaagacggtcatcgcgctgactccagagctcaaagtcttctaccagtcagacatccccacggggaggccgggccccacgtgcttccagattttaggctttgacattcttctaatgaaaaatctgaagcctatactacttgaagtaaatgcaaatcccagtatgagaatcgaacatgagcacgaactttctccaggggtgtttgaaaatgtccccagcctcgttgatgaagaagtgaaagtggctgtgatcagagacactctgcgcctcatggacccacttaagaagaaaagagagaatcagtctcagcagcttgaaaaaccattcgctggaaaggaagatgctttggacggcgagctgaccagtgctccagactgcaacgccaaccccgaagcccacctgccttccatttgcctcaagcaggtgttccccaagtacgcaaaacagttcaactacctgcgcctggtggacaggatggcaaatttgtttatccggttcctgggcatcaaggggacaatgaagttggggccaacaggctttcgtaccttcataaggagctgcaaactcagcagcagcagcctgtccatggctgccgtggacatcctctacattgacatcacacggaggtggaactccatgaccctggaccagcgggactcagggatgtgtctgcaggccttcgtagaagctttctttttcctggctcagaggaagttcaagatgctgccacttcatgagcaggtggcctcactgattgacctttgcgagtaccacctgtccctgctggatgaaaaacgcctggtgtgtggccggggcgtcccgtcggggggccggcccccacaccgtggccctccccaggagccctccccctcggcccagccagcaggggacaaccccccaccccgcaccagctgtgccaataagctctcccatcccagacataccctgtcctgagggccactctgtcctcctggaaaacggaagacgagagcagctttcagggctggagcgccccaggcattctgcctgcagaggaatggcaggcaggctgccgaggggcccagctgaggtccccacgaactgtctctgtgtgcggctgagctgtgcttcaccaggctggctggttctcacctgccttcctcctcacacctcctggtgatacaccctgtttctgagtcatcagtcatcggacatatgacatctaaaacgtgacagatggcaccttctattctgggctcacaggaagcaccaactggggcaaatctgttgtatttggggcacaggacacaatcgatcccaaggcccggagctgtggagaggaagccgagtgttaggatctgctgccggggcctccacgcgcccaccgggaaaagcctgagaacatcgtgtttatttcctgccgcccgttccgagagaaggaagtggaaatatcaagtaggcatctgcgaatctcccatcccagtcatgtgctacatgggtgtagtgaacagattaacctcatttagttcattagcttgcctgttgctgcaatatttggtttgttattaattaagaaaaaattaattaagaagtaactaagactcctggagcctcagagctggcaggagcctcag

SEQ ID NO: 195912 - DNA, 2012 bp, Homo sapiens
  Payload ID: 18659
  Gene Name: tubulin tyrosine ligase-like family member 11
  Uniprot ID: Q8NHH1
  ENST ID: ENST00000373776
  CDS Start-End: 189-1805
cgagtgttggcggggactgagcctcctgcttgaggtagttgtttttactcccagtccccaggctcacgagccccacgcgcgctcaatctgccctcccgcttctcctcgccactccgagttctgcgccctcgagatccagcgcatccgcggggtgggcgggtcctggcggctctttgccctcttccaacatggccgccgctgcctctgtgacaggcagggtcacgtgggcagcctcgcctatgaggtcgctggggctcggccggcgattgtcccttcccggaccccgtctcgatgcggtgactgccgctgtcaacccgagcctgagcgatcatggcaacgggctcgggcggggaacgcgtggcagcggctgcagcggcggcagtttggtggcggactggggcggcggagcggcggcggcggcggcggtggcactggcactggccccggccctgagcaccatgcggcggggcagctccgagagcgagctggcggcccggtgggaggcggaggcggtggctgcggccaaagcggcggccaaagctgaggccgaggccacagcggagacggtggcggaacaggtccgcgtggacgcgggcgcggccggggaaccggagtgcaaggcaggggaggagcagcccaaggtcctggccccggccccggcgcagcccagtgcggctgaggaggggaacacccaggtccttcagcggccgccgcccacgctgcccccgtccaagccgaagccggtgcagggcctctgcccgcacgggaagccccgggacaagggccgaagctgcaagcggagctcgggccacggttccggcgagaacggctcccagcggccggtcaccgtggacagctccaaggccaggacctccctggatgccctgaagatcagcatccgccagctcaagtggaaggagttcccatttggccggcgcttgccttgtgacatctactggcatggagtttcatttcacgacaatgacatattctccggtcaagtgaacaagtttccaggcatgacggagatggtgcgtaaaattactctgagcagagcagtgagaaccatgcagaatctctttcctgaggagtacaacttctaccctcgctcatggattctgcctgacgagttccagctctttgttgctcaggttcaaatggtgaaagacgatgacccctcctggaagcccacttttatcgtgaaacctgatggtggttgtcagggtgatggaatctacctcattaaagaccccagtgacatccgcctggcagggaccctccagagcaggccagcggtggtccaggagtacatctgcaaacctctccttatcgacaagctcaagtttgatattcgtctgtatgtcttactcaagtccttagaccccttagagatttatatagccaaagacggactctctaggttttgtaccgagccatatcaggagcccacccccaaaaacctgcaccgcatctttatgcacttaaccaactattcactgaacatccacagcggcaacttcatccactcggacagtgctagcactggcagcaaaaggactttttccagcatcctttgtagactgtcttccaaaggcgttgacatcaagaaggtctggtctgacatcatctccgtggtgattaagacggtcatcgcgctgactccagagctcaaagtcttctaccagtcagacatccccacggggaggccgggccccacgtgcttccaggtaaccattgccagttcccagcctgcgtttccagccttgaccggcctcaagagggctctctggcttcgtgtaggatgagtgatcggggtgggatggccagaggaggggacagtgttggtggtgctgtgggcttgggtgttaaacctgggcccaacttccaagctttctgtttgctccctgtgtgatttggggcaagctacttcccctctgttacctgtaaaatgaaatgaagaatacctatcttaaaaggttcttgtaagaattaaatgagataacacatgtaaa

SEQ ID NO: 195913 - DNA, 2195 bp, Homo sapiens
  Payload ID: 18659
  Gene Name: tubulin tyrosine ligase-like family member 11
  ENST ID: ENST00000373778
  CDS Start-End: 1-368
ggagctcgggccacggttccggcgagaacggctcccagcggccggtcaccgtggacagctccaaggccaggacctccctggatgccctgaagatcagcatccgccagctcaagtggaaggagttcccatttggccggcgcttgccttgtgacatctactggcatggagtttcatttcacgacaatgacatattctccggtcaagtgaacaagtttccaggcatgacggagatggtgcgtaaaattactctgagcagagcagtgagaaccatgcagaatctctttcctgaggagagtacatctgcaaacctctccttatcgacaagctcaagtttgatattcgtctgtatgtcttactcaagtccttagaccccttagagatttatatagccaaagacggactctctaggttttgtaccgagccatatcaggagcccacccccaaaaacctgcaccgcatctttatgcacttaaccaactattcactgaacatccacagcggcaacttcatccactcggacagtgctagcactggcagcaaaaggactttttccagcatcctttgtagactgtcttccaaaggcgttgacatcaagaaggtctggtctgacatcatctccgtggtgattaagacggtcatcgcgctgactccagagctcaaagtcttctaccagtcagacatccccacggggaggccgggccccacgtgcttccagattttaggctttgacattcttctaatgaaaaatctgaagcctatactacttgaagtaaatgcaaatcccagtatgagaatcgaacatgagcacgaactttctccaggggtgtttgaaaatgtccccagcctcgttgatgaagaagtgaaagtggctgtgatcagagacactctgcgcctcatggacccacttaagaagaaaagagagaatcagtctcagcagcttgaaaaaccattcgctggaaaggaagatgctttggacggcgagctgaccagtgctccagactgcaacgccaaccccgaagcccacctgccttccatttgcctcaagcaggtgttccccaagtacgcaaaacagttcaactacctgcgcctggtggacaggatggcaaatttgtttatccggttcctgggcatcaaggggacaatgaagttggggccaacaggctttcgtaccttcataaggagctgcaaactcagcagcagcagcctgtccatggctgccgtggacatcctctacattgacatcacacggaggtggaactccatgaccctggaccagcgggactcagggatgtgtctgcaggccttcgtagaagctttctttttcctggctcagaggaagttcaagatgctgccacttcatgagcaggtggcctcactgattgacctttgcgagtaccacctgtccctgctggatgaaaaacgcctggtgtgtggccggggcgtcccgtcggggggccggcccccacaccgtggccctccccaggagccctccccctcggcccagccagcaggggacaaccccccaccccgcaccagctgtgccaataagctctcccatcccagacataccctgtcctgagggccactctgtcctcctggaaaacggaagacgagagcagctttcagggctggagcgccccaggcattctgcctgcagaggaatggcaggcaggctgccgaggggcccagctgaggtccccacgaactgtctctgtgtgcggctgagctgtgcttcaccaggctggctggttctcacctgccttcctcctcacacctcctggtgatacaccctgtttctgagtcatcagtcatcggacatatgacatctaaaacgtgacagatggcaccttctattctgggctcacaggaagcaccaactggggcaaatctgttgtatttggggcacaggacacaatcgatcccaaggcccggagctgtggagaggaagccgagtgttaggatctgctgccggggcctccacgcgcccaccgggaaaagcctgagaacatcgtgtttatttcctgccgcccgttccgagagaaggaagtggaaatatcaagtaggcatctgcgaatctcccatcccagtcatgtgctacatgggtgtagtgaacagattaacctcatttagttcattagcttgcctgttgctgcaatatttggtttgttattaattaagaaaaaattaattaagaa

SEQ ID NO: 195914 - DNA, 1038 bp, Homo sapiens
  Payload ID: 18659
  Gene Name: tubulin tyrosine ligase-like family member 11
  ENST ID: ENST00000487468
  CDS Start-End: 1-200
cggtcaccgtggacagctccaaggccaggacctccctggatgccctgaagatcagcatccgccagctcaagtggaaggagttcccatttggccggcgcttgccttgtgacatctactggcatggagtttcatttcacgacaatgacatattctccggtcaagtgaacaagtttccaggttcaaatggtgaaagacgatgacccctcctggaagcccacttttatcgtgaaacctgatggtggttgtcagggtgatggaatctacctcattaaagaccccagtgacatccgcctggcagggaccctccagagcaggccagcggtggtccaggagtacatctgcaaacctctccttatcgacaagctcaagtttgatattcgtctgtatgtcttactcaagtccttagaccccttagagatttatatagccaaagacggactctctaggttttgtaccgagccatatcaggagcccacccccaaaaacctgcaccgcatctttatgcacttaaccaactattcactgaacatccacagcggcaacttcatccactcggacagtgctagcactggcagcaaaaggactttttccagcatcctttgtagactgtcttccaaaggcgttgacatcaagaaggtctggtctgacatcatctccgtggtgattaagacggtcatcgcgctgactccagagctcaaagtcttctaccagtcagacatccccacggggaggccgggccccacgtgcttccaggtaaccattgccagttcccagcctgcgtttccagccttgaccggcctcaagagggctctctggcttcgtgtaggatgagtgatcggggtgggatggccagaggaggggacagtgttggtggtgctgtgggcttgggtgttaaacctgggcccaacttccaagctttctgtttgctccctgtgtgatttggggcaagctacttcccctctgttacctgtaaaatgaaatgaagaatacctatcttaaaaggttcttgtaagaattaaatgagataacacatgtaaa

SEQ ID NO: 195915 - DNA, 2699 bp, Homo sapiens
  Payload ID: 18659
  Gene Name: tubulin tyrosine ligase-like family member 11
  ENST ID: ENST00000474723
  CDS Start-End: 1-718
gagcgatcatggcaacgggctcgggcggggaacgcgtggcagcggctgcagcggcggcagtttggtggcggactggggcggcggagcggcggcggcggcggcggtggcactggcactggccccggccctgagcaccatgcggcggggcagctccgagagcgagctggcggcccggtgggaggcggaggcggtggctgcggccaaagcggcggccaaagctgaggccgaggccacagcggagacggtggcggaacaggtccgcgtggacgcgggcgcggccggggaaccggagtgcaaggcaggggaggagcagcccaaggtcctggccccggccccggcgcagcccagtgcggctgaggaggggaacacccaggtccttcagcggccgccgcccacgctgcccccgtccaagccgaagccggtgcagggcctctgcccgcacgggaagccccgggacaagggccgaagctgcaagcggagctcgggccacggttccggcgagaacggctcccagcggccggtcaccgtggacagctccaaggccaggacctccctggatgccctgaagatcagcatccgccagctcaagtggaaggagttcccatttggccggcgcttgccttgtgacatctactggcatggagtttcatttcacgacaatgacatattctccggtcaagtgaacaagtttccaggttcaaatggtgaaagacgatgacccctcctggaagcccacttttatcgtgaaacctgatggtggttgtcagggtgatggaatctacctcattaaagaccccagtgacatccgcctggcagggaccctccagagcaggccagcggtggtccaggagtacatctgcaaacctctccttatcgacaagctcaagtttgatattcgtctgtatgtcttactcaagtccttagaccccttagagatttatatagccaaagacggactctctaggttttgtaccgagccatatcaggagcccacccccaaaaacctgcaccgcatctttatgcacttaaccaactattcactgaacatccacagcggcaacttcatccactcggacagtgctagcactggcagcaaaaggactttttccagcatcctttgtagactgtcttccaaaggcgttgacatcaagaaggtctggtctgacatcatctccgtggtgattaagacggtcatcgcgctgactccagagctcaaagtcttctaccagtcagacatccccacggggaggccgggccccacgtgcttccagattttaggctttgacattcttctaatgaaaaatctgaagcctatactacttgaagtaaatgcaaatcccagtatgagaatcgaacatgagcacgaagggtgtttgaaaatgtccccagcctcgttgatgaagaagtgaaagtggctgtgatcagagacactctgcgcctcatggacccacttaagaagaaaagagagaatcagtctcagcagcttgaaaaaccattcgctggaaaggaagatgctttggacggcgagctgaccagtgctccagactgcaacgccaaccccgaagcccacctgccttccatttgcctcaagcaggtgttccccaagtacgcaaaacagttcaactacctgcgcctggtggacaggatggcaaatttgtttatccggttcctgggcatcaaggggacaatgaagttggggccaacaggctttcgtaccttcataaggagctgcaaactcagcagcagcagcctgtccatggctgccgtggacatcctctacattgacatcacacggaggtggaactccatgaccctggaccagcgggactcagggatgtgtctgcaggccttcgtagaagctttctttttcctggctcagaggaagttcaagatgctgccacttcatgagcaggtggcctcactgattgacctttgcgagtaccacctgtccctgctggatgaaaaacgcctggtgtgtggccggggcgtcccgtcggggggccggcccccacaccgtggccctccccaggagccctccccctcggcccagccagcaggggacaaccccccaccccgcaccagctgtgccaataagctctcccatcccagacataccctgtcctgagggccactctgtcctcctggaaaacggaagacgagagcagctttcagggctggagcgccccaggcattctgcctgcagaggaatggcaggcaggctgccgaggggcccagctgaggtccccacgaactgtctctgtgtgcggctgagctgtgcttcaccaggctggctggttctcacctgccttcctcctcacacctcctggtgatacaccctgtttctgagtcatcagtcatcggacatatgacatctaaaacgtgacagatggcaccttctattctgggctcacaggaagcaccaactggggcaaatctgttgtatttggggcacaggacacaatcgatcccaaggcccggagctgtggagaggaagccgagtgttaggatctgctgccggggcctccacgcgcccaccgggaaaagcctgagaacatcgtgtttatttcctgccgcccgttccgagagaaggaagtggaaatatcaagtaggcatctgcgaatctcccatcccagtcatgtgctacatgggtgtagtgaacagattaacctcatttagttcattagcttgcctgttgctgc

SEQ ID NO: 195916 - DNA, 3385 bp, Homo sapiens
  Payload ID: 18660
  Gene Name: tubulin tyrosine ligase-like family member 12
  Uniprot ID: Q14166
  ENST ID: ENST00000216129
  CDS Start-End: 65-1999
gggccgacggacggcgggcggcggcggcggtggcggcgctggagtcggcgcgggtgctggcgccatggaggccgagcggggtcccgagcgccggcctgcggagcgtagcagcccgggccagacgccggaggagggcgcgcaggccttggccgagttcgcggcgctgcacggcccggcgctgcgcgcttcgggggtccccgaacgttactggggccgcctcctgcacaagctggagcacgaggttttcgacgctggggaagtgtttgggatcatgcaagtggaggaggtagaagaggaggaggacgaggcagcccgggaggtgcggaagcagcagcccaacccggggaacgagctgtgctacaaggtcatcgtgaccagggagagcgggctccaggcagcccaccccaacagcatcttcctcatcgaccacgcctggacgtgccgtgtggagcacgcgcgccagcagctgcagcaggtgcccgggctgctgcaccgcatggccaacctgatgggcattgagttccacggtgagctgcccagtacagaggctgtggccctggtgctggaggagatgtggaagttcaaccagacctaccagctggcccatgggacagctgaggagaagatgccggtgtggtatatcatggacgagttcggttcgcggatccagcacgcggacgtgcccagcttcgccacggcacccttcttctacatgccgcagcaggtggcctacacgctgctgtggcccctgagggacctggacactggcgaggaggtgacccgagactttgcctacggagagacggaccccctgatccggaagtgcatgctgctgccctgggcccccaccgacatgctggacctcagctcttgcacacccgagccgcccgccgagcactaccaggccattctggaggaaaacaaggagaagctgccacttgacatcaaccccgtggtgcacccccacggccacatcttcaaggtctacacggacgtgcagcaggtggccagcagcctcacccacccgcgcttcaccctcacccagagtgaggcggacgccgacatcctcttcaacttctcacacttcaaggactacaggaaactcagccaggagaggccaggcgtgctgctgaaccagttcccctgcgagaacctgctgactgtcaaggactgcctggcctccatcgcgcgccgggcaggtggccccgagggcccaccctggctgccccgaaccttcaacctgcgcactgagctgccccagtttgtcagctacttccagcagcgggaaaggtggggcgaggacaaccactggatctgcaagccctggaacctggcgcgcagcctggacacccacgtcaccaagagcctgcacagcatcatccggcaccgagagagcacccccaaggttgtgtccaagtacatcgaaagtcccgtgttgttccttcgagaagacgtgggaaaggtcaagttcgacatccgctacatcgtgctgctgcggtcagtgaggcccctacggttgttcgtgtatgatgtgttctggctgcggttctccaaccgggcctttgcactcaacgacctggatgactacgagaagcacttcacggtcatgaactatgacccggatgtggtgctgaagcaggtgcactgtgaagagttcatccccgagtttgagaagcaatacccagaatttccctggacggacgtccaggctgagatcttccgggccttcacggagctgttccaggtggcctgtgccaagccaccacccctgggcctctgcgactacccctcatcccgggccatgtatgccgtcgacctcatgctgaagtgggacaacggcccagatggaaggcgggtgatgcagccgcagatcctggaggtgaacttcaaccccgactgtgagcgagcctgcaggtaccaccccaccttcttcaacgacgtcttcagcaccttgtttctggaccagcccggtggctgccacgttacctgccttgtctaggcactcgctgtccccaaaacctgtgcttggggcaggattccaacctcagttctctgagctgcttctgcaaaggcccccatgtccctccccacaccggccctgggcatagcctcagccccaggcctctgtcctgccgagccatcctcccggcgccacactccgggagcacagcatcctcctctcacctgtgggtcagagcaggacagtgatggtgtccccagggctgagcaccaccccacgccctgccctcacccctcaccaccatctgtgcactgatgagtctccagtttagccaagggctttgttcctggcatggagaatttgttcctggctgctgtgtttccagggggtgctgggggaagggttccgtggagcgagacaaggtgtcctcgggagcagggttccaccgggaagcgtttgggagccctgtatcacacggggcaggcgggtttctcttccggggtctctgctcttatgcatcaggacgaccccgggacggctgtggggccccacactgcacccacagggctctatgcgacaggggcccaggaacagcctgaggccaccacccagcaagcccgccttatcacccattccagctcacccagaaccttcaccagcaaacctcctgctgaggtcctggcaggaggccaccgtcttgttaccgtttccttttcgtttgctgagggtcacagaccccaacagggaaatcagtatctgtcttcccagtggttgccctgctcgccgggcactccacggggtcccgcccttgtgtgagatgggccaggatccttcggcaaggggcgcctggggctggggctgattgtgggcggtggagcgccagacagaaaaggattccaatgagaacttcaggttaaagtcagatgccacctaccagggtctacagtcaaaatgttggctttttcttattttttaatgtatgggagaaaaatgtaaaattccagttcttttctaattgtgtttctgaaattaggagtcagctgccagcgtttttgtgtggctgcagtgtgcctgggcccagctcacgggcagtgggtggacctaactgcccaggcaggcgagagctacttccagagccttccagtgcatgggagggcagggctaggtgtagcggtgtctcctctttgaaattaagaactatctttcttgtagcaaagctgcacctgatgatgctgcctctcctctctgtgttgtctgggcccttgtttacaagcacgcgttacccttcctgaggggagccatgctctagcccctggagggcctgttgcaggggcagggcgggcccgtcgcctttggcagctcctggagagctgtggacatgcagtccccctcagttcgtgctgcaataaaggccatcttctctta

SEQ ID NO: 195917 - DNA, 888 bp, Homo sapiens
  Payload ID: 18660
  Gene Name: tubulin tyrosine ligase-like family member 12
  ENST ID: ENST00000494035
  CDS Start-End: 286-483
acactgcctcctaggaggactggcacacaggccagtcccaggagccgcctcctgagttcctgctatggaaggcgattgttagcgctgccatcatgagccaggctgggttctgtgttgtctcaggtgcactgtgaagagttcatccccgagtttgagaagcaatacccagaatttccctggacggacgtccaggctgagatcttccgggccttcacggagctgttccaggtggcctgtgccaagccaccacccctgggcctctgcgactacccctcatcccgggccatgtatgccgtcgacctcatgctgaagtgggacaacggcccagatggaaggcgggtgatgcagccgcagatcctggaggtgaacttcaaccccgactgtgagcgagcctgcaggtaccaccccaccttcttcaacgacgtcttcagcaccttgtttctggaccagcccggtggctgccacgttacctgccttgtctaggcactcgctgtccccaaaacctgtgcttggggcaggattccaacctcagttctctgagctgcttctgcaaaggcccccatgtccctccccacaccggccctgggcatagcctcagccccaggcctctgtcctgccgagccatcctcccggcgccacactccgggagcacagcatcctcctctcacctgtgggtcagagcaggacagtgatggtgtccccagggctgagcaccaccccacgccctgccctcacccctcaccaccatctgtgcactgatgagtctccagtttagccaagggctttgttcctggcatggagaatttgttcctggctgctgtgtttccagggggtgctgggggaagggttccgtggagcgagacaaggtgtcctcgggagcagggttcc

SEQ ID NO: 195918 - DNA, 2075 bp, Homo sapiens
  Payload ID: 18661
  Gene Name: tubulin tyrosine ligase-like family member 2
  Uniprot ID: Q9BWV7
  ENST ID: ENST00000239587
  CDS Start-End: 89-1867
agtgctccctccagcctccgcgcatttcagctggcgctgcagctgctgcacagagacccacagaggccaccctcggaaccagcgcccaatgagagggcgggacctgtgttcctccacacaaagccaggcgctgggatctttgagaaccaccaccccagcctttacccttaacattccatccgaggcaaaccacactgagcagccgcctgcaggcctgggagcaaggctacaggaagcaggtgtttccatccctcccaggcgaggccgcccaacaccaacactggagaagaagaaaaaacctcatttgatggcggaagatgaaccttcaggggccctcttgaagccgctggtttttcgcgttgacgagaccaccccggctgtggtgcaaagcgtcctcctggagagggggtggaataagtttgataagcaggagcagaacgcggaggactggaacctgtactggaggacatcctctttccgaatgaccgaacacaacagtgttaaaccgtggcagcagctaaaccaccaccctggaaccaccaagcttaccaggaaagactgtttggccaaacacctgaagcacatgaggaggatgtatggcacttccctgtaccagttcatccccctgacgttcgtcatgcccaatgactataccaagttcgtggctgaatactttcaggagaggcagatgctgggcaccaagcatagctattggatttgcaagcctgctgagttatctcgtgggagggggatactaattttcagtgactttaaagacttcatctttgatgatatgtacatagtgcagaaatatatctccaatcctttacttattggcagatataaatgtgatctccgcatctatgtttgtgttactggctttaagcctttgaccatttatgtttatcaggaagggttggttcggtttgccacggaaaagtttgacctcagtaatttgcaaaacaattatgcccatttgaccaacagcagcatcaataaatccggggcctcttatgagaagatcaaagaagtgattggtcatggttgtaaatggacgctcagcagatttttttcctaccttcgtagctgggatgtggacgatctgcttttgtggaagaaaatccaccgcatggttattctcaccattctcgccattgcaccatctgtcccctttgctgccaattgctttgagctctttgggtttgatattttgattgatgacaacttgaaaccatggcttttagaggtcaactacagcccagccttgaccttggattgttcaacagatgtgttggtgaagagaaaacttgtccatgatattattgacctgatttacttaaatggtctaagaaatgaggggagagaagccagtaatgccacacatggaaattccaacatcgacgctgcaaaaagtgacagaggtgggcttgatgctcctgactgtcttccttatgattctctttcgttcacaagcagaatgtacaacgaggatgactctgtggtggagaaagctgtgagtgtgcgtcctgaagctgcacctgcctcccagctggaaggagagatgagtgggcaggattttcatctgtcaacaagggagatgccacaaagcaagcccaagttacggagcaggcacacgcctcacaagacactcatgccctacgcgtccctcttccagtcgcactcctgcaagaccaagacctccccgtgtgtcctgtcagaccgtggcaaagctccagatccccaagcaggcaactttgttcttgtttttcctttcaatgaagcaactctcggagcttccaggaatggattaaatgtcaaaagaataatccaagagctccagaaactaatgaataagcaacattcctaagtggtaaaaaatcaaatcaagaaaaagtgacatggatttttaaaaaccaaggatcctgtcctagagaaagcaatagttcaagtccctacctgtgccaccagcatgttaactatgacattgggactgaagatgtggccatatgtataaatataacagctctgacaaagcacaatatgttcaagtggtgattaaactacattacatccca

SEQ ID NO: 195919 - DNA, 537 bp, Homo sapiens
  Payload ID: 18661
  Gene Name: tubulin tyrosine ligase-like family member 2
  ENST ID: ENST00000512917
  CDS Start-End: 70-222
gcgcatttcagctggcgctgcagctgctgcacagagacccacagaggccaccctcggaaccagcgcccaatgagagggcgggacctgtgttcctccacacaaagccaggcgctgggttcgatgacacctgaaattcctggtgttgaatcacatggtttaacccttcagctggatcccggtcaaatggaaagttgctctggggctctgtcctgtaagcagtgaatgtgccaaaaagataaaatgtgaagaaaaagactcttagttatttttgcagagcctgtcttggatggaagaaagcaccaaaactaggagctgtcggctaaggaggctgccgtccctgggagccgctctctcctactgcatcctgttgtccctcagtcttctgggcaaatcagtgggccctcatctagagatcgggattcccgcagtgatggaatacattatttttggctgacttccttgccatggggccccatacacccaggaatatcatcaagatctttgagaaccaccaccccagcctttacccttaacatt

SEQ ID NO: 195920 - DNA, 2680 bp, Homo sapiens
  Payload ID: 18661
  Gene Name: tubulin tyrosine ligase-like family member 2
  Uniprot ID: Q9BWV7
  ENST ID: ENST00000515138
  CDS Start-End: 77-1855
agcctccgcgcatttcagctggcgctgcagctgctgcacagagacccacagaggccaccctcggaaccagcgcccaatgagagggcgggacctgtgttcctccacacaaagccaggcgctgggatctttgagaaccaccaccccagcctttacccttaacattccatccgaggcaaaccacactgagcagccgcctgcaggcctgggagcaaggctacaggaagcaggtgtttccatccctcccaggcgaggccgcccaacaccaacactggagaagaagaaaaaacctcatttgatggcggaagatgaaccttcaggggccctcttgaagccgctggtttttcgcgttgacgagaccaccccggctgtggtgcaaagcgtcctcctggagagggggtggaataagtttgataagcaggagcagaacgcggaggactggaacctgtactggaggacatcctctttccgaatgaccgaacacaacagtgttaaaccgtggcagcagctaaaccaccaccctggaaccaccaagcttaccaggaaagactgtttggccaaacacctgaagcacatgaggaggatgtatggcacttccctgtaccagttcatccccctgacgttcgtcatgcccaatgactataccaagttcgtggctgaatactttcaggagaggcagatgctgggcaccaagcatagctattggatttgcaagcctgctgagttatctcgtgggagggggatactaattttcagtgactttaaagacttcatctttgatgatatgtacatagtgcagaaatatatctccaatcctttacttattggcagatataaatgtgatctccgcatctatgtttgtgttactggctttaagcctttgaccatttatgtttatcaggaagggttggttcggtttgccacggaaaagtttgacctcagtaatttgcaaaacaattatgcccatttgaccaacagcagcatcaataaatccggggcctcttatgagaagatcaaagaagtgattggtcatggttgtaaatggacgctcagcagatttttttcctaccttcgtagctgggatgtggacgatctgcttttgtggaagaaaatccaccgcatggttattctcaccattctcgccattgcaccatctgtcccctttgctgccaattgctttgagctctttgggtttgatattttgattgatgacaacttgaaaccatggcttttagaggtcaactacagcccagccttgaccttggattgttcaacagatgtgttggtgaagagaaaacttgtccatgatattattgacctgatttacttaaatggtctaagaaatgaggggagagaagccagtaatgccacacatggaaattccaacatcgacgctgcaaaaagtgacagaggtgggcttgatgctcctgactgtcttccttatgattctctttcgttcacaagcagaatgtacaacgaggatgactctgtggtggagaaagctgtgagtgtgcgtcctgaagctgcacctgcctcccagctggaaggagagatgagtgggcaggattttcatctgtcaacaagggagatgccacaaagcaagcccaagttacggagcaggcacacgcctcacaagacactcatgccctacgcgtccctcttccagtcgcactcctgcaagaccaagacctccccgtgtgtcctgtcagaccgtggcaaagctccagatccccaagcaggcaactttgttcttgtttttcctttcaatgaagcaactctcggagcttccaggaatggattaaatgtcaaaagaataatccaagagctccagaaactaatgaataagcaacattcctaagtggtaaaaaatcaaatcaagaaaaagtgacatggatttttaaaaaccaaggatcctgtcctagagaaagcaatagttcaagtccctacctgtgccaccagcatgttaactatgacattgggactgaagatgtggccatatgtataaatataacagctctgacaaagcacaatatgttcaagtggtgattaaactacattacatcccatgtttatttgctcaggtgtcttgaaagaattctacaaataccacacagcctcccaccaagtcttgctctgtcgccaggctggagtgcagtggcgccatctcggctcactgcaacttccgcctcataggttcaagtcattctcctgcctcagcctcctgagtagctgggactacagcaaaaatctgcaattggcatttcccatgtgatgctgcgtgttgagggctcatctgcttctcgtccaggacgacatttccagcttcatctttgatcttaaccctcccggaggcatacttggtttcctgacagccgctgcaatacacagtcttgacggtgccatccgggtactccctcctcttgaaccgggctgtgtggatttctttctgcccgttgctgagcacaatggttttgtcgccgttcctgagaggagaaacacatggaaataaggtctcttcctgtccatccttgagatgttccaccgtcccgtcgggaaacacgatttctttggagccattggggtagaatttttctgcagaatgcagtttttcagtatatgttacattgaatctgtttagaaacatgttctatgcaaataatctataaaatattcatgagattta

SEQ ID NO: 195921 - DNA, 1561 bp, Homo sapiens
  Payload ID: 18662
  Gene Name: tubulin tyrosine ligase-like family member 3
  ENST ID: ENST00000310252
  CDS Start-End: 1-1561
cttcgatgatttactgaaatttgatgacctagatggaacacatgctctgatgtcccgcatggtccagaatgagatcccctacttcatctggaccactcggcgggatgtgctcgactgtcgcttcctctccaaggatcagatgataaaccactacgcccgggctggctcctttaccacaaaggtgggtctatgtctcaatctccggaatttgccgtggtttgatgaggttgatgccaactccttcttcccacgctgctactgcctgggggctgaggatgacaaaaaagccttcatagaggacttctggctgactgctgcccgcaacgttctcaagctggtggtgaagtctgagtggaagtcataccctattcaggcagtagaggaagaggcctcaggagacaagcagcccaagaaacaggagaaaaacccagtgttggtgtccccagagtttgtggatgaagctctgtgtgcgtgcgaggagtaccttagcaacttggcccacatggacatcgacaaggacctggaggccccgctgtacctcacccccgagggctggtccctcttcctccagcgctactaccaagtggtccacgaaggggcagaactcaggcacctcgacactcaggtccagcgctgtgaggacatcctgcagcagctgcaggccgtggtaccccagatagacatggaaggggatcgcaacatctggatcgtgaagccaggagccaagtcccgcggacgaggcatcatgtgcatggaccacctggaggagatgctgaagctggtgaacggcaaccccgtggtgatgaaggacggcaagtgggtggtgcagaagtatattgagcggcccctcctcatctttggcaccaagtttgacctcagacagtggttcctggtaactgactggaacccacttaccgtgtggttctaccgcgacagctatatccgcttttccacgcagcccttctccctgaagaacctggacaactcagtgcacctgtgcaacaactccatccagaagcacctggagaactcatgccatcggcatccactgcttccgccagacaacatgtggtctagccagaggttccaggcccacctgcaggagatgggtgccccaaatgcttggtccaccatcatcgtgcctggcatgaaggatgctgtgatccacgcacttcagacctcccaggacaccgtgcagtgtcggaaggccagctttgagctctatggcgctgacttcgtgttcggggaggacttccagccctggctgattgagatcaacgccagccccacgatggcaccctccacagcagtcactgcccggctctgtgctggcgtgcaagctgacaccctgcgcgtggtcattgaccggatgctggaccgcaactgtgacacaggagcctttgagctcatctataagcagcccgtcaccacttccccagcctccacaccaaggcccagctgccttctccccatgtactccgacaccagggccaggtcctcagacgacagcacagcaagctggtgggcactaaggccctgtcgaccacaggcaaggccttga

SEQ ID NO: 195922 - DNA, 4834 bp, Homo sapiens
  Payload ID: 18662
  Gene Name: tubulin tyrosine ligase-like family member 3
  Uniprot ID: Q9Y4R7
  ENST ID: ENST00000383827
  CDS Start-End: 2282-3340
ttcttttttttttttgagacggagtctcgctctgtcacccaggctggggtgcagtggcgcgatcttggctcactgcaagctccgcctcccaggttcccgccattctcctgcctcagcctcccgagtagctgggactacaggcgcccgccatcacgcctggctaattttttgtatttttagtagagacggggtttcactgtgttagccaggatggtctcgatctcctgacctcatgatccatccacctcagcctcccaaagtgctgggattacaggcgtcagccaccgtgaccagcctgaaacaggagcaagttctaaactcaggctctagagtcagaaaaggtagagtcaggttctggatccaaaatggggcaagtcatgatcaggttctggaaccagaacaggcctcaagcctaggggctgagcagggtatcccctggcctgggagcagaggacttctggctgactgctgcccgcaacgttctcaagctggtggtgaagtctgagtggaagtcataccctattcaggcagtagaggaagaggcctcaggtaagtactgtggttacctccactctcccacccatttatcctccacccatccgcccttccacctatctgcccttctacctatctattcatccacgcacctactggttcatccacacatctgtgtatgattcacatctacccatctatccatccatccaccagccatccatccactcatccacccacgtattcacccactctctgatctaccgattcacccacccacccttccactcatccttccatcctcccacctgtcacccattgttaatctcgtcattcatctacctgatgtcagctccatactccccatccatctatccactccctgcctacctatccttccacagatccacctacccatctatctacctgctattccattctcccatctactacctatctgttcttcaggccatccactcatccattcttctgtcccaggtacttagacacttgtcttcccatccgtttgttagttgatccactcctcattcagccctcccatgggcctggcatgtagccgagcaccctggagagggcagactaagaagacatggtccgtccctgcctgtgaggagttcaggtctctgaggaggaggaagcagtgaaactgggctttacacatggcctgagaacagcttaggcctgaacataaggaacagcttggagtggaggggacacagaggaaccctcactatcatgcatgccaacccaaccactgcctgccctttcccttctggatttagctcgtgtctccaggctcctagtcctgtaatccagggacccatcagcgagggattcagggaagcagaggcagctctccaggaaggaggaaaatccctgcctcttccagagagactcccccattgctgtctcttgtgtgtgtcatgcacaaggaaggcttggttgtgtgccaggataaggggcacaagggcctcgggtgtggccagagaccccatgcttaagcttttatggtataggtcaggctgcaggggtttgagggcctcagttgtatatcagaatcttcagagcactgcgatgttcaggggtgagtcaggtctgtagatgtgcacggggtcttctgaagggtcagtttctgtaatcactttcaggtgtgtcagggccttgtgcagtaacagtgcacacagaagttagtgtttctgtgggctaagggttgtagctctgtatcaggattctgggagtgggtctggatttctggtgtgtggacttaagaagctgtgtcagacttgggggaggggcgttcatgtataactgggttcacataggccaagactcccaggtgcattttaggcagagcctcaggtgtgttagaggtcccaggggcagagaggctataggtgctgtcagaggccttggggacatttagggcagagcctcgagtgacaggtcctgggacagtgggagccaagggcaagtgctagagttgcagtgaatttagagcaaagcctcagctaagtgacacatcccagggcagtaggggatctatctaggttcgtgctgggcctcaggtaagtgacaggccttaggacaatgggggctgtggcatgcgtcaggttacctgccttgatatgggatcgtgacaggcccctccctatgtgcaggagacaagcagcccaagaaacaggagaaaaacccagtgttggtgtccccagagtttgtggatgaagctctgtgtgcgtgcgaggagtaccttagcaacttggcccacatggacatcgacaaggacctggaggccccgctgtacctcacccccgagggctggtccctcttcctccagcgctactaccaagtggtccacgaaggggcagaactcaggcacctcgacactcaggtccagcgctgtgaggacatcctgcagcagctgcaggccgtggtaccccagatagacatggaaggggatcgcaacatctggatcgtgaagccaggagccaagtcccgcggacgaggcatcatgtgcatggaccacctggaggagatgctgaagctggtgaacggcaaccccgtggtgatgaaggacggcaagtgggtggtgcagaagtatattgagcggcccctcctcatctttggcaccaagtttgacctcagacagtggttcctggtaactgactggaacccacttaccgtgtggttctaccgcgacagctatatccgcttttccacgcagcccttctccctgaagaacctggacaactcagtgcacctgtgcaacaactccatccagaagcacctggagaactcatgccatcggcatccactgcttccgccagacaacatgtggtctagccagaggttccaggcccacctgcaggagatgggtgccccaaatgcttggtccaccatcatcgtgcctggcatgaaggatgctgtgatccacgcacttcagacctcccaggacaccgtgcagtgtcggaaggccagctttgagctctatggcgctgacttcgtgttcggggaggacttccagccctggctgattgagatcaacgccagccccacgatggcaccctccacagcagtcactgcccggctctgtgctggcgtgcaagctgacaccctgcgcgtggtcattgaccggatgctggaccgcaactgtgacacaggagcctttgagctcatctataagcagcccgtcaccacttccccagcctccacaccaaggcccagctgccttctccccatgtactccgacaccagggccaggtcctcagacgacagcacagcaagctggtgggcactaaggccctgtcgaccacaggcaaggccttgaggactctacccacggctaaggtcttcatttccctcccaccgaaccttgatttcaaggtggcacccagcatcctgaagccaagaaaggtgggcctcgacctgtgactcacacccagtggacagtgctgagcacggggtcagggctggagggcacaggcagagggcagctcccaggctggctggcaccccaagggaagagctggtctccctcagaagccccttcctccacagacttctgatcatctccctcttctcccctcctttcacaccgaggctcctgctctcctgtgcctccgaggcccccagctggaagtgccttgttgcctctgccctttgaagtcggaacaattcctagcacctgtcggaaggtcaaggccaaaggcaaattcaaggccagactgtgacaaacccagggctgaggcctgccccatgaagaggctgagccccctgaaacccctgccccttgttggtacattccagaggcgcaggggcctgggggatatgaagctagggaagcccctgcttcgattccccactgcccttgtcctggatccaacaccaaataaaaagaaacaagtgaagtatttggggcttgactccattgctgttggagggtcaagagtggatggggcgaggccgtgtaccccagggtccacagcaagagcctgaggccatcagcagctcctccgtgcagcgaggcccagaattcccacctaaggacagacatggggcttcctatttagggactcccccagcatctccgatccaggggtggggagcgtgagccttcactttacagatgaagaaactgagtctgaaagaggaggcatggcttacccaagatcacgtggcagtgagtcgacgcagggacatattgccagaactgccgagcactgggagccccccaaccccagagaacaagccaagctagcagaatgacacctaccgggcataggaacgttaatgccatgagacaggggaaggaattggccttgcctaaacctcagcccttctgcagagggcatgggtctatcccttcttcagcaaggggccaaggtcacctaaaaatgaaacatccaataagccacacccacctgaagaaaagtgtggcactgcttagttgtagtgggttgaactgtggtcccctgaaaagagatgtctacttggaccctgtgaatgtgaccttatgtgggaaaagagtctttgtagctgggtatggtggctcacacctgttatcccagcactttgagaggccaaggcaggagatcgcttgagcccgcaagttcaagaccagtctgggcaacatggtgaaaccgtttctacagaaaattagctgggtgtggtggcacacacctgtagtcctagctactcgggaggcctaggtgggaggattacctgagcctgggaagatcaaaactgtggtgagctgtgatcacgccactgcgctctgagcctgggagacagagtgaaaccctaaatcaaaaaaaaaaaaaaa

SEQ ID NO: 195923 - DNA, 756 bp, Homo sapiens
  Payload ID: 18662
  Gene Name: tubulin tyrosine ligase-like family member 3
  ENST ID: ENST00000426827
  CDS Start-End: 190-756
agatgccaggcgggcagccccgcccctgcgcgccgcctcagcggcgccttcaagacgctggtcccaggcacccacgcccagggcgcctcggatacccaccccctcggccccccgcacaccccggtcctcgacccctctccgcaggatggtttcccggtcctctggcgaggatcctccaaggcgtctcacatgaaccggctcagaaacgccaaaatctacgtggagagagctgtcaagcagaagaagatctttacaatccaaggctgctacccggtgatccggtgtctcttgcgccggaggggctgggtggagaagaagatggtccatcgctcaggccccaccctgctgccaccccagaaggatctggatagctcagcgatgggtgacagtgacaccactgaggatgaggatgaagatgaggacgaggagttccagccatcacagctgttcgacttcgatgatttactgaaatttgatgacctagatggaacacatgctctgatgtcccgcatggtccagaatgagatcccctacttcatctggaccactcggcgggatgtgctcgactgtcgcttcctctccaaggatcagatgataaaccactacgcccgggctggctcctttaccacaaaggtgggtctatgtctcaatctccggaatttgccgtggtttgatgaggttgatgccaactccttcttcccacgctgctactgcctgggggctgaggatgacaaaaaagccttcataggtaaggag

SEQ ID NO: 195924 - DNA, 2767 bp, Homo sapiens
  Payload ID: 18662
  Gene Name: tubulin tyrosine ligase-like family member 3
  ENST ID: ENST00000426895
  CDS Start-End: 20-2767
cgagcgcggcgaggggcgcatgcagggccccgacgcgccactgctcctgagcgcgagggagctggggcccgggcgccggggctcggcctcctggtaccgccaggagggcggcgcggtgtgcaactggctgcggaagccgcagccgctcgagccacgcaccagtttcccctcggcgcgccgctccgagttccgtccacccaggaggctgccatgggccggccctgcctccgcccagtccgaggagggtcacgcaggcggcagatgccaggcgggcagccccgcccctgcgcgccgcctcagcggcgccttcaagacgctggtcccaggcacccacgcccagggcgcctcggatacccaccccctcggccccccgcacaccccggtcctcgacccctctccgcaggatggtttcccggtcctctggcgaggatcctccaaggcgtctcacatgaaccggctcagaaacgccaaaatctacgtggagagagctgtcaagcagaagaagatctttacaatccaaggctgctacccggtgatccggtgtctcttgcgccggaggggctgggtggagaagaagatggtccatcgctcaggccccaccctgctgccaccccagaaggatctggatagctcagcgatgggtgacagtgacaccactgaggatgaggatgaagatgaggacgaggagttccagccatcacagctgttcgacttcgatgatttactgaaatttgatgacctagatggaacacatgctctgatggtgggtctatgtctcaatctccggaatttgccgtggtttgatgaggttgatgccaactccttcttcccacgctgctactgcctgggggctgaggatgacaaaaaagccttcatagaggacttctggctgactgctgcccgcaacgttctcaagctggtggtgaagtctgagtggaagtcataccctattcaggcagtagaggaagaggcctcaggagacaagcagcccaagaaacaggagaaaaacccagtgttggtgtccccagagtttgtggatgaagctctgtgtgcgtgcgaggagtaccttagcaacttggcccacatggacatcgacaaggacctggaggccccgctgtacctcacccccgagggctggtccctcttcctccagcgctactaccaagtggtccacgaaggggcagaactcaggcacctcgacactcaggtccagcgctgtgaggacatcctgcagcagctgcaggccgtggtaccccagatagacatggaaggggatcgcaacatctggatcgtgaagccaggagccaagtcccgcggacgaggcatcatgtgcatggaccacctggaggagatgctgaagctggtgaacggcaaccccgtggtgatgaaggacggcaagtgggtggtgcagaagtatattgagcggcccctcctcatctttggcaccaagtttgacctcagacagtggttcctggtaactgactggaacccacttaccgtgtggttctaccgcgacagctatatccgcttttccacgcagcccttctccctgaagaacctggacaactcagtgcacctgtgcaacaactccatccagaagcacctggagaactcatgccatcggcatccactgcttccgccagacaacatgtggtctagccagaggttccaggcccacctgcaggagatgggtgccccaaatgcttggtccaccatcatcgtgcctggcatgaaggatgctgtgatccacgcacttcagacctcccaggacaccgtgcagtgtcggaaggccagctttgagctctatggcgctgacttcgtgttcggggaggacttccagccctggctgattgagatcaacgccagccccacgatggcaccctccacagcagtcactgcccggctctgtgctggcgtgcaagctgacaccctgcgcgtggtcattgaccggatgctggaccgcaactgtgacacaggagcctttgagctcatctataagcagcctgctgtggaggtgcctcaatatgtgggcatccggctcctggtagagggcttcaccatcaagaagcccatggcgatgtgtcatcggcggatgggggtccgcccagcagtccctctgctgacccagcgaggctctggggaagcccgtcaccacttccccagcctccacaccaaggcccagctgccttctccccatgtactccgacaccagggccaggtcctcagacgacagcacagcaagctggtgggcactaaggccctgtcgaccacaggcaaggccttgaggactctacccacggctaaggtcttcatttccctcccaccgaaccttgatttcaaggtggcacccagcatcctgaagccaagaaaggctcctgctctcctgtgcctccgaggcccccagctggaagtgccttgttgcctctgccctttgaagtcggaacaattcctagcacctgtcggaaggtcaaggccaaaggcaaattcaaggccagactgtgacaaacccagggctgaggcctgccccatgaagaggctgagccccctgaaacccctgccccttgttggtacattccagaggcgcaggggcctgggggatatgaagctagggaagcccctgcttcgattccccactgcccttgtcctggatccaacaccaaataaaaagaaacaagtgaagtatttggggcttgactccattgctgttggagggtcaagagtggatggggcgaggccgtgtaccccagggtccacagcaagagcctga

SEQ ID NO: 195925 - DNA, 497 bp, Homo sapiens
  Payload ID: 18662
  Gene Name: tubulin tyrosine ligase-like family member 3
  ENST ID: ENST00000439814
  CDS Start-End: 151-497
agtgccctgctcatcaagggtctgggtgaggccccaggtcataaggaagccctcgctcgactgccccggggcccatcgcagcccccaaccagccccgagcggtctgatggtttcccggtcctctggcgaggatcctccaaggcgtctcacatgaaccggctcagaaacgccaaaatctacgtggagagagctgtcaagcagaagaagatctttacaatccaaggctgctacccggtgatccggtgtctcttgcgccggaggggctgggtggagaagaagatggtccatcgctcaggccccaccctgctgccaccccagaaggatctggatagctcagcgatgggtgacagtgacaccactgaggatgaggatgaagatgaggacgaggagttccagccatcacagctgttcgacttcgatgatttactgaaatttgatgacctagatggaacacatgctctgatgtcccgcatggtccagaatgagatcccctactt

SEQ ID NO: 195926 - DNA, 3233 bp, Homo sapiens
  Payload ID: 18662
  Gene Name: tubulin tyrosine ligase-like family member 3
  ENST ID: ENST00000427220
  CDS Start-End: 728-1339
cgggagaggaggcggcgacgcggaggggcgcgggatcaggggccctgggagggcgagcgcggcgaggggcgcatgcagggccccgacgcgccactgctcctgagcgcgagggagctggggcccgggcgccggggctcggcctcctggtaccgccaggagggcggcgcggtgtgcaactggctgcggaagccgcagccgctcgagccacgcaccagtttcccctcggcgcgccgctccgagttccgtccacccaggaggctgccatgggccggccctgcctccgcccagtccgaggagggtcacgcaggcggcagatgccaggcgggcagccccgcccctgcgcgccgcctcagcggcgccttcaagacgctggtcccaggcacccacgcccagggcgcctcggatacccaccccctcggccccccgcacaccccggtcctcgacccctctccgcaggatggtgaggcccgtgcggcccgctcgctctggcctacagcggctgcgaggacgacaagacgctggggtggagggactgggggtcgggagaagagcggctgagggtgggcatctggatgaaggcaggaggaagaaaagaggcgtggctatgggcggccagaaaagatcctaggccgagaccctaggcccagcctcagtgtaccccgcccctattccgcatctttctgcaggtttcccggtcctctggcgaggatcctccaaggcgtctcacatgaaccggctcagaaacgccaaaatctacgtggagagagctgtcaagcagaagaagatctttacaatccaaggctgctacccggtgatccggtgtctcttgcgccggaggggctgggtggagaagaagatggtccatcgctcaggccccaccctgctgccaccccagaaggatctggatagctcagcgatgggtgacagtgacaccactgaggatgaggatgaagatgaggacgaggagttccagccatcacagctgttcgacttcgatgatttactgaaatttgatgacctagatggaacacatgctctgatgtcccgcatggtccagaatgagatcccctacttcatctggaccactcggcgggatgtgctcgactgtcgcttcctctccaaggatcagatgataaaccactacgcccgggctggctcctttaccacaaaggtgggtctatgtctcaatctccggaatttgccgtggtttgatgaggttgatgccaactccttcttcccacgctgctactgcctgggggctgaggatgacaaaaaagccttcatagagacggggtttcactgtgttagccaggatggtctcgatctcctgacctcatgatccatccacctcagcctcccaaagtgctgggattacaggcgtcagccaccgtgaccagcctgaaacaggagcaagttctaaactcaggctctagagtcagaaaaggtagagtcaggttctggatccaaaatggggcaagtcatgatcaggttctggaaccagaacaggcctcaagcctaggggctgagcagggtatcccctggcctgggagcagaggacttctggctgactgctgcccgcaacgttctcaagctggtggtgaagtctgagtggaagtcataccctattcaggcagtagaggaagaggcctcaggagacaagcagcccaagaaacaggagaaaaacccagtgttggtgtccccagagtttgtggatgaagctctgtgtgcgtgcgaggagtaccttagcaacttggcccacatggacatcgacaaggacctggaggccccgctgtacctcacccccgagggctggtccctcttcctccagcgctactaccaagtggtccacgaaggggcagaactcaggcacctcgacactcaggtccagcgctgtgaggacatcctgcagcagctgcaggccgtggtaccccagatagacatggaaggggatcgcaacatctggatcgtgaagccaggagccaagtcccgcggacgaggcatcatgtgcatggaccacctggaggagatgctgaagctggtgaacggcaaccccgtggtgatgaaggacggcaactcagtgcacctgtgcaacaactccatccagaagcacctggagaactcatgccatcggcatccactgcttccgccagacaacatgtggtctagccagaggttccaggcccacctgcaggagatgggtgccccaaatgcttggtccaccatcatcgtgcctggcatgaaggatgctgtgatccacgcacttcagacctcccaggacaccgtgcagtgtcggaaggccagctttgagctctatggcgctgacttcgtgttcggggaggacttccagccctggctgattgagatcaacgccagccccacgatggcaccctccacagcagtcactgcccggctctgtgctggcgtgcaagctgacaccctgcgcgtggtcattgaccggatgctggaccgcaactgtgacacaggagcctttgagctcatctataagcagcccgtcaccacttccccagcctccacaccaaggcccagctgccttctccccatgtactccgacaccagggccaggtcctcagacgacagcacagcaagctggtgggcactaaggccctgtcgaccacaggcaaggccttgaggactctacccacggctaaggtcttcatttccctcccaccgaaccttgatttcaaggtggcacccagcatcctgaagccaagaaaggtgggcctcgacctgtgactcacacccagtggacagtgctgagcacggggtcagggctggagggcacaggcagagggcagctcccaggctggctggcaccccaagggaagagctggtctccctcagaagccccttcctccacagacttctgatcatctccctcttctcccctcctttcacaccgaggctcctgctctcctgtgcctccgaggcccccagctggaagtgccttgttgcctctgccctttgaagtcggaacaattcctagcacctgtcggaaggtcaaggccaaaggcaaattcaaggccagactgtgacaaacccagggctgaggcctgccccatgaagaggctgagccccctgaaacccctgccccttgttggtacattccagaggcgcaggggcctgggggatatgaagctagggaagcccctgcttcgattccccactgcccttgtcctggatccaacaccaaataaaaagaaacaagtgaagta

SEQ ID NO: 195927 - DNA, 1674 bp, Homo sapiens
  Payload ID: 18662
  Gene Name: tubulin tyrosine ligase-like family member 3
  ENST ID: ENST00000430390
  CDS Start-End: 1-355
gctcagaaacgccaaaatctacgtggagagagctgtcaagcagaagaagatctttacaatccaaggctgctacccggtgatccggtgtctcttgcgccggaggggctgggtggagaagaagatggtccatcgctcaggccccaccctgctgccaccccagaaggatctggatagctcagcgatgggtgacagtgacaccactgaggatgaggatgaagatgaggacgaggagttccagccatcacagctgttcgacttcgatgatttactgaaatttgatgacctagatggaacacatgctctgatgcgaaggggcagaactcaggcacctcgacactcaggtccagcgctgtgaggacatcctgcagcagctgcaggccgtggtaccccagatagacatggaaggggatcgcaacatctggatcgtgaagccaggagccaagtcccgcggacgaggcatcatgtgcatggaccacctggaggagatgctgaagctggtgaacggcaaccccgtggtgatgaaggacggcaagtgggtggtgcagaagtatattgagcggcccctcctcatctttggcaccaagtttgacctcagacagtggttcctggtaactgactggaacccacttaccgtgtggttctaccgcgacagctatatccgcttttccacgcagcccttctccctgaagaacctggacaactcagtgcacctgtgcaacaactccatccagaagcacctggagaactcatgccatcggcatccactgcttccgccagacaacatgtggtctagccagaggttccaggcccacctgcaggagatgggtgccccaaatgcttggtccaccatcatcgtgcctggcatgaaggatgctgtgatccacgcacttcagacctcccaggacaccgtgcagtgtcggaaggccagctttgagctctatggcgctgacttcgtgttcggggaggacttccagccctggctgattgagatcaacgccagccccacgatggcaccctccacagcagtcactgcccggctctgtgctggcgtgcaagctgacaccctgcgcgtggtcattgaccggatgctggaccgcaactgtgacacaggagcctttgagctcatctataagcagcccgtcaccacttccccagcctccacaccaaggcccagctgccttctccccatgtactccgacaccagggccaggtcctcagacgacagcacagcaagctggtgggcactaaggccctgtcgaccacaggcaaggccttgaggactctacccacggctaaggtcttcatttccctcccaccgaaccttgatttcaaggtggcacccagcatcctgaagccaagaaaggctcctgctctcctgtgcctccgaggcccccagctggaagtgccttgttgcctctgccctttgaagtcggaacaattcctagcacctgtcggaaggtcaaggccaaaggcaaattcaaggccagactgtgacaaacccagggctgaggcctgccccatgaagaggctgagccccctgaaacccctgccccttgttggtacattccagaggcgcaggggcctgggggatatgaagctagggaagcccctgcttcgattccccactgcccttgtcctggatccaacaccaaataaaaagaaacaagtgaagta

SEQ ID NO: 195928 - DNA, 2031 bp, Homo sapiens
  Payload ID: 18662
  Gene Name: tubulin tyrosine ligase-like family member 3
  ENST ID: ENST00000443148
  CDS Start-End: 1-1860
tcccgcatggtccagaatgagatcccctacttcatctggaccactcggcgggatgtgctcgactgtcgcttcctctccaaggatcagatgataaaccactacgcccgggctggctcctttaccacaaaggtgggtctatgtctcaatctccggaatttgccgtggtttgatgaggttgatgccaactccttcttcccacgctgctactgcctgggggctgaggatgacaaaaaagccttcatagaggacttctggctgactgctgcccgcaacgttctcaagctggtggtgaagtctgagtggaagtcataccctattcaggcagtagaggaagaggcctcaggagacaagcagcccaagaaacaggagaaaaacccagtgttggtgtccccagagtttgtggatgaagctctgtgtgcgtgcgaggagtaccttagcaacttggcccacatggacatcgacaaggacctggaggccccgctgtacctcacccccgagggctggtccctcttcctccagcgctactaccaagtggtccacgaaggggcagaactcaggcacctcgacactcaggtccagcgctgtgaggacatcctgcagcagctgcaggccgtggtaccccagatagacatggaaggggatcgcaacatctggatcgtgaagccaggagccaagtcccgcggacgaggcatcatgtgcatggaccacctggaggagatgctgaagctggtgaacggcaaccccgtggtgatgaaggacggcaagtgggtggtgcagaagtatattgagcggcccctcctcatctttggcaccaagtttgacctcagacagtggttcctggtaactgactggaacccacttaccgtgtggttctaccgcgacagctatatccgcttttccacgcagcccttctccctgaagaacctggacaactcagtgcacctgtgcaacaactccatccagaagcacctggagaactcatgccatcggcatccactgcttccgccagacaacatgtggtctagccagaggttccaggcccacctgcaggagatgggtgccccaaatgcttggtccaccatcatcgtgcctggcatgaaggatgctgtgatccacgcacttcagacctcccaggacaccgtgcagtgtcggaaggccagctttgagctctatggcgctgacttcgtgttcggggaggacttccagccctggctgattgagatcaacgccagccccacgatggcaccctccacagcagtcactgcccggctctgtgctggcgtgcaagctgacaccctgcgcgtggtcattgaccggatgctggaccgcaactgtgacacaggagcctttgagctcatctataagcagcctgctgtggaggtgcctcaatatgtgggcatccggctcctggtagagggcttcaccatcaagaagcccatggcgatgtgtcatcggcggatgggggtccgcccagcagtccctctgctgacccagcgaggctctggggaaggcaaggactcggggacccctacccacagccgaggtatcaggaagtttaaggaagttgcccaaggttgcacagctcagaaggggcacagctgggatgcagacccagcccgtcaccacttccccagcctccacaccaaggcccagctgccttctccccatgtactccgacaccagggccaggtcctcagacgacagcacagcaagctggtgggcactaaggccctgtcgaccacaggcaaggccttgaggactctacccacggctaaggtcttcatttccctcccaccgaaccttgatttcaaggtggcacccagcatcctgaagccaagaaaggtgggcctcgacctgtgactcacacccagtggacagtgctgagcacggggtcagggctggagggcacaggcagagggcagctcccaggctggctggcaccccaagggaagagctggtctccctcagaagccccttcctccacagacttctgatcatctccctcttctcccctcctttcacaccgaggct

SEQ ID NO: 195929 - DNA, 1041 bp, Homo sapiens
  Payload ID: 18662
  Gene Name: tubulin tyrosine ligase-like family member 3
  ENST ID: ENST00000431204
  CDS Start-End: 190-540
agatgccaggcgggcagccccgcccctgcgcgccgcctcagcggcgccttcaagacgctggtcccaggcacccacgcccagggcgcctcggatacccaccccctcggccccccgcacaccccggtcctcgacccctctccgcaggatggtttcccggtcctctggcgaggatcctccaaggcgtctcacatgaaccggctcagaaacgccaaaatctacgtggagagagctgtcaagcagaagaagatctttacaatccaaggctgctacccggtgatccggtgtctcttgcgccggaggggctgggtggagaagaagatggtccatcgctcaggccccaccctgctgccaccccagaaggatctggatagctcagcgatgggtgacagtgacaccactgaggatgaggatgaagatgaggacgaggagttccagccatcacagctgttcgacttcgatgatttactgaaatttgatgacctagatggaacacatgctctgatggcatcatgtgcatggaccacctggaggagatgctgaagctggtgaacggcaaccccgtggtgatgaaggacggcaagtgggtggtgcagaagtatattgagcggcccctcctcatctttggcaccaagtttgacctcagacagtggttcctggtaactgactggaacccacttaccgtgtggttctaccgcgacagctatatccgcttttccacgcagcccttctccctgaagaacctggacaactcagtgcacctgtgcaacaactccatccagaagcacctggagaactcatgccatcggcatccactgcttccgccagacaacatgtggtctagccagaggttccaggcccacctgcaggagatgggtgccccaaatgcttggtccaccatcatcgtgcctggcatgaaggatgctgtgatccacgcacttcagacctcccaggacaccgtgcagtgtcggaaggccagctttgagctctatggcgctgacttcgtgttcggggaggacttccagccctggctgattgagatca

SEQ ID NO: 195930 - DNA, 579 bp, Homo sapiens
  Payload ID: 18662
  Gene Name: tubulin tyrosine ligase-like family member 3
  ENST ID: ENST00000452823
  CDS Start-End: 1-579
gaaatttgatgacctagatggaacacatgctctgatgtcccgcatggtccagaatgagatcccctacttcatctggaccactcggcgggatgtgctcgactgtcgcttcctctccaaggatcagatgataaaccactacgcccgggctggctcctttaccacaaaggtgggtctatgtctcaatctccggaatttgccgtggtttgatgaggttgatgccaactccttcttcccacgctgctactgcctgggggctgaggatgacaaaaaagccttcataggagacaagcagcccaagaaacaggagaaaaacccagtgttggtgtccccagagtttgtggatgaagctctgtgtgcgtgcgaggagtaccttagcaacttggcccacatggacatcgacaaggacctggaggccccgctgtacctcacccccgagggctggtccctcttcctccagcgctactaccaagtggtccacgaaggggcagaactcaggcacctcgacactcaggtccagcgctgtgaggacatcctgcagcagctgcaggccgtggtaccccagatagacatggaagggga

SEQ ID NO: 195931 - DNA, 603 bp, Homo sapiens
  Payload ID: 18662
  Gene Name: tubulin tyrosine ligase-like family member 3
  ENST ID: ENST00000452597
  CDS Start-End: 183-603
aattaggtgttccctcctccagggcacatggctatgttctagctttgcagtgaatgttaaaggtgctcacagtgaaactgggtgactaataggatatagcagctggtcactcaacaaccctcacaggacagcattgcctgggtttcccggtcctctggcgaggatcctccaaggcgtctcacatgaaccggctcagaaacgccaaaatctacgtggagagagctgtcaagcagaagaagatctttacaatccaaggctgctacccggtgatccggtgtctcttgcgccggaggggctgggtggagaagaagatggtccatcgctcaggccccaccctgctgccaccccagaaggatctggatagctcagcgatgggtgacagtgacaccactgaggatgaggatgaagatgaggacgaggagttccagccatcacagctgttcgacttcgatgatttactgaaatttgatgacctagatggaacacatgctctgatgtcccgcatggtccagaatgagatcccctacttcatctggaccactcggcgggatgtgctcgactgtcgcttcctctccaaggatcagatgataaaccactacgccc

SEQ ID NO: 195932 - DNA, 549 bp, Homo sapiens
  Payload ID: 18662
  Gene Name: tubulin tyrosine ligase-like family member 3
  ENST ID: ENST00000414814
  CDS Start-End: 214-549
aaaagggattcctccagatggccagaggggtttcttctgatggggtggacaagggcacatggctatgttctagctttgcagtgaatgttaaaggtgctcacagtgaaactgggtgactaataggatatagcagctggtcactcaacaaccctcacaggacagcattgcctgggtttcccggtcctctggcgaggatcctccaaggcgtctcacatgaaccggctcagaaacgccaaaatctacgtggagagagctgtcaagcagaagaagatctttacaatccaaggctgctacccggtgatccggtgtctcttgcgccggaggggctgggtggagaagaagatggtccatcgctcaggccccaccctgctgccaccccagaaggatctggatagctcagcgatgggtgacagtgacaccactgaggatgaggatgaagatgaggacgaggagttccagccatcacagctgttcgacttcgatgatttactgaaatttgatgacctagatggaacacatgctctgatgtcccgcatggtccagaatgag

SEQ ID NO: 195933 - DNA, 540 bp, Homo sapiens
  Payload ID: 18662
  Gene Name: tubulin tyrosine ligase-like family member 3
  ENST ID: ENST00000418745
  CDS Start-End: 174-540
agtgccctgctcatcaagggtctgggtgaggccccaggtcataaggaagccctcgctcgactgccccggggcccatcgcagcccccaaccagccccgagcggtctgatggtgcccagggaatggtttccaaggtttcccggtcctctggcgaggatcctccaaggcgtctcacatgaaccggctcagaaacgccaaaatctacgtggagagagctgtcaagcagaagaagatctttacaatccaaggctgctacccggtgatccggtgtctcttgcgccggaggggctgggtggagaagaagatggtccatcgctcaggccccaccctgctgccaccccagaaggatctggatagctcagcgatgggtgacagtgacaccactgaggatgaggatgaagatgaggacgaggagttccagccatcacagctgttcgacttcgatgatttactgaaatttgatgacctagatggaacacatgctctgatgtcccgcatggtccagaatgagatcccctacttcatctggaccactcggcggg

SEQ ID NO: 195934 - DNA, 591 bp, Homo sapiens
  Payload ID: 18662
  Gene Name: tubulin tyrosine ligase-like family member 3
  ENST ID: ENST00000419081
  CDS Start-End: 265-591
aacactaactaactggggctcagtgctctcttccgccttcagtgccctgctcatcaagggtctgggtgaggccccaggtcataaggaagccctcgctcgactgccccggggcccatcgcagcccccaaccagccccgagcggtctgatggtgcccagggaatggtttccaaggcaatagcaaacggggcggggcttggaacggaggacaaggctcgagcctaggtttcccggtcctctggcgaggatcctccaaggcgtctcacatgaaccggctcagaaacgccaaaatctacgtggagagagctgtcaagcagaagaagatctttacaatccaaggctgctacccggtgatccggtgtctcttgcgccggaggggctgggtggagaagaagatggtccatcgctcaggccccaccctgctgccaccccagaaggatctggatagctcagcgatgggtgacagtgacaccactgaggatgaggatgaagatgaggacgaggagttccagccatcacagctgttcgacttcgatgatttactgaaatttgatgacctagatggaacacatgctctgatggtgggtctatgt

SEQ ID NO: 195935 - DNA, 536 bp, Homo sapiens
  Payload ID: 18662
  Gene Name: tubulin tyrosine ligase-like family member 3
  ENST ID: ENST00000430718
  CDS Start-End: 91-536
aatagcaaacggggcggggcttggaacggaggacaaggctcgagcctaggtttcccggtcctctggcgaggatcctccaaggcgtctcacatgaaccggctcagaaacgccaaaatctacgtggagagagctgtcaagcagaagaagatctttacaatccaaggctgctacccggtgatccggtgtctcttgcgccggaggggctgggtggagaagaagatggtccatcgctcaggccccaccctgctgccaccccagaaggatctggatagctcagcgatgggtgacagtgacaccactgaggatgaggatgaagatgaggacgaggagttccagccatcacagctgttcgacttcgatgatttactgaaatttgatgacctagatggaacacatgctctgatgtcccgcatggtccagaatgagatcccctacttcatctggaccactcggcgggatgtgctcgactgtcgcttcctctccaaggatcagatgataaaccactacgcccgggctggctcctttaccacaaaggt

SEQ ID NO: 195936 - DNA, 2097 bp, Homo sapiens
  Payload ID: 18662
  Gene Name: tubulin tyrosine ligase-like family member 3
  Uniprot ID: Q9Y4R7
  ENST ID: ENST00000430793
  CDS Start-End: 360-1664
gccttggggacatttagggcagagcctcgagtgacaggtcctgggacagtgggagccaagggcaagtgctagagttgcagtgaatttagagcaaagcctcagctaagtgacacatcccagggcagtaggggatctatctaggttcgtgctgggcctcaggtaagtgacaggccttaggacaatgggggctgtggcatgcgtcaggttacctgccttgatatgggatcgtgacaggcccctccctatgtgcaggagacaagcagcccaagaaacaggagaaaaacccagtgttggtgtccccagagtttgtggatgaagctctgtgtgcgtgcgaggagtaccttagcaacttggcccacatggacatcgacaaggacctggaggccccgctgtacctcacccccgagggctggtccctcttcctccagcgctactaccaagtggtccacgaaggggcagaactcaggcacctcgacactcaggtccagcgctgtgaggacatcctgcagcagctgcaggccgtggtaccccagatagacatggaaggggatcgcaacatctggatcgtgaagccaggagccaagtcccgcggacgaggcatcatgtgcatggaccacctggaggagatgctgaagctggtgaacggcaaccccgtggtgatgaaggacggcaagtgggtggtgcagaagtatattgagcggcccctcctcatctttggcaccaagtttgacctcagacagtggttcctggtaactgactggaacccacttaccgtgtggttctaccgcgacagctatatccgcttttccacgcagcccttctccctgaagaacctggacaactcagtgcacctgtgcaacaactccatccagaagcacctggagaactcatgccatcggcatccactgcttccgccagacaacatgtggtctagccagaggttccaggcccacctgcaggagatgggtgccccaaatgcttggtccaccatcatcgtgcctggcatgaaggatgctgtgatccacgcacttcagacctcccaggacaccgtgcagtgtcggaaggccagctttgagctctatggcgctgacttcgtgttcggggaggacttccagccctggctgattgagatcaacgccagccccacgatggcaccctccacagcagtcactgcccggctctgtgctggcgtgcaagctgacaccctgcgcgtggtcattgaccggatgctggaccgcaactgtgacacaggagcctttgagctcatctataagcagcctgctgtggaggtgcctcaatatgtgggcatccggctcctggtagagggcttcaccatcaagaagcccatggcgatgtgtcatcggcggatgggggtccgcccagcagtccctctgctgacccagcgaggctctggggaagcccgtcaccacttccccagcctccacaccaaggcccagctgccttctccccatgtactccgacaccagggccaggtcctcagacgacagcacagcaagctggtgggcactaaggccctgtcgaccacaggcaaggccttgaggactctacccacggctaaggtcttcatttccctcccaccgaaccttgatttcaaggtggcacccagcatcctgaagccaagaaaggtgggcctcgacctgtgactcacacccagtggacagtgctgagcacggggtcagggctggagggcacaggcagagggcagctcccaggctggctggcaccccaagggaagagctggtctccctcagaagccccttcctccacagacttctgatcatctccctcttctcccctcctttcacaccgaggctcctgctctcctgtgcctccgaggcccccagctggaagtgccttgttgcctctgccctttgaagtcggaacaattcctagcacctgtcggaaggtcaaggccaaaggcaaattcaaggccagactgtgacaaacccagggctgaggcctgccccatgaagaggctgagccccctgaaacccctgccccttgttggtacattccagaggcgcaggggcctgggggatatgaagctagggaagcccctgcttcgattccccactg

SEQ ID NO: 195937 - DNA, 565 bp, Homo sapiens
  Payload ID: 18662
  Gene Name: tubulin tyrosine ligase-like family member 3
  ENST ID: ENST00000417065
  CDS Start-End: 86-565
agtgctctcttccgccttcagtgccctgctcatcaagggtctgggtttcccggtcctctggcgaggatcctccaaggcgtctcacatgaaccggctcagaaacgccaaaatctacgtggagagagctgtcaagcagaagaagatctttacaatccaaggctgctacccggtgatccggtgtctcttgcgccggaggggctgggtggagaagaagatggtccatcgctcaggccccaccctgctgccaccccagaaggatctggatagctcagcgatgggtgacagtgacaccactgaggatgaggatgaagatgaggacgaggagttccagccatcacagctgttcgacttcgatgatttactgaaatttgatgacctagatggaacacatgctctgatggtgggtctatgtctcaatctccggaatttgccgtggtttgatgaggttgatgccaactccttcttcccacgctgctactgcctgggggctgaggatgacaaaaaagccttcatagaggacttctggctgactgctgcccgcaacgttctcaagctggtggtgaag

SEQ ID NO: 195938 - DNA, 1743 bp, Homo sapiens
  Payload ID: 18662
  Gene Name: tubulin tyrosine ligase-like family member 3
  Uniprot ID: Q9Y4R7
  ENST ID: ENST00000438141
  CDS Start-End: 360-1418
gccttggggacatttagggcagagcctcgagtgacaggtcctgggacagtgggagccaagggcaagtgctagagttgcagtgaatttagagcaaagcctcagctaagtgacacatcccagggcagtaggggatctatctaggttcgtgctgggcctcaggtaagtgacaggccttaggacaatgggggctgtggcatgcgtcaggttacctgccttgatatgggatcgtgacaggcccctccctatgtgcaggagacaagcagcccaagaaacaggagaaaaacccagtgttggtgtccccagagtttgtggatgaagctctgtgtgcgtgcgaggagtaccttagcaacttggcccacatggacatcgacaaggacctggaggccccgctgtacctcacccccgagggctggtccctcttcctccagcgctactaccaagtggtccacgaaggggcagaactcaggcacctcgacactcaggtccagcgctgtgaggacatcctgcagcagctgcaggccgtggtaccccagatagacatggaaggggatcgcaacatctggatcgtgaagccaggagccaagtcccgcggacgaggcatcatgtgcatggaccacctggaggagatgctgaagctggtgaacggcaaccccgtggtgatgaaggacggcaagtgggtggtgcagaagtatattgagcggcccctcctcatctttggcaccaagtttgacctcagacagtggttcctggtaactgactggaacccacttaccgtgtggttctaccgcgacagctatatccgcttttccacgcagcccttctccctgaagaacctggacaactcagtgcacctgtgcaacaactccatccagaagcacctggagaactcatgccatcggcatccactgcttccgccagacaacatgtggtctagccagaggttccaggcccacctgcaggagatgggtgccccaaatgcttggtccaccatcatcgtgcctggcatgaaggatgctgtgatccacgcacttcagacctcccaggacaccgtgcagtgtcggaaggccagctttgagctctatggcgctgacttcgtgttcggggaggacttccagccctggctgattgagatcaacgccagccccacgatggcaccctccacagcagtcactgcccggctctgtgctggcgtgcaagctgacaccctgcgcgtggtcattgaccggatgctggaccgcaactgtgacacaggagcctttgagctcatctataagcagcccgtcaccacttccccagcctccacaccaaggcccagctgccttctccccatgtactccgacaccagggccaggtcctcagacgacagcacagcaagctggtgggcactaaggccctgtcgaccacaggcaaggccttgaggactctacccacggctaaggtcttcatttccctcccaccgaaccttgatttcaaggtggcacccagcatcctgaagccaagaaaggctcctgctctcctgtgcctccgaggcccccagctggaagtgccttgttgcctctgccctttgaagtcggaacaattcctagcacctgtcggaaggtcaaggccaaaggcaaattcaaggccagactgtgacaaacccagggctgaggcctgccccatgaagaggctgagccccctgaaacccctgccccttgttggtacattccagaggcgcaggggcctgggggatatgaagctagg

SEQ ID NO: 195939 - DNA, 2848 bp, Homo sapiens
  Payload ID: 18662
  Gene Name: tubulin tyrosine ligase-like family member 3
  ENST ID: ENST00000455274
  CDS Start-End: 1351-2331
attctcccatctactacctatctgttcttcaggccatccactcatccattcttctgtcccaggtacttagacacttgtcttcccatccgtttgttagttgatccactcctcattcagccctcccatgggcctggcatgtagccgagcaccctggagagggcagactaagaagacatggtccgtccctgcctgtgaggagttcaggtctctgaggaggaggaagcagtgaaactgggctttacacatggcctgagaacagcttaggcctgaacataaggaacagcttggagtggaggggacacagaggaaccctcactatcatgcatgccaacccaaccactgcctgccctttcccttctggatttagctcgtgtctccaggctcctagtcctgtaatccagggacccatcagcgagggattcagggaagcagaggcagctctccaggaaggaggaaaatccctgcctcttccagagagactcccccattgctgtctcttgtgtgtgtcatgcacaaggaaggcttggttgtgtgccaggataaggggcacaagggcctcgggtgtggccagagaccccatgcttaagcttttatggtataggtcaggctgcaggggtttgagggcctcagttgtatatcagaatcttcagagcactgcgatgttcaggggtgagtcaggtctgtagatgtgcacggggtcttctgaagggtcagtttctgtaatcactttcaggtgtgtcagggccttgtgcagtaacagtgcacacagaagttagtgtttctgtgggctaagggttgtagctctgtatcaggattctgggagtgggtctggatttctggtgtgtggacttaagaagctgtgtcagacttgggggaggggcgttcatgtataactgggttcacataggccaagactcccaggtgcattttaggcagagcctcaggtgtgttagaggtcccaggggcagagaggctataggtgctgtcagaggccttggggacatttagggcagagcctcgagtgacaggtcctgggacagtgggagccaagggcaagtgctagagttgcagtgaatttagagcaaagcctcagctaagtgacacatcccagggcagtaggggatctatctaggttcgtgctgggcctcaggtaagtgacaggccttaggacaatgggggctgtggcatgcgtcaggttacctgccttgatatgggatcgtgacaggcccctccctatgtgcaggagacaagcagcccaagaaacaggagaaaaacccagtgttggtgtccccagagtttgtggatgaagctctgtgtgcgtgcgaggagtaccttagcaacttggcccacatggacatcgacaaggacctggaggccccgctgtacctcacccccgagggctggtccctcttcctccagcgctactaccaagtggtccacgaaggggcagaactcaggcacctcgacactcaggtccagcgctgtgaggacatcctgcagcagctgcaggccgtggtaccccagatagacatggaaggggatcgcaacatctggatcgtgaagccaggagccaagtcccgcggacgaggcatcatgtgcatggaccacctggaggagatgctgaagctggtgaacggcaaccccgtggtgatgaaggacggcaagtgggtggtgcagaagtatattgagcggcccctcctcatctttggcaccaagtttgacctcagacagtggttcctggtaactgactggaacccacttaccgtgtggttctaccgcgacagctatatccgcttttccacgcagcccttctccctgaagaacctggacaactcagtgcacctgtgcaacaactccatccagaagcacctggagaactcatgccatcggcatccactgcttccgccagacaacatgtggtctagccagaggttccaggcccacctgcaggagatgggtgccccaaatgcttggtccaccatcatcgtgcctggcatgaaggatgctgtgatccacgcacttcagacctcccaggacaccgtgcagtgtcggaaggccagctttgagctctatggcgctgacttcgtgttcggggaggacttccagccctggctgattgagatcaacgccagccccacgatggcaccctccacagcagtcactgcccggctctgtgctggcgtgcaagctgacaccctgcgcgtggtcattgaccggatgctggaccgcaactgtgacacaggagcctttgagctcatctataagcagggcccagctcctaacatgcaggtgtcaccagagagaaatgcaccactgtgcccagcaccatagctctggctcagagagtttgcctgagaaagcagcagacagaaaacaaaaggtgcgagttgctcccgaaggaactgacttcatgtgcaacagagctcggagaagtccaaggctaagcacactctccagaacagtggaggttgtgctgaaaggcaactgggaggcgacggagagcctgggaggtgcgggctacactggaggccagcaagtctgccagagagaaacagaaaaaaagacaggtgggaagagctctcctggggtcagaacaaagcttaatatcttctttgacaaagaacgtaacatcaaaatagccaactatgggtttagttcaacatttgcaaagagagacaacactgaaaagggaacgtttgatgggactctcccttatgcaggcccagaactcttcttgggccatgggtaccaatgccctgccatcaacgtttggagccttggcatcatcgtatgcaaaatggtggctggggccctgccattttatgagcagaactgtaaggatatactg

SEQ ID NO: 195940 - DNA, 545 bp, Homo sapiens
  Payload ID: 18662
  Gene Name: tubulin tyrosine ligase-like family member 3
  ENST ID: ENST00000422738
  CDS Start-End: 61-545
attccgcatctttctgcaggtttcccggtcctctggcgaggatcctccaaggcgtctcacatgaaccggctcagaaacgccaaaatctacgtggagagagctgtcaagcagaagaagatctttacaatccaaggctgctacccggtgatccggtgtctcttgcgccggaggggctgggtggagaagaagatggtccatcgctcaggccccaccctgctgccaccccagaaggatctggatagctcagcgatgggtgacagtgacaccactgaggatgaggatgaagatgaggacgaggagttccagccatcacagctgttcgacttcgatgatttactgaaatttgatgacctagatggaacacatgctctgatggttgatgccaactccttcttcccacgctgctactgcctgggggctgaggatgacaaaaaagccttcatagaggacttctggctgactgctgcccgcaacgttctcaagctggtggtgaagtctgagtggaagtcataccctattcaggcagtagaggaagaggcctcagg

SEQ ID NO: 195941 - DNA, 540 bp, Homo sapiens
  Payload ID: 18662
  Gene Name: tubulin tyrosine ligase-like family member 3
  ENST ID: ENST00000438596
  CDS Start-End: 86-540
agtgctctcttccgccttcagtgccctgctcatcaagggtctgggtttcccggtcctctggcgaggatcctccaaggcgtctcacatgaaccggctcagaaacgccaaaatctacgtggagagagctgtcaagaagaagatctttacaatccaaggctgctacccggtgatccggtgtctcttgcgccggaggggctgggtggagaagaagatggtccatcgctcaggccccaccctgctgccaccccagaaggatctggatagctcagcgatgggtgacagtgacaccactgaggatgaggatgaagatgaggacgaggagttccagccatcacagctgttcgacttcgatgatttactgaaatttgatgacctagatggaacacatgctctgatgtcccgcatggtccagaatgagatcccctacttcatctggaccactcggcgggatgtgctcgactgtcgcttcctctccaaggatcagatgataaaccactacgcccgggctggctcctttaccacaaaggtgggtctatgtct

SEQ ID NO: 195942 - DNA, 3811 bp, Homo sapiens
  Payload ID: 18662
  Gene Name: tubulin tyrosine ligase-like family member 3
  ENST ID: ENST00000473661
  CDS Start-End: 2093-2419
ggtttcactgtgttagccaggatggtctcgatctcctgacctcatgatccatccacctcagcctcccaaagtgctgggattacaggcgtcagccaccgtgaccagcctgaaacaggagcaagttctaaactcaggctctagagtcagaaaaggtagagtcaggttctggatccaaaatggggcaagtcatgatcaggttctggaaccagaacaggcctcaagcctaggggctgagcagggtatcccctggcctgggagcagaggacttctggctgactgctgcccgcaacgttctcaagctggtggtgaagtctgagtggaagtcataccctattcaggcagtagaggaagaggcctcaggtaagtactgtggttacctccactctcccacccatttatcctccacccatccgcccttccacctatctgcccttctacctatctattcatccacgcacctactggttcatccacacatctgtgtatgattcacatctacccatctatccatccatccaccagccatccatccactcatccacccacgtattcacccactctctgatctaccgattcacccacccacccttccactcatccttccatcctcccacctgtcacccattgttaatctcgtcattcatctacctgatgtcagctccatactccccatccatctatccactccctgcctacctatccttccacagatccacctacccatctatctacctgctattccattctcccatctactacctatctgttcttcaggccatccactcatccattcttctgtcccaggtacttagacacttgtcttcccatccgtttgttagttgatccactcctcattcagccctcccatgggcctggcatgtagccgagcaccctggagagggcagactaagaagacatggtccgtccctgcctgtgaggagttcaggtctctgaggaggaggaagcagtgaaactgggctttacacatggcctgagaacagcttaggcctgaacataaggaacagcttggagtggaggggacacagaggaaccctcactatcatgcatgccaacccaaccactgcctgccctttcccttctggatttagctcgtgtctccaggctcctagtcctgtaatccagggacccatcagcgagggattcagggaagcagaggcagctctccaggaaggaggaaaatccctgcctcttccagagagactcccccattgctgtctcttgtgtgtgtcatgcacaaggaaggcttggttgtgtgccaggataaggggcacaagggcctcgggtgtggccagagaccccatgcttaagcttttatggtataggtcaggctgcaggggtttgagggcctcagttgtatatcagaatcttcagagcactgcgatgttcaggggtgagtcaggtctgtagatgtgcacggggtcttctgaagggtcagtttctgtaatcactttcaggtgtgtcagggccttgtgcagtaacagtgcacacagaagttagtgtttctgtgggctaagggttgtagctctgtatcaggattctgggagtgggtctggatttctggtgtgtggacttaagaagctgtgtcagacttgggggaggggcgttcatgtataactgggttcacataggccaagactcccaggtgcattttaggcagagcctcaggtgtgttagaggtcccaggggcagagaggctataggtgctgtcagaggccttggggacatttagggcagagcctcgagtgacaggtcctgggacagtgggagccaagggcaagtgctagagttgcagtgaatttagagcaaagcctcagctaagtgacacatcccagggcagtaggggatctatctaggttcgtgctgggcctcaggtaagtgacaggccttaggacaatgggggctgtggcatgcgtcaggttacctgccttgatatgggatcgtgacaggcccctccctatgtgcaggagacaagcagcccaagaaacaggagaaaaacccagtgttggtgtccccagagtttgtggatgaagctctgtgtgcgtgcgaggagtaccttagcaacttggcccacatggacatcgacaaggacctggaggccccgctgtacctcacccccgagggctggtccctcttcctccagcgctactaccaagtggtccacgaaggggcagaactcaggcacctcgacactcaggtccagcgctgtgaggacatcctgcagcagctgcaggccgtggtaccccagatagacatggaaggggatcgcaacatctggatcgtgaagccaggagccaagtcccgcggacgaggcatcatgtgcatggaccacctggaggagatgctgaagctggtgaacggcaaccccgtggtgatgaaggacggcaacccttctccctgaagaacctggacaactcagtgcacctgtgcaacaactccatccagaagcacctggagaactcatgccatcggcatccactgcttccgccagacaacatgtggtctagccagaggttccaggcccacctgcaggagatgggtgccccaaatgcttggtccaccatcatcgtgcctggcatgaaggatgctgtgatccacgcacttcagacctcccaggacaccgtgcagtgtcggaaggccagctttgagctctatggcgctgacttcgtgttcggggaggacttccagccctggctgattgagatcaacgccagccccacgatggcaccctccacagcagtcactgcccggctctgtgctggcgtgcaagctgacaccctgcgcgtggtcattgaccggatgctggaccgcaactgtgacacaggagcctttgagctcatctataagcagcctgctgtggaggtgcctcaatatgtgggcatccggctcctggtagagggcttcaccatcaagaagcccatggcgatgtgtcatcggcggatgggggtccgcccagcagtccctctgctgacccagcgaggctctggggaagccgaggtatcaggaagtttaaggaagttgcccaaggttgcacagctcagaaggggcacagctgggatgcagacccagcccgtcaccacttccccagcctccacaccaaggcccagctgccttctccccatgtactccgacaccagggccaggtcctcagacgacagcacagcaagctggtgggcactaaggccctgtcgaccacaggcaaggccttgaggactctacccacggctaaggtcttcatttccctcccaccgaaccttgatttcaaggtggcacccagcatcctgaagccaagaaaggtgggcctcgacctgtgactcacacccagtggacagtgctgagcacggggtcagggctggagggcacaggcagagggcagctcccaggctggctggcaccccaagggaagagctggtctccctcagaagccccttcctccacagacttctgatcatctccctcttctcccctcctttcacaccgaggctcctgctctcctgtgcctccgaggcccccagctggaagtgccttgttgcctctgccctttgaagtcggaacaattcctagcacctgtcggaaggtcaaggccaaaggcaaattcaaggccagactgtgacaaacccagggctgaggcctgccccatgaagaggctgagccccctgaaacccctgccccttgttggtacattccagaggcgcaggggcctgggggatatgaagctagggaagcccctgcttcgattccccactgcccttgtcctggatccaacaccaaataaaaagaaacaagtgaagta

SEQ ID NO: 195943 - DNA, 543 bp, Homo sapiens
  Payload ID: 18662
  Gene Name: tubulin tyrosine ligase-like family member 3
  ENST ID: ENST00000471058
  CDS Start-End: 1-543
acaccgtgcagtgtcggaaggccagctttgagctctatggcgctgacttcgtgttcggggaggacttccagccctggctgattgagatcaacgccagccccacgatggcaccctccacagcagtcactgcccggctctgtgctggcgtgcaagctgacaccctgcgcgtggtcattgaccggatgctggaccgcaactgtgacacaggagcctttgagctcatctataagcaggctcctgctctcctgtgcctccgaggcccccagctggaagtgccttgttgcctctgccctttgaagtcggaacaattcctagcacctgtcggaaggtcaaggccaaaggcaaattcaaggccagactgtgacaaacccagggctgaggcctgccccatgaagaggctgagccccctgaaacccctgccccttgttggtacattccagaggcgcaggggcctgggggatatgaagctagggaagcccctgcttcgattccccactgcccttgtcctggatccaacaccaaataaaaagaaacaagtgaagt

SEQ ID NO: 195944 - DNA, 603 bp, Homo sapiens
  Payload ID: 18662
  Gene Name: tubulin tyrosine ligase-like family member 3
  ENST ID: ENST00000474948
  CDS Start-End: 1-211
gaaatttgatgacctagatggaacacatgctctgatgtcccgcatggtccagaatgagatcccctacttcatctggaccactcggcgggatgtgctcgactgtcgcttcctctccaaggatcagatgataaaccactacgcccgggctggctcctttaccacaaagagacggggtttcactgtgttagccaggatggtctcgatctcctgacctcatgatccatccacctcagcctcccaaagtgctgggattacaggcgtcagccaccgtgaccagcctgaaacaggagcaagttctaaactcaggctctagagtcagaaaaggtagagtcaggttctggatccaaaatggggcaagtcatgatcaggttctggaaccagaacaggcctcaagcctaggggctgagcagggtatcccctggcctgggagcagaggacttctggctgactgctgcccgcaacgttctcaagctggtggtgaagtctgagtggaagtcataccctattcaggcagtagaggaagaggcctcaggagacaagcagcccaagaaacaggagaaaaacccagtgttggtgtccccagagtttgtggatgaagctctg

SEQ ID NO: 195945 - DNA, 507 bp, Homo sapiens
  Payload ID: 18662
  Gene Name: tubulin tyrosine ligase-like family member 3
  ENST ID: ENST00000496246
  CDS Start-End: 1-84
ctgaaatttgatgacctagatggaacacatgctctgatgagacggggtttcactgtgttagccaggatggtctcgatctcctgacctcatgatccatccacctcagcctcccaaagtgctgggattacaggcgtcagccaccgtgaccagcctgaaacaggagcaagttctaaactcaggctctagagtcagaaaaggtagagtcaggttctggatccaaaatggggcaagtcatgatcaggttctggaaccagaacaggcctcaagcctaggggctgagcagggtatcccctggcctgggagcagaggacttctggctgactgctgcccgcaacgttctcaagctggtggtgaagtctgagtggaagtcataccctattcaggcagtagaggaagaggcctcaggagacaagcagcccaagaaacaggagaaaaacccagtgttggtgtccccagagtttgtggatgaagctctgtgtgcgtgcgaggagtaccttagcaacttgg

SEQ ID NO: 195946 - DNA, 4730 bp, Homo sapiens
  Payload ID: 18663
  Gene Name: tubulin tyrosine ligase-like family member 4
  Uniprot ID: Q14679
  ENST ID: ENST00000258398
  CDS Start-End: 104-3703
ttcagactgacagacttcaaggatgcagctgctactaccggaggtgtgtggcaccttacctcagcaaggccatgagaccgtgtggccatgatgtgggcccctcatggcctcagcaggaacacagcactatagtattggcctccgccagaaaaacagcttcaagcagagtggtccctcaggcacagtacctgccacgccacctgagaaaccctcggagggcagagtctggcctcaggcccatcagcaagtgaagccaatctggaagctggaaaagaagcaagtggagacactgtcagcagggttgggcccaggcctcttgggcgtcccaccccagccagcatatttcttttgccccagcactttatgtagctctgggaccacggctgtcattgcaggccacagcagttcctgttacctacactctctcccggacttgttcaacagcaccctgctataccgccgctccagctataggcaaaaaccgtaccagcaactggagtctttctgcttgcgttcgagcccgtcagaaaaaagccctttttctctccctcaaaagagcctccctgtcagtctcactgccaacaaggccacttcttccatggtcttctccatggcccagcccatggcctcctcatccacagaaccatacctctgcttggcagcggctggggaaaacccttcagggaagagcctggcctctgccatctcagggaagatcccatctccactctcttcctcctataagcccatgctgaataataattccttcatgtggccaaatagcacgccagtgcctttattgcagaccacacagggcctgaagccagtatcgccacccaagatccagcctgtctcctggcatcattcagggggtactggagactgtgcaccgcagcctgttgaccataaggtgcccaaaagcattggcactgtcccagctgatgccagtgcccatatcgccttgtctaccgctagctcccacgacacatccaccaccagtgttgcctcttcctggtataaccggaataacttagccatgagggcagagccactttcctgtgctctggatgacagctctgattcccaggatccaactaaggagattcggttcactgaggccgtgaggaaattgaccgcaagaggctttgagaagatgccgaggcaaggctgccagcttgaacagtctagtttcctgaaccccagcttccagtggaatgtcctcaacaggagcaggcggtggaaacctcctgcggtaaatcagcagtttcctcaggaggatgctggatcggtcaggcgggtcctccctggtgcctcagataccttggggttggacaatacagtcttctgtaccaagcgtatcagcattcacctccttgcctcacatgccagtgggctcaatcacaaccctgcctgtgaatctgtaattgactcctcagcatttggagaaggcaaagctccaggtcccccttttcctcaaactcttggcatagccaacgtggccacccgcctctcttccatccagctgggccagtctgagaaggagagacctgaggaggccagggagctggactcatctgatagggatattagttcagctactgacctccagccagatcaggctgagactgaagatacagaagaagaactagtagatggtttggaagactgttgtagccgtgatgagaatgaagaggaggagggagactcagagtgctcctcattaagtgctgtctcccccagcgaatcggtggccatgatctctagaagctgtatggaaattctgaccaaacccctttccaatcatgagaaagttgtccgaccagccctcatctacagtctctttcccaacgttccccctaccatctattttggcactcgggatgagagagtggagaaacttccctgggaacagaggaagttgctccgatggaagatgagcacagtgacccccaacattgtcaagcagaccattggacggtcccacttcaaaatcagcaaaagaaacgatgactggctgggctgctggggtcaccacatgaagtctcctagtttccgatccattcgagagcatcagaagctaaaccatttcccaggctcattccagattgggaggaaggaccggctatggcggaacctgtcacgtatgcagagccgctttggcaagaaggagttcagtttcttcccccagtcctttatcctgccccaggacgccaagctcctgcgcaaagcgtgggagagcagcagccgccaaaagtggattgtgaagccaccagcatcagctcgaggcattggcatccaggttattcacaagtggagtcagctccccaagcgaaggcccctcctggtacagaggtatctacacaaaccctacctcatcagcggcagcaagtttgacctgcggatctatgtttatgtcacttcctacgatcctctgcggatttacctcttttcagatggactggtccgctttgccagttgcaagtattcgccttccatgaagagccttggcaataagttcatgcacctgaccaactacagtgtcaataaaaagaatgccgagtaccaggccaatgcagatgaaatggcttgccagggccacaaatgggcactgaaggctttgtggaactacctgagccagaagggagtcaatagcgacgccatctgggagaagataaaggatgttgttgtcaaaactatcatctcgtcagagccctatgtgaccagcctgctcaagatgtatgtgcgacggccctatagctgccatgaactctttggttttgacatcatgctagacgaaaacctcaagccctgggtcctggaagtcaacatttccccaagcctccactccagctctccactggatatcagcatcaaaggccagatgattcgtgaccttctgaatctggcaggttttgtcctgcccaatgcagaggatatcatttccagccccagcagctgcagcagctccaccaccagcctgcccacctcccctggggacaaatgtcgaatggctccagagcatgtcactgcacagaagatgaagaaagcctattatctgacccagaaaattcctgatcaggacttctatgcatctgtgctggatgtcctgacaccagatgatgttcggattctggttgagatggaagatgagttttctcgccgtggtcagtttgaacgaatttttccttctcatatctcctctcgctatctccgcttttttgagcagccacgatatttcaacattctcaccacccaatgggaacagaaataccatggcaacaagcttaaaggagtagatctgctccggagttggtgctacaaagggttccacatgggagttgtctctgattctgctccagtgtggtctctcccgacatcacttctgactatctcaaaggatgacgtgatactcaatgccttcagcaaatcagagactagcaagctgggaaaacaaagctcctgtgaggttagcctactactctctgaagacgggaccacgcccaaatccaagaagactcaagctggcctttccccttatccccagaaacccagttcctcaaaggacagtgaggacaccagcaaagagcccagcctttctacccagacgttacctgtgatcaagtgctctgggcagacttcaagactttctgcttcctccactttccagtcaatcagtgactccctcctggctgtgagcccataactggcctctctccaaaagcctctgcccaggagcatgggcatcagctacctcacgggaaccagcctgctgttcagaccagtctgaccccctacccctttcaccctgtccctcctcagagtattttttgaagtggttgcattatagagatgggtatttgtagggccggagggatggtagtgatggggagaaggtgaggaagggtcaccctctgtcacctgtctgcctggctggcacctcatatctcagcagagaagccagtggtggccacgcagccttataaagcaggttttggtttctaccttaagtgagccatgtgtggtttgtctgggggccctggtgtggttgctgagttgtagctcaagaggagaaaacatacagaacatatttggaccggaaatcctttgttctgaatttgagggggtcttctgaggtccttacttccttaggtctttcctcacccctctcccaccgctgtcctgaggagaaacccttgaacttcctcagtagacaggcggagaggccacaacatgccgaacccatttcctgtcatcctagtcttgggtcttcaccgcctccttccaaatacccaccctgccagcagccctaggtcttcctgttctgaccccccatcactgctcgttcagccttctagatgtctctctcgtggacatctgttctttagctgttggctttctctgaggtgtgagagggtctatgaactttgtgaatttcccatggccccagtgaaggagcccagataatcccagtagctgttacctgtctccatgtatcaaaggacacagtccagggggagggtggaaggagatgtggtttctctatagtgcaacaaacatggtttctcaatgttctgctgtgcagcaagcagggtctggcggcttggtaggtgggtttcaggagcagtcactattgtaggatgggcttccaatcaaacctcagactaaactcttgtactgaactgattctacctccctcctctagactcagtaaacagtgactattcaataaa

SEQ ID NO: 195947 - DNA, 4967 bp, Homo sapiens
  Payload ID: 18663
  Gene Name: tubulin tyrosine ligase-like family member 4
  Uniprot ID: Q14679
  ENST ID: ENST00000392102
  CDS Start-End: 341-3940
gcggtgtgtggcaggcggcagcggcgctggcggccgagtgcgcttgtcacgcgtggcggtgcgtggttgctaggggcgcctgaggctgccgggtagcccagcaggccgagggaggaagtagcgtggagccggtgccgagccggggcgaagctggatcccctagatagactgtcttcaagctcactgatattttcctctgcttgatccattgtgctgttgagagcctctagtaaatttttcagactgacagacttcaaggatgcagctgctactaccggaggtgtgtggcaccttacctcagcaaggccatgagaccgtgtggccatgatgtgggcccctcatggcctcagcaggaacacagcactatagtattggcctccgccagaaaaacagcttcaagcagagtggtccctcaggcacagtacctgccacgccacctgagaaaccctcggagggcagagtctggcctcaggcccatcagcaagtgaagccaatctggaagctggaaaagaagcaagtggagacactgtcagcagggttgggcccaggcctcttgggcgtcccaccccagccagcatatttcttttgccccagcactttatgtagctctgggaccacggctgtcattgcaggccacagcagttcctgttacctacactctctcccggacttgttcaacagcaccctgctataccgccgctccagctataggcaaaaaccgtaccagcaactggagtctttctgcttgcgttcgagcccgtcagaaaaaagccctttttctctccctcaaaagagcctccctgtcagtctcactgccaacaaggccacttcttccatggtcttctccatggcccagcccatggcctcctcatccacagaaccatacctctgcttggcagcggctggggaaaacccttcagggaagagcctggcctctgccatctcagggaagatcccatctccactctcttcctcctataagcccatgctgaataataattccttcatgtggccaaatagcacgccagtgcctttattgcagaccacacagggcctgaagccagtatcgccacccaagatccagcctgtctcctggcatcattcagggggtactggagactgtgcaccgcagcctgttgaccataaggtgcccaaaagcattggcactgtcccagctgatgccagtgcccatatcgccttgtctaccgctagctcccacgacacatccaccaccagtgttgcctcttcctggtataaccggaataacttagccatgagggcagagccactttcctgtgctctggatgacagctctgattcccaggatccaactaaggagattcggttcactgaggccgtgaggaaattgaccgcaagaggctttgagaagatgccgaggcaaggctgccagcttgaacagtctagtttcctgaaccccagcttccagtggaatgtcctcaacaggagcaggcggtggaaacctcctgcggtaaatcagcagtttcctcaggaggatgctggatcggtcaggcgggtcctccctggtgcctcagataccttggggttggacaatacagtcttctgtaccaagcgtatcagcattcacctccttgcctcacatgccagtgggctcaatcacaaccctgcctgtgaatctgtaattgactcctcagcatttggagaaggcaaagctccaggtcccccttttcctcaaactcttggcatagccaacgtggccacccgcctctcttccatccagctgggccagtctgagaaggagagacctgaggaggccagggagctggactcatctgatagggatattagttcagctactgacctccagccagatcaggctgagactgaagatacagaagaagaactagtagatggtttggaagactgttgtagccgtgatgagaatgaagaggaggagggagactcagagtgctcctcattaagtgctgtctcccccagcgaatcggtggccatgatctctagaagctgtatggaaattctgaccaaacccctttccaatcatgagaaagttgtccgaccagccctcatctacagtctctttcccaacgttccccctaccatctattttggcactcgggatgagagagtggagaaacttccctgggaacagaggaagttgctccgatggaagatgagcacagtgacccccaacattgtcaagcagaccattggacggtcccacttcaaaatcagcaaaagaaacgatgactggctgggctgctggggtcaccacatgaagtctcctagtttccgatccattcgagagcatcagaagctaaaccatttcccaggctcattccagattgggaggaaggaccggctatggcggaacctgtcacgtatgcagagccgctttggcaagaaggagttcagtttcttcccccagtcctttatcctgccccaggacgccaagctcctgcgcaaagcgtgggagagcagcagccgccaaaagtggattgtgaagccaccagcatcagctcgaggcattggcatccaggttattcacaagtggagtcagctccccaagcgaaggcccctcctggtacagaggtatctacacaaaccctacctcatcagcggcagcaagtttgacctgcggatctatgtttatgtcacttcctacgatcctctgcggatttacctcttttcagatggactggtccgctttgccagttgcaagtattcgccttccatgaagagccttggcaataagttcatgcacctgaccaactacagtgtcaataaaaagaatgccgagtaccaggccaatgcagatgaaatggcttgccagggccacaaatgggcactgaaggctttgtggaactacctgagccagaagggagtcaatagcgacgccatctgggagaagataaaggatgttgttgtcaaaactatcatctcgtcagagccctatgtgaccagcctgctcaagatgtatgtgcgacggccctatagctgccatgaactctttggttttgacatcatgctagacgaaaacctcaagccctgggtcctggaagtcaacatttccccaagcctccactccagctctccactggatatcagcatcaaaggccagatgattcgtgaccttctgaatctggcaggttttgtcctgcccaatgcagaggatatcatttccagccccagcagctgcagcagctccaccaccagcctgcccacctcccctggggacaaatgtcgaatggctccagagcatgtcactgcacagaagatgaagaaagcctattatctgacccagaaaattcctgatcaggacttctatgcatctgtgctggatgtcctgacaccagatgatgttcggattctggttgagatggaagatgagttttctcgccgtggtcagtttgaacgaatttttccttctcatatctcctctcgctatctccgcttttttgagcagccacgatatttcaacattctcaccacccaatgggaacagaaataccatggcaacaagcttaaaggagtagatctgctccggagttggtgctacaaagggttccacatgggagttgtctctgattctgctccagtgtggtctctcccgacatcacttctgactatctcaaaggatgacgtgatactcaatgccttcagcaaatcagagactagcaagctgggaaaacaaagctcctgtgaggttagcctactactctctgaagacgggaccacgcccaaatccaagaagactcaagctggcctttccccttatccccagaaacccagttcctcaaaggacagtgaggacaccagcaaagagcccagcctttctacccagacgttacctgtgatcaagtgctctgggcagacttcaagactttctgcttcctccactttccagtcaatcagtgactccctcctggctgtgagcccataactggcctctctccaaaagcctctgcccaggagcatgggcatcagctacctcacgggaaccagcctgctgttcagaccagtctgaccccctacccctttcaccctgtccctcctcagagtattttttgaagtggttgcattatagagatgggtatttgtagggccggagggatggtagtgatggggagaaggtgaggaagggtcaccctctgtcacctgtctgcctggctggcacctcatatctcagcagagaagccagtggtggccacgcagccttataaagcaggttttggtttctaccttaagtgagccatgtgtggtttgtctgggggccctggtgtggttgctgagttgtagctcaagaggagaaaacatacagaacatatttggaccggaaatcctttgttctgaatttgagggggtcttctgaggtccttacttccttaggtctttcctcacccctctcccaccgctgtcctgaggagaaacccttgaacttcctcagtagacaggcggagaggccacaacatgccgaacccatttcctgtcatcctagtcttgggtcttcaccgcctccttccaaatacccaccctgccagcagccctaggtcttcctgttctgaccccccatcactgctcgttcagccttctagatgtctctctcgtggacatctgttctttagctgttggctttctctgaggtgtgagagggtctatgaactttgtgaatttcccatggccccagtgaaggagcccagataatcccagtagctgttacctgtctccatgtatcaaaggacacagtccagggggagggtggaaggagatgtggtttctctatagtgcaacaaacatggtttctcaatgttctgctgtgcagcaagcagggtctggcggcttggtaggtgggtttcaggagcagtcactattgtaggatgggcttccaatcaaacctcagactaaactcttgtactgaactgattctacctccctcctctagactcagtaaacagtgactattcaataaa

SEQ ID NO: 195948 - DNA, 747 bp, Homo sapiens
  Payload ID: 18663
  Gene Name: tubulin tyrosine ligase-like family member 4
  ENST ID: ENST00000437755
  CDS Start-End: 225-747
gtgcgcttgtcacgcgtggcggtgcgtggttgctaggggcgcctgaggctgccgggtagcccagcaggccgagggaggaagtagcgtggagccggtgccgagccggggcgaagctggatcccctagactgacagacttcaaggatgcagctgctactaccggaggtgtgtggcaccttacctcagcaaggccatgagaccgtgtggccatgatgtgggcccctcatggcctcagcaggaacacagcactatagtattggcctccgccagaaaaacagcttcaagcagagtggtccctcaggcacagtacctgccacgccacctgagaaaccctcggagggcagagtctggcctcaggcccatcagcaagtgaagccaatctggaagctggaaaagaagcaagtggagacactgtcagcagggttgggcccaggcctcttgggcgtcccaccccagccagcatatttcttttgccccagcactttatgtagctctgggaccacggctgtcattgcaggccacagcagttcctgttacctacactctctcccggacttgttcaacagcaccctgctataccgccgctccagctataggcaaaaaccgtaccagcaactggagtctttctgcttgcgttcgagcccgtcagaaaaaagccctttttctctccctcaaaagagcctccctgtcagtctcactgccaacaaggccacttcttccatggtcttctccatggcccagcccatgg

SEQ ID NO: 195949 - DNA, 583 bp, Homo sapiens
  Payload ID: 18663
  Gene Name: tubulin tyrosine ligase-like family member 4
  ENST ID: ENST00000448224
  CDS Start-End: 1-583
ggaggaaggaccggctatggcggaacctgtcacgtatgcagagccgctttggcaagaaggagttcagtttcttcccccagtcctttatcctgccccaggacgccaagctcctgcgcaaagcgtgggagagcagcagccgccaaaagtggattgtgaagccaccagcatcagctcgaggcattggcatccaggttattcacaagtggagtcagctccccaagcgaaggcccctcctggtacagaggtatctacacaaaccctacctcatcagcggcagcaagtttgacctgcggatctatgtttatgtcacttcctacgatcctctgcggatttacctcttttcagatggactggtccgctttgccagttgcaaggcactgaaggctttgtggaactacctgagccagaagggagtcaatagcgacgccatctgggagaagataaaggatgttgttgtcaaaactatcatctcgtcagagccctatgtgaccagcctgctcaagatgtatgtgcgacggccctatagctgccatgaactctttggttttgacatcatgctagacgaaaacctcaagccctgggt

SEQ ID NO: 195950 - DNA, 3723 bp, Homo sapiens
  Payload ID: 18663
  Gene Name: tubulin tyrosine ligase-like family member 4
  ENST ID: ENST00000457313
  CDS Start-End: 412-3333
agactctcggtctgtccgctgggggcgcgcgcggtgtgtggcaggcggcagcggcgctggcggccgagtgcgcttgtcacgcgtggcggtgcgtggttgctaggggcgcctgaggctgccgggtagcccagcaggccgagggaggaaccagcatatttcttttgccccagcactttatgtagctctgggaccacggctgtcattgcaggccacagcagttcctgttacctacactctctcccggacttgttcaacagcaccctgctataccgccgctccagctataggcaaaaaccgtaccagcaactggagtctttctgcttgcgttcgagcccgtcagaaaaaagccctttttctctccctcaaaagagcctccctgtcagtctcactgccaacaaggccacttcttccatggtcttctccatggcccagcccatggcctcctcatccacagaaccatacctctgcttggcagcggctggggaaaacccttcagggaagagcctggcctctgccatctcagggaagatcccatctccactctcttcctcctataagcccatgctgaataataattccttcatgtggccaaatagcacgccagtgcctttattgcagaccacacagggcctgaagccagtatcgccacccaagatccagcctgtctcctggcatcattcagggggtactggagactgtgcaccgcagcctgttgaccataaggtgcccaaaagcattggcactgtcccagctgatgccagtgcccatatcgccttgtctaccgctagctcccacgacacatccaccaccagtgttgcctcttcctggtataaccggaataacttagccatgagggcagagccactttcctgtgctctggatgacagctctgattcccaggatccaactaaggagattcggttcactgaggccgtgaggaaattgaccgcaagaggctttgagaagatgccgaggcaaggctgccagcttgaacagtctagtttcctgaaccccagcttccagtggaatgtcctcaacaggagcaggcggtggaaacctcctgcggtaaatcagcagtttcctcaggaggatgctggatcggtcaggcgggtcctccctggtgcctcagataccttggggttggacaatacagtcttctgtaccaagcgtatcagcattcacctccttgcctcacatgccagtgggctcaatcacaaccctgcctgtgaatctgtaattgactcctcagcatttggagaaggcaaagctccaggtcccccttttcctcaaactcttggcatagccaacgtggccacccgcctctcttccatccagctgggccagtctgagaaggagagacctgaggaggccagggagctggactcatctgatagggatattagttcagctactgacctccagccagatcaggctgagactgaagatacagaagaagaactagtagatggtttggaagactgttgtagccgtgatgagaatgaagaggaggagggagactcagagtgctcctcattaagtgctgtctcccccagcgaatcggtggccatgatctctagaagctgtatggaaattctgaccaaacccctttccaatcatgagaaagttgtccgaccagccctcatctacagtctctttcccaacgttccccctaccatctattttggcactcgggatgagagagtggagaaacttccctgggaacagaggaagttgctccgatggaagatgagcacagtgacccccaacattgtcaagcagaccattggacggtcccacttcaaaatcagcaaaagaaacgatgactggctgggctgctggggtcaccacatgaagtctcctagtttccgatccattcgagagcatcagaagctaaaccatttcccaggctcattccagattgggaggaaggaccggctatggcggaacctgtcacgtatgcagagccgctttggcaagaaggagttcagtttcttcccccagtcctttatcctgccccaggacgccaagctcctgcgcaaagcgtgggagagcagcagccgccaaaagtggattgtgaagccaccagcatcagctcgaggcattggcatccaggttattcacaagtggagtcagctccccaagcgaaggcccctcctggtacagaggtatctacacaaaccctacctcatcagcggcagcaagtttgacctgcggatctatgtttatgtcacttcctacgatcctctgcggatttacctcttttcagatggactggtccgctttgccagttgcaagtattcgccttccatgaagagccttggcaataagttcatgcacctgaccaactacagtgtcaataaaaagaatgccgagtaccaggccaatgcagatgaaatggcttgccagggccacaaatgggcactgaaggctttgtggaactacctgagccagaagggagtcaatagcgacgccatctgggagaagataaaggatgttgttgtcaaaactatcatctcgtcagagccctatgtgaccagcctgctcaagatgtatgtgcgacggccctatagctgccatgaactctttggttttgacatcatgctagacgaaaacctcaagccctgggtcctggaagtcaacatttccccaagcctccactccagctctccactggatatcagcatcaaaggccagatgattcgtgaccttctgaatctggcaggttttgtcctgcccaatgcagaggatatcatttccagccccagcagctgcagcagctccaccaccagcctgcccacctcccctggggacaaatgtcgaatggctccagagcatgtcactgcacagaagatgaagaaagcctattatctgacccagaaaattcctgatcaggacttctatgcatctgtgctggatgtcctgacaccagatgatgttcggattctggttgagatggaagatgagttttctcgccgtggtcagtttgaacgaatttttccttctcatatctcctctcgctatctccgcttttttgagcagccacgatatttcaacattctcaccacccaatgggaacagaaataccatggcaacaagcttaaaggagtagatctgctccggagttggtgctacaaagggttccacatgggagttgtctctgattctgctccagtgtggtctctcccgacatcacttctgactatctcaaaggatgacgtgatactcaatgccttcagcaaatcagagactagcaagctgggaaacccagttcctcaaaggacagtgaggacaccagcaaagagcccagcctttctacccagacgttacctgtgatcaagtgctctgggcagacttcaagactttctgcttcctccactttccagtcaatcagtgactccctcctggctgtgagcccataactggcctctctccaaaagcctctgcccaggagcatgggcatcagctacctcacgggaaccagcctgctgttcagaccagtctgaccccctacccctttcaccctgtccctcctcagagtattttttgaagtggttgcattatagagatgggtatttgtagggccggagggatggtagtgatggggagaaggtgaggaagggtcaccctctgtcacctgtctgcctggctggcacctcatatctcagcagagaagccagtggtggccacgcagccttataaagcaggttttggtttctaccttaa

SEQ ID NO: 195951 - DNA, 3971 bp, Homo sapiens
  Payload ID: 18663
  Gene Name: tubulin tyrosine ligase-like family member 4
  ENST ID: ENST00000442769
  CDS Start-End: 260-3667
gaggctgccgggtagcccagcaggccgagggaggaagtagcgtggagccggtgccgagccggggcgaagctggatcccctagatagactgtcttcaagctcactgatattttcctctgcttgatccattgtgctgttgagagcctctagtaaatttttcagactgacagacttcaaggatgcagctgctactaccggaggtgtgtggcaccttacctcagcaaggccatgagaccgtgtggccatgatgtgggcccctcatggcctcagcaggaacacagcactatagtattggcctccgccagaaaaacagcttcaagcagagtggtccctcaggcacagtacctgccacgccacctgagaaaccctcggagggcagagtctggcctcaggcccatcagcaagtgaagccaatctggaagctggaaaagaagcaagtggagacactgtcagcagggttgggcccaggcctcttgggcgtcccaccccagccagcatatttcttttgccccagcactttatgtagctctgggaccacggctgtcattgcaggccacagcagttcctgttacctacactctctcccggacttgttcaacagcaccctgctataccgccgctccagctataggcaaaaaccgtaccagcaactggagtctttctgcttgcgttcgagcccgtcagaaaaaagccctttttctctccctcaaaagagcctccctgtcagtctcactgccaacaaggccacttcttccatggtcttctccatggcccagcccatggcctcctcatccacagaaccatacctctgcttggcagcggctggggaaaacccttcagggaagagcctggcctctgccatctcagggaagatcccatctccactctcttcctcctataagcccatgctgaataataattccttcatgtggccaaatagcacgccagtgcctttattgcagaccacacagggcctgaagccagtatcgccacccaagatccagcctgtctcctggcatcattcagggggtactggagactgtgcaccgcagcctgttgaccataaggtgcccaaaagcattggcactgtcccagctgatgccagtgcccatatcgccttgtctaccgctagctcccacgacacatccaccaccagtgttgcctcttcctggtataaccggaataacttagccatgagggcagagccactttcctgtgctctggatgacagctctgattcccaggatccaactaaggagattcggttcactgaggccgtgaggaaattgaccgcaagaggctttgagaagatgccgaggcaaggctgccagcttgaacagtctagtttcctgaaccccagcttccagtggaatgtcctcaacaggagcaggcggtggaaacctcctgcggtaaatcagcagtttcctcaggaggatgctggatcggtcaggcgggtcctccctggtgcctcagataccttggggttggacaatacagtcttctgtaccaagcgtatcagcattcacctccttgcctcacatgccagtgggctcaatcacaaccctgcctgtgaatctgtaattgactcctcagcatttggagaaggcaaagctccaggtcccccttttcctcaaactcttggcatagccaacgtggccacccgcctctcttccatccagctgggccagtctgagaaggagagacctgaggaggccagggagctggactcatctgatagggatattagttcagctactgacctccagccagatcaggctgagactgaagatacagaagaagaactagtagatggtttggaagactgttgtagccgtgatgagaatgaagaggaggagggagactcagagtgctcctcattaagtgctgtctcccccagcgaatcggtggccatgatctctagaagctgtatggaaattctgaccaaacccctttccaatcatgagaaagttgtccgaccagccctcatctacagtctctttcccaacgttccccctaccatctattttggcactcgggatgagagagtggagaaacttccctgggaacagaggaagttgctccgatggaagatgagcacagtgacccccaacattgtcaagcagaccattggacggtcccacttcaaaatcagcaaaagaaacgatgactggctgggctgctggggtcaccacatgaagtctcctagtttccgatccattcgagagcatcagaagccagcatcagctcgaggcattggcatccaggttattcacaagtggagtcagctccccaagcgaaggcccctcctggtacagaggtatctacacaaaccctacctcatcagcggcagcaagtttgacctgcggatctatgtttatgtcacttcctacgatcctctgcggatttacctcttttcagatggactggtccgctttgccagttgcaagtattcgccttccatgaagagccttggcaataagttcatgcacctgaccaactacagtgtcaataaaaagaatgccgagtaccaggccaatgcagatgaaatggcttgccagggccacaaatgggcactgaaggctttgtggaactacctgagccagaagggagtcaatagcgacgccatctgggagaagataaaggatgttgttgtcaaaactatcatctcgtcagagccctatgtgaccagcctgctcaagatgtatgtgcgacggccctatagctgccatgaactctttggttttgacatcatgctagacgaaaacctcaagccctgggtcctggaagtcaacatttccccaagcctccactccagctctccactggatatcagcatcaaaggccagatgattcgtgaccttctgaatctggcaggttttgtcctgcccaatgcagaggatatcatttccagccccagcagctgcagcagctccaccaccagcctgcccacctcccctggggacaaatgtcgaatggctccagagcatgtcactgcacagaagatgaagaaagcctattatctgacccagaaaattcctgatcaggacttctatgcatctgtgctggatgtcctgacaccagatgatgttcggattctggttgagatggaagatgagttttctcgccgtggtcagtttgaacgaatttttccttctcatatctcctctcgctatctccgcttttttgagcagccacgatatttcaacattctcaccacccaatgggaacagaaataccatggcaacaagcttaaaggagtagatctgctccggagttggtgctacaaagggttccacatgggagttgtctctgattctgctccagtgtggtctctcccgacatcacttctgactatctcaaaggatgacgtgatactcaatgccttcagcaaatcagagactagcaagctgggaaaacaaagctcctgtgaggttagcctactactctctgaagacgggaccacgcccaaatccaagaagactcaagctggcctttccccttatccccagaaacccagttcctcaaaggacagtgaggacaccagcaaagagcccagcctttctacccagacgttacctgtgatcaagtgctctgggcagacttcaagactttctgcttcctccactttccagtcaatcagtgactccctcctggctgtgagcccataactggcctctctccaaaagcctctgcccaggagcatgggcatcagctacctcacgggaaccagcctgctgttcagaccagtctgaccccctacccctttcaccctgtccctcctcagagtattttttgaagtggttgcattatagagatgggtatttgtagggccggagggatggtagtgatggggagaaggtgaggaagggtcaccctctgtcacctgtctgcctggctggcacctcatatctcagcagagaagccagtggtggccacgcagccttataaagcaggttttggtttctaccttaa

SEQ ID NO: 195952 - DNA, 601 bp, Homo sapiens
  Payload ID: 18663
  Gene Name: tubulin tyrosine ligase-like family member 4
  ENST ID: ENST00000417855
  CDS Start-End: 1-488
ctgcacagaagatgaagaaagcctattatctgacccagaaaattcctgatcaggacttctatgcatctgtgctggatgtcctgacaccagatgatgttcggattctggttgagatggaagatgagttttctcgccgtggtcagtttgaacgaatttttccttctcatatctcctctcgctatctccgcttttttgagcagccacgatatttcaacattctcaccacccaatgggaacagaaataccatggcaacaagcttaaagatctgctccggagttggtgctacaaagggttccacatgggagttgtctctgattctgctccagtgtggtctctcccgacatcacttctgactatctcaaaggatgacgtgatactcaatgccttcagcaaatcagagactagcaagctgggaaacccagttcctcaaaggacagtgaggacaccagcaaagagcccagcctttctacccagacgttacctgtgatcaagtgctctgggcagacttcaagactttctgcttcctccactttccagtcaatcagtgactccctcctggctgtgagcccataactggcctctctccaaaagcctctgccc

SEQ ID NO: 195953 - DNA, 588 bp, Homo sapiens
  Payload ID: 18663
  Gene Name: tubulin tyrosine ligase-like family member 4
  ENST ID: ENST00000424644
  CDS Start-End: 287-588
agcgtggagccggtgccgagccggggcgaagctggatcccctagatagactgtcttcaagctcactgatattttcctctgcttgatccattgtgctgttgagagcctctagtaaatttttcagatgctgccatgaaagcaggcccacctttccttactggagaatattttgtgaatttgatttagaaaactgacagacttcaaggatgcagctgctactaccggaggtgtgtggcaccttacctcagcaaggccatgagaccgtgtggccatgatgtgggcccctcatggcctcagcaggaacacagcactatagtattggcctccgccagaaaaacagcttcaagcagagtggtccctcaggcacagtacctgccacgccacctgagaaaccctcggagggcagagtctggcctcaggcccatcagcaagtgaagccaatctggaagctggaaaagaagcaagtggagacactgtcagcagggttgggcccaggcctcttgggcgtcccaccccagccagcatatttcttttgccccagcactttatgtagctctgggaccacggctgtcattgcaggccacagcag

SEQ ID NO: 195954 - DNA, 476 bp, Homo sapiens
  Payload ID: 18663
  Gene Name: tubulin tyrosine ligase-like family member 4
  ENST ID: ENST00000434241
  CDS Start-End: 1-302
gaaacgatgactggctgggctgctggggtcaccacatgaagtctcctagtttccgatccattcgagagcatcagaagctaaaccatttcccaggctcattccagattgggaggaaggaccggctatggcggaacctgtcacgtatgcagagccgctttggcaagaaggagttcagtttcttcccccagtcctttatcctgccccaggacgccaagctcctgcgcaaagcgtgggagagcagcagccgccaaaagtggattgtgaagccagtattcgccttccatgaagagccttggcaataagttcatgcacctgaccaactacagtgtcaataaaaagaatgccgagtaccaggccaatgcagatgaaatggcttgccagggccacaaatgggcactgaaggctttgtggaactacctgagccagaagggagtcaatagcgacgccatctgggagaagataaaggatgttgttgt

SEQ ID NO: 195955 - DNA, 712 bp, Homo sapiens
  Payload ID: 18663
  Gene Name: tubulin tyrosine ligase-like family member 4
  ENST ID: ENST00000415717
  CDS Start-End: 410-712
tctcggtctgtccgctgggggcgcgcgcggtgtgtggcaggcggcagcggcgctggcggccgagtgcgcttgtcacgcgtggcggtgcgtggttgctaggggcgcctgaggctgccgggtagcccagcaggccgagggaggaagtagcgtggagccggtgccgagccggggcgaagctggatcccctagatagactgtcttcaagctcactgatattttcctctgcttgatccattgtgctgttgagagcctctagtaaatttttcaggtcactacctctttttcaacactagatggcatcttggccccagactgacagacttcaaggatgcagctgctactaccggaggtgtgtggcaccttacctcagcaaggccatgagaccgtgtggccatgatgtgggcccctcatggcctcagcaggaacacagcactatagtattggcctccgccagaaaaacagcttcaagcagagtggtccctcaggcacagtacctgccacgccacctgagaaaccctcggagggcagagtctggcctcaggcccatcagcaagtgaagccaatctggaagctggaaaagaagcaagtggagacactgtcagcagggttgggcccaggcctcttgggcgtcccaccccagccagcatatttcttttgccccagcactttatgtagctctgggaccacggctgtcattgcaggccacagcagt

SEQ ID NO: 195956 - DNA, 811 bp, Homo sapiens
  Payload ID: 18663
  Gene Name: tubulin tyrosine ligase-like family member 4
  ENST ID: ENST00000417196
  CDS Start-End: 1-539
tggaaattctgaccaaacccctttccaatcatgagaaagttgtccgaccagccctcatctacagtctctttcccaacgttccccctaccatctattttggcactcgggatgagagagtggagaaacttccctgggaacagaggaagttgctccgatggaagatgagcacagtgacccccaacattgtcaagcagaccattggacggtcccacttcaaaatcagcaaaagaaacgatgactggctgggctgctggggtcaccacatgaagtctcctagtttccgatccattcgagagcatcagaagctaaaccatttcccaggctcattccagattgggaggaaggaccggctatggcggaacctgtcacgtatgcagagccgctttggcaagaaggagttcagtttcttcccccagtcctttatcctgccccaggacgccaagctcctgcgcaaagcgtgggagagcagcagccgccaaaagtggattgtgaagccagtatctacacaaaccctacctcatcagcggcagcaagtttgacctgcggatctatgtttatgtcacttcctacgatcctctgcggatttacctcttttcagatggactggtccgctttgccagttgcaagtattcgccttccatgaagagccttggcaataagttcatgcacctgaccaactacagtgtcaataaaaagaatgccgagtaccaggccaatgcagatgaaatggcttgccagggccacaaatgggcactgaaggctttgtggaactacctgagccagaagggagtcaatagcgacgccatctggg

SEQ ID NO: 195957 - DNA, 738 bp, Homo sapiens
  Payload ID: 18663
  Gene Name: tubulin tyrosine ligase-like family member 4
  ENST ID: ENST00000436668
  CDS Start-End: 1-738
gataaaggatgttgttgtcaaaactatcatctcgtcagagccctatgtgaccagcctgctcaagatgtatgtgcgacggccctatagctgccatgaactctttggttttgacatcatgctagacgaaaacctcaagccctgggtcctggaagtcaacatttccccaagcctccactccagctctccactggatatcagcatcaaaggccagatgattcgtgaccttctgaatctggcaggttttgtcctgcccaatgcagaggatatcatttccagccccagcagctgcagcagctccaccaccagcctgcccacctcccctggggacaaatgtcgaatggctccagagcatgtcactgcacagaagatgaagaaagcctattatctgacccagaaaattcctgatcaggacttctatgcatctgtgctggatgtcctgacaccagatgatgttcggattctggttgagatggaagatgagttttctcgccgtggagtagatctgctccggagttggtgctacaaagggttccacatgggagttgtctctgattctgctccagtgtggtctctcccgacatcacttctgactatctcaaaggatgacgtgatactcaatgccttcagcaaatcagagactagcaagctgggaaaacaaagctcctgtgaggttagcctactactctctgaagacgggaccacgcccaaatccaagaagactcaagctggcctttcccc

SEQ ID NO: 195958 - DNA, 1595 bp, Homo sapiens
  Payload ID: 18664
  Gene Name: tubulin tyrosine ligase-like family member 5
  Uniprot ID: Q6EMB2
  ENST ID: ENST00000286650
  CDS Start-End: 206-1015
gggaagcagccgtcggcggctgccctgagccttcctggggaaggaggagggaggtaggcgcagagcgcggtccacgcctgctcgccccgaaccatgggaagatgagacaggaatctgtgccatccaaattgcttgatccagtgaatctgctaggaaaggtctctgaggcccccgtctgctgactgcatgacaaaccctaaaggaaatgccaatcgtgatggcccgggacctggaggaaacagcatcatcctcagaggatgaggaggtcataagtcaagaggatcatccatgcatcatgtggactggaggctgcaggagaattccagttttggtattccatgccgacgctattcttacaaaggacaacaatattagagtaattggagaacgttatcatttgtcttataagattgtacgaacggacagtcgcctagtacgcagcattctgacagcccatggatttcatgaagttcacccaagcagcactgactataacctaatgtggacaggatcccacctgaagcccttcttactgcgcaccctctctgaagcacaaaaagttaatcactttcccaggtcttatgaacttacccggaaggaccgactgtacaaaaacattattcgaatgcagcatacacatggattcaaggcttttcacatcctcccccagaccttcctcctgccagctgagtacgcggaattttgtaattcatattcgaaggaccggggaccttggatagtaaaaccagtggcatcttcaagggggcggggcgtctacctgatcaacaatccaaaccagatctccctggaagagaacattttggtctcccgttacattaacaaccccctgctcatagatgatttcaagtttgacgtgcgcctctatgtgctcgtgacttcctatgatcctcttgtcatctatctctatgaagaaggattggctagaaaatgcaattggaagatgggaaataccatggataaaagaaggctacctatttatgtacaggtgctttgacagatattattgtactctgacaactattattttagaatggtcttttaatgattttagagacttagtttttttcacatgtatcctatgacttgaaatcagtgagagcagactaaccaaacctcgctggtggagctctgtgttccgttcgcctctaggtggcagtcacagcatttataagtcctgtcatattcttaactgagattttgagtttgagccctgggaacattggagactaccaaaactccctagttctggcctcttccttgaaaattgagaaagggaagaactgaaacatctcgcagttattagataaagggctggaccaggcatctgaacatgagctgactactagctctaatcaggtttttataggaaagaaattgtcgataatatttgtagacacacgtgctctcacgttttgaagtatcactatacaaaattaggtataaaagcctattcctggccaggcgtggtggctcacacctgtaatcctagcactttgggaggccgagacgggaggattgcctgaggccaggagttcaagaccagtttgggcaacattgtgagaccccatctcatt

SEQ ID NO: 195959 - DNA, 4683 bp, Homo sapiens
  Payload ID: 18664
  Gene Name: tubulin tyrosine ligase-like family member 5
  Uniprot ID: Q6EMB2
  ENST ID: ENST00000298832
  CDS Start-End: 206-4051
gggaagcagccgtcggcggctgccctgagccttcctggggaaggaggagggaggtaggcgcagagcgcggtccacgcctgctcgccccgaaccatgggaagatgagacaggaatctgtgccatccaaattgcttgatccagtgaatctgctaggaaaggtctctgaggcccccgtctgctgactgcatgacaaaccctaaaggaaatgccaatcgtgatggcccgggacctggaggaaacagcatcatcctcagaggatgaggaggtcataagtcaagaggatcatccatgcatcatgtggactggaggctgcaggagaattccagttttggtattccatgccgacgctattcttacaaaggacaacaatattagagtaattggagaacgttatcatttgtcttataagattgtacgaacggacagtcgcctagtacgcagcattctgacagcccatggatttcatgaagttcacccaagcagcactgactataacctaatgtggacaggatcccacctgaagcccttcttactgcgcaccctctctgaagcacaaaaagttaatcactttcccaggtcttatgaacttacccggaaggaccgactgtacaaaaacattattcgaatgcagcatacacatggattcaaggcttttcacatcctcccccagaccttcctcctgccagctgagtacgcggaattttgtaattcatattcgaaggaccggggaccttggatagtaaaaccagtggcatcttcaagggggcggggcgtctacctgatcaacaatccaaaccagatctccctggaagagaacattttggtctcccgttacattaacaaccccctgctcatagatgatttcaagtttgacgtgcgcctctatgtgctcgtgacttcctatgatcctcttgtcatctatctctatgaagaaggattggctaggtttgcaactgtgcgatatgatcaaggagccaagaacattcggaaccagttcatgcatctgacaaactacagtgtcaacaagaaaagtggagattacgtcagttgtgacgatccagaagtggaggattatggaaacaaatggagcatgagtgctatgcttaggtacctgaaacaagaaggcagagatacaaccgcattgatggcccatgtagaagacctgatcattaagactataatctctgctgaactagctattgctactgcctgtaaaacctttgttcctcatcgcagcagttgttttgaactctatggctttgacgtgctcatagattctactctgaagccatggttgttggaagtgaatctctctccttctttggcctgtgatgcgcctctggacctaaagattaaagccagtatgatttcagatatgttcactgttgtaggatttgtgtgccaagatcctgcccagcgggcatcaactcggccaatttatcccacctttgagtcttccaggcgaaaccctttccagaaacctcagcgttgccgtccactctctgccagtgatgcggaaatgaaaaacctcgtgggctcagcccgggagaaagggccagggaagttgggtggttctgtgcttggtctgtcaatggaggagatcaaagttttacgaagggtgaaggaggagaatgatcggcgaggtggatttattcgcatatttcctacatctgagacatgggaaatatatgggtcctacctcgagcataagacctcaatgaactatatgctggcaacacgcctcttccaggacagaatgactgctgatggagcgccagaattgaagatagagagtctgaattcaaaggccaagctgcatgctgcactttacgagaggaagctcctgtctctggaggtgcgaaaacgtagacgacggagtagcagattgagggcaatgaggccaaaatacccagtgattacccaaccagctgaaatgaatgttaaaactgagacagagagtgaagaggaggaagaagtcgcattagataatgaagatgaagaacaggaggcttcccaggaggagtctgcaggatttcttagagaaaatcaagccaaatatacaccctcattgacagctttggtagaaaatacacccaaagaaaattccatgaaagttcgtgaatggaataataaaggtggacactgctgcaaacttgagactcaggagctagagcctaaatttaacctgatgcagattcttcaagataatggcaatcttagcaaaatgcaggcccgaatagcattctctgcctatctccagcatgttcaaattcgcctgatgaaagacagtggcggtcagacgttcagtgccagttgggctgccaaagaggatgaacagatggagctggttgttcgtttcctcaagcgagcatcaaataacctccagcattcactgaggatggtattacccagtcgacgattggcacttctggaacgcagaagaatcctggcccaccagctgggtgactttatcattgtatacaacaaggaaacagaacaaatggctgaaaagaaatcaaagaagaaagttgaggaagaagaggaagatggggtgaatatggaaaactttcaggagttcatcagacaagcaagtgaggctgaactggaggaggtgttgactttttatacccaaaagaacaagtctgctagtgtcttcctggggactcactctaaaatttctaagaacaacaacaattattctgatagtggggcaaaaggtgatcaccctgagactataatggaagaagtgaaaataaagccacctaaacagcaacagacgacagaaattcattctgataaattatctcgatttaccacttcagcagaaaaagaggcaaaattagtttatagcaattcctcctctggtcctactgctactctgcagaaaattcccaacacccatttgtcatctgttacaacctctgacctctctccagggccttgccaccattcttctttatctcaaattccttcagctatccccagcatgcctcaccagccaacaattttactgaacacagtctctgccagtgcttctccctgcctacatcccggggcacagaacatcccaagccctactggcctgccacgctgtcgatcaggaagtcacaccattggtcccttttcttccttccaaagtgctgcacacatctatagccagaaactgtctcgtccctcttcagcaaaggcaggatcgtgctatctaaacaagcatcattcaggaatagccaaaacacaaaaagagggagaagatgcttctttatatagcaaacggtacaaccaaagtatggttacagctgaacttcagcggctagctgagaagcaggcagcgagacagtattctccatccagccacatcaacctcctcacccaacaggtaacaaacctgaatttggcaactggcatcataaacagaagcagtgcttcagctcccccaaccctccgacccatcatcagtcctagtggcccgacatggtctacacagtcagacccccaagctcccgagaatcactccagctctcctggaagcaggagcctgcagacagggggatttgcctgggaaggagaagtagaaaacaacgtgtacagccaggctacaggggtggtcccccagcacaagtatcaccccacagcaggcagctatcagcttcaatttgccctgcagcaacttgaacaacaaaaacttcagtcccggcagctcctggaccagagtcgagcccggcaccaggcaatctttggcagccagacactacctaactccaatttatggacaatgaataatggtgcaggttgtagaatttccagtgccacagctagtggccagaagccaaccactctgccacaaaaagtggtaccacctccaagttcttgcgcctccctggttcccaaacccccacccaaccacgaacaagtgctcagaagggcaacatcccagaaagcttccaaagggtcctccgcggaagggcagctgaatggactccagagcagccttaaccctgcagcctttgtgcccatcaccagctctacagatcctgctcacactaaaatatgaaccacaaacacacagagaaacaacctgttcaccactcctgggtgcatgattgagggtgaagcatccaccagcacttcaaggggtccatagtatttttttttttgctgcctcaaagtccccaaagccttcgagcagaagtggcagtagatggttgccaatcagccaatgcagactttcactgggacaacaagaaagcagatcttctgggttttgatggaacttggcagtggggacattcagctgatgcattatataccccgtcagagcacacttgtatcttttaccttccctttgccccatgcccccaaactgcttaggtcttctctgtccctttactgctgctgcacagagatgatataaaagaggctctttggctatttgcattttgcttcctcttcttttccagattacagtatgaagctttattttctttgtacaagcttaaaatttcaacatcatcatccgccaaagttgttcctcccttttcggaggatctagggggaaagaggagcattcatcacaagtttcctagagagaggagacaaatcggtgtgccattgacaacatgagccagggtaaaggcaccctttggaattactgatttcaaagattaataaagtaattctattttt

SEQ ID NO: 195960 - DNA, 4168 bp, Homo sapiens
  Payload ID: 18664
  Gene Name: tubulin tyrosine ligase-like family member 5
  ENST ID: ENST00000557636
  CDS Start-End: 216-4061
gtagtaaccggggaagcagccgtcggcggctgccctgagccttcctggggaaggaggagggaggtaggcgcagagcgcggtccacgcctgctcgccccgaaccatgggaagatgagacaggaatctgtgccatccaaattgcttgatccagtgaatctgctaggaaaggtctctgaggcccccgtctgctgactgcatgacaaaccctaaaggaaatgccaatcgtgatggcccgggacctggaggaaacagcatcatcctcagaggatgaggaggtcataagtcaagaggatcatccatgcatcatgtggactggaggctgcaggagaattccagttttggtattccatgccgacgctattcttacaaaggacaacaatattagagtaattggagaacgttatcatttgtcttataagattgtacgaacggacagtcgcctagtacgcagcattctgacagcccatggatttcatgaagttcacccaagcagcactgactataacctaatgtggacaggatcccacctgaagcccttcttactgcgcaccctctctgaagcacaaaaagttaatcactttcccaggtcttatgaacttacccggaaggaccgactgtacaaaaacattattcgaatgcagcatacacatggattcaaggcttttcacatcctcccccagaccttcctcctgccagctgagtacgcggaattttgtaattcatattcgaaggaccggggaccttggatagtaaaaccagtggcatcttcaagggggcggggcgtctacctgatcaacaatccaaaccagatctccctggaagagaacattttggtctcccgttacattaacaaccccctgctcatagatgatttcaagtttgacgtgcgcctctatgtgctcgtgacttcctatgatcctcttgtcatctatctctatgaagaaggattggctaggtttgcaactgtgcgatatgatcaaggagccaagaacattcggaaccagttcatgcatctgacaaactacagtgtcaacaagaaaagtggagattacgtcagttgtgacgatccagaagtggaggattatggaaacaaatggagcatgagtgctatgcttaggtacctgaaacaagaaggcagagatacaaccgcattgatggcccatgtagaagacctgatcattaagactataatctctgctgaactagctattgctactgcctgtaaaacctttgttcctcatcgcagcagttgttttgaactctatggctttgacgtgctcatagattctactctgaagccatggttgttggaagtgaatctctctccttctttggcctgtgatgcgcctctggacctaaagattaaagccagtatgatttcagatatgttcactgttgtaggatttgtgtgccaagatcctgcccagcgggcatcaactcggccaatttatcccacctttgagtcttccaggcgaaaccctttccagaaacctcagcgtccagtatctgcacagtttcagtcgtcaaaggccaagcagcgttgccgtccactctctgccagtgatgcggaaatgaaaaacctcgtgggctcagcccgggagaaagggccagggaagttgggtggttctgtgcttggtctgtcaatggaggagatcaaagttttacgaagggtgaaggaggagaatgatcggcgaggtggatttattcgcatatttcctacatctgagacatgggaaatatatgggtcctacctcgagcataagacctcaatgaactatatgctggcaacacgcctcttccaggacagaatgactgctgatggagcgccagaattgaagatagagagtctgaattcaaaggccaagctgcatgctgcactttacgagaggaagctcctgtctctggaggtgcgaaaacgtagacgacggagtagcagattgagggcaatgaggccaaaatacccagtgattacccaaccagctgaaatgaatgttaaaactgagacagagagtgaagaggaggaagaagtcgcattagataatgaagatgaagaacaggaggcttcccaggaggagtctgcaggatttcttagagaaaatcaagccaaatatacaccctcattgacagctttggtagaaaatacacccaaagaaaattccatgaaagttcgtgaatggaataataaaggtggacactgctgcaaacttgagactcaggagctagagcctaaatttaacctgatgcagattcttcaagataatggcaatcttagcaaaatgcaggcccgaatagcattctctgcctatctccagcatgttcaaattcgcctgatgaaagacagtggcggtcagacgttcagtgccagttgggctgccaaagaggatgaacagatggagctggttgttcgtttcctcaagcgagcatcaaataacctccagcattcactgaggatggtattacccagtcgacgattggcacttctggaacgcagaagaatcctggcccaccagctgggtgactttatcattgtatacaacaaggaaacagaacaaatggctgaaaagaaatcaaagaagaaagttgaggaagaagaggaagatggggtgaatatggaaaactttcaggagttcatcagacaagcaagtgaggctgaactggaggaggtgttgactttttatacccaaaagaacaagtctgctagtgtcttcctggggactcactctaaaatttctaagaacaacaacaattattctgatagtggggcaaaaggtgatcaccctgagactataatggaagaagtgaaaataaagccacctaaacagcaacagacgacagaaattcattctgataaattatctcgatttaccacttcagcagaaaaagaggcaaaattagtttatagcaattcctcctctggtcctactgctactctgcagaaaattcccaacacccatttgtcatctgttacaacctctgacctctctccagggccttgccaccattcttctttatctcaaattccttcagctatccccagcatgcctcaccagccaacaattttactgaacacagtctctgccagtgcttctccctgcctacatcccggggcacagaacatcccaagccctactggcctgccacgctgtcgatcaggaagtcacaccattggtcccttttcttccttccaaagtgctgcacacatctatagccagaaactgtctcgtccctcttcagcaaaggcagcaggatcgtgctatctaaacaagcatcattcaggaatagccaaaacacaaaaagagggagaagatgcttctttatatagcaaacggtacaaccaaagtatggttacagctgaacttcagcggctagctgagaagcaggcagcgagacagtattctccatccagccacatcaacctcctcacccaacaggtaacaaacctgaatttggcaactggcatcataaacagaagcagtgcttcagctcccccaaccctccgacccatcatcagtcctagtggcccgacatggtctacacagtcagacccccaagctcccgagaatcactccagctctcctggaagcaggagcctgcagacagggggatttgcctgggaaggagaagtagaaaacaacgtgtacagccaggctacaggggtggtcccccagcacaagtatcaccccacagcaggcagctatcagcttcaatttgccctgcagcaacttgaacaacaaaaacttcagtcccggcagctcctggaccagagtcgagcccggcaccaggcaatctttggcagccagacactacctaactccaatttatggacaatgaataatggtgcaggttgtagaatttccagtgccacagctagtggccagaagccaaccactctgccacaaaaagtggtaccacctccaagttcttgcgcctccctggttcccaaacccccacccaaccacgaacaagtgctcagaagggcaacatcccagaaagcttccaatacccgcttcagatcctcctttcaaaactatttgtggtatttcttccaagcagtcagctgaactgaggacgacagcctacaaacaactacatgcatctgaactgtctcttgtaaatgagcttttttcagagccagaatcatactctccaggaaatatggagaaagaaa

SEQ ID NO: 195961 - DNA, 1961 bp, Homo sapiens
  Payload ID: 18664
  Gene Name: tubulin tyrosine ligase-like family member 5
  ENST ID: ENST00000556977
  CDS Start-End: 260-634
cgcctgcgcagtggctccgagcgggcggttgcttgttggttgttgtagtaaccggggaagcagccgtcggcggctgccctgagccttcctggggaaggaggagggaggtaggcgcagagcgcggtccacgcctgctcgccccgaaccatgggaagatgagacaggaatctgtgccatccaaattgcttgatccagtgaatctgctaggaaaggtctctgaggcccccgtctgctgactgcatgacaaaccctaaaggaaatgccaatcgtgatggcccgggacctggaggaaacagcatcatcctcagaggatgaggaggtcataagtcaagaggatcatccatgcatcatgtggactggaggctgcaggagaattccagttttggtattccatgccgacgctattcttacaaaggacaacaatattagagtaattggagaacgttatcatttgtcttataagattgtacgaacggacagtcgcctagtacgcagcattctgacagcccatggatttcatgaagttcacccaagcagcactgactataacctaatgtggacaggatcccacctgaagcccttcttactgcgcaccctctctgaagcacaaaaagttaatcactttcccaggtaatgctctttgtagctgctttgcttcatttaaaggtacatgacattggggcatgtagccagcaaaggtaattagtgtccttaaagaagaggaagatgaaaatgaagaagaagaaggacttttttttttttttttgagatgagtatcgctctgtcacccaggctggagtgcagtggcatgatcttggctcactgcaacctctgcctcctgagttcaagcaattctcctgcctcagcctacccagtagctgggaatacaagcttgcaccaccatgcccggctaatttttgtatctttgggagagacgaggtttcgccatgtaggccaggctggtctcaaactcctgacctcaattgatctgcctgccttggcctcccaaagtgctgggattacagacatgagccaccacgcccggccagaagaagaaatttttctggtacggaacagcactctgcaaatcaaactgttgtgttcatatccctgagcatgaatgaacactttctaagggctatatagacatggatggttttaaaggagatagtttctggttctctttcctaaagttgagctgcttgggagtacctcatgaggatgggtttgcctttcttacttccccttcacagttactgttttttcacttttattaaagaatggctcacctagaatcttagtctggtatattgtccttaggtgtagaaattttcagggttccaaagaaaggtagaaaaaaattagtgtctaatttaattctagtaatagcataacaaatcctttttgcatgatggtagtttctatttctttgtttttaaaataattgaaggatgatataatctagctattagctgatcattaaacataattttgatgacagatcattttataattttttgatgtgtaattaggaaggagttcacagagttgagcgtcattggtgtttggatgaattgtatactacaatacttgcaatgataatcagtcatgtatatataaacagttatagccttacggtcacagggaattaaaaatatatgccaattcctatgtataattttgctgtacagaaggtatgatatgatgtaaaagacaagtattaaatacgttaggctaacctgttgtttgtgggaaatgaaagaattaaaaacaagagtgactgggggatagtgtctgtgtggcagtctgagggaggcttttctggcatgctgggaatgttctatacagaacttgagtggtggctacacagttgtgttcactttgtaaaaattcattatgccctgccgtgttctttgtatacttttctgtacatacgttaacttcattaaaaagcatatttt

SEQ ID NO: 195962 - DNA, 2624 bp, Homo sapiens
  Payload ID: 18664
  Gene Name: tubulin tyrosine ligase-like family member 5
  ENST ID: ENST00000554510
  CDS Start-End: 120-2447
agatcaaagttttacgaagggtgaaggaggagaatgatcggcgaggtggatttattcgcatatttcctacatctgagacatgggaaatatatgggtcctacctcgagcataagacctcaatgaactatatgctggcaacacgcctcttccaggacaggggaaacccaagaagaagcttattgacaggaagaacacgaatgactgctgatggagcgccagaattgaagatagagagtctgaattcaaaggccaagctgcatgctgcactttacgagaggaagctcctgtctctggaggtgcgaaaacgtagacgacggagtagcagattgagggcaatgaggccaaaatacccagtgattacccaaccagctgaaatgaatgttaaaactgagacagagagtgaagaggaggaagaagtcgcattagataatgaagatgaagaacaggaggcttcccaggaggagtctgcaggatttcttagagaaaatcaagccaaatatacaccctcattgacagctttggtagaaaatacacccaaagaaaattccatgaaagttcgtgaatggaataataaaggtggacactgctgcaaacttgagactcaggagctagagcctaaatttaacctgatgcagattcttcaagataatggcaatcttagcaaaatgcaggcccgaatagcattctctgcctatctccagcatgttcaaattcgcctgatgaaagacagtggcggtcagacgttcagtgccagttgggctgccaaagaggatgaacagatggagctggttgttcgtttcctcaagcgagcatcaaataacctccagcattcactgaggatggtattacccagtcgacgattggcacttctggaacgcagaagaatcctggcccaccagctgggtgactttatcattgtatacaacaaggaaacagaacaaatggctgaaaagaaatcaaagaagaaagttgaggaagaagaggaagatggggtgaatatggaaaactttcaggagttcatcagacaagcaagtgaggctgaactggaggaggtgttgactttttatacccaaaagaacaagtctgctagtgtcttcctggggactcactctaaaatttctaagaacaacaacaattattctgatagtggggcaaaaggtgatcaccctgagactataatggaagaagtgaaaataaagccacctaaacagcaacagacgacagaaattcattctgataaattatctcgatttaccacttcagcagaaaaagaggcaaaattagtttatagcaattcctcctctggtcctactgctactctgcagaaaattcccaacacccatttgtcatctgttacaacctctgacctctctccagggccttgccaccattcttctttatctcaaattccttcagctatccccagcatgcctcaccagccaacaattttactgaacacagtctctgccagtgcttctccctgcctacatcccggggcacagaacatcccaagccctactggcctgccacgctgtcgatcaggaagtcacaccattggtcccttttcttccttccaaagtgctgcacacatctatagccagaaactgtctcgtccctcttcagcaaaggcaggatcgtgctatctaaacaagcatcattcaggaatagccaaaacacaaaaagagggagaagatgcttctttatatagcaaacggtacaaccaaagtatggttacagctgaacttcagcggctagctgagaagcaggcagcgagacagtattctccatccagccacatcaacctcctcacccaacaggtaacaaacctgaatttggcaactggcatcataaacagaagcagtgcttcagctcccccaaccctccgacccatcatcagtcctagtggcccgacatggtctacacagtcagacccccaagctcccgagaatcactccagctctcctggaagcaggagcctgcagacagggggatttgcctgggaaggagaagtagaaaacaacgtgtacagccaggctacaggggtggtcccccagcacaagtatcaccccacagcaggcagctatcagcttcaatttgccctgcagcaacttgaacaacaaaaacttcagtcccggcagctcctggaccagagtcgagcccggcaccaggcaatctttggcagccagacactacctaactccaatttatggacaatgaataatggtgcaggttgtagaatttccagtgccacagctagtggccagaagccaaccactctgccacaaaaagtggtaccacctccaagttcttgcgcctccctggttcccaaacccccacccaaccacgaacaagtgctcagaagggcaacatcccagaaagcttccaatacccgcttcagatcctcctttcaaaactatttgtggtatttcttccaagcagtcagctgaactgaggacgacagcctacaaacaactacatgcatctgaactgtctcttgtaaatgagcttttttcagagccagaatcatactctccaggaaatatggagaaagaaacctgaggagattgaagtttgccaggcacaagggcaaaactcagactgaatgaatttgaaagggtggggcc

SEQ ID NO: 195963 - DNA, 3071 bp, Homo sapiens
  Payload ID: 18664
  Gene Name: tubulin tyrosine ligase-like family member 5
  Uniprot ID: Q6EMB2
  ENST ID: ENST00000556893
  CDS Start-End: 71-2524
gaaaaacctcgtgggctcagcccgggagaaagggccagggaagttgggtggttctgtgcttggtctgtcaatggaggagatcaaagttttacgaagggtgaaggaggagaatgatcggcgaggtggatttattcgcatatttcctacatctgagacatgggaaatatatgggtcctacctcgagcataagacctcaatgaactatatgctggcaacacgcctcttccaggacaggggaaacccaagaagaagcttattgacaggaagaacacgaatgactgctgatggagcgccagaattgaagatagagagtctgaattcaaaggccaagctgcatgctgcactttacgagaggaagctcctgtctctggaggtgcgaaaacgtagacgacggagtagcagattgagggcaatgaggccaaaatacccagtgattacccaaccagctgaaatgaatgttaaaactgagacagagagtgaagaggaggaagaagtcgcattagataatgaagatgaagaacaggaggcttcccaggaggagtctgcaggatttcttagagaaaatcaagccaaatatacaccctcattgacagctttggtagaaaatacacccaaagaaaattccatgaaagttcgtgaatggaataataaaggtggacactgctgcaaacttgagactcaggagctagagcctaaatttaacctgatgcagattcttcaagataatggcaatcttagcaaaatgcaggcccgaatagcattctctgcctatctccagcatgttcaaattcgcctgatgaaagacagtggcggtcagacgttcagtgccagttgggctgccaaagaggatgaacagatggagctggttgttcgtttcctcaagcgagcatcaaataacctccagcattcactgaggatggtattacccagtcgacgattggcacttctggaacgcagaagaatcctggcccaccagctgggtgactttatcattgtatacaacaaggaaacagaacaaatggctgaaaagaaatcaaagaagaaagttgaggaagaagaggaagatggggtgaatatggaaaactttcaggagttcatcagacaagcaagtgaggctgaactggaggaggtgttgactttttatacccaaaagaacaagtctgctagtgtcttcctggggactcactctaaaatttctaagaacaacaacaattattctgatagtggggcaaaaggtgatcaccctgagactataatggaagaagtgaaaataaagccacctaaacagcaacagacgacagaaattcattctgataaattatctcgatttaccacttcagcagaaaaagaggcaaaattagtttatagcaattcctcctctggtcctactgctactctgcagaaaattcccaacacccatttgtcatctgttacaacctctgacctctctccagggccttgccaccattcttctttatctcaaattccttcagctatccccagcatgcctcaccagccaacaattttactgaacacagtctctgccagtgcttctccctgcctacatcccggggcacagaacatcccaagccctactggcctgccacgctgtcgatcaggaagtcacaccattggtcccttttcttccttccaaagtgctgcacacatctatagccagaaactgtctcgtccctcttcagcaaaggcaggatcgtgctatctaaacaagcatcattcaggaatagccaaaacacaaaaagagggagaagatgcttctttatatagcaaacggtacaaccaaagtatggttacagctgaacttcagcggctagctgagaagcaggcagcgagacagtattctccatccagccacatcaacctcctcacccaacaggtaacaaacctgaatttggcaactggcatcataaacagaagcagtgcttcagctcccccaaccctccgacccatcatcagtcctagtggcccgacatggtctacacagtcagacccccaagctcccgagaatcactccagctctcctggaagcaggagcctgcagacagggggatttgcctgggaaggagaagtagaaaacaacgtgtacagccaggctacaggggtggtcccccagcacaagtatcaccccacagcaggcagctatcagcttcaatttgccctgcagcaacttgaacaacaaaaacttcagtcccggcagctcctggaccagagtcgagcccggcaccaggcaatctttggcagccagacactacctaactccaatttatggacaatgaataatggtgcaggttgtagaatttccagtgccacagctagtggccagaagccaaccactctgccacaaaaagtggtaccacctccaagttcttgcgcctccctggttcccaaacccccacccaaccacgaacaagtgctcagaagggcaacatcccagaaagcttccaatacccgcttcagatcctcctttcaaaactatttgtggtatttcttccaagcagtcagctgaactgaggacgacagcctacaaacaactacatgcatctgaactgtctcttgtaaatgagcttttttcagagccagaatcatactctccaggaaatatggagaaagaaacctgaggagattgaagtttgccaggcacaagggcaaaactcagactgaatgaatttgaaagggtggggccaaagatgttgtaacctgggagacttctctgaagaaagaaaactgtttaagaaacacagactgaactgcagtacttttccttaaatagctgagatgaccttctttaccctgggcttaggtgattctcatcagggtgacctgagtggaagttggtggtaacgactgttctgtgtcagcacccaggacagtggtgtctgttaaggctgccagggattagcagggaggaaagccatcaggactgggtagcctggtagcaccaaatcccaattaatgttacctgaacatgtggtgaggtcagccgtatgatgaaagatgtttaagagattaatgtcagaagaatatgaaaataaacaccggcttaaaaaatgtta

SEQ ID NO: 195964 - DNA, 339 bp, Homo sapiens
  Payload ID: 18664
  Gene Name: tubulin tyrosine ligase-like family member 5
  ENST ID: ENST00000555018
  CDS Start-End: 1-183
aacctcctcacccaacaggtaacaaacctgaatttggcaactggcatcataaacagaagcagtgcttcagctcccccaaccctccgacccatcatcagtcctagtggcccgacatggtctacacagtcagacccccaagctcccgagaatcactccagctctcctggaagcagtttcatataactgaactcaaacaacctcgctgaacaatgctcatttgggaagtgggaaggaaatttcctttatgtagttgagagatgtggctaaagataaaatccacgtagcttctggcaataatgtaagcagcttccaaattaaaaaagaaaccactgtattgaa

SEQ ID NO: 195965 - DNA, 3371 bp, Homo sapiens
  Payload ID: 18665
  Gene Name: tubulin tyrosine ligase-like family member 6
  ENST ID: ENST00000376681
  CDS Start-End: 1-557
agccaatgggagcgttactccttcatccttcgaggagggggccggcaggtgtggttgcaagctggactagcagcccagcggggcgagacgggggagtaggaattgcgggggcctggtatttccccagagcctcctcccaggccagggagatgccacagtgcccgactttggaaagccaggaaggggaaaactccgaagagaagggggacagttccaaagaagatccaaaagaaaccgtcgcgctggcttttgtgagagagaacccaggggcacaaaacggacttcagaatgcccagcagcaaggcaagaagaagaggaagaaaaagaggatgcctttaaaaaatagcaggaaaagaagatttccttgttttaagaaggcgctgatttgtcctggaaatttagtacgccttcagtatgatagcaccatactgacttatcaggatccaactgcagcttgtgcattccagttcttgtttaatatttcaccatgccttgctccattcagactgattgatgaaggaaagcttgtccactttcttattcatagcttcccttaatggggggaagaggaaggagacaagtattttggccaaaaatattttcaattcctgtccctgatgagccagtggagtaaaaggcttgaggcaatgatgttagtgagaagctgcaagcaagatcagctgtaattgcaatacagaatttctaccttctgggtagagtaatagtaccctgatgccatgttttccaccatgctgtacccccttggactcgtgtcctcagcaacagggacggtcaaaccaggcttagcatggcaggctagatttcagacagctccacctgggacaggatgtttctggatacagtcacttgttctggcaagtgtgtctctgtcttgctgctttcctttttctcttttccagatgattggtgatcaatctatccagctgccggtatgagagtgtgcgcagggctgcccaacagtacggctttagagagggaggggaagacgatgactggactctctattggacagattactcagtgtcactggagcgggtgatggaaatgaaaagttaccagaagatcaatcacttccccgggatgagtgaaatctgccggaaggacttgctggccaggaacatgagccgcatgttaaagatgttccctaaagatttccgctttttccctaggacctggtgtcttcctgctgactggggagatttgcagacctacagcaggtcaagaaaaaataagacatacatttgtaagccggattcgggctgccaagggaaaggtatattcatcacccggacagtgaaagaaatcaaaccaggggaggatatgatctgtcagctgtatatttcaaagccctttatcattgatgggtttaagtttgacctacggatttatgtactggtgacatcctgtgaccctctcaggatttttgtgtacaatgaaggactggcccgctttgcgacgacctcttactcccgcccttgcacagacaacctggatgatatctgcatgcacctgactaattattccattaataagcacagttcaaatttcagtcgagatgcacactctggcagtaagaggaagctctccaccttcagtgcatacttggaggaccacagctacaacgtggagcagatatggagggatattgaggacgtcatcatcaagaccctcatctcggcccaccccatcatcaggcataactaccacacctgcttccccaaccacacactcaacagcgcctgctttgagatcctgggctttgacattttgttggaccacaaactcaaaccctggctgctggaggtcaaccactctccaagcttctccaccgactctcggttggataaagaggtgaaagatggtctgctgtatgacaccttagtcctgatcaacctggaaagctgtgacaagaagaaagtcttggaggaggagagacaacgggggcagttcctgcagcagtgttgttctcgggagatgaggattgaggaagccaagggtttccgggccgtgcagttaaagaaaactgaaacgtatgagaaggaaaactgtggagggttccgactgatttatcccagtctgaattcggagaagtatgagaagtttttccaggacaacaactccctcttccagaatactgttgcttccagggctcgggaggagtatgcccggcaactgatccaggagctgagactaaaacgggagaaaaagcccttccaaatgaagaagaaggtagagatgcagggggaatcggcaggcgagcaagtgagaaagaagggcatgaggggctggcaacagaaacaacagcagaaagacaaggccgccacccaagcctccaaacagtacatccagccattgacattagtatcctacacacctgacttgctcttgagtgtcagaggtgaaaggaaaaatgaaacagacagcagcctcaaccaggaggctcccacggaggaggccagctctgttttccccaagctgacgtctgcgaagcccttcagttctctacccgatctgaggaatatcaatctcagcagctcgaagttggagcccagtaaacccaacttcagcatcaaggaggccaagtctgcctctgcagtgaacgtattcactggcactgtgaatcagactggatctctgccacttttcccttcctacctcttaacttgcaggaaacaatgtgtctcttccgacagtgtctccagtgttcacagaatcaactgaagttttgtttgctcatctagatatactggtcttccattagttcctagtagcagcaatggggccaacagccctgcctctgttccctcccagttagcttacagtgctacaggaccatgatttctggggttggattggtgctgccccaggacacactccagttgccgtaccagtggcacttctctgggttcttcacatggcaccatcatccagaatactcccccagataaagcaacttcgggagtagtgtttcagagaaggactcatgatttccaggagtcaaaagccctcagtccaccaacagaactatgccagttggtcttcgtctccaagataaaagatgaggtcagggatgggcatggtgcataactctgagccctgagtgagagaactgaggcagctgcaacttcacaaggtcaaggcccgacctccgcccatccccaccagcccaaagacttgccacctcagtgcccgagcatcctctggtgacctccctcaccagcccaacttaatctcaccagtgaaaacagaggtgaggcgagagtacccagcctgaagatgcttcttctatcagcctgcagaaatgttacactttcccttcaggcatccattaataaaagaaattgccatgc

SEQ ID NO: 195966 - DNA, 3551 bp, Homo sapiens
  Payload ID: 18665
  Gene Name: tubulin tyrosine ligase-like family member 6
  Uniprot ID: Q8N841
  ENST ID: ENST00000393382
  CDS Start-End: 143-2818
aattggattcgggagggagggggcatggcagctactgcaggggccaatcgaaggcctagaaggccccgtatgcaaatatgagggccgggcggacccaaagttagggcgagcgcgggttggggttggggctgtctggcagccaatgggagcgttactccttcatccttcgaggagggggccggcaggtgtggttgcaagctggactagcagcccagcggggcgagacgggggagtaggaattgcgggggcctggtatttccccagagcctcctcccaggccagggagatgccacagtgcccgactttggaaagccaggaaggggaaaactccgaagagaagggggacagttccaaagaagatccaaaagaaaccgtcgcgctggcttttgtgagagagaacccaggggcacaaaacggacttcagaatgcccagcagcaaggcaagaagaagaggaagaaaaagagattggtgatcaatctatccagctgccggtatgagagtgtgcgcagggctgcccaacagtacggctttagagagggaggggaagacgatgactggactctctattggacagattactcagtgtcactggagcgggtgatggaaatgaaaagttaccagaagatcaatcacttccccgggatgagtgaaatctgccggaaggacttgctggccaggaacatgagccgcatgttaaagatgttccctaaagatttccgctttttccctaggacctggtgtcttcctgctgactggggagatttgcagacctacagcaggtcaagaaaaaataagacatacatttgtaagccggattcgggctgccaagggaaaggtatattcatcacccggacagtgaaagaaatcaaaccaggggaggatatgatctgtcagctgtatatttcaaagccctttatcattgatgggtttaagtttgacctacggatttatgtactggtgacatcctgtgaccctctcaggatttttgtgtacaatgaaggactggcccgctttgcgacgacctcttactcccgcccttgcacagacaacctggatgatatctgcatgcacctgactaattattccattaataagcacagttcaaatttcagtcgagatgcacactctggcagtaagaggaagctctccaccttcagtgcatacttggaggaccacagctacaacgtggagcagatatggagggatattgaggacgtcatcatcaagaccctcatctcggcccaccccatcatcaggcataactaccacacctgcttccccaaccacacactcaacagcgcctgctttgagatcctgggctttgacattttgttggaccacaaactcaaaccctggctgctggaggtcaaccactctccaagcttctccaccgactctcggttggataaagaggtgaaagatggtctgctgtatgacaccttagtcctgatcaacctggaaagctgtgacaagaagaaagtcttggaggaggagagacaacgggggcagttcctgcagcagtgttgttctcgggagatgaggattgaggaagccaagggtttccgggccgtgcagttaaagaaaactgaaacgtatgagaaggaaaactgtggagggttccgactgatttatcccagtctgaattcggagaagtatgagaagtttttccaggacaacaactccctcttccagaatactgttgcttccagggctcgggaggagtatgcccggcaactgatccaggagctgagactaaaacgggagaaaaagcccttccaaatgaagaagaaggtagagatgcagggggaatcggcaggcgagcaagtgagaaagaagggcatgaggggctggcaacagaaacaacagcagaaagacaaggccgccacccaagcctccaaacagtacatccagccattgacattagtatcctacacacctgacttgctcttgagtgtcagaggtgaaaggaaaaatgaaacagacagcagcctcaaccaggaggctcccacggaggaggccagctctgttttccccaagctgacgtctgcgaagcccttcagttctctacccgatctgaggaatatcaatctcagcagctcgaagttggagcccagtaaacccaacttcagcatcaaggaggccaagtctgcctctgcagtgaacgtattcactggcactgtgcacttaacctccgtagaaaccaccccagaatccaccacccaactctcaatctccccaaagtctccgccaaccctggctgtgaccgccagctctgagtacagtggcccagagacggacagggtggtatcctttaaatgcaagaagcagcagacccctccacacttaacccagaagaaaatgttaaaatcttttctgcccacaaaatccaagagcttctgggagagtccgaacacaaactggactttgctaaagagtgacatgaacaagccacatttgatatccgagctactcaccaagcttcaactgagtgggaagctctccttcttcccagctcactacaaccccaagctggggatgaataacctgtcacaaaacccctccctgcctggggagtgccactcccgcagtgacagctctggcgagaagaggcagctggatgtgtcctccctcctcttgcagagtcctcagagctataatgttactctgagggacctgctggtgattgccactccagcccaactggatccaaggccttgtagaagccacgcaagtgctatgagggacccatgtatgcaggatcaagaagcatacagccattgcctgatctctggccaaaaaggatgtgagaggagctagaatcagactggatctctgccacttttcccttcctacctcttaacttgcaggaaacaatgtgtctcttccgacagtgtctccagtgttcacagaatcaactgaagttttgtttgctcatctagatatactggtcttccattagttcctagtagcagcaatggggccaacagccctgcctctgttccctcccagttagcttacagtgctacaggaccatgatttctggggttggattggtgctgccccaggacacactccagttgccgtaccagtggcacttctctgggttcttcacatggcaccatcatccagaatactcccccagataaagcaacttcgggagtagtgtttcagagaaggactcatgatttccaggagtcaaaagccctcagtccaccaacagaactatgccagttggtcttcgtctccaagataaaagatgaggtcagggatgggcatggtgcataactctgagccctgagtgagagaactgaggcagctgcaacttcacaaggtcaaggcccgacctccgcccatccccaccagcccaaagacttgccacctcagtgcccgagcatcctctggtgacctccctcaccagcccaacttaatctcaccagtgaaaacagaggtgaggcgagagtacccagcctgaagatgcttcttctatcagcctgcagaaatgttacactttcccttcaggcatccattaataaaagaaattgccatgctt

SEQ ID NO: 195967 - DNA, 2548 bp, Homo sapiens
  Payload ID: 18665
  Gene Name: tubulin tyrosine ligase-like family member 6
  Uniprot ID: Q8N841
  ENST ID: ENST00000433608
  CDS Start-End: 55-1809
atttttccttagtctaagggcacagaatggaaaggttctcattttcctcctccaatgagaattggcaccccaacagcaggccctgggccctcggctgtgatggaggggtgtctcggggtagcagaactaaggaagctctccaccttcagtgcatacttggaggaccacagctacaacgtggagcagatatggagggatattgaggacgtcatcatcaagaccctcatctcggcccaccccatcatcaggcataactaccacacctgcttccccaaccacacactcaacagcgcctgctttgagatcctgggctttgacattttgttggaccacaaactcaaaccctggctgctggaggtcaaccactctccaagcttctccaccgactctcggttggataaagaggtgaaagatggtctgctgtatgacaccttagtcctgatcaacctggaaagctgtgacaagaagaaagtcttggaggaggagagacaacgggggcagttcctgcagcagtgttgttctcgggagatgaggattgaggaagccaagggtttccgggccgtgcagttaaagaaaactgaaacgtatgagaaggaaaactgtggagggttccgactgatttatcccagtctgaattcggagaagtatgagaagtttttccaggacaacaactccctcttccagaatactgttgcttccagggctcgggaggagtatgcccggcaactgatccaggagctgagactaaaacgggagaaaaagcccttccaaatgaagaagaaggtagagatgcagggggaatcggcaggcgagcaagtgagaaagaagggcatgaggggctggcaacagaaacaacagcagaaagacaaggccgccacccaagcctccaaacagtacatccagccattgacattagtatcctacacacctgacttgctcttgagtgtcagaggtgaaaggaaaaatgaaacagacagcagcctcaaccaggaggctcccacggaggaggccagctctgttttccccaagctgacgtctgcgaagcccttcagttctctacccgatctgaggaatatcaatctcagcagctcgaagttggagcccagtaaacccaacttcagcatcaaggaggccaagtctgcctctgcagtgaacgtattcactggcactgtgcacttaacctccgtagaaaccaccccagaatccaccacccaactctcaatctccccaaagtctccgccaaccctggctgtgaccgccagctctgagtacagtggcccagagacggacagggtggtatcctttaaatgcaagaagcagcagacccctccacacttaacccagaagaaaatgttaaaatcttttctgcccacaaaatccaagagcttctgggagagtccgaacacaaactggactttgctaaagagtgacatgaacaagccacatttgatatccgagctactcaccaagcttcaactgagtgggaagctctccttcttcccagctcactacaaccccaagctggggatgaataacctgtcacaaaacccctccctgcctggggagtgccactcccgcagtgacagctctggcgagaagaggcagctggatgtgtcctccctcctcttgcagagtcctcagagctataatgttactctgagggacctgctggtgattgccactccagcccaactggatccaaggccttgtagaagccacgcaagtgctatgagggacccatgtatgcaggatcaagaagcatacagccattgcctgatctctggccaaaaaggatgtgagaggagctagaatcagactggatctctgccacttttcccttcctacctcttaacttgcaggaaacaatgtgtctcttccgacagtgtctccagtgttcacagaatcaactgaagttttgtttgctcatctagatatactggtcttccattagttcctagtagcagcaatggggccaacagccctgcctctgttccctcccagttagcttacagtgctacaggaccatgatttctggggttggattggtgctgccccaggacacactccagttgccgtaccagtggcacttctctgggttcttcacatggcaccatcatccagaatactcccccagataaagcaacttcgggagtagtgtttcagagaaggactcatgatttccaggagtcaaaagccctcagtccaccaacagaactatgccagttggtcttcgtctccaagataaaagatgaggtcagggatgggcatggtgcataactctgagccctgagtgagagaactgaggcagctgcaacttcacaaggtcaaggcccgacctccgcccatccccaccagcccaaagacttgccacctcagtgcccgagcatcctctggtgacctccctcaccagcccaacttaatctcaccagtgaaaacagaggtgaggcgagagtacccagcctgaagatgcttcttctatcagcctgcagaaatgttacactttcccttcaggcatccattaataaaagaaattgccatgcttactgcc

SEQ ID NO: 195968 - DNA, 543 bp, Homo sapiens
  Payload ID: 18665
  Gene Name: tubulin tyrosine ligase-like family member 6
  ENST ID: ENST00000424018
  CDS Start-End: 60-143
attttcctcctccaatgagaattggcaccccaacagcaggccctgggccctcggctgtgatggaggggtgtctcggggtagcagaactaaggtcaaccactctccaagcttctccaccgactctcggttggataaagaggtgaaagatggtctgctgtatgacaccttagtcctgatcaacctggaaagctgtgacaagaagaaagtcttggaggaggagagacaacgggggcagttcctgcagcagtgttgttctcgggagatgaggattgaggaagccaagggtttccgggccgtgcagttaaagaaaactgaaacgtatgagaaggaaaactgtggagggttccgactgatttatcccagtctgaattcggagaagtatgagaagtttttccaggacaacaactccctcttccagaatactgttgcttccagggctcgggaggagtatgcccggcaactgatccaggagctgagactaaaacgggagaaaaagcccttccaaatgaagaagaaggtagagatgcagggggaatcggcagg

SEQ ID NO: 195969 - DNA, 580 bp, Homo sapiens
  Payload ID: 18665
  Gene Name: tubulin tyrosine ligase-like family member 6
  ENST ID: ENST00000456415
  CDS Start-End: 70-216
aaatatgagggccgggcggacccaaagttagggcgagcgcgggttggggttggggctgtctggcagccaatgggagcgttactccttcatccttcgaggagggggccggcaggtgtggttgcaagctggactagcagcccagcggggcgagacgggggagtaggaattgcggaaccactggaggccttcagagggatgcttccagtagggaaatgaggaccaaaagatgaaaaggaggggcctggtatttccccagagcctcctcccaggccagggagatgccacagtgcccgactttggaaagccaggaaggggaaaactccgaagagaagggggacagttccaaagaagatccaaaagaaaccgtcgcgctggcttttgtgagagagaacccaggggcacaaaacggacttcagaatgcccagcagcaaggcaagaagaagaggaagaaaaagagattggtgatcaatctatccagctgccggtatgagagtgtgcgcagggctgcccaacagtacggctttagagagggaggggaagacgatgactggactctctattggacagattactcagtgtc

SEQ ID NO: 195970 - DNA, 1928 bp, Homo sapiens
  Payload ID: 18665
  Gene Name: tubulin tyrosine ligase-like family member 6
  ENST ID: ENST00000416950
  CDS Start-End: 100-726
atttttccttagtctaagggcacagaatggaaaggttctcattttcctcctccaatgagaattggcaccccaacagcaggccctgggccctcggctgtgatggaggggtgtctcggggtagcagaactaaggaagctctccaccttcagtgcatacttggaggaccacagctacaacgtggagcagatatggagggatattgaggacgtcatcatcaagaccctcatctcggcccaccccatcatcaggcataactaccacacctgcttccccaaccacacactcaacagcgcctgctttgagatcctgggctttgacattttgttggaccacaaactcaaaccctggctgctggaggtcaaccactctccaagcttctccaccgactctcggttggataaagaggtgaaagatggtctgctgtatgacaccttagtcctgatcaacctggaaagctgtgacaagaagaaagtcttggaggaggagagacaacgggggcagttcctgcagcagtgttgttctcgggagatgaggattgaggaagccaagggtttccgggccgtgcagttaaagaaaactgaaacgtatgagaaggaaaactgtggagggttccgactgatttatcccagtctgaattcggagaagtatgagaagtttttccaggacaacaactccctcttccagaatactgttgcttccagggctcgggaggagtatgcccggtaggaagacatccgggatgaggcaactgatccaggagctgagactaaaacgggagaaaaagcccttccaaatgaagaagaaggtagagatgcagggggaatcggcaggcgagcaagtgagaaagaagggcatgaggggctggcaacagaaacaacagcagaaagacaaggccgccacccaagcctccaaacagtacatccagccattgacattagtatcctacacacctgacttgctcttgagtgtcagaggtgaaaggaaaaatgaaacagacagcagcctcaaccaggaggctcccacggaggaggccagctctgttttccccaagctgacgtctgcgaagcccttcagttctctacccgatctgaggaatatcaatctcagcagctcgaagttggagcccagtaaacccaacttcagcatcaaggaggccaagtctgcctctgcagtgaacgtattcactggcactgtgaatcagactggatctctgccacttttcccttcctacctcttaacttgcaggaaacaatgtgtctcttccgacagtgtctccagtgttcacagaatcaactgaagttttgtttgctcatctagatatactggtcttccattagttcctagtagcagcaatggggccaacagccctgcctctgttccctcccagttagcttacagtgctacaggaccatgatttctggggttggattggtgctgccccaggacacactccagttgccgtaccagtggcacttctctgggttcttcacatggcaccatcatccagaatactcccccagataaagcaacttcgggagtagtgtttcagagaaggactcatgatttccaggagtcaaaagccctcagtccaccaacagaactatgccagttggtcttcgtctccaagataaaagatgaggtcagggatgggcatggtgcataactctgagccctgagtgagagaactgaggcagctgcaacttcacaaggtcaaggcccgacctccgcccatccccaccagcccaaagacttgccacctcagtgcccgagcatcctctggtgacctccctcaccagcccaacttaatctcaccagtgaaaacagaggtgaggcgagagtacccagcctgaagatgcttcttctatcagcctgcagaaatgttacactttcccttcaggcatccattaataaaagaaattgccatgctt

SEQ ID NO: 195971 - DNA, 7976 bp, Homo sapiens
  Payload ID: 18666
  Gene Name: tubulin tyrosine ligase-like family member 7
  Uniprot ID: Q6ZT98
  ENST ID: ENST00000260505
  CDS Start-End: 379-3042
gttccaggcactccgcgtcgagcaccggagtcccgagccgtggctgccacgggcggtgggcgggcggaggagagcaccggaccaccagtgcaggctgccgagtcggggcggccgcccacggggaagctgcgaggcgcgggagcacctgggggaccgcttgcagcggggacgcgaggacccgggctgggctttcctcacccgggtaccttgttatcccataactttggtatcctgaaatctgaggattccaccaagataatatgataagaactttcagtgatttggggccatatcctacttagactaatgtggaatttccagatttcctgagagcttggtacagcagcacacactgcttgctaatcagcacaggcaataatgccatctctgcctcaagaaggagttattcagggaccctctcccctggatttgaatacagaattaccttatcaaagcacaatgaaaaggaaagtcagaaagaagaaaaagaagggaaccattacagcaaatgttgccgggacaaagtttgaaattgttcgtttagtaatagatgaaatgggatttatgaaaactccagatgaggatgaaacaagtaatcttatatggtgtgattctgctgttcagcaggagaaaatttcagagctgcaaaattatcagaggatcaaccattttccaggaatgggggagatctgtaggaaggatttcttagcaagaaatatgaccaaaatgatcaagtctcggcctctggattatacctttgttcctcgaacttggatctttcctgctgaatatactcaattccaaaattatgtgaaagaattgaagaaaaaacggaagcagaaaacttttatagtgaaaccagctaatggtgcaatgggtcatgggatttctttgataagaaatggtgacaaacttccatctcaggatcatttgattgttcaagaatacattgaaaagcctttcctaatggaaggttacaagtttgacttacgaatttatattctggttacatcgtgtgatccactaaaaatatttctctaccatgatgggcttgtgcgaatgggtacagagaagtacattccacctaatgagtccaatttgacccagttatacatgcatctgacaaactactccgtgaacaagcataatgagcattttgaacgggatgaaactgagaacaaaggcagcaaacgttccatcaaatggtttacagaattccttcaagcaaatcaacatgatgttgctaagttttggagtgatatttcagaattggtggtaaagaccctgattgtagcagaacctcatgtcctgcatgcctatcgaatgtgtagacctggtcaacctccaggaagcgaaagtgtctgctttgaagtcctgggatttgatattttgttggatagaaaactaaagccatggcttctggagattaaccgagccccaagctttggaactgatcagaaaatagactatgatgtaaaaaggggagtgctgctaaatgcgttgaagctactaaacataaggaccagtgacaaaagaagaaacttggccaaacaaaaagctgaggctcaaaggaggctctatggtcaaaattcaattaaaaggctcttaccaggctcctcagactgggaacagcagagacaccagttggagaggcggaaagaagagttgaaagagagactcgctcaagtacgaaagcagatctcacgagaagaacatgaaaatcgacatatggggaattatagacgaatttatcctcctgaagataaagcattacttgaaaagtatgaaaatttgttagctgttgcctttcagaccttcctttcaggaagagcagcttcattccagcgagagttgaataatcctttgaaaaggatgaaggaagaagatattttggatcttctggagcaatgtgaaattgatgatgaaaagttgatgggaaaaactaccaagactcgaggaccaaagcctctgtgttctatgcctgagagtactgagataatgaaaagaccaaagtactgcagcagtgacagcagttatgatagtagcagcagctcttcagaatctgacgaaaatgaaaaagaagagtaccaaaataagaaaagagaaaagcaagttacatataatcttaaaccctccaaccactacaaattaattcaacaacccagctccataagacgttcagtcagctgccctcggtccatctctgctcaatcaccttccagtggggacacccgcccattttctgctcaacaaatgatatctgtgtcacggccaacttctgcatctcggtcacattccttaaaccgtgcttcctcctacatgaggcatctgcctcacagtaatgatgcctgctctaccaactctcaagtgagtgagtctttgcggcaactgaaaacaaaagaacaagaagatgatctaacaagtcagaccttatttgttctcaaagacatgaagatccggtttccaggaaagtcagatgcagaatcagaacttctgatagaagatatcattgataactggaagtatcataaaaccaaagtggcttcatattggctcataaaattggactctgtaaaacaacgaaaagttttggacatagtgaaaacaagtattcgtacagttcttccacgcatctggaaggtgcctgatgttgaagaagtaaatttatatcggattttcaaccgggtttttaatcgcttactctggagtcgtggccaagggctgtggaactgtttctgtgattcaggatcctcttgggagagtatattcaataaaagcccggaggtggtgactcctttgcagctccagtgttgccagcgcctagtggagctttgtaaacagtgcctgctagtggtttacaaatatgcaactgacaaaagaggatcactttcaggcattggtcctgactggggtaattccaggtatttactaccagggagcacccaattcttcttgagaacaccaacctacaacttgaagtacaattcacctggaatgactcgctccaatgttttgtttacatccagatatggccatctgtgaaacagaagggaagatcgccattggttatacataacagcaattcatttttttcctctgaagttgaacatgcaaagaacatgaccattaagtgctgttttatgtatataagacatatatatgtgtgaaaatatatgcacatatgcaccctaataacatatatttattatattaaatgatatatgaaagaagaattagcagaaaatggaatataagacttaacctttctggaaacgtaataaaccatgttaaaattgtttacacaaatatgtgaatgtctagaatctgctaggtttataattaattccttcctactagaaatgttatttttgctgcagagtatataaaacaaattgatcttgaagatccaattacagtgttaaattattttctagataacatgccttttgacctgaaaaagggtttagtataataccttaaaaattctcatatatagtagccattttaaatgaaacaaaaagatttagaagcctggtgttgcttgatgataagattaagaagtttaaaacgggtttatcattactatagcacactgtaaagtgctagaaaagtcataacctgattctccaatctttttattcctctatgtggaaatttagctacttgtaataaggtacattttcagtaaggatctggtgagatcatattatgatctaacatgaaagacaggctgggcgcggtggctcacgcctgtaattccagcactttgggaggccgaggtgagtggatcaccgctggtcaggagtttgagactagcctggccaacatggtgaaaccccatctctactaaaaatacaaaaattagctgggcgtgatggtaagtgcttgtaatcccagctacttgggcggctgagacaggagaatcacttgaacctgggaggcggaggttgcagtgagccgagattgtgccattgcattctagcctgggtgacaagagtgaaactctgtctcaaaaaaaaaaaataataataaaataaaataaataaataaataaaaagaagataaaaataaataaataaaatggaagacaatccaatgggttaaaaataaaatgtaaactagctttcatttttacttttcataatcacataaaggaacagaaaatgatggtaacaaaatctttctatatggcttttatgtcttataccactcatttttatttggaaagtatatctttgatgggtttaacatgtggttaaatacaatttctcctgtttcgcagaagtagaagagttgacacatttcactcattttagtgttacaggataatgagacaaacttatttttataaatctctcaaggttgaaatcaacttatattgcaaattctaatacagtagtttctcattgcaccacagaaacagttaaaggattgtgaatagaagatttcaattatcacatattacaagtcatcagtgtacccttgagggtttttaaaaaatcaaaacagagaacgaagtgttcttgtccaaagttgttatgcataagtttcatagcagtttacttccttttcttgaatacagtttttaaaaccaagagtgagctttcagttttccataaaaatataagccgtactactttgacattgaaatcatcagtgcagccatcacttcttagaatttatttaaacttcttctcccaacagttttattttcttttagctgctaattattttcgaaattcatgaatgttttacctccttttactattctgaaagttatttcaagaagtggccccaaagcaggagaactgagaggggcaaattggcctggtttaattcacagcctgaagaattggcaacctaaagttataagttagatgtattttgcttttcaagccatcttctgagccttttttaggctgaaatgatttgtttatttcccaaattattgctagctacttgattttttatggctacctaacatccacatttggtagatacttttcctctctgcatgcatcccaaagaagaatttgctatttgtggaagaagagaataagggtatcagaatgaaggaaattacagtgactacactgtttatgactccattttgtgaattcttaaatatgctatggatttttttttagaaaaaataatgcaaaaattgggatattacagaatcaccataaagatgatcaacaagtaataagtcttttcatggagttcatttttcttttaaattcatgatttggccacaaaaatatatatataagtgtctgatatatgataacagcccagtttctcggccactcatttgcattatcttaaatcacaaataattacttaatttgctggagtgtgtgctttgcaacttttgtaccagagcaaaatttgtatttaaaacaaaaaataagaatgcccatcactaggagaaacactcctcacagaaaacacacacacacacacacacacaatttaaaaactgagtaaatttaaatgtatgaaagtaccccacaaattgatttcaacaaataaatttcatttctctagctacttatgtctggccttattttgagcgttacaattttattgccttcatttgcctatttagactgatgtagtttgatatgatgaagttgtgaataaaagccttgtgttcattatttatatatactacctggtatgctatggactgtgtctgctgtagtgctattccctaatgagcaactaagagaagacacaacaataaaccatggaagtgttgggaggccatggaaatgatttagaggtataaaatattcccaagtttttattataaatttttattcataggttaaaacatataagcataagtgattgtacaggtgtgactcccttttctaggagagaaaatagctttatttgaaaactccaaaagctacttaatcttaccagaggtttttaataggggaactgggtttacttacaatgaaagcatattttcattctgctatagaaaaacatatccctgctcattcagtaaatctaagattggaatgctttctagaactatgcaatatttgaataatttctagaaatgtctaagaaacaaccttttttattttaaatcatcacttacaaacgtagtctgagactgcaaactagttttcacttgactaatccatcattatagattagttaccatttgctctatataatctattgaagaaactattgttattcatattttgattaattttactagcaacaaatttttattttagtagcattgcatttaccttaaatatgtaaaaatgaagttgtaacaggatcaaatatggaaatggcaatggtaactctgcctagaacatagttgaatgtccttggttgtcggtaagatgcaaagatctatacaaattttatcataggtcaaaattatttctaaatatacaaacagtttcaactatttctttctccctaaaactaaaaccaaaccaaacccaaatgaagaaacctaaacttcttttcatctaatagttatacccaactagataatagtagcttctagacatcaataaaaagatttcattttaactgtctttttaatttgtaaaatatatgagtatggaattttgtatctaacttgaaatttcagatgttttaataatccaaatacgttcttctttagcatgtcaaagtactaatagttaaaaaatttctttagatttaagcatatacattacttgactttttcaaaagtatcaaaaaattgatagctgcagaaatgccattatttgattttctaaaaaacattgattcattcttaaatgtgtattctttaaaaaatagtaaatacctcaagagtgacagaaaactttccttttctgttctgtaatgctaatttaaactttgagtcttagtttacatggtcataggggttaaataaaatgtataactgtacaattaattgtgttcttgtgacctgatgattttttgaaaatttgcttttctctttaagaaatttaagttttcaagggccgtattagttatctaaatattttgggctaatgttgacttataaataaataaaaatttagaaatatattcatgatgacaattttgttacttacactgcctattctttatttcttttttagttcaaaggtgaaattttgacctttgtattaacaaagcctcaagaaaagagaaattctgccttttaaacattggttttccttgcattttatggtggtgtgattttgcctcagcaataataaaacataaaatatgttgttgcatcaagttcagtttgtctgctgagattatttttaagaaccaggttgaagcctctatgcctaaaaaagcgtttattgtctggatacatataaagcaagatatatggctacaaataagtcttgcaaccaaaattggtatattaaaatttactgcacactttgagattgctgccattttttggtgctttttggacctcgtcataaagggatgtatcgtatattagggaaaattactcaagttacacattctacattaactgcgctgtattatctacaggtacaatcaatggaccaatagttcctaaattagtaataaggcttaccttacaaaagtaatgaaataacactgatatttctctttcaaaggctaacagcaattcttggtcctgagctattcagttcatacaataactactgtacatgctacaacatctgaatattaatggttttgctgcagattctgggtatgaggattagcttgaaagcaatacatttgctaacatgaatcatgactcacattatccccgtgtgctttactacctgtatatgaatgcaaatgttgttacagaaaatatgcttgaaatgtcaatacagtgtgcaattagcgttgcattgtcatgctccagcatgtgatatctgtatggtgaagttatttcaattactctgatacattactataataaaaaagtttaacctaagaaa

SEQ ID NO: 195972 - DNA, 2550 bp, Homo sapiens
  Payload ID: 18666
  Gene Name: tubulin tyrosine ligase-like family member 7
  ENST ID: ENST00000485638
  CDS Start-End: 346-2007
tatattccttgggagcagagatgatactaatttatcttactatctccagtacctagcacagagtgtgtactctaaaaaaaatgtttttgatgtactaatatgtaaattagtacatattagggcaaggttgtttttttttttcactgatgaatccatagtccagaatagtgtctaacacttaataggtgctcagtagacatttgttgaatgaatgaaatcaatgaataagtaaatgaaggaatggagaaaatttaaatctttgtggcaaatatcagtagcccagagaaagaaaatatatgctagtttgaatagaaattatttttcctattatgtccaatttacagaatgatcaagtctcggcctctggattatacctttgttcctcgaacttggatctttcctgctgaatatactcaattccaaaattatgtgaaagaattgaagaaaaaacggaagcagaaaacttttatagtgaaaccagctaatggtgcaatgggtcatgggatttctttgataagaaatggtgacaaacttccatctcaggatcatttgattgttcaagaatacattgaaaagcctttcctaatggaaggttacaagtttgacttacgaatttatattctggttacatcgtgtgatccactaaaaatatttctctaccatgatgggcttgtgcgaatgggtacagagaagtacattccacctaatgagtccaatttgacccagttatacatgcatctgacaaactactccgtgaacaagcataatgagcattttgaacgggatgaaactgagaacaaaggcagcaaacgttccatcaaatggtttacagaattccttcaagcaaatcaacatgatgttgctaagttttggagtgatatttcagaattggtggtaaagaccctgattgtagcagaacctcatgtcctgcatgcctatcgaatgtgtagacctggtcaacctccaggaagcgaaagtgtctgctttgaagtcctgggatttgatattttgttggatagaaaactaaagccatggcttctggagattaaccgagccccaagctttggaactgatcagaaaatagactatgatgtaaaaaggggagtgctgctaaatgcgttgaagctactaaacataaggaccagtgacaaaagaagaaacttggccaaacaaaaagctgaggctcaaaggaggctctatggtcaaaattcaattaaaaggctcttaccaggctcctcagactgggaacagcagagacaccagttggagaggcggaaagaagagttgaaagagagactcgctcaagtacgaaagcagatctcacgagaagaacatgaaaatcgacatatggggaattatagacgaatttatcctcctgaagataaagcattacttgaaaagtatgaaaatttgttagctgttgcctttcagaccttcctttcaggaagagcagcttcattccagcgagagttgaataatcctttgaaaaggatgaaggaagaagatattttggatcttctggagcaatgtgaaattgatgatgaaaagttgatgggaaaaactaccaagactcgaggaccaaagcctctgtgttctatgcctgagagtactgagataatgaaaagaccaaagtactgcagcagtgacagcagttatgatagtagcagcagctcttcagaatctgacgaaaatgaaaaagaagagtaccaaaataagaaaagagaaaagcaagttacatataatcttaaaccctccaaccactacaaattaattcaacaacccagctccataagacgttcagtcagctgccctcggtccatctctgctcaatcaccttccagtggggacacccgcccattttctgctcaacaaatgatatctgtgtcacggccaacttctgcatctcggtcacattccttaaaccgtgcttcctcctacatgaggcatctgcctcacagtaatgatgcctgctctaccaactctcaagtgattatactggcacaatgaaataagaccccctccaaatatctgtattctttcaaatttaagagtgagtctttgcggcaactgaaaacaaaagaacaagaagatgatctaacaagtcagaccttatttgttctcaaagacatgaagatccggtttccaggaaagtcagatgcagaatcagaacttctgatagaagatatcattgataactggaagtatcataaaaccaaagtggcttcatattggctcataaaattggactctgtaaaacaacgaaaagttttggacatagtgaaaacaagtattcgtacagttcttccacgcatctggaaggtgcctgatgttgaagaagtaaatttatatcggattttcaaccgggtttttaatcgcttactctggagtcgtggccaagggctgtggaactgtttctgtgattcaggatcctcttgggagagtatattcaataaaagcccggaggtggtgactcctttgcagctccagtgttgccagcgcctagtggagctttgtaaacagtgcctgctagtggtttacaaatatgcaact

SEQ ID NO: 195973 - DNA, 7157 bp, Homo sapiens
  Payload ID: 18666
  Gene Name: tubulin tyrosine ligase-like family member 7
  ENST ID: ENST00000474957
  CDS Start-End: 278-1711
gcttgggcagcgacagctgttccaggcactccgcgtcgagcaccggagtcccgagccgtggctgccacgggcggtgggcgggcggaggagagcaccggaccaccagtgcaggctgccgagtcggggcggccgcccacggggaagctgcgaggcgcgggagcacctgggggaccgcttgcagcggggacgcgaggacccgggctgggctttcctcacccgggaattggtggtaaagaccctgattgtagcagaacctcatgtcctgcatgcctatcgaatgtgtagacctggtcaacctccaggaagcgaaagtgtctgctttgaagtcctgggatttgatattttgttggatagaaaactaaagccatggcttctggagattaaccgagccccaagctttggaactgatcagaaaatagactatgatgtaaaaaggggagtgctgctaaatgcgttgaagctactaaacataaggaccagtgacaaaagaagaaacttggccaaacaaaaagctgaggctcaaaggaggctctatggtcaaaattcaattaaaaggctcttaccaggctcctcagactgggaacagcagagacaccagttggagaggcggaaagaagagttgaaagagagactcgctcaagtacgaaagcagatctcacgagaagaacatgaaaatcgacatatggggaattatagacgaatttatcctcctgaagataaagcattacttgaaaagtatgaaaatttgttagctgttgcctttcagaccttcctttcaggaagagcagcttcattccagcgagagttgaataatcctttgaaaaggatgaaggaagaagatattttggatcttctggagcaatgtgaaattgatgatgaaaagttgatgggaaaaactaccaagactcgaggaccaaagcctctgtgttctatgcctgagagtactgagataatgaaaagaccaaagtactgcagcagtgacagcagttatgatagtagcagcagctcttcagaatctgacgaaaatgaaaaagaagagtaccaaaataagaaaagagaaaagcaagttacatataatcttaaaccctccaaccactacaaattaattcaacaacccagctccataagacgttcagtcagctgccctcggtccatctctgctcaatcaccttccagtggggacacccgcccattttctgctcaacaaatgatatctgtgtcacggccaacttctgcatctcggtcacattccttaaaccgtgcttcctcctacatgaggcatctgcctcacagtaatgatgcctgctctaccaactctcaagtgagtgagtctttgcggcaactgaaaacaaaagaacaagaagatgatctaacaagtcagaccttatttgttctcaaagacatgaagatccggtttccaggaaagtcagatgcagaatcagaacttctgatagaagatatcattgataactggaagtatcataaaaccaaagtggcttcatattggctcataaaattggactctgtaaaacaacgaaaagttttggacatagtgaaaacaagtattcgtacagttcttccacgcatctggaaggtgcctgatgttgaagaagtaaatttatatcggattttcaaccgggtttttaatcgcttactctggagtcgtggccaagggctgtggaactgtttctgtgattcaggttacgtgtaaaatcttagaaaaatataatccaagtgtttgattatatccaagaatccaaggccttgattcttgcctttgcctgtcaacattcccaataataaaacaaaatcctcttgggagagtatattcaataaaagcccggaggtggtgactcctttgcagctccagtgttgccagcgcctagtggagctttgtaaacagtgcctgctagtggtttacaaatatgcaactgacaaaagaggatcactttcaggcattggtcctgactggggtaattccagggactgaacaaggacagcaatcacgaacctaaaggtgataaaacatacttggaaatgaagttatttgacttatataccttcactttcaaaagtccagagcaagagcatccaaaaatgtggtatttactaccagggagcacccaattcttcttgagaacaccaacctacaacttgaagtacaattcacctggaatgactcgctccaatgttttgtttacatccagatatggccatctgtgaaacagaagggaagatcgccattggttatacataacagcaattcatttttttcctctgaagttgaacatgcaaagaacatgaccattaagtgctgttttatgtatataagacatatatatgtgtgaaaatatatgcacatatgcaccctaataacatatatttattatattaaatgatatatgaaagaagaattagcagaaaatggaatataagacttaacctttctggaaacgtaataaaccatgttaaaattgtttacacaaatatgtgaatgtctagaatctgctaggtttataattaattccttcctactagaaatgttatttttgctgcagagtatataaaacaaattgatcttgaagatccaattacagtgttaaattattttctagataacatgccttttgacctgaaaaagggtttagtataataccttaaaaattctcatatatagtagccattttaaatgaaacaaaaagatttagaagcctggtgttgcttgatgataagattaagaagtttaaaacgggtttatcattactatagcacactgtaaagtgctagaaaagtcataacctgattctccaatctttttattcctctatgtggaaatttagctacttgtaataaggtacattttcagtaaggatctggtgagatcatattatgatctaacatgaaagacaggctgggcgcggtggctcacgcctgtaattccagcactttgggaggccgaggtgagtggatcaccgctggtcaggagtttgagactagcctggccaacatggtgaaaccccatctctactaaaaatacaaaaattagctgggcgtgatggtaagtgcttgtaatcccagctacttgggcggctgagacaggagaatcacttgaacctgggaggcggaggttgcagtgagccgagattgtgccattgcattctagcctgggtgacaagagtgaaactctgtctcaaaaaaaaaaaataataataaaataaaataaataaataaataaaaagaagataaaaataaataaataaaatggaagacaatccaatgggttaaaaataaaatgtaaactagctttcatttttacttttcataatcacataaaggaacagaaaatgatggtaacaaaatctttctatatggcttttatgtcttataccactcatttttatttggaaagtatatctttgatgggtttaacatgtggttaaatacaatttctcctgtttcgcagaagtagaagagttgacacatttcactcattttagtgttacaggataatgagacaaacttatttttataaatctctcaaggttgaaatcaacttatattgcaaattctaatacagtagtttctcattgcaccacagaaacagttaaaggattgtgaatagaagatttcaattatcacatattacaagtcatcagtgtacccttgagggtttttaaaaaatcaaaacagagaacgaagtgttcttgtccaaagttgttatgcataagtttcatagcagtttacttccttttcttgaatacagtttttaaaaccaagagtgagctttcagttttccataaaaatataagccgtactactttgacattgaaatcatcagtgcagccatcacttcttagaatttatttaaacttcttctcccaacagttttattttcttttagctgctaattattttcgaaattcatgaatgttttacctccttttactattctgaaagttatttcaagaagtggccccaaagcaggagaactgagaggggcaaattggcctggtttaattcacagcctgaagaattggcaacctaaagttataagttagatgtattttgcttttcaagccatcttctgagccttttttaggctgaaatgatttgtttatttcccaaattattgctagctacttgattttttatggctacctaacatccacatttggtagatacttttcctctctgcatgcatcccaaagaagaatttgctatttgtggaagaagagaataagggtatcagaatgaaggaaattacagtgactacactgtttatgactccattttgtgaattcttaaatatgctatggatttttttttagaaaaaataatgcaaaaattgggatattacagaatcaccataaagatgatcaacaagtaataagtcttttcatggagttcatttttcttttaaattcatgatttggccacaaaaatatatatataagtgtctgatatatgataacagcccagtttctcggccactcatttgcattatcttaaatcacaaataattacttaatttgctggagtgtgtgctttgcaacttttgtaccagagcaaaatttgtatttaaaacaaaaaataagaatgcccatcactaggagaaacactcctcacagaaaacacacacacacacacacacacaatttaaaaactgagtaaatttaaatgtatgaaagtaccccacaaattgatttcaacaaataaatttcatttctctagctacttatgtctggccttattttgagcgttacaattttattgccttcatttgcctatttagactgatgtagtttgatatgatgaagttgtgaataaaagccttgtgttcattatttatatatactacctggtatgctatggactgtgtctgctgtagtgctattccctaatgagcaactaagagaagacacaacaataaaccatggaagtgttgggaggccatggaaatgatttagaggtataaaatattcccaagtttttattataaatttttattcataggttaaaacatataagcataagtgattgtacaggtgtgactcccttttctaggagagaaaatagctttatttgaaaactccaaaagctacttaatcttaccagaggtttttaataggggaactgggtttacttacaatgaaagcatattttcattctgctatagaaaaacatatccctgctcattcagtaaatctaagattggaatgctttctagaactatgcaatatttgaataatttctagaaatgtctaagaaacaaccttttttattttaaatcatcacttacaaacgtagtctgagactgcaaactagttttcacttgactaatccatcattatagattagttaccatttgctctatataatctattgaagaaactattgttattcatattttgattaattttactagcaacaaatttttattttagtagcattgcatttaccttaaatatgtaaaaatgaagttgtaacaggatcaaatatggaaatggcaatggtaactctgcctagaacatagttgaatgtccttggttgtcggtaagatgcaaagatctatacaaattttatcataggtcaaaattatttctaaatatacaaacagtttcaactatttctttctccctaaaactaaaaccaaaccaaacccaaatgaagaaacctaaacttcttttcatctaatagttatacccaactagataatagtagcttctagacatcaataaaaagatttcattttaactgtctttttaatttgtaaaatatatgagtatggaattttgtatctaacttgaaatttcagatgttttaataatccaaatacgttcttctttagcatgtcaaagtactaatagttaaaaaatttctttagatttaagcatatacattacttgactttttcaaaagtatcaaaaaattgatagctgcagaaatgccattatttgattttctaaaaaacattgattcattcttaaatgtgtattctttaaaaaatagtaaatacctcaagagtgacagaaaactttccttttctgttctgtaatgctaatttaaactttgagtcttagtttacatggtcataggggttaaataaaatgtataactgtacaattaattgtgttcttgtgacctgatgattttttgaaaatttgcttttctctttaagaaatttaagttttcaagggccgtattagttatctaaatattttgggctaatgttgacttataaataaataaaaatttagaaatatattcatgatgacaattttgttacttacactgcctattctttatttcttttttagttcaaaggtgaaattttgacctttgtattaacaaagcctcaagaaaagagaaattctgccttttaaacattggttttccttgcattttatggtggtgtgattttgcctcagcaataataaaacataaaatatgttgttgcatcaagttcagtttgtctgctgagattatttttaagaaccaggttgaagcctctatgcctaaaaaagcgtttattgtctggatacatataaagcaagatatatggctacaaataagtcttgcaaccaaaattggtatattaaaatttactgcacactttgagattgctgccattttttggtgctttttggacctcgtcataaagggatgtatcgtatattagggaaaattactcaagttacacattctacattaactgcgctgtattatctacaggtacaatcaatggaccaatagttcctaaattagtaataaggcttaccttacaaaagtaatgaaataacactgatatttctctttcaaaggctaacagcaattcttggtcctgagctattcagttcatacaataactactgtacatgctacaacatctgaatattaatggttttgctgcagattctgggtatgaggattagcttgaaagcaatacatttgctaacatgaatcatgactcacattatccccgtgtgctttactacctgtatatgaatgcaaatgttgttacagaaaatatgcttgaaatgtcaatacagtgtgcaattagcgttgcattgtcatgctccagcatgtgatatctgtatggtgaagttatttcaattactctgatacattactataataaaaaagtttaacctaagaaa

SEQ ID NO: 195974 - DNA, 7828 bp, Homo sapiens
  Payload ID: 18666
  Gene Name: tubulin tyrosine ligase-like family member 7
  Uniprot ID: Q6ZT98
  ENST ID: ENST00000480174
  CDS Start-End: 171-2180
tgttatcccataactttggtatcctgaaatctgaggattccaccaagataatatgataagaactttcagtgatttggggccatatcctacttagactaatgtggaatttccagatttcctgagagcttggtacagcagcacacactgcttgctaatcagcacaggcaataatgccatctctgcctcaagaaggagttattcagggaccctctcccctggatttgaatacagaattaccttatcaaagcacaatgaaaaggaaagtcagaaagaagaaaaagaagggaaccattacagcaaatgttgccgggacaaagtttgaaattgttcgtttagtaatagatgaaatgggatttatgaaaactccagatgaggatgaaacaagtaatcttatatggtgtgattctgctgttcagcaggagaaaatttcagagctgcaaaattatcagaggatcaaccattttccaggaatgggggagatctgtaggaaggatttcttagcaagaaatatgaccaaaatgatcaagtctcggcctctggattatacctttgttcctcgaacttggatctttcctgctgaatatactcaattccaaaattatgtgaaagaattgaagaaaaaacggaagcagaaaacttttatagtgaaaccagctaatggtgcaatgggtcatgggatttctttgataagaaatggtgacaaacttccatctcaggatcatttgattgttcaagaatacattgaaaagcctttcctaatggaaggttacaagtttgacttacgaatttatattctggttacatcgtgtgatccactaaaaatatttctctaccatgatgggcttgtgcgaatgggtacagagaagtacattccacctaatgagtccaatttgacccagttatacatgcatctgacaaactactccgtgaacaagcataatgagcattttgaacgggatgaaactgagaacaaaggcagcaaacgttccatcaaatggtttacagaattccttcaagcaaatcaacatgatgttgctaagttttggagtgatatttcagaattggtggtaaagaccctgattgtagcagaacctcatgtcctgcatgcctatcgaatgtgtagacctggtcaacctccaggaagcgaaagtgtctgctttgaagtcctgggatttgatattttgttggatagaaaactaaagccatggcttctggagattaaccgagccccaagctttggaactgatcagaaaatagactatgatgtaaaaaggggagtgctgctaaatgcgttgaagctactaaacataaggaccagtgacaaaagaagaaacttggccaaacaaaaagctgaggctcaaaggaggctctatggtcaaaattcaattaaaaggctcttaccaggctcctcagactgggaacagcagagacaccagttggagaggcggaaagaagagttgaaagagagactcgctcaagtacgaaagcagatctcacgagaagaacatgaaaatcgacatatggggaattatagacgaatttatcctcctgaagataaagcattacttgaaaagtatgaaaatttgttagctgttgcctttcagaccttcctttcaggaagagcagcttcattccagcgagagttgaataatcctttgaaaaggatgaaggaagaagatattttggatcttctggagcaatgtgaaattgatgatgaaaagttgatgggaaaaactaccaagactcgaggaccaaagcctctgtgttctatgcctgagagtactgagataatgaaaagaccaaagtactgcagcagtgacagcagttatgatagtagcagcagctcttcagaatctgacgaaaatgaaaaagaagagtaccaaaataagaaaagagaaaagcaagttacatataatcttaaaccctccaaccactacaaattaattcaacaacccagctccataagacgttcagtcagctgccctcggtccatctctgctcaatcaccttccagtggggacacccgcccattttctgctcaacaaatgatatctgtgtcacggccaacttctgcatctcggtcacattccttaaaccgtgcttcctcctacatgaggcatctgcctcacagtaatgatgcctgctctaccaactctcaagtgattatactggcacaatgaaataagaccccctccaaatatctgtattctttcaaatttaagagtgagtctttgcggcaactgaaaacaaaagaacaagaagatgatctaacaagtcagaccttatttgttctcaaagacatgaagatccggtttccaggaaagtcagatgcagaatcagaacttctgatagaagatatcattgataactggaagtatcataaaaccaaagtggcttcatattggctcataaaattggactctgtaaaacaacgaaaagttttggacatagtgaaaacaagtattcgtacagttcttccacgcatctggaaggtgcctgatgttgaagaagtaaatttatatcggattttcaaccgggtttttaatcgcttactctggagtcgtggccaagggctgtggaactgtttctgtgattcaggatcctcttgggagagtatattcaataaaagcccggaggtggtgactcctttgcagctccagtgttgccagcgcctagtggagctttgtaaacagtgcctgctagtggtttacaaatatgcaactgacaaaagaggatcactttcaggcattggtcctgactggggtaattccaggtatttactaccagggagcacccaattcttcttgagaacaccaacctacaacttgaagtacaattcacctggaatgactcgctccaatgttttgtttacatccagatatggccatctgtgaaacagaagggaagatcgccattggttatacataacagcaattcatttttttcctctgaagttgaacatgcaaagaacatgaccattaagtgctgttttatgtatataagacatatatatgtgtgaaaatatatgcacatatgcaccctaataacatatatttattatattaaatgatatatgaaagaagaattagcagaaaatggaatataagacttaacctttctggaaacgtaataaaccatgttaaaattgtttacacaaatatgtgaatgtctagaatctgctaggtttataattaattccttcctactagaaatgttatttttgctgcagagtatataaaacaaattgatcttgaagatccaattacagtgttaaattattttctagataacatgccttttgacctgaaaaagggtttagtataataccttaaaaattctcatatatagtagccattttaaatgaaacaaaaagatttagaagcctggtgttgcttgatgataagattaagaagtttaaaacgggtttatcattactatagcacactgtaaagtgctagaaaagtcataacctgattctccaatctttttattcctctatgtggaaatttagctacttgtaataaggtacattttcagtaaggatctggtgagatcatattatgatctaacatgaaagacaggctgggcgcggtggctcacgcctgtaattccagcactttgggaggccgaggtgagtggatcaccgctggtcaggagtttgagactagcctggccaacatggtgaaaccccatctctactaaaaatacaaaaattagctgggcgtgatggtaagtgcttgtaatcccagctacttgggcggctgagacaggagaatcacttgaacctgggaggcggaggttgcagtgagccgagattgtgccattgcattctagcctgggtgacaagagtgaaactctgtctcaaaaaaaaaaaataataataaaataaaataaataaataaataaaaagaagataaaaataaataaataaaatggaagacaatccaatgggttaaaaataaaatgtaaactagctttcatttttacttttcataatcacataaaggaacagaaaatgatggtaacaaaatctttctatatggcttttatgtcttataccactcatttttatttggaaagtatatctttgatgggtttaacatgtggttaaatacaatttctcctgtttcgcagaagtagaagagttgacacatttcactcattttagtgttacaggataatgagacaaacttatttttataaatctctcaaggttgaaatcaacttatattgcaaattctaatacagtagtttctcattgcaccacagaaacagttaaaggattgtgaatagaagatttcaattatcacatattacaagtcatcagtgtacccttgagggtttttaaaaaatcaaaacagagaacgaagtgttcttgtccaaagttgttatgcataagtttcatagcagtttacttccttttcttgaatacagtttttaaaaccaagagtgagctttcagttttccataaaaatataagccgtactactttgacattgaaatcatcagtgcagccatcacttcttagaatttatttaaacttcttctcccaacagttttattttcttttagctgctaattattttcgaaattcatgaatgttttacctccttttactattctgaaagttatttcaagaagtggccccaaagcaggagaactgagaggggcaaattggcctggtttaattcacagcctgaagaattggcaacctaaagttataagttagatgtattttgcttttcaagccatcttctgagccttttttaggctgaaatgatttgtttatttcccaaattattgctagctacttgattttttatggctacctaacatccacatttggtagatacttttcctctctgcatgcatcccaaagaagaatttgctatttgtggaagaagagaataagggtatcagaatgaaggaaattacagtgactacactgtttatgactccattttgtgaattcttaaatatgctatggatttttttttagaaaaaataatgcaaaaattgggatattacagaatcaccataaagatgatcaacaagtaataagtcttttcatggagttcatttttcttttaaattcatgatttggccacaaaaatatatatataagtgtctgatatatgataacagcccagtttctcggccactcatttgcattatcttaaatcacaaataattacttaatttgctggagtgtgtgctttgcaacttttgtaccagagcaaaatttgtatttaaaacaaaaaataagaatgcccatcactaggagaaacactcctcacagaaaacacacacacacacacacacacaatttaaaaactgagtaaatttaaatgtatgaaagtaccccacaaattgatttcaacaaataaatttcatttctctagctacttatgtctggccttattttgagcgttacaattttattgccttcatttgcctatttagactgatgtagtttgatatgatgaagttgtgaataaaagccttgtgttcattatttatatatactacctggtatgctatggactgtgtctgctgtagtgctattccctaatgagcaactaagagaagacacaacaataaaccatggaagtgttgggaggccatggaaatgatttagaggtataaaatattcccaagtttttattataaatttttattcataggttaaaacatataagcataagtgattgtacaggtgtgactcccttttctaggagagaaaatagctttatttgaaaactccaaaagctacttaatcttaccagaggtttttaataggggaactgggtttacttacaatgaaagcatattttcattctgctatagaaaaacatatccctgctcattcagtaaatctaagattggaatgctttctagaactatgcaatatttgaataatttctagaaatgtctaagaaacaaccttttttattttaaatcatcacttacaaacgtagtctgagactgcaaactagttttcacttgactaatccatcattatagattagttaccatttgctctatataatctattgaagaaactattgttattcatattttgattaattttactagcaacaaatttttattttagtagcattgcatttaccttaaatatgtaaaaatgaagttgtaacaggatcaaatatggaaatggcaatggtaactctgcctagaacatagttgaatgtccttggttgtcggtaagatgcaaagatctatacaaattttatcataggtcaaaattatttctaaatatacaaacagtttcaactatttctttctccctaaaactaaaaccaaaccaaacccaaatgaagaaacctaaacttcttttcatctaatagttatacccaactagataatagtagcttctagacatcaataaaaagatttcattttaactgtctttttaatttgtaaaatatatgagtatggaattttgtatctaacttgaaatttcagatgttttaataatccaaatacgttcttctttagcatgtcaaagtactaatagttaaaaaatttctttagatttaagcatatacattacttgactttttcaaaagtatcaaaaaattgatagctgcagaaatgccattatttgattttctaaaaaacattgattcattcttaaatgtgtattctttaaaaaatagtaaatacctcaagagtgacagaaaactttccttttctgttctgtaatgctaatttaaactttgagtcttagtttacatggtcataggggttaaataaaatgtataactgtacaattaattgtgttcttgtgacctgatgattttttgaaaatttgcttttctctttaagaaatttaagttttcaagggccgtattagttatctaaatattttgggctaatgttgacttataaataaataaaaatttagaaatatattcatgatgacaattttgttacttacactgcctattctttatttcttttttagttcaaaggtgaaattttgacctttgtattaacaaagcctcaagaaaagagaaattctgccttttaaacattggttttccttgcattttatggtggtgtgattttgcctcagcaataataaaacataaaatatgttgttgcatcaagttcagtttgtctgctgagattatttttaagaaccaggttgaagcctctatgcctaaaaaagcgtttattgtctggatacatataaagcaagatatatggctacaaataagtcttgcaaccaaaattggtatattaaaatttactgcacactttgagattgctgccattttttggtgctttttggacctcgtcataaagggatgtatcgtatattagggaaaattactcaagttacacattctacattaactgcgctgtattatctacaggtacaatcaatggaccaatagttcctaaattagtaataaggcttaccttacaaaagtaatgaaataacactgatatttctctttcaaaggctaacagcaattcttggtcctgagctattcagttcatacaataactactgtacatgctacaacatctgaatattaatggttttgctgcagattctgggtatgaggattagcttgaaagcaatacatttgctaacatgaatcatgactcacattatccccgtgtgctttactacctgtatatgaatgcaaatgttgttacagaaaatatgcttgaaatgtcaatacagtgtgcaattagcgttgcattgtcatgctccagcatgtgatatctgtatggtgaagttatttcaattactctgatacattactataataaaaaagtttaacctaagaaa

SEQ ID NO: 195975 - DNA, 2028 bp, Homo sapiens
  Payload ID: 18666
  Gene Name: tubulin tyrosine ligase-like family member 7
  ENST ID: ENST00000610996
  CDS Start-End: 397-2028
gcttgggcagcgacagctgttccaggcactccgcgtcgagcaccggagtcccgagccgtggctgccacgggcggtgggcgggcggaggagagcaccggaccaccagtgcaggctgccgagtcggggcggccgcccacggggaagctgcgaggcgcgggagcacctgggggaccgcttgcagcggggacgcgaggacccgggctgggctttcctcacccgggtaccttgttatcccataactttggtatcctgaaatctgaggattccaccaagataatatgataagaactttcagtgatttggggccatatcctacttagactaatgtggaatttccagatttcctgagagcttggtacagcagcacacactgcttgctaatcagcacaggcaataatgccatctctgcctcaagaaggagttattcagggaccctctcccctggatttgaatacagaattaccttatcaaagcacaatgaaaaggaaagtcagaaagaagaaaaagaagggaaccattacagcaaatgttgccgggacaaagtttgaaattgttcgtttagtaatagatgaaatgggatttatgaaaactccagatgaggatgaaacaagtaatcttatatggtgtgattctgctgttcagcaggagaaaatttcagagctgcaaaattatcagaggatcaaccattttccaggaatgggggagatctgtaggaaggatttcttagcaagaaatatgaccaaaatgatcaagtctcggcctctggattatacctttgttcctcgaacttggatctttcctgctgaatatactcaattccaaaattatgtgaaagaattgaagaaaaaacggaagcagaaaacttttatagtgaaaccagctaatggtgcaatgggtcatgggatttctttgataagaaatggtgacaaacttccatctcaggatcatttgattgttcaagaatacattgaaaagcctttcctaatggaaggttacaagtttgacttacgaatttatattctggttacatcgtgtgatccactaaaaatatttctctaccatgatgggcttgtgcgaatgggtacagagaagtacattccacctaatgagtccaatttgacccagttatacatgcatctgacaaactactccgtgaacaagcataatgagcattttgaacgggatgaaactgagaacaaaggcagcaaacgttccatcaaatggtttacagaattccttcaagcaaatcaacatgatgttgctaagttttggagtgatatttcagaattggtggtaaagaccctgattgtagcagaacctcatgtcctgcatgcctatcgaatgtgtagacctggtcaacctccaggaagcgaaagtgtctgctttgaagtcctgggatttgatattttgttggatagaaaactaaagccatggcttctggagattaaccgagccccaagctttggaactgatcagaaaatagactatgatgtaaaaaggggagtgctgctaaatgcgttgaagctactaaacataaggaccagtgacaaaagaagaaacttggccaaacaaaaagctgaggctcaaaggaggctctatggtcaaaattcaattaaaaggctcttaccaggctcctcagactgggaacagcagagacaccagttggagaggcggaaagaagagttgaaagagagactcgctcaagtacgaaagcagatctcacgagaagaacatgaaaatcgacatatggggaattatagacgaatttatcctcctgaagataaagcattacttgaaaagtatgaaaatttgttagctgttgcctttcagaccttcctttcaggaagagcagcttcattccagcgagagttgaataatcctttgaaaaggatgaaggaagaagatattttggatcttctggagcaatgtgaaattgatgatgaaaagttgatgggaaaaactaccaagactcgaggaccaaagggtcgaataactcattatgtagtcaagctctttaagaacacttaa

SEQ ID NO: 195976 - DNA, 2505 bp, Homo sapiens
  Payload ID: 18667
  Gene Name: tubulin tyrosine ligase-like family member 8
  Uniprot ID: A6PVC2
  ENST ID: ENST00000266182
  CDS Start-End: 1-2505
atgaggctcctggatgggaaacagacttccaggtactcagagaatgcctgcgagaagaagattttctctatctacggacactacccggtggtccgggccgctctgcgaaggaagggctgggtagagaagaagttccactttttgcccaaggtcattccggatgtcgaggatgaaggcgcccgggtcaatgatgatacatgtgccaaagtcaaagaaaatcaagaaatggctttggagaaaacagacaacatccacgacgtgatgtctaggttggtaaaaaatgagatgccgtacctcctctggaccatcaagagggacatcattgactatcacagcctgacctacgaccagatgctgaaccactacgcaaagacagcctccttcaccaccaagatcgggctgtgcgtgaacatgcggagcctgccctggtacgtcccggccaaccccgactccttcttcccacgctgctacagcctctgcaccgagagtgagcagcaggagttcctggaagacttccggcgcaccatggcatccagcatcctcaagtgggtggtcagccaccagagctgcagcaggagcagcagaagcaagcccagggaccagagggaggaggccgggagcagcgacctgagcagcaggcaagatgctgaaaatgctgaggcaaagctcaggggcctcccggggcagcttgtggacatcgcgtgcaaggtgtgccaggcctacctggggcagctggagcatgaggacatcgacacgtcagcagatgccgtggaggacctcactgaggccgagtgggaggacctgacccagcagtactactccctcgttcaggtgcctttggggagtagcattgtcttgtgcatcttcaaaatccagaaggttatgatgtcatttgagccccccacagcccgagacaggcagtgccaggctctgctgaatagaatcacgtctgtgaaccctcagacggacattgacgggctccggaacatctggattataaagcccgcggccaagtcccggggccgaggtgagtcccctgacatagtgtgcatggaccgtgtggaggagatcctggagctggcagctgcagaccaccctctttccagggacaacaagtgggtggtccagaagtacatcgagacgccgctgctcatctgtgacaccaagttcgacatcagacagtggttcctcgtcacggactggaaccccctgaccatctggttctacaaggagagttacttgcggttctcaactcagcgcttctccctggacaagctggacagcgccatccacctgtgcaacaacgccgtccagaagtacctgaagaatgatgtgggccgcagccccctgctgcccgcacacaacatgtggaccagcaccaggttccaggagtacctgcagcgccagggccgtggcgccgtgtggggcagcgtcatctacccgtccatgaagaaggccatcgcccacgccatgaaggtggcccaggaccacgtggagcctcgcaagaacagctttgagctctacggggctgacttcgtccttgggagggacttcaggccctggctgatcgagatcaattccagccccaccatgcacccgtccacgccggtcacggcccagctgtgtgcacaggtgcaggaggacaccatcaaggtggccgtggaccgcagctgtgacatcggcaacttcgagctcctgtggaggcagccggtggttgagccgcccccattcagcgggtccgacctctgcgtggcgggcgtcagtgtgaggagagccaggaggcaggtgctgcccgtctgcaacctcaaggcctcggcctcgctgttggacgcgcagccgctgaaggcacggggcccctcggccatgccagaccctgcccagggacccccatcaccagctctccagcgggacttgggactgaaggaagagaaggggctccccctggccttgctggcacccttaaggggggcagccgagagcggtggagccgcacagcccacccgcaccaaagctgctgggaaggtggagctcccggcctgcccctgtcgccacgtggacagtcaggccccaaacaccggtgtccccgtagcccagcccgccaaaagctgggatccaaaccagctaaatgcgcacccgctggagcctgtgctgcggggcctgaagacagcagagggcgcgctgcgtccgccgcccggaggaaaaggagagggcacggtctgcagccgcctgccacaccacgggcaccacgtggccgcctgccagaccacgggcaccacgtgggatggtgggcctggggtgtgcttcctccggcagctcctggcatcagaactgcccatgggccctgggctgccgagggacccccgagcgccgccctgcctcgtgtgccgcgggctgctgccacccgccgggccctgcaagcgctgccgctcgttctgcgccgcggtcctgcagggcgcgtccttcgtgcggctcggcgggcggagctgcagcccgcggaccccgtga

SEQ ID NO: 195977 - DNA, 2549 bp, Homo sapiens
  Payload ID: 18667
  Gene Name: tubulin tyrosine ligase-like family member 8
  ENST ID: ENST00000433387
  CDS Start-End: 1-2549
atggaaccagagaggaaggggctatcgttggcttcttcttcagatggagacgggagagaagaaaataaattaaaacaaggaatttcccaagacttggcttcttcctccagattagacagatacaaaatagcaaggcagttaacagaaaaagcaatcaaggagaagaagattttctctatctacggacactacccggtggtccgggccgctctgcgaaggaagggctgggtagagaagaagttccactttttgcccaaggtcattccggatgtcgaggatgaaggcgcccgggtcaatgatgatacatgtgccaaagtcaaagaaaatcaagaaatggctttggagaaaacagacaacatccacgacgtgatgtctaggttggtaaaaaatgagatgccgtacctcctctggaccatcaagagggacatcattgactatcacagcctgacctacgaccagatgctgaaccactacgcaaagacagcctccttcaccaccaagatcgggctgtgcgtgaacatgcggagcctgccctggtacgtcccggccaaccccgactccttcttcccacgctgctacagcctctgcaccgagagtgagcagcaggagttcctggaagacttccggcgcaccatggcatccagcatcctcaagtgggtggtcagccaccagagctgcagcaggagcagcagaagcaagcccagggaccagagggaggaggccgggagcagcgacctgagcagcaggcaagatgctgaaaatgctgaggcaaagctcaggggcctcccggggcagcttgtggacatcgcgtgcaaggtgtgccaggcctacctggggcagctggagcatgaggacatcgacacgtcagcagatgccgtggaggacctcactgaggccgagtgggaggacctgacccagcagtactactccctcgttcatggcgatgctttcatctccaattcaagaaattacttttcgcagtgccaggctctgctgaatagaatcacgtctgtgaaccctcagacggacattgacgggctccggaacatctggattataaagcccgcggccaagtcccggggccgagacatagtgtgcatggaccgtgtggaggagatcctggagctggcagctgcagaccaccctctttccagggacaacaagtgggtggtccagaagtacatcgagacgccgctgctcatctgtgacaccaagttcgacatcagacagtggttcctcgtcacggactggaaccccctgaccatctggttctacaaggagagttacttgcggttctcaactcagcgcttctccctggacaagctggacagcgccatccacctgtgcaacaacgccgtccagaagtacctgaagaatgatgtgggccgcagccccctgctgcccgcacacaacatgtggaccagcaccaggttccaggagtacctgcagcgccagggccgtggcgccgtgtggggcagcgtcatctacccgtccatgaagaaggccatcgcccacgccatgaaggtggcccaggaccacgtggagcctcgcaagaacagctttgagctctacggggctgacttcgtccttgggagggacttcaggccctggctgatcgagatcaattccagccccaccatgcacccgtccacgccggtcacggcccagctgtgtgcacaggtgcaggaggacaccatcaaggtggccgtggaccgcagctgtgacatcggcaacttcgagctcctgtggaggcagccggtggttgagccgcccccattcagcgggtccgacctctgcgtggcgggcgtcagtgtgaggagagccaggaggcaggtgctgcccgtctgcaacctcaaggcctcggcctcgctgttggacgcgcagccgctgaaggcacggggcccctcggccatgccagaccctgcccagggacccccatcaccagctctccagcgggacttgggactgaaggaagagaaggggctccccctggccttgctggcacccttaaggggggcagccgagagcggtggagccgcacagcccacccgcaccaaagctgctgggaaggtggagctcccggcctgcccctgtcgccacgtggacagtcaggccccaaacaccggtgtccccgtagcccagcccgccaaaagctgggatccaaaccagctaaatgcgcacccgctggagcctgtgctgcggggcctgaagacagcagagggcgcgctgcgtccgccgcccggaggaaaaggagagggcacggtctgcagccgcctgccacaccacgggcaccacgtggccgcctgccagaccacgggcaccacgtgggatggtgggcctggggtgtgcttcctccggcagctcctggcatcagaactgcccatgggccctgggctgccgagggacccccgagcgccgccctgcctcgtgtgccgcgggctgctgccacccgccgggccctgcaagcgctgccgctcgttctgcgccgcggtcctgcagggcgcgtccttcgtgcggctcggcgggcggagctgcagcccgcggacccc

SEQ ID NO: 195978 - DNA, 1540 bp, Homo sapiens
  Payload ID: 18668
  Gene Name: tubulin tyrosine ligase-like family member 9
  ENST ID: ENST00000310998
  CDS Start-End: 197-514
ggatgtcgcctagagccccccggccggcccacaaactcccgtcccccttccggctctgcctggacgtccctgcgggccccgggggaaagcacccaacttctcccgcctcggcttctagcagaaacgtgacggggctggactttgatcgccgagggctctctgctcttcagagtctgcttggaacgggataagagggatggtgccatccagggaagctctgctgggaccaggcacaactgccattaggtgccccaagaaattacagatgacatcattgtatccagagaaaactcaaaggatttacaaactaccagaactaatcattcagcaagggcatcaaatacaagaaccaaaattacaagggccatggattgtcaaagggaaaagagcgagagcagagagcatcgatccggttcaagaccaccctcatgaacacactcatggacgtccttcgccacaggccaggatgggtggaagtgaaggacgaaggggagtgggatttctactggtgtgacgtcagctggctccgggagaacttcgaccacacctacatggatgaacatgtgcggatcagtcacttccggaaccactatgagctgacccggaagaactacatggtgaagaacctgaagcggttccggaagcagctggagcgtgaggcaggaaagctggaggcagccaagtgtgacttcttccccaaaacctttgagatgccttgcgagtaccacctgtttgtagaggagtttcgcaaaaacccaggaatcacctggatcatgaagcctgacacaagaagctctgacgaccagaaagatgatattcccgtggagaactatgtggctcagcgttacattgaaaatccttacctgataggaggccgcaagtttgacctgcgtgtctatgtgctggtgatgtcgtacatcccgctgcgggcctggctctaccgggatggctttgcccgattctccaacacccgcttcacactgaacagcattgatgaccagtatgttcacctcaccaacgtggctgtgcaaaaaacatctcccgactaccacccaaagaaggtggctcctggaggtcaatgcgtccccatcactgacagccagcagccaggaagactatgagctcaagacctgcctcctggaagacaccctgcatgttgtggacatggaagcgaggctgcgtcaacgatcggaagaaacaactgaggcagctcttctgctcccttcaagttcagaagaaagcttccagttgatccccagctgccaggaggaaatcagccttagcaggccttgtgtttgagattgggagctgagccagaaaccggaaaaccctgggctcatgggcaggacagcttcgggagttgagtgtcaagcccgaagggaagacttttggaaggaaaatactggcaaatccaagaagtgaaccagccgactttaggaaagccagaagccaggctactctagaccttctgccttcagagcatgaggacttctcccactcatccctgtacctgaggcacaccaacccagacaggtccagg

SEQ ID NO: 195979 - DNA, 2760 bp, Homo sapiens
  Payload ID: 18668
  Gene Name: tubulin tyrosine ligase-like family member 9
  ENST ID: ENST00000375921
  CDS Start-End: 249-566
gcgggggccttaccccaccctggcaccggcaggcgcgggcggatggggggatgtcgcctagagccccccggccggcccacaaactcccgtcccccttccggctctgcctggacgtccctgcgggccccgggggaaagcacccaacttctcccgcctcggcttctagcagaaacgtgacggggctggactttgatcgccgagggctctctgctcttcagagtctgcttggaacgggataagtgggagggatggtgccatccagggaagctctgctgggaccaggcacaactgccattaggtgccccaagaaattacagatgacatcattgtatccagagaaaactcaaaggatttacaaactaccagaactaatcattcagcaagggcatcaaatacaagaaccaaaattacaagggccatggattgtcaaagggaaaagagcgagagcagagagcatcgatccggttcaagaccaccctcatgaacacactcatggacgtccttcgccacaggccaggatgggtggaagtgaaggacgaaggggagtgggatttctactggtgtgacgtcagctggctccgggagaacttcgaccacacctacatggatgaacatgtgcggatcagtcacttccggaaccactatgagctgacccggaagaactacatggtgaagaacctgaagcggttccggaagcagctggagcgtgaggcaggaaagctggaggcagccaagtgtgacttcttccccaaaacctttgagatgccttgcgagtaccacctgtttgtagaggagtttcgcaaaaacccaggaatcacctggatcatgaagcctgtagcccggtctcaagggaaaggcatcttcctcttccgtaggctgaaggacatcgtggactggaggaaggacacaagaagctctgacgaccagaaagatgatattcccgtggagaactatgtggctcagcgttacattgaaaatccttacctgataggaggccgcaagtttgacctgcgtgtctatgtgctggtgatgtcgatgttcacctcaccaacgtggctgtgcaaaaaacatctcccgactaccacccaaagaagggctgcaagtggacgctgcagcgcttccggcagtacctggcgtccaaacacgggcccgaggcagtggagacactcttcagggacatcgacaacatctttgtcaaaagcctgcagagtgtgcagaaggtgatcatcagtgacaagcactgcttcgagctgtacggctatgacatcctcatcgaccaggacctcaagccgtggctcctggaggtcaatgcgtccccatcactgacagccagcagccaggaagactatgagctcaagacctgcctcctggaagacaccctgcatgttgtggacatggaagcgagcttttccccgattattccagcagaagtttgagggctgattctccttgctggtaactgggacacattcccattcctaaaccactcactgtgactctgcttgaccaggctcacgggaagggagaagcgagtcgggggctttgacctcatgtggaatgatggccctgttagcagagaggagggggctcctgacctgtcgggaatgggaaactttgtgaccaacacacatctcggctgcgtcaacgatcggaagaaacaactgaggcagctcttctgctcccttcaagttcagaagaaagcttccagttgatccccagctgccaggaggaaatcagccttagcaggccttgtgtttgagattgggagctgagccagaaaccggaaaaccctgggctcatgggcaggacagcttcgggagttgagtgtcaagcccgaagggaagacttttggaaggaaaatactggcaaatccaagaagtgaaccagccgactttaggaaagccagaagccaggctactctagaccttctgccttcagagcatgaggacttctcccactcatccctgtacctgaggcacaccaacccagacaggtccaggcatggactccaggttccctatttccagaaggaatgcgattagctttttttggcccagcacccaccctgccagggaggaaggggcaattttccagtgatgaaattgtgaatcaggcagtcacactggacaacatctagcaaggtgaattctgcaactccctactttatttacattttaaaataagcaatatattcatacggtttaaaatccaaagtttacaaaagggtatagggtgacatctccttccctcccacctgtgcgccccaaccctgcaggtgctgttctgagggaatcacactgtgcttgcacaaaaattattagcttataagacaccagccttccccttgctttcctcacttgatgtatcttggagcttgttccttattcttgattatagttgtatggtattgcactatctggagctaacacctgtgacccacactcatgttttaaaagtttctgcattagtcaaaaatatttaaaaggagattcaacttcacaacccatatgtctagcttctcttgaaaacacgtaagaactggccatgacagcctgtgtttctatgtaactatgagccagagccaaggagcggggggaccaggagaggtgtgcccctgccatgctgccatttgttatcacccgcctgtcaaatcacaggtttatttcaaggcaagaaccatgttcataggttgtattctaaatggagtggcgtgcccttactgaaggactagatgaggcaaataaagactagttgctgcta

SEQ ID NO: 195980 - DNA, 1263 bp, Homo sapiens
  Payload ID: 18668
  Gene Name: tubulin tyrosine ligase-like family member 9
  ENST ID: ENST00000375934
  CDS Start-End: 55-894
aagcacgcgaggcgcgcggtggcggtttggatctggcccctggggaatcgcgttatgtcgcgaccgaagaaccaaaattacaagggccatggattgtcaaagggaaaagagcgagagcagagagcatcgatccggttcaagaccaccctcatgaacacactcatggacgtccttcgccacaggccaggatgggtggaagtgaaggacgaaggggagtgggatttctactggtgtgacgtcagctggctccgggagaacttcgaccacacctacatggatgaacatgtgcggatcagtcacttccggaaccactatgagctgacccggaagaactacatggtgaagaacctgaagcggttccggaagcagctggagcgtgaggcaggaaagctggaggcagccaagtgtgacttcttccccaaaacctttgagatgccttgcgagtaccacctgtttgtagaggagtttcgcaaaaacccaggaatcacctggatcatgaagcctgtagcccggtctcaagggaaaggcatcttcctcttccgtaggctgaaggacatcgtggactggaggaaggacacaagaagctctgacgaccagaaagatgatattcccgtggagaactatgtggctcagcgttacattgaaaatccttacctgataggaggccgcaagtttgacctgcgtgtctatgtgctggtgatgtcgatgttcacctcaccaacgtggctgtgcaaaaaacatctcccgactaccacccaaagaagggctgcaagtggacgctgcagcgcttccggcagtacctggcgtccaaacacgggcccgaggcagtggagacactcttcagggacatcgacaacatctttgtcaaaagcctgcagagtgtgcagaaggtgatcatcagtgacaagcactgcttcgagctgtacggctatgacatcctcatcgaccaggacctcaagccgtggctcctggaggtcaatgcgtccccatcactgacagccagcagccaggaagactatgagctcaagacctgcctcctggaagacaccctgcatgttgtggacatggaagcgaggctcacgggaagggagaagcgagtcgggggctttgacctcatgtggaatgatggccctgttagcagagaggagggggctcctgacctgtcgggaatgggaaactttgtgaccaacacacatctcggctgcgtcaacgatcggaagaaacaactgaggcagctcttctgctcccttcaagttcagaaga

SEQ ID NO: 195981 - DNA, 2623 bp, Homo sapiens
  Payload ID: 18668
  Gene Name: tubulin tyrosine ligase-like family member 9
  Uniprot ID: Q3SXZ7
  ENST ID: ENST00000375938
  CDS Start-End: 254-1573
gaggtgggggcgggggccttaccccaccctggcaccggcaggcgcgggcggatggggggatgtcgcctagagccccccggccggcccacaaactcccgtcccccttccggctctgcctggacgtccctgcgggccccgggggaaagcacccaacttctcccgcctcggcttctagcagaaacgtgacggggctggactttgatcgccgagggctctctgctcttcagagtctgcttggaacgggataagagggatggtgccatccagggaagctctgctgggaccaggcacaactgccattaggtgccccaagaaattacagaaccaaaattacaagggccatggattgtcaaagggaaaagagcgagagcagagagcatcgatccggttcaagaccaccctcatgaacacactcatggacgtccttcgccacaggccaggatgggtggaagtgaaggacgaaggggagtgggatttctactggtgtgacgtcagctggctccgggagaacttcgaccacacctacatggatgaacatgtgcggatcagtcacttccggaaccactatgagctgacccggaagaactacatggtgaagaacctgaagcggttccggaagcagctggagcgtgaggcaggaaagctggaggcagccaagtgtgacttcttccccaaaacctttgagatgccttgcgagtaccacctgtttgtagaggagtttcgcaaaaacccaggaatcacctggatcatgaagcctgtagcccggtctcaagggaaaggcatcttcctcttccgtaggctgaaggacatcgtggactggaggaaggacacaagaagctctgacgaccagaaagatgatattcccgtggagaactatgtggctcagcgttacattgaaaatccttacctgataggaggccgcaagtttgacctgcgtgtctatgtgctggtgatgtcggtgtttgctgaatgcctgctgtggtctgggcacaggagacaggatgttcacctcaccaacgtggctgtgcaaaaaacatctcccgactaccacccaaagaagggctgcaagtggacgctgcagcgcttccggcagtacctggcgtccaaacacgggcccgaggcagtggagacactcttcagggacatcgacaacatctttgtcaaaagcctgcagagtgtgcagaaggtgatcatcagtgacaagcactgcttcgagctgtacggctatgacatcctcatcgaccaggacctcaagccgtggctcctggaggtcaatgcgtccccatcactgacagccagcagccaggaagactatgagctcaagacctgcctcctggaagacaccctgcatgttgtggacatggaagcgaggctcacgggaagggagaagcgagtcgggggctttgacctcatgtggaatgatggccctgttagcagagaggagggggctcctgacctgtcgggaatgggaaactttgtgaccaacacacatctcggctgcgtcaacgatcggaagaaacaactgaggcagctcttctgctcccttcaagttcagaagaaagcttccagttgatccccagctgccaggaggaaatcagccttagcaggccttgtgtttgagattgggagctgagccagaaaccggaaaaccctgggctcatgggcaggacagcttcgggagttgagtgtcaagcccgaagggaagacttttggaaggaaaatactggcaaatccaagaagtgaaccagccgactttaggaaagccagaagccaggctactctagaccttctgccttcagagcatgaggacttctcccactcatccctgtacctgaggcacaccaacccagacaggtccaggcatggactccaggttccctatttccagaaggaatgcgattagctttttttggcccagcacccaccctgccagggaggaaggggcaattttccagtgatgaaattgtgaatcaggcagtcacactggacaacatctagcaaggtgaattctgcaactccctactttatttacattttaaaataagcaatatattcatacggtttaaaatccaaagtttacaaaagggtatagggtgacatctccttccctcccacctgtgcgccccaaccctgcaggtgctgttctgagggaatcacactgtgcttgcacaaaaattattagcttataagacaccagccttccccttgctttcctcacttgatgtatcttggagcttgttccttattcttgattatagttgtatggtattgcactatctggagctaacacctgtgacccacactcatgttttaaaagtttctgcattagtcaaaaatatttaaaaggagattcaacttcacaacccatatgtctagcttctcttgaaaacacgtaagaactggccatgacagcctgtgtttctatgtaactatgagccagagccaaggagcggggggaccaggagaggtgtgcccctgccatgctgccatttgttatcacccgcctgtcaaatcacaggtttatttcaaggcaagaaccatgttcataggttgtattctaaatggagtggcgtgcccttactgaaggactagatgaggcaaataaagactagttgctgctatt

SEQ ID NO: 195982 - DNA, 3261 bp, Homo sapiens
  Payload ID: 18668
  Gene Name: tubulin tyrosine ligase-like family member 9
  Uniprot ID: Q3SXZ7
  ENST ID: ENST00000535842
  CDS Start-End: 1-1320
atggtgccatccagggaagctctgctgggaccaggcacaactgccattaggtgccccaagaaattacagaaccaaaattacaagggccatggattgtcaaagggaaaagagcgagagcagagagcatcgatccggttcaagaccaccctcatgaacacactcatggacgtccttcgccacaggccaggatgggtggaagtgaaggacgaaggggagtgggatttctactggtgtgacgtcagctggctccgggagaacttcgaccacacctacatggatgaacatgtgcggatcagtcacttccggaaccactatgagctgacccggaagaactacatggtgaagaacctgaagcggttccggaagcagctggagcgtgaggcaggaaagctggaggcagccaagtgtgacttcttccccaaaacctttgagatgccttgcgagtaccacctgtttgtagaggagtttcgcaaaaacccaggaatcacctggatcatgaagcctgtagcccggtctcaagggaaaggcatcttcctcttccgtaggctgaaggacatcgtggactggaggaaggacacaagaagctctgacgaccagaaagatgatattcccgtggagaactatgtggctcagcgttacattgaaaatccttacctgataggaggccgcaagtttgacctgcgtgtctatgtgctggtgatgtcggtgtttgctgaatgcctgctgtggtctgggcacaggagacaggatgttcacctcaccaacgtggctgtgcaaaaaacatctcccgactaccacccaaagaagggctgcaagtggacgctgcagcgcttccggcagtacctggcgtccaaacacgggcccgaggcagtggagacactcttcagggacatcgacaacatctttgtcaaaagcctgcagagtgtgcagaaggtgatcatcagtgacaagcactgcttcgagctgtacggctatgacatcctcatcgaccaggacctcaagccgtggctcctggaggtcaatgcgtccccatcactgacagccagcagccaggaagactatgagctcaagacctgcctcctggaagacaccctgcatgttgtggacatggaagcgaggctcacgggaagggagaagcgagtcgggggctttgacctcatgtggaatgatggccctgttagcagagaggagggggctcctgacctgtcgggaatgggaaactttgtgaccaacacacatctcggctgcgtcaacgatcggaagaaacaactgaggcagctcttctgctcccttcaagttcagaagaaagcttccagttgatccccagctgccaggaggaaatcagccttagcaggtgccacccaggcctcccccccactcccagatcccagcacagcacctcacagcattcgcctccccacctccagcctggcaccagctttgctggcttagcagctgcagcttactacctgaattgggccccttggatacctccagcccatccccaggcatctttgcaccaggagacagccaatcactgggactgggggaggtttaaccttgacaaactgacttggcagttaggcccaaagagaacaaatacagcaagttctgctacccccaggagatcatatctaataaatgagcacaggccctacttggagtcactgggcaccaggcctggttccggggatactgttggctgcagccaagtcctcctggctttgacacttggatacctcccaagtcagtgctgaaaaggtccttcaggagcaagagtttggaggctaaggaactcgtctttaagctgtgcttacacagcaagcagttattagattgtgtgtttattgggggcctggggaagtactgagccctaaacacatcctcttctccttgcatgtcaggggagcccatggggctccctgaccatcatctgaaaaccagtgggacagggcatccccatttctcagatggacaagacagaccagggaggcagagcttagtgagggtctctgcaaaggtgcatttatctaagtcagatgggtgacttaagtgcttctctaggccttgtgtttgagattgggagctgagccagaaaccggaaaaccctgggctcatgggcaggacagcttcgggagttgagtgtgagtaaaaatctgccttttcacatcttacattgctaagcttcctcttggtttaagaggggttgcaacaagactcggggctgttggggtaactgttccaggggggacttactccctctaccactccgcctgcttcagagtagtttctctggctgcaaatggttgaatctgcctgcctaggtcaagcccgaagggaagacttttggaaggaaaatactggcaaatccaagaagtgaaccagccgactttaggaaagccagaagccaggctactctagaccttctgccttcagagcatgaggacttctcccactcatccctgtacctgaggcacaccaacccagacaggtccaggcatggactccaggttccctatttccagaaggaatgcgattagctttttttggcccagcacccaccctgccagggaggaaggggcaattttccagtgatgaaattgtgaatcaggcagtcacactggacaacatctagcaaggtgaattctgcaactccctactttatttacattttaaaataagcaatatattcatacggtttaaaatccaaagtttacaaaagggtatagggtgacatctccttccctcccacctgtgcgccccaaccctgcaggtgctgttctgagggaatcacactgtgcttgcacaaaaattattagcttataagacaccagccttccccttgctttcctcacttgatgtatcttggagcttgttccttattcttgattatagttgtatggtattgcactatctggagctaacacctgtgacccacactcatgttttaaaagtttctgcattagtcaaaaatatttaaaaggagattcaacttcacaacccatatgtctagcttctcttgaaaacacgtaagaactggccatgacagcctgtgtttctatgtaactatgagccagagccaaggagcggggggaccaggagaggtgtgcccctgccatgctgccatttgttatcacccgcctgtcaaatcacaggtttatttcaaggcaagaaccatgttcataggttgtattctaaatggagtggcgtgcccttactgaaggactagatgaggcaaataaagactagttgctgctattc

SEQ ID NO: 195983 - DNA, 1024 bp, Homo sapiens
  Payload ID: 18668
  Gene Name: tubulin tyrosine ligase-like family member 9
  ENST ID: ENST00000612972
  CDS Start-End: 1-554
tcctggaagacaccctgcatgttgtggacatggaagcgaggctgcgtcaacgatcggaagaaacaactgaggcagctcttctgctcccttcaagttcagaagaaagcttccagttgatccccagctgccaggaggaaatcagccttagcaggtgccacccaggcctcccccccactcccagatcccagcacagcacctcacagcattcgcctccccacctccagcctggcaccagctttgctggcttagcagctgcagcttactacctgaattgggccccttggatacctccagcccatccccaggcatctttgcaccaggagacagccaatcactgggactgggggaggtttaaccttgacaaactgacttggcagttaggcccaaagagaacaaatacagcaagttctgctacccccaggagatcatatctaataaatgagcacaggccctacttggagtcactgggcaccaggcctggttccggggatactgttggctgcagccaagtcctcctggctttgacacttggatacctcccaagtcagtgctgaaaaggtccttcaggagcaagagtttggaggctaaggaactcgtctttaagctgtgcttacacagcaagcagttattagattgtgtgtttattgggggcctggggaagtactgagccctaaacacatcctcttctccttgcatgtcaggggagcccatggggctccctgaccatcatctgaaaaccagtgggacagggcatccccatttctcagatggacaagacagaccagggaggcagagcttagtgagggtctctgcaaaggtgcatttatctaagtcagatgggtgacttaagtgcttctctaggccttgtgtttgagattgggagctgagccagaaaccggaaaaccctgggctcatgggcaggacagcttcgggagttgagtgtgagtaaaaatctgccttttcacatcttacattgctaagcttcctcttggtttaagaggggttgcaacaagactcggggctg

SEQ ID NO: 195984 - DNA, 1808 bp, Homo sapiens
  Payload ID: 18668
  Gene Name: tubulin tyrosine ligase-like family member 9
  ENST ID: ENST00000616761
  CDS Start-End: 47-724
gaggcgcgcggtggcggtttggatctggcccctggggaatcgcgttatgtcgcgaccgaagaaccaaaattacaagggccatggattgtcaaagggaaaagagcgagagcagagagcatcgatccggttcaagaccaccctcatgaacacactcatggacgtccttcgccacaggccaggatgggtggaagtgaaggacgaaggggagtgggatttctactggtgtgacgtcagctggctccgggagaacttcgaccacacctacatggatgaacatgtgcggatcagtcacttccggaaccactatgagctgacccggaagaactacatggtgaagaacctgaagcggttccggaagcagctggagcgtgaggcaggaaagctggaggcagccaagtgtgacttcttccccaaaacctttgagatgccttgcgagtaccacctgtttgtagaggagtttcgcaaaaacccaggaatcacctggatcatgaagcctgtagcccggtctcaagggaaaggcatcttcctcttccgtaggctgaaggacatcgtggactggaggaagggcactacaggaaagagctcagcagcctggaggcccagcctgcctggagcacggtcagtccctctggcagccacgacacaagaagctctgacgaccagaaagatgatattcccgtggagaactatgtggctcagcgttacattgaaaatccttacctgataggaggccgcaagtttgacctgcgtgtctatgtgctggtgatgtcgtacatcccgctgcgggcctggctctaccgggatggctttgcccgattctccaacacccgcttcacactgaacagcattgatgaccagtatgttcacctcaccaacgtggctgtgcaaaaaacatctcccgactaccacccaaagaagggctgcaagtggacgctgcagcgcttccggcagtacctggcgtccaaacacgggcccgaggcagtggagacactcttcagggacatcgacaacatctttgtcaaaagcctgcagagtgtgcagaaggtgatcatcagtgacaagcactgcttcgagctgtacggctatgacatcctcatcgaccaggacctcaagccgtggctcctggaggtcaatgcgtccccatcactgacagccagcagccaggaagactatgagctcaagacctgcctcctggaagacaccctgcatgttgtggacatggaagcgaggctcacgggaagggagaagcgagtcgggggctttgacctcatgtggaatgatggccctgttagcagagaggagggggctcctgacctgtcgggaatgggaaactttgtgaccaacacacatctcggctgcgtcaacgatcggaagaaacaactgaggcagctcttctgctcccttcaagttcagaagaaagcttccagttgatccccagctgccaggaggaaatcagccttagcaggtgccacccaggcctcccccccactcccagatcccagcacagcacctcacagcattcgcctccccacctccagcctggcaccagctttgctggcttagcagctgcagcttactacctgaattgggccccttggatacctccagcccatccccaggcatctttgcaccaggagacagccaatcactgggactgggggaggtttaaccttgacaaactgacttggcagttaggcccaaagagaacaaatacagcaagttctgctacccccaggagatcatatctaataaatgagcacaggccctacttggagtcactgggcaccaggcctggttccggggatact

SEQ ID NO: 195985 - DNA, 2345 bp, Homo sapiens
  Payload ID: 18668
  Gene Name: tubulin tyrosine ligase-like family member 9
  ENST ID: ENST00000619753
  CDS Start-End: 1-119
atgttcacctcaccaacgtggctgtgcaaaaaacatctcccgactaccacccaaagaaggtggctcctggaggtcaatgcgtccccatcactgacagccagcagccaggaagactatgagctcaagacctgcctcctggaagacaccctgcatgttgtggacatggaagcgagaagtttgagggctgattctccttgctggtaactgggacacattcccattcctaaaccactcactgtgactctgcttgaccaggctcacgggaagggagaagcgagtcgggggctttgacctcatgtggaatgatggccctgttagcagagaggagggggctcctgacctgtcgggaatgggaaactttgtgaccaacacacatctcggtatgtagggccaggtggggagtgggcacaagggatggggtcatgggaggtaccaggtagtctaggaggcagcttgggatagtggttagattgtttgaattcaatctgcaacttaccagctgtgtgaccttgggcaagggacttaacctctgttcctcgtttttaaacttggtttctaaaaagtgaaaactttccctgattataaaaaagggattcacactcattgtagaatatttgaaaactagagaaagaaataaaaacatccagacataagcatctttaacaatctggtgtatttccttccagttcttaaaaaatgcatatattcatactttttcttttataaaattggcattgggctagagttttgaatccctcttttccccttggcatttttcattcaagcatattaagagcctccctcttgaatgcactttttggtccagtccggatgaaatcttttacatacattatctcattttatctttaaggagtttttattgtcattttacagatgaggaaatgatatccaggtgctatgtaacttgctgaatgaaggttttggccataagtggtgagccaggactcaaactcccatctgcctggctccaaaacttgagtgcttgtccgctagactctcctgcctcttggcagagtttaaaaaaattaccatatggctgcaaaatatttcagtttgtacatatgccaaaatttactaaaccaatttcttataattggacatttggcacaattgcattttattttttttttacttttataaattataccatgatgaacatcctttcacattaagctcggctgaaattctggccatttcctgaggacagattcctagaagcagaattattgggccaaagggatgggattattacaaccaaatttctttccagaaagattatacgaatttgtcagatttgaatttttagaaaaaagaaatctgtgccaactggtgaggtaaaacatactgactcgttgttttatgtgcattccattgattactggtgaggtttccgttttttaaatttgcatttcttcttttgtaagctgtccatactctttatccatttttctatgggttgtttagttttctaaatgtataaggcttcagatgactatataacactgtccaagcttaatttaatatgcatacaatcacctggaaatcttgttaaactatagattgtgactccataggtctagggtggggcctaagattgtatttctaacaagctcctgggtgatgctctattgattaaccattgctgtgtaacaagccctcccaaaacctagcagcttaaagcaactattttatttgctcatccttcctcaggtctctcctggggtcacttatagggctgcaggcacctggcagatttactggagacttgatggtgtacgacagcctcattcataggtgtgggggttgatactggctgtcagttgggcctctctttccatgtggccactcgtcttccaacagtctggccctggcttcttcacgtggtagactcggggttctaagagggtgagaaaacacactgcaaagccttttgcggcccggactcagaagtcccataaagtcattctgctacaatcaaagcatttgctggtgtagcccagtcactgggtaagaaaatagaccccacctcgccgggcgcggtggctcacgcctgtaatcccaacactttgggaggccgaggcgggcggatcatgaggtcaggagagcgaaaccatcctggctaacacggtgaaacactgtctctactaaaaaatacaaaaaaattagccaggcgtgctggcgggcgcctgtagtcagctactcgggaggctgaggcaggagaatggcgtgaacccgggaggcggagcttgcagtgagccgagattgcgccactgcactccagcctgggcgacagagcgagactgtctcacacagaaaaagaaaaa

SEQ ID NO: 195986 - DNA, 3034 bp, Homo sapiens
  Payload ID: 18668
  Gene Name: tubulin tyrosine ligase-like family member 9
  ENST ID: ENST00000620043
  CDS Start-End: 67-1092
aacgggacgcataagcacgcgaggcgcgcggtggcggtttggatctggcccctggggaatcgcgttatgtcgcgaccgaagatgacatcattgtatccagagaaaactcaaaggatttacaaactaccagaactaatcattcagcaagggcatcaaatacaagaaccaaaattacaagggccatggattgtcaaagggaaaagagcgagagcagagagcatcgatccggttcaagaccaccctcatgaacacactcatggacgtccttcgccacaggccaggatgggtggaagtgaaggagacacaagaagctctgacgaccagaaagatgatattcccgtggagaactatgtggctcagcgttacattgaaaatccttacctgataggaggccgcaagtttgacctgcgtgtctatgtgctggtgatgtcgtacatcccgctgcgggcctggctctaccgggatggctttgcccgattctccaacacccgcttcacactgaacagcattgatgaccagtatgttcacctcaccaacgtggctgtgcaaaaaacatctcccgactaccacccaaagaagggctgcaagtggacgctgcagcgcttccggcagtacctggcgtccaaacacgggcccgaggcagtggagacactcttcagggacatcgacaacatctttgtcaaaagcctgcagagtgtgcagaaggtgatcatcagtgacaagcactgcttcgagctgtacggctatgacatcctcatcgaccaggacctcaagccgtggctcctggaggtcaatgcgtccccatcactgacagccagcagccaggaagactatgagctcaagacctgcctcctggaagacaccctgcatgttgtggacatggaagcgaggctcacgggaagggagaagcgagtcgggggctttgacctcatgtggaatgatggccctgttagcagagaggagggggctcctgacctgtcgggaatgggaaactttgtgaccaacacacatctcggctgcgtcaacgatcggaagaaacaactgaggcagctcttctgctcccttcaagttcagaagaaagcttccagttgatccccagctgccaggaggaaatcagccttagcaggtgccacccaggcctcccccccactcccagatcccagcacagcacctcacagcattcgcctccccacctccagcctggcaccagctttgctggcttagcagctgcagcttactacctgaattgggccccttggatacctccagcccatccccaggcatctttgcaccaggagacagccaatcactgggactgggggaggtttaaccttgacaaactgacttggcagttaggcccaaagagaacaaatacagcaagttctgctacccccaggagatcatatctaataaatgagcacaggccctacttggagtcactgggcaccaggcctggttccggggatactgttggctgcagccaagtcctcctggctttgacacttggatacctcccaagtcagtgctgaaaaggtccttcaggagcaagagtttggaggctaaggaactcgtctttaagctgtgcttacacagcaagcagttattagattgtgtgtttattgggggcctggggaagtactgagccctaaacacatcctcttctccttgcatgtcaggggagcccatggggctccctgaccatcatctgaaaaccagtgggacagggcatccccatttctcagatggacaagacagaccagggaggcagagcttagtgagggtctctgcaaaggtgcatttatctaagtcagatgggtgacttaagtgcttctctaggccttgtgtttgagattgggagctgagccagaaaccggaaaaccctgggctcatgggcaggacagcttcgggagttgagtgtgagtaaaaatctgccttttcacatcttacattgctaagcttcctcttggtttaagaggggttgcaacaagactcggggctgttggggtaactgttccaggggggacttactccctctaccactccgcctgcttcagagtagtttctctggctgcaaatggttgaatctgcctgcctaggtcaagcccgaagggaagacttttggaaggaaaatactggcaaatccaagaagtgaaccagccgactttaggaaagccagaagccaggctactctagaccttctgccttcagagcatgaggacttctcccactcatccctgtacctgaggcacaccaacccagacaggtccaggcatggactccaggttccctatttccagaaggaatgcgattagctttttttggcccagcacccaccctgccagggaggaaggggcaattttccagtgatgaaattgtgaatcaggcagtcacactggacaacatctagcaaggtgaattctgcaactccctactttatttacattttaaaataagcaatatattcatacggtttaaaatccaaagtttacaaaagggtatagggtgacatctccttccctcccacctgtgcgccccaaccctgcaggtgctgttctgagggaatcacactgtgcttgcacaaaaattattagcttataagacaccagccttccccttgctttcctcacttgatgtatcttggagcttgttccttattcttgattatagttgtatggtattgcactatctggagctaacacctgtgacccacactcatgttttaaaagtttctgcattagtcaaaaatatttaaaaggagattcaacttcacaacccatatgtctagcttctcttgaaaacacgtaagaactggccatgacagcctgtgtttctatgtaactatgagccagagccaaggagcggggggaccaggagaggtgtgcccctgccatgctgccatttgttatcacccgcctgtcaaatcacaggtttatttcaaggcaagaaccatgttcataggttgtattctaaatggagtggcgtgcccttactgaaggactagatgaggcaaataaagactagttgctgctattca

SEQ ID NO: 195987 - DNA, 1799 bp, Homo sapiens
  Payload ID: 18668
  Gene Name: tubulin tyrosine ligase-like family member 9
  ENST ID: ENST00000611624
  CDS Start-End: 78-755
gtcgccttggcaacgggacgcataagcacgcgaggcgcgcggtggcggtttggatctggcccctggggaatcgcgttatgtcgcgaccgaagaaccaaaattacaagggccatggattgtcaaagggaaaagagcgagagcagagagcatcgatccggttcaagaccaccctcatgaacacactcatggacgtccttcgccacaggccaggatgggtggaagtgaaggacgaaggggagtgggatttctactggtgtgacgtcagctggctccgggagaacttcgaccacacctacatggatgaacatgtgcggatcagtcacttccggaaccactatgagctgacccggaagaactacatggtgaagaacctgaagcggttccggaagcagctggagcgtgaggcaggaaagctggaggcagccaagtgtgacttcttccccaaaacctttgagatgccttgcgagtaccacctgtttgtagaggagtttcgcaaaaacccaggaatcacctggatcatgaagcctgtagcccggtctcaagggaaaggcatcttcctcttccgtaggctgaaggacatcgtggactggaggaagggcactacaggaaagagctcagcagcctggaggcccagcctgcctggagcacggtcagtccctctggcagccacgacacaagaagctctgacgaccagaaagatgatattcccgtggagaactatgtggctcagcgttacattgaaaatccttacctgataggaggccgcaagtttgacctgcgtgtctatgtgctggtgatgtcgtacatcccgctgcgggcctggctctaccgggatggctttgcccgattctccaacacccgcttcacactgaacagcattgatgaccagtatgttcacctcaccaacgtggctgtgcaaaaaacatctcccgactaccacccaaagaagggctgcaagtggacgctgcagcgcttccggcagtacctggcgtccaaacacgggcccgaggcagtggagacactcttcagggacatcgacaacatctttgtcaaaagcctgcagagtgtgcagaaggtgatcatcagtgacaagcactgcttcgagctgtacggctatgacatcctcatcgaccaggacctcaagccgtggctcctggaggtcaatgcgtccccatcactgacagccagcagccaggaagactatgagctcaagacctgcctcctggaagacaccctgcatgttgtggacatggaagcgaggctcacgggaagggagaagcgagtcgggggctttgacctcatgtggaatgatggccctgttagcagagaggagggggctcctgacctgtcgggaatgggaaactttgtgaccaacacacatctcggctgcgtcaacgatcggaagaaacaactgaggcagctcttctgctcccttcaagttcagaagaaagcttccagttgatccccagctgccaggaggaaatcagccttagcaggtgccacccaggcctcccccccactcccagatcccagcacagcacctcacagcattcgcctccccacctccagcctggcaccagctttgctggcttagcagctgcagcttactacctgaattgggccccttggatacctccagcccatccccaggcatctttgcaccaggagacagccaatcactgggactgggggaggtttaaccttgacaaactgacttggcagttaggcccaaagagaacaaatacagcaagttctgctacccccaggagatcatatctaataaatgagcacaggcccta

SEQ ID NO: 195988 - DNA, 1915 bp, Homo sapiens
  Payload ID: 18669
  Gene Name: tubulin, alpha 1a
  Uniprot ID: Q71U36
  ENST ID: ENST00000301071
  CDS Start-End: 346-1701
ataatggatgctcggccgactgcttctgcacggtctctttgtctaaaggatgcaaacagtctacggatgctagagaaaaaggggtgggggagagattacctcatcccacgtcgcttgcaccaatcaccagtctcctgtcatggcttctctgggcagattgggggtctggaccaacaggaaaaggccccggcccatccccatggtgaccgagttgtatatagggagccgcatccgcctatgtgccgcaggttctcttacatcgaccgcctaagagtcgcgctgtaagaagcaacaacctctcctcttcgtctccgccatcagctcggcagtcgcgaagcagcaaccatgcgtgagtgcatctccatccacgttggccaggctggtgtccagattggcaatgcctgctgggagctctactgcctggaacacggcatccagcccgatggccagatgccaagtgacaagaccattgggggaggagatgattccttcaacaccttcttcagtgagacgggggctggcaagcatgtgccccgggcagtgtttgtagacttggaacccacagtcattgatgaagttcgcactggcacctaccgccagctcttccaccctgagcaacttatcacaggcaaagaagatgctgccaataactatgcccgagggcactacaccattggcaaggagatcattgacctcgtgttggaccgaattcgcaagctggccgaccagtgcacgggtctccagggcttcttggttttccacagctttggtgggggaactggttctgggttcacctcgctgctcatggaacgtctctcagttgattatggcaagaagtccaagctggagttctctatttacccggcgccccaggtttccacagctgtagttgagccctacaactccatcctcaccacccacaccaccctggagcactctgattgtgccttcatggtagacaatgaggccatctatgacatctgtcgtagaaacctcgatattgagcgtccaacctatactaacctgaataggttaataggtcaaattgtgtcctccatcactgcttccctgagatttgatggagccctgaatgttgacctgacagaattccagaccaacctggtgccctatccccgcatccacttccctctggccacatatgcccctgtcatctctgctgagaaagcctaccatgaacagctttctgtagcagagatcaccaatgcttgctttgagccagccaaccagatggtgaaatgtgaccctcgccatggtaaatacatggcttgctgcctgttgtaccgtggtgacgtggttcccaaagatgtcaatgctgccattgccaccatcaagaccaagcgtaccatccagtttgtggattggtgccccactggcttcaaggttggcatcaactaccagcctcccactgtggtgcctggtggagacctggccaaggtacagagagctgtgtgcatgctgagcaacaccacagccattgctgaggcctgggctcgcctggaccacaagtttgacctgatgtatgccaaacgtgcctttgttcactggtacgttggggaggggatggaggaaggtgagttttcagaggcccgtgaggacatggctgcccttgagaaggattatgaggaggttggtgtggattctgttgaaggagagggtgaggaagaaggagaggaatactaaagttaaaacgtcacaaaggtgctgcttttacagggaagcttattctgttttaaacattgaaaagttgtggtctgatcagttaatttgtatgtagcagtgtatgctctcatatacaattactgacctatgctctaaaacatgaatgctttgttacagacccaagctgtccatttctgtgatgggttttgaataaagtattccctgtcttaaatga

SEQ ID NO: 195989 - DNA, 1887 bp, Homo sapiens
  Payload ID: 18669
  Gene Name: tubulin, alpha 1a
  Uniprot ID: Q71U36
  ENST ID: ENST00000295766
  CDS Start-End: 481-1836
tcttttctttcgtaagctctctgggcgagggtggtggtatgttttgtgaggtttagcttagccccaaatcctcaagccccgccgccgccgcagtgcgggtgcaggaaccgggccagtactgcgcccagggcgcagcagagcgctggggaggaacaaaggcggcgcctaggcgcctgtgttatccgagagactttcgggggccgcgggcagcccgtctgccgcgaccgaggggtctggggcgtcccggctgggccccgtgtctgtgcgcacggtttcgctgatgctgaggggccactttctgtctcgcgttgttctctggggaccgggagaggaggaggcacccaaaaagagcgggggcgttgggcgagctgggggacgtgggagggggaacgggaacaaagcgcagcctagggttagcgtgggaagaccctccgcggtctttggcgttttggaaagatacccacacattcccgggaaaacatgcgtgagtgcatctccatccacgttggccaggctggtgtccagattggcaatgcctgctgggagctctactgcctggaacacggcatccagcccgatggccagatgccaagtgacaagaccattgggggaggagatgattccttcaacaccttcttcagtgagacgggggctggcaagcatgtgccccgggcagtgtttgtagacttggaacccacagtcattgatgaagttcgcactggcacctaccgccagctcttccaccctgagcaacttatcacaggcaaagaagatgctgccaataactatgcccgagggcactacaccattggcaaggagatcattgacctcgtgttggaccgaattcgcaagctggccgaccagtgcacgggtctccagggcttcttggttttccacagctttggtgggggaactggttctgggttcacctcgctgctcatggaacgtctctcagttgattatggcaagaagtccaagctggagttctctatttacccggcgccccaggtttccacagctgtagttgagccctacaactccatcctcaccacccacaccaccctggagcactctgattgtgccttcatggtagacaatgaggccatctatgacatctgtcgtagaaacctcgatattgagcgtccaacctatactaacctgaataggttaataggtcaaattgtgtcctccatcactgcttccctgagatttgatggagccctgaatgttgacctgacagaattccagaccaacctggtgccctatccccgcatccacttccctctggccacatatgcccctgtcatctctgctgagaaagcctaccatgaacagctttctgtagcagagatcaccaatgcttgctttgagccagccaaccagatggtgaaatgtgaccctcgccatggtaaatacatggcttgctgcctgttgtaccgtggtgacgtggttcccaaagatgtcaatgctgccattgccaccatcaagaccaagcgtaccatccagtttgtggattggtgccccactggcttcaaggttggcatcaactaccagcctcccactgtggtgcctggtggagacctggccaaggtacagagagctgtgtgcatgctgagcaacaccacagccattgctgaggcctgggctcgcctggaccacaagtttgacctgatgtatgccaaacgtgcctttgttcactggtacgttggggaggggatggaggaaggtgagttttcagaggcccgtgaggacatggctgcccttgagaaggattatgaggaggttggtgtggattctgttgaaggagagggtgaggaagaaggagaggaatactaaagttaaaacgtcacaaaggtgctgcttttacagggaagcttattctgtttt

SEQ ID NO: 195990 - DNA, 984 bp, Homo sapiens
  Payload ID: 18669
  Gene Name: tubulin, alpha 1a
  ENST ID: ENST00000546918
  CDS Start-End: 88-783
atcgaccgcctaagagtcgcgctgtaagaagcaacaacctctcctcttcgtctccgccatcagctcggcagtcgcgaagcagcaaccatgcgtgagtgcatctccatccacgttggccaggctggtgtccagattggcaatgcctgctgggagctctactgcctggaacacggcatccagcccgatggccagatgccaagtgacaagaccattgggggaggagatgattccttcaacaccttcttcagtgagacgggggctggcaagcatgtgccccgggcagtgtttgtagacttggaacccacagtcattggtgagttgacctcagtaacccaagtgagatcccagggtgctgggacaggaggtctgtcctggggggctccgctggtcactcacccactctccctccccgctcctcgtccctcctcctcctcccccctgctcctcccccatcatgttctccagatgaagttcgcactggcacctaccgccagctcttccaccctgagcaacttatcacaggcaaagaagatgctgccaataactatgcccgagggcactacaccattggcaaggagatcattgacctcgtgttggaccgaattcgcaagctggccgaccagtgcacgggtctccagggcttcttggttttccacagctttggtgggggaactggttctgggttcacctcgctgctcatggaacgtctctcagttgattatggcaagaagtccaagctggagttctctatttacccggcgccccaggtttccacagctgtagttgagccctacaactccatcctcaccacccacaccaccctggagcactctgattgtgccttcatggtagacaatgaggccatctatgacatctgtcgtagaaacctcgatattgagcgtccaacctatactaacctgaataggttaataggtcaaattgtgtcctccatcactgcttccctgagatttgatggagccctga

SEQ ID NO: 195991 - DNA, 1384 bp, Homo sapiens
  Payload ID: 18669
  Gene Name: tubulin, alpha 1a
  Uniprot ID: Q71U36
  ENST ID: ENST00000550767
  CDS Start-End: 134-1384
tttacgattttttcacttttcctccccacagcgtgagtgcatctccatccacgttggccaggctggtgtccagattggcaatgcctgctgggagctctactgcctggaacacggcatccagcccgatggccagatgccaagtgacaagaccattgggggaggagatgattccttcaacaccttcttcagtgagacgggggctggcaagcatgtgccccgggcagtgtttgtagacttggaacccacagtcattgatgaagttcgcactggcacctaccgccagctcttccaccctgagcaacttatcacaggcaaagaagatgctgccaataactatgcccgagggcactacaccattggcaaggagatcattgacctcgtgttggaccgaattcgcaagctggccgaccagtgcacgggtctccagggcttcttggttttccacagctttggtgggggaactggttctgggttcacctcgctgctcatggaacgtctctcagttgattatggcaagaagtccaagctggagttctctatttacccggcgccccaggtttccacagctgtagttgagccctacaactccatcctcaccacccacaccaccctggagcactctgattgtgccttcatggtagacaatgaggccatctatgacatctgtcgtagaaacctcgatattgagcgtccaacctatactaacctgaataggttaataggtcaaattgtgtcctccatcactgcttccctgagatttgatggagccctgaatgttgacctgacagaattccagaccaacctggtgccctatccccgcatccacttccctctggccacatatgcccctgtcatctctgctgagaaagcctaccatgaacagctttctgtagcagagatcaccaatgcttgctttgagccagccaaccagatggtgaaatgtgaccctcgccatggtaaatacatggcttgctgcctgttgtaccgtggtgacgtggttcccaaagatgtcaatgctgccattgccaccatcaagaccaagcgtaccatccagtttgtggattggtgccccactggcttcaaggttggcatcaactaccagcctcccactgtggtgcctggtggagacctggccaaggtacagagagctgtgtgcatgctgagcaacaccacagccattgctgaggcctgggctcgcctggaccacaagtttgacctgatgtatgccaaacgtgcctttgttcactggtacgttggggaggggatggaggaaggtgagttttcagaggcccgtgaggacatggctgcccttgagaaggattatgaggaggttggtgtggattctgttgaaggagagggtgaggaagaaggagaggaatactaa

SEQ ID NO: 195992 - DNA, 628 bp, Homo sapiens
  Payload ID: 18669
  Gene Name: tubulin, alpha 1a
  ENST ID: ENST00000552924
  CDS Start-End: 293-628
aggttctcttacatcgaccgcctaagagtcgcgctgtaagaagcaacaacctctcctcttcgtctccgccatcagctcggcagtcgcgaagcagcaaccatggtgagaatcggcttcggctctttgtggccgttgggtggagtcagcgcccccaggctctacttggaaaacctttaagctcttttctttccgtgagtgcatctccatccacgttggccaggctggtgtccagattggcaatgcctgctgggagctctactgcctggaacacggcatccagcccgatggccagatgccaagtgacaagaccattgggggaggagatgattccttcaacaccttcttcagtgagacgggggctggcaagcatgtgccccgggcagtgtttgtagacttggaacccacagtcattgatgaagttcgcactggcacctaccgccagctcttccaccctgagcaacttatcacaggcaaagaagatgctgccaataactatgcccgagggcactacaccattggcaaggagatcattgacctcgtgttggaccgaattcgcaagctggccgaccagtgcacgggtctccagggcttcttggttttccacagctttggtgggggaactggttct

SEQ ID NO: 195993 - DNA, 650 bp, Homo sapiens
  Payload ID: 18669
  Gene Name: tubulin, alpha 1a
  ENST ID: ENST00000550811
  CDS Start-End: 572-650
acaatgagatcatgtaggcagctgctggaaatagagcttgctctgttaaataatgtagcagacagtacaggctagcaccaggcacagcaaatacagcaatgcagcaatgcagaaggcagaccttgtctaaactcctagtattgatggattctgcagacagactgcagaagggtgtggcttcttgcctcagctgcagtacagatgtccggattataatatcaagtcctattcagaggaaactttcatctttatttaaaagggaagaaagcagtaaaattaatcccaattaagtcataattggatttacttcattttacaaaatttgtgctttgaatactgaatactttttaaatatgaaaaatcttctattcaagcatggtagtaggcacaatgggctggtaccacgtgctgaacagggccaaggcgacatcattattcagaccacacccatatgcagcatttgtagcagcgtgagtgcatctccatccacgttggccaggctggtgtccagattggcaatgcctgctgggagctctactgcctggaacacggcatccagcccgatggccagatgccaagtgacaagaccattgggggaggagatgattccttcaacaccttcttcagtgagacgggggctggcaagcatg

SEQ ID NO: 195994 - DNA, 946 bp, Homo sapiens
  Payload ID: 18669
  Gene Name: tubulin, alpha 1a
  ENST ID: ENST00000547939
  CDS Start-End: 288-946
atcgaccgcctaagagtcgcgctgtaagaagcaacaacctctcctcttcgtctccgccatcagctcggcagtcgcgaagcagcaaccatgcatggtagtaggcacaatgggctggtaccacgtgctgaacagggccaaggcgacatcattattcagaccacacccatatgcagcatttgtagcagcgtgagtgcatctccatccacgttggccaggctggtgtccagattggcaatgcctgctgggagctctactgcctggaacacggcatccagcccgatggccagatgccaagtgacaagaccattgggggaggagatgattccttcaacaccttcttcagtgagacgggggctggcaagcatgtgccccgggcagtgtttgtagacttggaacccacagtcattgatgaagttcgcactggcacctaccgccagctcttccaccctgagcaacttatcacaggcaaagaagatgctgccaataactatgcccgagggcactacaccattggcaaggagatcattgacctcgtgttggaccgaattcgcaagctggccgaccagtgcacgggtctccagggcttcttggttttccacagctttggtgggggaactggttctgggttcacctcgctgctcatggaacgtctctcagttgattatggcaagaagtccaagctggagttctctatttacccggcgccccaggtttccacagctgtagttgagccctacaactccatcctcaccacccacaccaccctggagcactctgattgtgccttcatggtagacaatgaggccatctatgacatctgtcgtagaaacctcgatattgagcgtccaacctatactaacctgaataggttaataggtcaaattgtgtcctccatcactgcttccctgagatttgatggagccctgaatgttgacctgacagaatt

SEQ ID NO: 195995 - DNA, 1627 bp, Homo sapiens
  Payload ID: 18670
  Gene Name: tubulin, alpha 1b
  Uniprot ID: P68363
  ENST ID: ENST00000336023
  CDS Start-End: 96-1451
agtgcgttacttacctcgactcttagcttgtcggggacggtaaccgggacccggtgtctgctcctgtcgccttcgcctcctaatccctagccactatgcgtgagtgcatctccatccacgttggccaggctggtgtccagattggcaatgcctgctgggagctctactgcctggaacacggcatccagcccgatggccagatgccaagtgacaagaccattgggggaggagatgactccttcaacaccttcttcagtgagacgggcgctggcaagcacgtgccccgggctgtgtttgtagacttggaacccacagtcattgatgaagttcgcactggcacctaccgccagctcttccaccctgagcagctcatcacaggcaaggaagatgctgccaataactatgcccgagggcactacaccattggcaaggagatcattgaccttgtgttggaccgaattcgcaagctggctgaccagtgcaccggtcttcagggcttcttggttttccacagctttggtgggggaactggttctgggttcacctccctgctcatggaacgtctctcagttgattatggcaagaagtccaagctggagttctccatttacccagcaccccaggtttccacagctgtagttgagccctacaactccatcctcaccacccacaccaccctggagcactctgattgtgccttcatggtagacaatgaggccatctatgacatctgtcgtagaaacctcgatatcgagcgcccaacctacactaaccttaaccgccttattagccagattgtgtcctccatcactgcttccctgagatttgatggagccctgaatgttgacctgacagaattccagaccaacctggtgccctacccccgcatccacttccctctggccacatatgcccctgtcatctctgctgagaaagcctaccatgaacagctttctgtagcagagatcaccaatgcttgctttgagccagccaaccagatggtgaaatgtgaccctcgccatggtaaatacatggcttgctgcctgttgtaccgtggtgacgtggttcccaaagatgtcaatgctgccattgccaccatcaaaaccaagcgcagcatccagtttgtggattggtgccccactggcttcaaggttggcatcaactaccagcctcccactgtggtgcctggtggagacctggccaaggtacagagagctgtgtgcatgctgagcaacaccacagccattgctgaggcctgggctcgcctggaccacaagtttgacctgatgtatgccaagcgtgcctttgttcactggtacgtgggtgaggggatggaggaaggcgagttttcagaggcccgtgaagatatggctgcccttgagaaggattatgaggaggttggtgtggattctgttgaaggagagggtgaggaagaaggagaggaatactaattatccattccttttggccctgcagcatgtcatgctcccagaatttcagcttcagcttaactgacagacgttaaagctttctggttagattgttttcacttggtgatcatgtcttttccatgtgtacctgtaatatttttccatcatatctcaaagtaaagtcattaacatcaaaa

SEQ ID NO: 195996 - DNA, 1875 bp, Homo sapiens
  Payload ID: 18670
  Gene Name: tubulin, alpha 1b
  ENST ID: ENST00000547765
  CDS Start-End: 96-245
agtgcgttacttacctcgactcttagcttgtcggggacggtaaccgggacccggtgtctgctcctgtcgccttcgcctcctaatccctagccactatgcaccgccggggggcgcaagagcgcgcgcccggaattgctcattcatcctgtgccgcagagccccgccccttgtccctgcggacagacatttcttctgcgctggtctggccacgtgcttcctgtgctaggagctgcccggaaatgtgaccacctagtctaaagtgggcttctggggcctgagcgctggatggatgcccaccttcctgtcttggtcctccaaaggaggaagctgtgactgagctgtcttggtctggaaggaggccttcccggtttaggatgggaagcgtgagtgcatctccatccacgttggccaggctggtgtccagattggcaatgcctgctgggagctctactgcctggaacacggcatccagcccgatggccagatgccaagtgacaagaccattgggggaggagatgactccttcaacaccttcttcagtgagacgggcgctggcaagcacgtgccccgggctgtgtttgtagacttggaacccacagtcattgatgaagttcgcactggcacctaccgccagctcttccaccctgagcagctcatcacaggcaaggaagatgctgccaataactatgcccgagggcactacaccattggcaaggagatcattgaccttgtgttggaccgaattcgcaagctggctgaccagtgcaccggtcttcagggcttcttggttttccacagctttggtgggggaactggttctgggttcacctccctgctcatggaacgtctctcagttgattatggcaagaagtccaagctggagttctccatttacccagcaccccaggtttccacagctgtagttgagccctacaactccatcctcaccacccacaccaccctggagcactctgattgtgccttcatggtagacaatgaggccatctatgacatctgtcgtagaaacctcgatatcgagcgcccaacctacactaaccttaaccgccttattagccagattgtgtcctccatcactgcttccctgagatttgatggagccctgaatgttgacctgacagaattccagaccaacctggtgccctacccccgcatccacttccctctggccacatatgcccctgtcatctctgctgagaaagcctaccatgaacagctttctgtagcagagatcaccaatgcttgctttgagccagccaaccagatggtgaaatgtgaccctcgccatggtaaatacatggcttgctgcctgttgtaccgtggtgacgtggttcccaaagatgtcaatgctgccattgccaccatcaaaaccaagcgcagcatccagtttgtggattggtgccccactggcttcaaggttggcatcaactaccagcctcccactgtggtgcctggtggagacctggccaaggtacagagagctgtgtgcatgctgagcaacaccacagccattgctgaggcctgggctcgcctggaccacaagtttgacctgatgtatgccaagcgtgcctttgttcactggtacgtgggtgaggggatggaggaaggcgagttttcagaggcccgtgaagatatggctgcccttgagaaggattatgaggaggttggtgtggattctgttgaaggagagggtgaggaagaaggagaggaatactaattatccattccttttggccctgcagcatgtcatgctcccagaatttcagcttcagcttaactgacagacgttaaagctttctggttagattgttttcacttggtgatcatgtcttttccatgtgtacctgtaatattttt

SEQ ID NO: 195997 - DNA, 574 bp, Homo sapiens
  Payload ID: 18670
  Gene Name: tubulin, alpha 1b
  ENST ID: ENST00000552984
  CDS Start-End: 427-574
agtgcgttacttacctcgactcttagcttgtcggggacggtaaccgggacccggtgtctgctcctgtcgccttcgcctcctaatccctagccactatgagccccgccccttgtccctgcggacagacatttcttctgcgctggtctggccacgtgcttcctgtgctaggagctgcccggaaatgtgaccacctagtctaaagtgggcttctggggcctgagcgctggatggatgcccaccttcctgtcttggtcctccaaaggaggaagctgtgactgagctgtcttggtctggaaggaggccttcccggtttaggatgggaagcgtgagtgcatctccatccacgttggccaggctggtgtccagattggcaatgcctgctgggagctctactgcctggaacacggcatccagcccgatggccagatgccaagtgacaagaccattgggggaggagatgactccttcaacaccttcttcagtgagacgggcgctggcaagcacgtgccccgggctgtgtttgtagacttggaacccacagtcattgatgaagttcgcactggcacctaccgcc

SEQ ID NO: 195998 - DNA, 835 bp, Homo sapiens
  Payload ID: 18670
  Gene Name: tubulin, alpha 1b
  ENST ID: ENST00000550367
  CDS Start-End: 96-835
agtgcgttacttacctcgactcttagcttgtcggggacggtaaccgggacccggtgtctgctcctgtcgccttcgcctcctaatccctagccactatgcgtgagtgcatctccatccacgttggccaggctggtgtccagattggcaatgcctgctgggagctctactgcctggaacacggcatccagcccgatggccagatgccaagtgacaagaccattgggggaggagatgactccttcaacaccttcttcagtgagacgggcgctggcaagcacgtgccccgggctgtgtttgtagacttggaacccacagtcattgatgaagttcgcactggcacctaccgccagctcttccaccctgagcagctcatcacaggcaaggaagatgctgccaataactatgcccgagggcactacaccattggcaaggagatcattgaccttgtgttggaccgaattcgcaagctggctgaccagtgcaccggtcttcagggcttcttggtttccacagctgtagttgagccctacaactccatcctcaccacccacaccaccctggagcactctgattgtgccttcatggtagacaatgaggccatctatgacatctgtcgtagaaacctcgatatcgagcgcccaacctacactaaccttaaccgccttattagccagattgtgtcctccatcactgcttccctgagatttgatggagccctgaatgttgacctgacagaattccagaccaacctggtgccctacccccgcatccacttccctctggccacatatgcccctgtcatctctgctgagaaagcctaccatgaacagctttc

SEQ ID NO: 195999 - DNA, 565 bp, Homo sapiens
  Payload ID: 18670
  Gene Name: tubulin, alpha 1b
  ENST ID: ENST00000549870
  CDS Start-End: 322-565
attcattaaaagcaacgtagactatagtgtagctgttctcaaaagtagtacatcttagaaaaggatctttagaaaagatcgctttagaaaaggaaattcgttttcagattacgtgagtagcctaggtaacacagccagacctcatctccacaaaaaaaatgaaaaaattagccagcttggtggtctgtgcctgtggtcccagctgctccagaggctgagcgtgagtgcatctccatccacgttggccaggctggtgtccagattggcaatgcctgctgggagctctactgcctggaacacggcatccagcccgatggccagatgccaagtgacaagaccattgggggaggagatgactccttcaacaccttcttcagtgagacgggcgctggcaagcacgtgccccgggctgtgtttgtagacttggaacccacagtcattgatgaagttcgcactggcacctaccgccagctcttccaccctgagcagctcatcacaggcaaggaagatgctgccaataactatgcccgagggcactacaccattggcaaggagatcattgacc

SEQ ID NO: 196000 - DNA, 584 bp, Homo sapiens
  Payload ID: 18670
  Gene Name: tubulin, alpha 1b
  ENST ID: ENST00000547476
  CDS Start-End: 359-584
ctagtgcgttacttacctcgactcttagcttgtcggggacggtaaccgggacccggtgtctgctcctgtcgccttcgcctcctaatccctagccactatggagctgcccggaaatgtgaccacctagtctaaagtgggcttctggggcctgagcgctggatggatgcccaccttcctgtcttggtcctccaaaggaggaagctgtgactgagctgtcttggtctggaaggaggccttcccggtttaggatgggaagcgtgagtgcatctccatccacgttggccaggctggtgtccagattggcaatgcctgctgggagctctactgcctggaacacggcatccagcccgatggccagatgccaagtgacaagaccattgggggaggagatgactccttcaacaccttcttcagtgagacgggcgctggcaagcacgtgccccgggctgtgtttgtagacttggaacccacagtcattgatgaagttcgcactggcacctaccgccagctcttccaccctgagcagctcatcacaggcaaggaagatgctgccaataactatgcccgagggcactacaccattg

SEQ ID NO: 196001 - DNA, 3001 bp, Homo sapiens
  Payload ID: 18671
  Gene Name: tubulin, alpha 1c
  Uniprot ID: Q9BQE3
  ENST ID: ENST00000301072
  CDS Start-End: 276-1625
gaacttttgaatccgccaatcagcgccgcgcgcccccactccgcgggtgcggccgggcgcaggccagggctcgaaggtggggccgcagcggcacggggcggggtctggggcccgccctcccgacacgtggccggggaccgggtatataaggcccttcggggccggccaccctttcactacttctcccccggactccttggtagtctgttagtgggagatccttgttgccgtcccttcgcctccttcaccgccgcagaccccttcaagttctagtcatgcgtgagtgcatctccatccacgttggccaggctggtgtccagattggcaatgcctgctgggagctctactgcctggaacacggcatccagcccgatggccagatgccaagtgacaagaccattgggggaggagatgattccttcaacaccttcttcagtgaaacgggtgctggcaagcatgtgccccgggcagtgtttgtagacttggaacccacagtcattgatgaagttcgcactggcacttaccgccagctcttccaccctgagcaactcatcacaggcaaggaagatgctgccaataactatgcccgagggcactacaccattggcaaggagatcattgacctcgtgttggaccgaattcgcaagctggctgaccagtgcaccggtcttcagggcttcttggttttccacagctttggtgggggaactggttctgggttcacctcgctgctcatggaacgtctctcagttgattatggcaagaagtccaagctggagttctccatttacccggcgccccaggtttccacagctgtagttgagccctacaactccatcctcaccacccacaccaccctggagcactctgattgtgccttcatggtagacaatgaggccatctatgacatctgtcgtagaaacctcgatatcgagcgcccaacctacactaaccttaaccgccttattagccagattgtgtcctccatcactgcttccctgagatttgatggagccctgaatgttgacctgacagaattccagaccaacctggtgccctacccccgcatccacttccctctggccacatatgcccctgtcatctctgctgagaaagcctaccacgaacagcttactgtagcagagatcaccaatgcttgctttgagccagccaaccagatggtgaaatgtgaccctcgccatggtaaatacatggcttgctgcctgttataccgtggtgacgtggttcccaaagatgtcaatgctgccattgccaccatcaaaaccaagcgtaccatccagtttgtggattggtgccccactggcttcaaggttggcattaattaccagcctcccactgtggtgcctggcggagacctggccaaggtacagagagctgtgtgcatgctgagcaataccacagctgttgccgaggcctgggctcgcctggaccacaagtttgacctgatgtatgccaagcgtgcctttgttcactggtacgtgggtgaggggatggaggaaggcgagttttcagaggcccgtgaggacatggctgcccttgagaaggattatgaggaggttggagcagatagtgctgacggagaggatgagggtgaagagtattaacctgtgtgctgtacttttacactcctttgtcttggaactgtcttatttttgttctgtaaatgtctattgccgtaaattgttaataaaattgaagtttccattttaaatgtcgagctgacttaaatacttgatccagttaaagttggatgtatgaggctggtagatgaaaccacctgagtcgagggtcttgctctgtcacccaggctggagtgcagtggcatgataatacatagctcattgcagcctcgagctcctggactcatgtgattctcctgcttcagcctcctaagtagctggggactgcaggtgcacaccaccatgcccagctatttttatttcttgtagagatggggccttgctatgctgcccagggtggtcttcaactggcttcaagtgatcctcctgcctcaacctctcaaagttttgattataggcatgagccactgcccagcttcttggtttatctgtttaatttgggcctgaattaagtggttatagaatcattttgtaagtgaggaaacgggttcagattgagccagtgcttctctaactaaaatggatgtgaatcacctgtagatattaaaatgcaggtttggggtcaacctggtggctcatgcacttcgggaggccaagttgggtggatcacgagcccaggaattcgagaccagcctgggcaacatggtgaaaacccatctctaccaaaacaaaaatttgcatgctgtgatggcacctgcctataggtgggaggaccacctgagcccaaggaggttgaggtagtgagccatgattgcaccactgcattccagcctgggtgacggagacccctgactctcaaatttaaaaacaaaatgcaggttctaattctataggcttgaggtgaggcttcagacacgtcttaaattttttttctttgagatggtctctttcccaggctgcagtgcaatggcaccatcatagctcacccccaccttgacctgggctaagccatcctcccacctcagcctcccaagtagccaggactacaggtgtgttccaccatgcctggctgattcttgtaatttttttttttttttttttttttttttttggtagagatggggttttgccatgttgcttaggctggccttgaactcctgggctcaggcaatcctgcctcagcctcccaaagtgctgggattacaggagtgagccactacacctggcccctagatacgttttttaataacctcccaaatgatgctgttggtctgatgtgaccacatgtacagtagcaaagggttagataacagtaactgctggagccaaaattcaagtgcccagccacactgccagaactattgctgtcagtctttaataaagtattagtcacacgagaa

SEQ ID NO: 196002 - DNA, 1695 bp, Homo sapiens
  Payload ID: 18671
  Gene Name: tubulin, alpha 1c
  ENST ID: ENST00000541364
  CDS Start-End: 29-1588
aagtgaacaatgggcgcccagctctaaaatgacagcctggttcaatggggtggaggagctagggagggatgagtgctttgtgtgcttggaattagatccttcaaatggatcctttctgaatgcaaaactgtacatctctaactggattcttatttacttcaccaggactcttcagctccctgcgccttttaacacatgcacatccagcaaaagcagaggagaacctggctgtgattcaaagcgtgagtgcatctccatccacgttggccaggctggtgtccagattggcaatgcctgctgggagctctactgcctggaacacggcatccagcccgatggccagatgccaagtgacaagaccattgggggaggagatgattccttcaacaccttcttcagtgaaacgggtgctggcaagcatgtgccccgggcagtgtttgtagacttggaacccacagtcattgatgaagttcgcactggcacttaccgccagctcttccaccctgagcaactcatcacaggcaaggaagatgctgccaataactatgcccgagggcactacaccattggcaaggagatcattgacctcgtgttggaccgaattcgcaagctggctgaccagtgcaccggtcttcagggcttcttggttttccacagctttggtgggggaactggttctgggttcacctcgctgctcatggaacgtctctcagttgattatggcaagaagtccaagctggagttctccatttacccggcgccccaggtttccacagctgtagttgagccctacaactccatcctcaccacccacaccaccctggagcactctgattgtgccttcatggtagacaatgaggccatctatgacatctgtcgtagaaacctcgatatcgagcgcccaacctacactaaccttaaccgccttattagccagattgtgtcctccatcactgcttccctgagatttgatggagccctgaatgttgacctgacagaattccagaccaacctggtgccctacccccgcatccacttccctctggccacatatgcccctgtcatctctgctgagaaagcctaccacgaacagcttactgtagcagagatcaccaatgcttgctttgagccagccaaccagatggtgaaatgtgaccctcgccatggtaaatacatggcttgctgcctgttataccgtggtgacgtggttcccaaagatgtcaatgctgccattgccaccatcaaaaccaagcgtaccatccagtttgtggattggtgccccactggcttcaaggttggcattaattaccagcctcccactgtggtgcctggcggagacctggccaaggtacagagagctgtgtgcatgctgagcaataccacagctgttgccgaggcctgggctcgcctggaccacaagtttgacctgatgtatgccaagcgtgcctttgttcactggtacgtgggtgaggggatggaggaaggcgagttttcagaggcccgtgaggacatggctgcccttgagaaggattatgaggaggttggagcagatagtgctgacggagaggatgagggtgaagagtattaacctgtgtgctgtacttttacactcctttgtcttggaactgtcttatttttgttctgtaaatgtctattgccgtaaattgttaataaaattgaagtttccattttaaa

SEQ ID NO: 196003 - DNA, 536 bp, Homo sapiens
  Payload ID: 18671
  Gene Name: tubulin, alpha 1c
  ENST ID: ENST00000549818
  CDS Start-End: 28-294
agtgaacaatgggcgcccagctctaaaatgacagcctggttcaatggggtggaggagctagggagggatgagtgctttgtgtgcttggaattagatccttcaaatggatcctttctgaatgcaaaactgtacatctctaactggattcttatttacttcaccaggactcttcagctccctgcgccttttaacacatgcacatccagcaaaagcagaggagaacctggctgtgattcaaagtgtgtgaacccagctctgtcccttgggttccgtacatataaatggagcagctgagggaactggataagaagtcgattttgtagttacaggctgttccgtatcacccatttacaagagtctcactctactgcccaggctggagtgcagtggtacaatcttggctcactgcagcctccgccttccgggttccagtgatcctcctgcctcagcctcccaagtagctgagattacagcgtgagtgcatctccatccacgttggccaggctggtgtccagattggcaatgcctgctgggag

SEQ ID NO: 196004 - DNA, 575 bp, Homo sapiens
  Payload ID: 18671
  Gene Name: tubulin, alpha 1c
  ENST ID: ENST00000552125
  CDS Start-End: 1-247
gaatgcaaaactgtacatctctaactggattcttatttacttcaccaggactcttcagctccctgcgccttttaacacatgcacatccagcaaaagcagaggagaacctggctgtgattcaaagagtctcactctactgcccaggctggagtgcagtggtacaatcttggctcactgcagcctccgccttccgggttccagtgatcctcctgcctcagcctcccaagtagctgagattacagcgtgagtgcatctccatccacgttggccaggctggtgtccagattggcaatgcctgctgggagctctactgcctggaacacggcatccagcccgatggccagatgccaagtgacaagaccattgggggaggagatgattccttcaacaccttcttcagtgaaacgggtgctggcaagcatgtgccccgggcagtgtttgtagacttggaacccacagtcattgatgaagttcgcactggcacttaccgccagctcttccaccctgagcaactcatcacaggcaaggaagatgctgccaataactatgcccgagggcactacaccattggcaag

SEQ ID NO: 196005 - DNA, 696 bp, Homo sapiens
  Payload ID: 18671
  Gene Name: tubulin, alpha 1c
  ENST ID: ENST00000549183
  CDS Start-End: 102-494
cactacttctcccccggactccttggtagtctgttagtgggagatccttgttgccgtcccttcgcctccttcaccgccgcagaccccttcaagttctagtcatgcgtgagtgcatctccatccacgttggccaggctggtgtccagattggcaatgcctgctgggagctctactgcctggaacacggcatccagcccgatggccagatgccaagtgacaagaccattgggggaggagatgattccttcaacaccttcttcagtgaaacgggtgctggcaagcatgtgccccgggcagtgtttgtagacttggaacccacagtcattgatgaagttcgcactggcacttaccgccagctcttccaccctgagcaactcatcacaggcaaggaagatgctgccaataactatgcccgagggcactacaccattggcaaggagatcattgacctcgtgttggaccgaattcgcaagctggtaagtatagtactttaaataaagtgggatgagagtttcttttgcagttctgagaccaaactacagaaatcattctttgcaactaaaatgagactatttgcattgcaactaaaatgtatctgttcactaaattaattggatttctgaaccagatgatcttggatttatgggacaactatggggtagaagtaagtgctctttagcctattttgcttcaagc

SEQ ID NO: 196006 - DNA, 1800 bp, Homo sapiens
  Payload ID: 18671
  Gene Name: tubulin, alpha 1c
  ENST ID: ENST00000552448
  CDS Start-End: 25-291
gaacaatgggcgcccagctctaaaatgacagcctggttcaatggggtggaggagctagggagggatgagtgctttgtgtgcttggaattagatccttcaaatggatcctttctgaatgcaaaactgtacatctctaactggattcttatttacttcaccaggactcttcagctccctgcgccttttaacacatgcacatccagcaaaagcagaggagaacctggctgtgattcaaagtgtgtgaacccagctctgtcccttgggttccgtacatataaatggagcagctgagggaactggataagaagtcgattttgtagttacaggctgttccgtatcacccatttacaagcgtgagtgcatctccatccacgttggccaggctggtgtccagattggcaatgcctgctgggagctctactgcctggaacacggcatccagcccgatggccagatgccaagtgacaagaccattgggggaggagatgattccttcaacaccttcttcagtgaaacgggtgctggcaagcatgtgccccgggcagtgtttgtagacttggaacccacagtcattgatgaagttcgcactggcacttaccgccagctcttccaccctgagcaactcatcacaggcaaggaagatgctgccaataactatgcccgagggcactacaccattggcaaggagatcattgacctcgtgttggaccgaattcgcaagctggctgaccagtgcaccggtcttcagggcttcttggttttccacagctttggtgggggaactggttctgggttcacctcgctgctcatggaacgtctctcagttgattatggcaagaagtccaagctggagttctccatttacccggcgccccaggtttccacagctgtagttgagccctacaactccatcctcaccacccacaccaccctggagcactctgattgtgccttcatggtagacaatgaggccatctatgacatctgtcgtagaaacctcgatatcgagcgcccaacctacactaaccttaaccgccttattagccagattgtgtcctccatcactgcttccctgagatttgatggagccctgaatgttgacctgacagaattccagaccaacctggtgccctacccccgcatccacttccctctggccacatatgcccctgtcatctctgctgagaaagcctaccacgaacagcttactgtagcagagatcaccaatgcttgctttgagccagccaaccagatggtgaaatgtgaccctcgccatggtaaatacatggcttgctgcctgttataccgtggtgacgtggttcccaaagatgtcaatgctgccattgccaccatcaaaaccaagcgtaccatccagtttgtggattggtgccccactggcttcaaggttggcattaattaccagcctcccactgtggtgcctggcggagacctggccaaggtacagagagctgtgtgcatgctgagcaataccacagctgttgccgaggcctgggctcgcctggaccacaagtttgacctgatgtatgccaagcgtgcctttgttcactggtacgtgggtgaggggatggaggaaggcgagttttcagaggcccgtgaggacatggctgcccttgagaaggattatgaggaggttggagcagatagtgctgacggagaggatgagggtgaagagtattaacctgtgtgctgtacttttacactcctttgtcttggaactgtcttatttttgttctgtaaatgtctattgccgtaaattgttaataaaattgaagtttccat

SEQ ID NO: 196007 - DNA, 1551 bp, Homo sapiens
  Payload ID: 18672
  Gene Name: tubulin, alpha 3c
  Uniprot ID: Q13748
  ENST ID: ENST00000400113
  CDS Start-End: 106-1458
aatcccagacagcgcacggcgggaggctgtcgttgggcgtgcgcagctgcagcggcggttgaggtcaagtagtagcgttgggctgcggcagcggaggagctcaacatgcgtgagtgtatctctatccacgtggggcaggcaggagtccagatcggcaatgcctgctgggaactgtactgcctggaacatggaattcagcccgatggtcagatgccaagtgataaaaccattggtggtggggacgactccttcaacacgttcttcagtgagactggagctggcaagcacgtgcccagagcagtgtttgtggacctggagcccactgtggtcgatgaagtgcgcacaggaacctataggcagctcttccacccagagcagctgatcaccgggaaggaagatgcggccaataattacgccagaggccattacaccatcggcaaggagatcgtcgacctggtcctggaccggatccgcaaactggcggatctgtgcacgggactgcagggcttcctcatcttccacagttttgggggtggcactggctctgggttcgcatctctgctcatggagcggctctcagtggattacggcaagaagtccaagctagaatttgccatttacccagccccccaggtctccacggccgtggtggagccctacaactccatcctgaccacccacacgaccctggaacattctgactgtgccttcatggtcgacaatgaagccatctatgacatatgtcggcgcaacctggacatcgagcgtcccacgtacaccaacctcaatcgcctgattgggcagatcgtgtcctccatcacggcctccctgcgatttgacggggccctgaatgtggacttgacggaattccagaccaacctagtgccgtacccccgcatccacttccccctggccacctacgccccggtcatctcagccgagaaggcctaccacgagcagctgtccgtggctgagatcaccaatgcctgcttcgagccagccaatcagatggtcaagtgtgaccctcgccacggcaagtacatggcctgctgcatgttgtacaggggggatgtggtcccgaaagatgtcaacgcggccatcgccaccatcaagaccaagcgcaccatccagtttgtagattggtgcccaactggatttaaggtgggcattaactaccagccccccacggtggtccctgggggagacctggccaaggtgcagcgggctgtgtgcatgctgagcaacaccacggccatcgcggaggcctgggctcgcctggaccataagttcgatctcatgtatgccaagcgggcctttgtgcactggtacgtgggagaaggcatggaggagggggagttctctgaggcccgcgaggacctggcagctctggagaaggattatgaagaggtgggcgtggattccgtggaagccgaggctgaagaaggtgaagaatactgaggggagggtgtggtgggttctccactccactgccacccccagcgtggctgctttcaagttctttgcaattaaaggttctgtataaaaccaaga

SEQ ID NO: 196008 - DNA, 1386 bp, Homo sapiens
  Payload ID: 18672
  Gene Name: tubulin, alpha 3c
  Uniprot ID: Q13748
  ENST ID: ENST00000618094
  CDS Start-End: 49-1305
gttgaggtcaagtagtagcgttgggctgcggcagcggaggagctcaacatgcgtgagtgtatctctatccacgtggggcaggcaggagtccagatcggcaatgcctgctgggaactgtactgcctggaacatggaattcagcccgatggtcagatgccaagtgataaaaccattggtggtggggacgactccttcaacacgttcttcagtgagactggagctggcaagcacgtgcccagagcagtgtttgtggacctggagcccactgtggtcgatgaagtgcgcacaggaacctataggcagctcttccacccagagcagctgatcaccgggaaggaagatgcggccaataattacgccagaggccattacaccatcggcaaggagatcgtcgacctggtcctggaccggatccgcaaactggcggatctgtgcacgggactgcagggcttcctcatcttccacagttttgggggtggcactggctctgggttcgcatctctgctcatggagcggctctcagtggattacggcaagaagtccaagctagaatttgccatttacccagccccccaggtctccacggccgtggtggagccctacaactccatcctgaccacccacacgaccctggaacattctgactgtgccttcatggtcgacaatgaagccatctatgacatatgtcggcgcaacctggacatcgagcgtcccacgtacaccaacctcaatcgcctgattgggcagatcgtgtcctccatcacggcctccctgcgatttgacggggccctgaatgtggacttgacggaattccagaccaacctagtgccgtacccccgcatccacttccccctggccacctacgccccggtcatctcagccgagaaggcctaccacgagcagctgtccgtggctgagatcaccaatgcctgcttcgagccagccaatcagatggtcaagtgtgaccctcgccacggcaagtacatggcctgctgcatgttgtacaggggggatgtggtcccgaaagatgtcaacgcggccatcgccaccatcaagaccaagcgcaccatccagtttgtagattggtgcccaactggatttaaggtgggcattaactaccagccccccacggtggtccctgggggagacctggccaaggtgcagcgggctgtgtgcatgctgagcaacaccacggccatcgcggaggcctgggctcgcctggacctggcagctctggagaaggattatgaagaggtgggcgtggattccgtggaagccgaggctgaagaaggtgaagaatactgaggggagggtgtggtgggttctccactccactgccacccccagcgtggctgctttcaagttctttgcaattaaaggttctgt

SEQ ID NO: 196009 - DNA, 1546 bp, Homo sapiens
  Payload ID: 18673
  Gene Name: tubulin, alpha 3d
  Uniprot ID: Q13748
  ENST ID: ENST00000321253
  CDS Start-End: 108-1460
aatcccgtgcggcgcgcacaggcaggaggttgcagttgggcgctcagcagctgtggcagccggttgaggtctggcagtagcgttgggctgaagcagcggagttcgccatgcgcgagtgtatctctatccacgtggggcaggcgggtgtccagatcggcaatgcctgctgggaactgtactgccttgaacatggaattcagcccgatggccaaatgccaagtgataaaaccattggtggcggggacgactccttcaacacgttcttcagtgagactggagctggcaagcacgtgcccagagcagtgtttgtggacctggagcccactgtggtcgatgaagtgcgcacagggacctacaggcagctcttccacccggagcagctgatcaccgggaaggaagatgcagccaataattacgccaggggccattacaccatcggcaaggagattgttgacctagtcctggaccggatccgcaaactggcggatctgtgcacaggactgcagggcttcctcatcttccacagctttgggggcggcactggctctgggttcgcatctctgctcatggagcggctctcagtggattacggcaagaagtccaagctagagtttgccatttacccagccccccaggtctccacagccgtggtggagccctacaactccatcctgaccacccacacgaccctggaacattctgactgtgccttcatggtcgacaatgaagccatctatgacatatgtcggcgcaacctggacattgaacgtcccacgtacaccaacctcaatcgcctgattgggcagatcgtgtcctccatcacagcctccctgcgatttgatggggccctgaatgtggacttgacggaattccagaccaacctagtgccgtacccccgcatccacttccccctggccacctatgccccagtcatctcagctgagaaggcctaccacgagcagctgtctgtggccgagatcaccaatgcctgcttcgagccagccaatcaaatggtcaagtgtgaccctcgccacggcaagtacatggcctgctgcatgttgtacaggggggacgtggtccccaaagacgtcaacgcggccatcgccaccatcaagaccaagcgcaccatccagtttgtggattggtgcccgactggatttaaggtgggcattaactaccagccccccacagtggtccccgggggagacctggccaaggtgcagcgggccgtgtgcatgctgagcaacaccacggccattgcggaggcctgggcccgcctggaccataagttcgatctcatgtatgccaagcgggcctttgtgcactggtacgtgggcgaaggcatggaagagggagagttctctgaggcccgcgaggacctggcagctctagagaaggattatgaagaggtgggcgtggattccgtggaagctgaggctgaagaaggcgaagaatactgaggggagggtgtggtgggttctcccctgccacccccgggatggctgcttccaagttgtttgcaattaaaggttctgtataaaaccaa

SEQ ID NO: 196010 - DNA, 1542 bp, Homo sapiens
  Payload ID: 18674
  Gene Name: tubulin, alpha 3e
  Uniprot ID: Q6PEY2
  ENST ID: ENST00000312988
  CDS Start-End: 102-1454
gtgcggcgcgcgtgggcaggtcattgcagttgggcgctcagcagctgtggcagccggttgaggtctggaagtagcgttgggctgaagcagcggagttcgccatgcgcgagtgtatctctatccacgtggggcaggcgggtgtccagatcggcaatgcctgctgggaactgtactgccttgaacatggaattcagcccgatggtcaaatgccaagtgataaaaccattggtggcggggacgactccttcaacacgttcttcagtgagactggagctggcaagcacgtgcccagagcagtgtttgtggacctggagcccactgtggtcgatgaagtgcgcacagggacctacaggcagctcttccacccagagcagctgatcaccgggaaggaagatgcagccagtaattacgccaggggccattacaccatcggcaaggagattgttgacctagtcctggaccggatccgcaaactggcggatctgtgcacaggactgcagggcttcctcatcttccacagctttgggggcggcactggctctgggttcgcatctctgctcatggagcggctctcagtggattacagcaagaagtccaagctagagtttgccatttacccagccccccaggtctccacagccgtggtggagccctacaactccatcctaaccacccacacgaccctggaacattctgactgtgccttcatggtcgacaatgaagccatctatgacatatgtcggcgcaacctggacattgaacgtcccacgtacaccaacctcaatcgcctgattgggcagatcgtgtcctccatcacggcctccctgcgatttgatggggccctgaatgtggacttgacggaattccagaccaacctcgtgccgtacccccgcatccacttccccctggccacctacgccccagtcatctcagctgagaaggcctaccacgagcagctgtctgtggccgagatcaccaatgcctgcttcgagccagccaatcagatggtcaagtgtgaccctcgccatggcaagtacatggcctgctgcatgttgtacaggggggacgtggtccccaaagacgtcaatgcggccatcgccaccatcaagaccaagcgcactatccagtttgtggattggtgcccgactggatttaaggtgggcattaactaccagccccccacagtggtccccgggggagacctggccaaggtgcagcgggccgtgtgcatgctgagcaacaccacggccattgcggaggcctgggcccgcctggtccataagttcgatctcatgtatgccaagtgggcctttgtgcactggtacgtgggcgaaggcatggaagagggagagttctctgaggcccgcgaggacctggcagctctagagaaggattgtgaagaggtgggcgtggattccgtggaagctgaggctgaagaaggcgaagcatactgaggggagggtgtggtgggttctcccctgccacccctaggatggctgctttcaagttgtttgcaattaaagattctgtataaaaccaaga

SEQ ID NO: 196011 - DNA, 2162 bp, Homo sapiens
  Payload ID: 18675
  Gene Name: tubulin, alpha 4a
  Uniprot ID: P68366
  ENST ID: ENST00000248437
  CDS Start-End: 175-1521
gcttaccctcccgggaggcgtggcctgcgggccgcccagcctctagtgggcgagcggggaacgcgggccccgccccccccccgcctataagggcggtgcggcactgcagctagcgcagttctcactgagacctgtcaccccgactcaacgtgagacgcaccgcccggactcaccatgcgtgaatgcatctcagtccacgtggggcaggcaggtgtccagatgggcaatgcctgctgggagctctattgcttggaacatgggattcagcctgatgggcagatgcccagtgacaagaccattggtggaggggacgactccttcaccaccttcttctgtgaaactggtgctggaaaacacgtaccccgggcagtttttgtggatctggagcctacggtcattgatgagatccgaaatggcccataccgacagctcttccacccagagcagctcatcactgggaaagaggatgctgccaacaactatgcccgtggtcactataccattggcaaggagatcattgacccagtgctggatcggatccgcaagctgtctgaccagtgcacaggacttcagggcttcctggtgttccacagctttggtgggggcactggctctggcttcacctcactcctgatggagcggctctctgttgactatggcaagaaatccaagctggaattctccatctacccagccccccaggtgtctacagccgtggtcgagccctacaactctatcctgaccacccacaccaccctggagcactcagactgtgccttcatggtggacaacgaagcaatctatgacatctgccgccgcaacctagacatcgagcgcccaacctacaccaacctcaatcgcctcattagccaaattgtctcctccatcacagcttctctgcgctttgacggggccctcaatgtggacctgacagagttccagaccaacctggtgccctaccctcgcatccacttccccctggccacctatgcaccagtcatctctgcagaaaaggcataccacgagcagctgtcggtggcagagatcaccaatgcctgctttgagcctgccaaccagatggtaaagtgtgatccccggcacggcaagtacatggcctgctgcctgctgtaccgtggagatgtggtgcccaaggatgtcaacgctgccattgccgccatcaagaccaagcgcagcattcagtttgtggactggtgccccacaggcttcaaggttggtatcaactaccagcctcccactgtggtgcctgggggtgacctggccaaggtgcagcgtgccgtgtgcatgctgagcaacacgaccgccatcgccgaggcctgggcccgcctggaccacaagttcgacctgatgtatgccaagagggcgtttgtgcactggtatgtgggtgagggcatggaggagggtgagttctccgaggcccgtgaggatatggctgccctggagaaggattatgaggaggtgggcatcgactcctatgaggacgaggatgagggagaagaataaagcagctgcctggagcctattcactatgtttattgcaaaatcctttcgaaataaacagtttccttgcacggtttcttgttccctctgagtgcttgagcttctgctgccttccccttcatgctgctgctgctctgtttgctgttcatgacccttatcccttccatcgctgaaggtgagacctgcaaaggggttcttgccaggcccaggaagcataaccccagggactttaaattgaagtcctagggttactcagtatagggaggaaatgaggaccaaaatccaggcacaaactgttgaaggatgagtcttcagctcctttccaagtaggagtataatccagtggtttctgtctttgaaagttagactgctaccctgttcttcctgctgcctctacatttaccaactctggaagcaaggcttggcccaggctcctctgtgcattatgagggtttgggagtggggctgggctggcccagagttcctgggcatggagccacgtcataagcttgggggatgggagggaacacaggcgatctcctagagttgtttgtgccactgcacctctgagcagctttgcatagcttcctgtcttgctgctttgctggagctggggctgtgccattaaaagtcaggtcatctcc

SEQ ID NO: 196012 - DNA, 2499 bp, Homo sapiens
  Payload ID: 18675
  Gene Name: tubulin, alpha 4a
  Uniprot ID: P68366
  ENST ID: ENST00000392088
  CDS Start-End: 557-1858
gatgacagcgccactgacccgcgggcggccggcgagccgcggcagattccggggtcggccccggcagacaggctgcggggctcgactctgcgggagcgcctaaggcattggcaatctggggctcaggctgtgcagttctgggtcctcggccgcccacaggcgtcggcgaaaggctgccgccccggccggggaccaggaagcgtcaggcagctggcaagggctccccggggacgcgccacagcctcacagccggcccgagtctcctgggaggcagggctggaagggcaggggtgaaggccagctgtggccgcttgggaaggaccgcctcgcctgctcccgacctaagtcagaacacctggatgaccggtgcctccaggacgcaggtgcaggtgagactcgccctgccacagcaccctgcatctccgcggaggccctcgggagcccagcgtgtctgctcaaaacgaggaaagaatggttaaagcccgaatcgcgactcttaatcccagcgggacagcgtgaatgcatctcagtccacgtggggcaggcaggtgtccagatgggcaatgcctgctgggagctctattgcttggaacatgggattcagcctgatgggcagatgcccagtgacaagaccattggtggaggggacgactccttcaccaccttcttctgtgaaactggtgctggaaaacacgtaccccgggcagtttttgtggatctggagcctacggtcattgatgagatccgaaatggcccataccgacagctcttccacccagagcagctcatcactgggaaagaggatgctgccaacaactatgcccgtggtcactataccattggcaaggagatcattgacccagtgctggatcggatccgcaagctgtctgaccagtgcacaggacttcagggcttcctggtgttccacagctttggtgggggcactggctctggcttcacctcactcctgatggagcggctctctgttgactatggcaagaaatccaagctggaattctccatctacccagccccccaggtgtctacagccgtggtcgagccctacaactctatcctgaccacccacaccaccctggagcactcagactgtgccttcatggtggacaacgaagcaatctatgacatctgccgccgcaacctagacatcgagcgcccaacctacaccaacctcaatcgcctcattagccaaattgtctcctccatcacagcttctctgcgctttgacggggccctcaatgtggacctgacagagttccagaccaacctggtgccctaccctcgcatccacttccccctggccacctatgcaccagtcatctctgcagaaaaggcataccacgagcagctgtcggtggcagagatcaccaatgcctgctttgagcctgccaaccagatggtaaagtgtgatccccggcacggcaagtacatggcctgctgcctgctgtaccgtggagatgtggtgcccaaggatgtcaacgctgccattgccgccatcaagaccaagcgcagcattcagtttgtggactggtgccccacaggcttcaaggttggtatcaactaccagcctcccactgtggtgcctgggggtgacctggccaaggtgcagcgtgccgtgtgcatgctgagcaacacgaccgccatcgccgaggcctgggcccgcctggaccacaagttcgacctgatgtatgccaagagggcgtttgtgcactggtatgtgggtgagggcatggaggagggtgagttctccgaggcccgtgaggatatggctgccctggagaaggattatgaggaggtgggcatcgactcctatgaggacgaggatgagggagaagaataaagcagctgcctggagcctattcactatgtttattgcaaaatcctttcgaaataaacagtttccttgcacggtttcttgttccctctgagtgcttgagcttctgctgccttccccttcatgctgctgctgctctgtttgctgttcatgacccttatcccttccatcgctgaaggtgagacctgcaaaggggttcttgccaggcccaggaagcataaccccagggactttaaattgaagtcctagggttactcagtatagggaggaaatgaggaccaaaatccaggcacaaactgttgaaggatgagtcttcagctcctttccaagtaggagtataatccagtggtttctgtctttgaaagttagactgctaccctgttcttcctgctgcctctacatttaccaactctggaagcaaggcttggcccaggctcctctgtgcattatgagggtttgggagtggggctgggctggcccagagttcctgggcatggagccacgtcataagcttgggggatgggagggaacacaggcgatctcctagagttgtttgtgccactgcacctctgagcagctttgcatagcttcctgtcttgctgctttgctggagctggggctgtgccattaaaagtcaggtcatctcc

SEQ ID NO: 196013 - DNA, 648 bp, Homo sapiens
  Payload ID: 18675
  Gene Name: tubulin, alpha 4a
  ENST ID: ENST00000447205
  CDS Start-End: 189-648
gtgactcagcaccccgcgtctgagctgagagggttggtgggaacggggttcggcctcctgaagcgagctggccctctccagccgaagcccgggtgcgcggatgggcagagacagctggcgctgagcactgcgcgggccgaggccagcgtgaatgcatctcagtccacgtggggcaggcaggtgtccagatgggcaatgcctgctgggagctctattgcttggaacatgggattcagcctgatgggcagatgcccagtgacaagaccattggtggaggggacgactccttcaccaccttcttctgtgaaactggtgctggaaaacacgtaccccgggcagtttttgtggatctggagcctacggtcattgatgagatccgaaatggcccataccgacagctcttccacccagagcagctcatcactgggaaagaggatgctgccaacaactatgcccgtggtcactataccattggcaaggagatcattgacccagtgctggatcggatccgcaagctgtctgaccagtgcacaggacttcagggcttcctggtgttccacagctttggtgggggcactggctctggcttcacctcactcctgatggagcggctctctgttgactatggcaagaaatccaagctggaat

SEQ ID NO: 196014 - DNA, 615 bp, Homo sapiens
  Payload ID: 18675
  Gene Name: tubulin, alpha 4a
  ENST ID: ENST00000398989
  CDS Start-End: 148-615
ggcgatggggccaacagcggcctctagtgtctggaggaggaagtgtcagcgctactgccgcagtctgaccagtgcacaggacttcagggcttcctggtgttccacagctttggtgggggcactggctctggcttcacctcactcctgatggagcggctctctgttgactatggcaagaaatccaagctggaattctccatctacccagccccccaggtgtctacagccgtggtcgagccctacaactctatcctgaccacccacaccaccctggagcactcagactgtgccttcatggtggacaacgaagcaatctatgacatctgccgccgcaacctagacatcgagcgcccaacctacaccaacctcaatcgcctcattagccaaattgtctcctccatcacagcttctctgcgctttgacggggccctcaatgtggacctgacagagttccagaccaacctggtgccctaccctcgcatccacttccccctggccacctatgcaccagtcatctctgcagaaaaggcataccacgagcagctgtcggtggcagagatcaccaatgcctgctttgagcctgccaaccagatggtaaagtgtgatccccggcac

SEQ ID NO: 196015 - DNA, 565 bp, Homo sapiens
  Payload ID: 18675
  Gene Name: tubulin, alpha 4a
  ENST ID: ENST00000425551
  CDS Start-End: 207-565
atttggaaaccgtcaccccgccatttcggtgtgggaagagcgcgcgggccctgccggactttagtgctttaggggttaatttcgggctgacagggacggagcctaaggcagtgagcgccccagtaccctcaaaccttattgctggcccctgctgtctgagcttacaagcattaccgccgctatttccgtgcgggctgacacgggagatgaaagtgcgtgaatgcatctcagtccacgtggggcaggcaggtgtccagatgggcaatgcctgctgggagctctattgcttggaacatgggattcagcctgatgggcagatgcccagtgacaagaccattggtggaggggacgactccttcaccaccttcttctgtgaaactggtgctggaaaacacgtaccccgggcagtttttgtggatctggagcctacggtcattgatgagatccgaaatggcccataccgacagctcttccacccagagcagctcatcactgggaaagaggatgctgccaacaactatgcccgtggtcactataccattggcaaggagatcattgacccagt

SEQ ID NO: 196016 - DNA, 940 bp, Homo sapiens
  Payload ID: 18675
  Gene Name: tubulin, alpha 4a
  ENST ID: ENST00000427737
  CDS Start-End: 400-940
gggtttgaggcggacgtgagagaagaaggtggtgtgagtgtcctggtttcctggctgcccaccatcagaacctcctgcctacatttggggaattcccatcgcaagggccctaatggaaagcaggccaccatttgccacaaagccccaatgcttgctctccctgactcggctctggggttgcaggcagaagacatgagctccgccaatcggatgctccaactgggactttgaatctggagcaagtcacggaatagcaaggctggtttaggaattcatttctgcggcggcggtggaggcgatggggccaacagcggcctctagtgtctggaggaggaagtgtcagcgctactgccgcagcgtgaatgcatctcagtccacgtggggcaggcaggtgtccagatgggcaatgcctgctgggagctctattgcttggaacatgggattcagcctgatgggcagatgcccagtgacaagaccattggtggaggggacgactccttcaccaccttcttctgtgaaactggtgctggaaaacacgtaccccgggcagtttttgtggatctggagcctacggtcattgatgagatccgaaatggcccataccgacagctcttccacccagagcagctcatcactgggaaagaggatgctgccaacaactatgcccgtggtcactataccattggcaaggagatcattgacccagtgctggatcggatccgcaagctgtctgaccagtgcacaggacttcagggcttcctggtgttccacagctttggtgggggcactggctctggcttcacctcactcctgatggagcggctctctgttgactatggcaagaaatccaagctggaattctccatctacccagccccccaggtgtctacagccgtggtcgagccctacaactctatcctgaccacccacaccaccctgg

SEQ ID NO: 196017 - DNA, 673 bp, Homo sapiens
  Payload ID: 18675
  Gene Name: tubulin, alpha 4a
  ENST ID: ENST00000456818
  CDS Start-End: 79-673
aaacccaatccccgctttgggctgggaaataactgtaaagactccagagggagagcggatgtagggctgggctgcaggatggcgcccatcctgcccgggacaaggcgggtcacctctggggcctcaccgcaggttccacttcctttctggcgtgaatgcatctcagtccacgtggggcaggcaggtgtccagatgggcaatgcctgctgggagctctattgcttggaacatgggattcagcctgatgggcagatgcccagtgacaagaccattggtggaggggacgactccttcaccaccttcttctgtgaaactggtgctggaaaacacgtaccccgggcagtttttgtggatctggagcctacggtcattgatgagatccgaaatggcccataccgacagctcttccacccagagcagctcatcactgggaaagaggatgctgccaacaactatgcccgtggtcactataccattggcaaggagatcattgacccagtgctggatcggatccgcaagctgtctgaccagtgcacaggacttcagggcttcctggtgttccacagctttggtgggggcactggctctggcttcacctcactcctgatggagcggctctctgttgactatggcaagaaatccaagctggaattctccatctacccagcccccc

SEQ ID NO: 196018 - DNA, 1380 bp, Homo sapiens
  Payload ID: 18676
  Gene Name: tubulin, alpha 4b
  Uniprot ID: Q9H853
  ENST ID: ENST00000490341
  CDS Start-End: 166-891
gtctctgcccatccgcgcacccgggcttcggctggagagggccagctcgcttcaggaggccgaaccccgttcccaccaaccctctcagctcagacgcggggtgctgagtcacggggggggggtggttctgtggatagttggaatgcatacacagaggaaagggggatgcggcaccagcagacagagagacaagaccccagccagcccctgtccaggcagcatggcacataccgccagatcttccatccagagcagctcatcacaggcaaggaagatgctgccaataactatgcctggggccactacaccattgggaaggagttcatcgacctgctactggaccggattcggaagctggctgaccagtgcacaggacttcagggcttcctggtgttccacagccttggtcggggcactggctctgacgtcacctcattcctgatggagtggctttctgttaactatggcaagaaatccaagctgggattctccatctacccagccccccaggtgtctacagccatggtccagccctacaactctatcctgaccacccacaccaccctggagcactcagactgtgccttcatggtggacaacaaagcaatctatgacatctgccactgcaacctagacatcgagcgcccaacctacaccaacctcaatcgcctcattagccaaattgtctcctccatcacagcttctctgcgctttgacggggccctcaatgtggacctgacagagttccagaccaacctggtgtcctacctcacatccacttccccctggccacctatgcaccagtcatctctgcagaaaaggtataccacgagcagctgttggtggcagagattaccaatgcctgctttgagcctgccaaccagatggtgaagtgtgatccccggcacggcaagtacatggcctgctgcctgctataccatggagatgtggtgcccaaggatgtcaacgctgccattgctgccatcaagaccaagtgcagcattcagtttgtggactggtgccccacaggctttaaggttgatatcaatcaccagcctcccactgtggtgcctgggagtgacctggtaaagtgcaacgtgccatgtgcatgctgagcaacatgacagccatcactatggcctgggcccgcctggaccacaagtttgacctgatgtatgccaagagggcgtttgggcactgatatgtgggtgagggcatggaggagggtgagttctccaaggcccatgaggatatgactgccctggagaaggattacaaggaggtgggcatggatagtgtggagtggggggaagaaaagataggggggatgaatactaggggaatactgtgtgtctgtcctacataaagtgctgtggcctt

SEQ ID NO: 196019 - DNA, 1518 bp, Homo sapiens
  Payload ID: 18677
  Gene Name: tubulin, alpha 8
  Uniprot ID: Q9NY65
  ENST ID: ENST00000316027
  CDS Start-End: 349-1500
tttgtgacctgcccgcccctccccggcactgtgatgccggggggcagctgcgggcccggcgcgcctgtccccggcgtccccccctcccggtgtgtcacaacggcggaggcggctgtatctggagcagtcggggcgggcaggcccagctgagagcgggaatgcatatcagtccacgtgggccaagcgggagttcagattggcaatgcctgctgggagctcttctgcctggaacacggcatccaggcagacggcacttttgatgctcaagctagcaagatcaacgatgatgactccttcaccacctttttcagcgagactggcaatgggaagcatgtgccccgggccgtcatgatagatctggagcctactgtagtggatgaggttcgggcaggaacctaccgccagctcttccatccagagcagctgatcacaggaaaggaggatgcagccaacaactatgcccggggccactacacggtgggcaaggagagcattgacctggtgctggaccgcatacggaagctgacagatgcttgctctggcctgcagggcttcctgattttccacagttttggtgggggcactggctccggcttcacttctctgctgatggaacgcctctccctggattatggcaagaaatccaagctggagtttgccatctacccagccccccaggtctctactgcagtggtggagccctacaactccatcctgaccacccacaccacactggaacattcagattgtgctttcatggtggacaacgaagccatctatgacatctgccgcaggaaccttgacattgagcgccctacctataccaacctcaaccgcctcatcagtcagattgtgtcctcaatcactgcttctctccgctttgacggggccctcaatgtggacctcactgagttccagaccaacctggtgccctacccccgcatccacttcccgctggtcacctacgcgcccatcatctctgccgagaaagcctatcacgaacagctctctgtggccgagataaccagctcctgctttgagcccaacagccagatggtgaagtgcgacccgagacatggcaagtacatggcctgctgcatgctctaccggggcgacgtggtgcccaaggatgtgaatgtcgctattgctgccatcaagaccaagaggaccatccagtttgtagactggtgtcccacaggcttcaaggtgggcatcaactaccagcccccgaccgtggtccccgggggagacctggccaaggtgcagcgggccgtctgcatgctcagcaacaccacggccattgcggaggcctgggcccgcctcgaccacaagttcgacctcatgtacgccaagcgggcctttgtgcattggtatgtgggagaggggatggaagaaggagaattttctgaggccagggaagacttagctgccctggagaaggattatgaagaagtggggactgattcgtttgaagaagaaaatgaaggggaggaattttaaatatataccttccccttg

SEQ ID NO: 196020 - DNA, 2018 bp, Homo sapiens
  Payload ID: 18677
  Gene Name: tubulin, alpha 8
  Uniprot ID: Q9NY65
  ENST ID: ENST00000330423
  CDS Start-End: 74-1423
aggcggctgtatctggagcagtcggggcgggcaggcccagctgagaggtgcgcgggcgaggacagcggcagcgatgcgggaatgcatatcagtccacgtgggccaagcgggagttcagattggcaatgcctgctgggagctcttctgcctggaacacggcatccaggcagacggcacttttgatgctcaagctagcaagatcaacgatgatgactccttcaccacctttttcagcgagactggcaatgggaagcatgtgccccgggccgtcatgatagatctggagcctactgtagtggatgaggttcgggcaggaacctaccgccagctcttccatccagagcagctgatcacaggaaaggaggatgcagccaacaactatgcccggggccactacacggtgggcaaggagagcattgacctggtgctggaccgcatacggaagctgacagatgcttgctctggcctgcagggcttcctgattttccacagttttggtgggggcactggctccggcttcacttctctgctgatggaacgcctctccctggattatggcaagaaatccaagctggagtttgccatctacccagccccccaggtctctactgcagtggtggagccctacaactccatcctgaccacccacaccacactggaacattcagattgtgctttcatggtggacaacgaagccatctatgacatctgccgcaggaaccttgacattgagcgccctacctataccaacctcaaccgcctcatcagtcagattgtgtcctcaatcactgcttctctccgctttgacggggccctcaatgtggacctcactgagttccagaccaacctggtgccctacccccgcatccacttcccgctggtcacctacgcgcccatcatctctgccgagaaagcctatcacgaacagctctctgtggccgagataaccagctcctgctttgagcccaacagccagatggtgaagtgcgacccgagacatggcaagtacatggcctgctgcatgctctaccggggcgacgtggtgcccaaggatgtgaatgtcgctattgctgccatcaagaccaagaggaccatccagtttgtagactggtgtcccacaggcttcaaggtgggcatcaactaccagcccccgaccgtggtccccgggggagacctggccaaggtgcagcgggccgtctgcatgctcagcaacaccacggccattgcggaggcctgggcccgcctcgaccacaagttcgacctcatgtacgccaagcgggcctttgtgcattggtatgtgggagaggggatggaagaaggagaattttctgaggccagggaagacttagctgccctggagaaggattatgaagaagtggggactgattcgtttgaagaagaaaatgaaggggaggaattttaaatatataccttccccttggctgtgtctctttatttatgctgtgccattcaaagcacatgttcaagagaacagaacactctccccgccccagcctgattcctgccttacccaggaggagggtgcctggccccagtacccagggtggcacgactgggctaagtggacactgagcttcatcaggccctccctgggtaggagcagctttgtgtcactaaagaaagtgagggccactgtctccggcgggtgaggctgcagcccagtttcacatgcgaggaggcctaatcaggagtttcaattccagatcgggctgggtccagccccaaaacatggcctgctggctggggagtgggaacactcagagaaaggggagatctgggcctgggaagattccggggcaggggtgagcggacgttcacatgagtgggtctatagcccgctccgggcatcatctagacttagcatgcattcactcccccatcacatattccaatacacaccctgtcctaggcactgagagctggagagttggtgataagcgagacgaacacatttcctgccctcatacacacataaataaagtgaatgagatcatgtc

SEQ ID NO: 196021 - DNA, 582 bp, Homo sapiens
  Payload ID: 18677
  Gene Name: tubulin, alpha 8
  ENST ID: ENST00000426208
  CDS Start-End: 442-582
agcttgccaagcacacacggccctagggcgcccagctgagacggcaccttggcacccgggcccgctgcagcccgctccggtcagctgcaccccagtcaggagcctttccagcgggtcggaggagaacggaagtttggggagacccgcgcgattcgcctggctgcattttacatttctttctccggcagctggggtcacgaaggctgctctcgccggcggtgttggaacgtggacacgtgcgctttgcgggaatgcatatcagtccacgtgggccaagcgggagttcagattggcaatgcctgctgggagctcttctgcctggaacacggcatccaggcagacggcacttttgatgctcaagctagcaagatcaacgatgatgactccttcaccacctttttcagcgagactggcaatgggaagcatgtgccccgggccgtcatgatagatctggagcctactgtagtggatgaggttcgggcaggaacctaccgccagctcttccatccagagcagctgatcacaggaaaggaggatgcagccaacaactatgcccggggccactacacggtgggcaaggag

SEQ ID NO: 196022 - DNA, 1700 bp, Homo sapiens
  Payload ID: 18677
  Gene Name: tubulin, alpha 8
  ENST ID: ENST00000416740
  CDS Start-End: 298-1700
ggcgtaggctgaaggagagtttctgccatgatcgccagttcttccttgggccttcttcaccagtgcaggaatcttgtggtttggaattagccccttgcttcatctttgcaaccaccctccttttttctttcctggtataaaaggtcaaccctgggaagcaacctttagagcaaagcacaaaacagctgtgtcttctttggatctaagtcctggtccagctgctatagagctggggcacctgcagcctcaacgccaactggcaatggggggctggggcctggctggcctgcaaggtgaatgttatggggatgtagggcaaaggcatgctgggggcccagactctctgacctcgttgcttccctctccccacagcgggaatgcatatcagtccacgtgggccaagcgggagttcagattggcaatgcctgctgggagctcttctgcctggaacacggcatccaggcagacggcacttttgatgctcaagctagcaagatcaacgatgatgactccttcaccacctttttcagcgagactggcaatgggaagcatgtgccccgggccgtcatgatagatctggagcctactgtagtggatgaggttcgggcaggaacctaccgccagctcttccatccagagcagctgatcacaggaaaggaggatgcagccaacaactatgcccggggccactacacggtgggcaaggagagcattgacctggtgctggaccgcatacggaagctgacagatgcttgctctggcctgcagggcttcctgattttccacagttttggtgggggcactggctccggcttcacttctctgctgatggaacgcctctccctggattatggcaagaaatccaagctggagtttgccatctacccagccccccaggtctctactgcagtggtggagccctacaactccatcctgaccacccacaccacactggaacattcagattgtgctttcatggtggacaacgaagccatctatgacatctgccgcaggaaccttgacattgagcgccctacctataccaacctcaaccgcctcatcagtcagattgtgtcctcaatcactgcttctctccgctttgacggggccctcaatgtggacctcactgagttccagaccaacctggtgccctacccccgcatccacttcccgctggtcacctacgcgcccatcatctctgccgagaaagcctatcacgaacagctctctgtggccgagataaccagctcctgctttgagcccaacagccagatggtgaagtgcgacccgagacatggcaagtacatggcctgctgcatgctctaccggggcgacgtggtgcccaaggatgtgaatgtcgctattgctgccatcaagaccaagaggaccatccagtttgtagactggtgtcccacaggcttcaaggtgggcatcaactaccagcccccgaccgtggtccccgggggagacctggccaaggtgcagcgggccgtctgcatgctcagcaacaccacggccattgcggaggcctgggcccgcctcgaccacaagttcgacctcatgtacgccaagcgggcctttgtgcattggtatgtgggagaggggatggaagaaggagaattttctgaggccagggaagacttagctgccctggagaaggattatgaagaagtggggactgattcgtttgaagaagaaaa

SEQ ID NO: 196023 - DNA, 1391 bp, Homo sapiens
  Payload ID: 18677
  Gene Name: tubulin, alpha 8
  ENST ID: ENST00000608634
  CDS Start-End: 1-826
ctttgacggggccctcaatgtggacctcactgagttccagaccaacctggtgccctacccccgcatccacttcccgctggtcacctacgcgcccatcatctctgccgagaaagcctatcacgaacagctctctgtggccgagataaccagctcctgctttgagcccaacagccagatggtgaagtgcgacccgagacatggcaagtacatggcctgctgcatgctctaccggggcgacgtggtgcccaaggatgtgaatgtcgctattgctgccatcaagaccaagaggaccatccagtttgtagactggtgtcccacaggcttcaaggtgggcatcaactaccagcccccgaccgtggtccccgggggagacctggccaaggtgcagcgggccgtctgcatgctcagcaacaccacggccattgcggaggcctgggcccgcctcgaccacaagttcgacctcatgtacgccaagcgggcctttgtgcattgccaaaggatccagttggggatctcctgttcatctatgacctctttggtctctgccagtctggagccgttcctcaaagctgtctttgattttcatgaatcgtttgaagatggcagaccagctgatctgcagaatgcccctcgatttgggttggccaggacccgcgtcctggcgaaggggttccggttactgaccttcgatgggaacagcacagaagtgataccgcgctggctccactctgtcctctggtggcacgcaattccagtgttccccgcactgatgactttcttgtaccgaatatttacattaattacattctttatagttataatgtaatattacatatgagaccatggggttcatctgattaggtctgcccaatttagcctgccctgcttgctttgggtcacttgcttttgttattttttttctgtgaagctgaaggccgcgccactgagcgctgtaacttaaccttgccggcttccttacagataacatgtatgtcactactgtcatgatcgttcaaattgtttttcaggaacttggggcagctcctgcctagttcaaaccagttgagaccgtgagctttcaagtaggcttgtgcaaacaaaagaagtggccttttgacatcagaggccccaagcgacaccctcagatcacgctaaggctgtcattttttgaacatgtgccctgtgaagtgccacgaaccctgactatgcttgcagtggtcaccgactgcctcattttcccccactgccaatcacctttgcccataccttacaccaccctgcttctctcaccggtaaatatccctaagacttatctttggggaggaagatttgagagctgttctcctgcctcctcactgggctgccttgcgaataaatcttttctcttttac

SEQ ID NO: 196024 - DNA, 1798 bp, Homo sapiens
  Payload ID: 18678
  Gene Name: tubulin, alpha-like 3
  Uniprot ID: A6NHL2
  ENST ID: ENST00000380419
  CDS Start-End: 39-1379
tcattactacagggcaggaagggcacgttctcatcagcatgagggagtgcctttccatccacatcggtcaagctggcatccagattggggacgcctgctgggaactctattgcctggaacatggaatccagccaaatggcgttgttcttgacactcaacaggatcagctggaaaatgcaaaaatggagcacacaaatgcatctttcgataccttcttctgtgagacaagagctgggaagcatgtgcctagagcactcttcgtggacttggagccaactgttatagatgggatccggacgggccagcaccgttcactcttccaccccgagcagctccttagcggaaaggaggatgctgctaacaattacgcgcgaggccgttactctgtggggtcggaggtcatcgaccttgtgctggagaggacccggaagctggcagaacagtgtggtggacttcagggatttttgattttccgaagctttggaggaggcactggttcagggtttacgtctctcttaatggagaggctcacaggagaatatagcagaaagactaagctggagttctcggtctacccagcccccaggatctccactgctgtggtagagccttataactctgtcctcaccacccactccaccacagagcacacggactgtaccttcatggtggacaacgaggccgtctatgatatatgccatcgtaaactcggtgttgaatgcccctctcatgccagcatcaatagattggtggttcaggtggtatcttccatcactgcctccctccggtttgaagggcccttgaatgtagacctaattgaattccagaccaacctggtaccttatccgagaatacatttccccatgacagccttcgcccccatcgtctctgctgacaaagcctaccatgagcagttctctgtgtcagacatcaccactgcctgctttgagtcctccaaccagctggtcaagtgtgatcctcggcttgggaagtacatggcctgctgcctactctatagaggggatgtggtccccaaggaagtgaatgcagcaatcgcagccacgaagtcgaggcactctgttcagtttgtagattggtgtccaactggtttcaaggtgggcatcaacaatcggccgcccacggtgatgccgggtggggacctggccaaagtccaccggtccatctgcatgctgagcaacaccacggcgattgtggaggcctgggcccgcctggaccacaagtttgacctcatgtacgccaagagagcatttctgcactggtacctcagagaaggcatggaagaagcagagttcttggaggccagggaagatctggcagccctggagagggactatgaggaagtggcgcaaagtttctgaggcatgtatgatgggtgcaaatgaatgtcaagttaaaatggcatgttttcttttcaagccgttatatgcctagtgggtagttcccctgatgagcagaaaaatgaactcaaatcaggcaagactctaggttccacactaaattaagtgggtcagtaccaacaatgaacacattatttcctggtctactggtacaagtcagctctgctacctgggagcctttggaagcttagagtcctttgaactgctgagtcacttctaggtgggatttttttgttttaccaagagacaatgaaatcctgaagtttatgcttttcctttctggtaccggaagtagaaaacagcacatgttgattacgaatgttttttcccccatgtctacattttttacactgattaaatcataaatattttcagtatga

SEQ ID NO: 196025 - DNA, 1505 bp, Homo sapiens
  Payload ID: 18678
  Gene Name: tubulin, alpha-like 3
  Uniprot ID: A6NHL2
  ENST ID: ENST00000479328
  CDS Start-End: 37-1257
attactacagggcaggaagggcacgttctcatcagcatggatcagctggaaaatgcaaaaatggagcacacaaatgcatctttcgataccttcttctgtgagacaagagctgggaagcatgtgcctagagcactcttcgtggacttggagccaactgttatagatgggatccggacgggccagcaccgttcactcttccaccccgagcagctccttagcggaaaggaggatgctgctaacaattacgcgcgaggccgttactctgtggggtcggaggtcatcgaccttgtgctggagaggacccggaagctggcagaacagtgtggtggacttcagggatttttgattttccgaagctttggaggaggcactggttcagggtttacgtctctcttaatggagaggctcacaggagaatatagcagaaagactaagctggagttctcggtctacccagcccccaggatctccactgctgtggtagagccttataactctgtcctcaccacccactccaccacagagcacacggactgtaccttcatggtggacaacgaggccgtctatgatatatgccatcgtaaactcggtgttgaatgcccctctcatgccagcatcaatagattggtggttcaggtggtatcttccatcactgcctccctccggtttgaagggcccttgaatgtagacctaattgaattccagaccaacctggtaccttatccgagaatacatttccccatgacagccttcgcccccatcgtctctgctgacaaagcctaccatgagcagttctctgtgtcagacatcaccactgcctgctttgagtcctccaaccagctggtcaagtgtgatcctcggcttgggaagtacatggcctgctgcctactctatagaggggatgtggtccccaaggaagtgaatgcagcaatcgcagccacgaagtcgaggcactctgttcagtttgtagattggtgtccaactggtttcaaggtgggcatcaacaatcggccgcccacggtgatgccgggtggggacctggccaaagtccaccggtccatctgcatgctgagcaacaccacggcgattgtggaggcctgggcccgcctggaccacaagtttgacctcatgtacgccaagagagcatttctgcactggtacctcagagaaggcatggaagaagcagagttcttggaggccagggaagatctggcagccctggagagggactatgaggaagtggcgcaaagtttctgaggcatgtatgatgggtgcaaatgaatgtcaagttaaaatggcatgttttcttttcaagccgttatatgcctagtgggtagttcccctgatgagcagaaaaatgaactcaaatcaggcaagactctaggttccacactaaattaagtgggtcagtaccaacaatgaacacattatttcctggtctactggtacaagtcagctctgctacctgggagcctttggaagcttagagtcctttgaactgctga

SEQ ID NO: 196026 - DNA, 3496 bp, Homo sapiens
  Payload ID: 18679
  Gene Name: tubulin, beta 1 class VI
  Uniprot ID: Q9H4B7
  ENST ID: ENST00000217133
  CDS Start-End: 270-1625
ggggcagtattctgtgttgagggaggaaaaacactcccttccaaaagcatgacaggcagaaagcagagaagggccaggactggctgagggcggggagctgggcctctggggtggacacacccttggtcacattgtgagggtagcttggttggccagtcccaccactgcagtgaccacagttgtgttgggctcacaccagtgaaccgaagctctggattctgagagtctgaggattccgtgaagatctcagacttgggctcagagcaaggatgcgtgaaattgtccatattcagattggccagtgtggcaaccagatcggagccaagttctgggagatgattggtgaggaacacgggatcgacttggctgggagcgaccgcggggcctcggccttgcagctggagagaatcagcgtgtactacaacgaagcctacggtaggaaatatgtgccccgagcagtcttggtggacctagaacctgggacgatggacagcattcgatctagcaaattaggagctctctttcaacccgacagttttgtccatggtaactctggggctggcaacaactgggccaaaggccactacacggagggagccgagctgatcgagaatgtcctagaggtggtgaggcacgagagtgagagctgtgactgcctgcagggcttccagatcgtccactccctgggcgggggcacaggctccgggatgggcactctgctcatgaacaagattagagaggagtacccggaccggatcatgaattccttcagcgtcatgccttctcccaaggtgtcggacactgtggtggagccctacaacgcggttctgtctatccaccagctgattgagaatgcagatgcctgtttctgcattgacaatgaggccctctatgacatctgcttccgtaccctgaagctgacgacacccacctatggggatctcaaccacctagtgtccttgaccatgagcggcataaccacctccctccggttcccgggtcagctcaacgcagacctgcgcaagctggcggtgaacatggtccccttcccccgcctgcacttctttatgcccggctttgccccactcacggcccagggcagccagcagtaccgagccctctccgtggccgagctcacccagcagatgttcgatgcccgcaataccatggctgcctgtgacctccgccgtggccgctacctcacagtggcctgcattttccggggcaagatgtccaccaaggaagtggaccagcaactgctctccgtgcagaccaggaacagcagctgctttgtggagtggattcccaacaacgtcaaggtggctgtctgcgacatcccgccccgggggctgagcatggccgccaccttcattggcaacaacacggccatccaagagatctttaatagggtctctgagcatttctcagccatgttcaaaaggaaagcttttgtgcactggtacaccagcgaagggatggacataaacgaatttggggaagctgaaaataacatccatgatttggtatccgagtaccaacaatttcaagatgccaaagcagttctagaggaagatgaagaggtcacggaggaggcagaaatggagccagaagataagggacattaactgtgagagaagctgtgccgcggagtcgcttacagaacagtttctcattagatgagtgtttctcctgcagcactccaaaacccactctgcactgcagcacagtgaatgatatgcactcaccattagcttcgacacagggactgagggagacaggtggggagcagctgacaggcattagggtctttgctgacatctactaaccttgaagagtttgatgttcagtgcatacttattaacttaaaaaaatagcaaatttattgtaaagtgctccctttgtttcaaagtgtttgccaggcatccagactacacgtgtggatttgcagggagccactggagttggtgttacatttttatactttagcagcactgataggcaccctggaatcctcacttggtatccgagggctactaagactctttccttaggttctttcctctgagcaaacactgactggcatcctgctttccagtgcctgccagcctccagaagagccaggtgcctgactagtacatggggagctacagagccaaggtcaatgtgagtcaacatccactagaaatatccatgttgtgtagacctgtgcatacaacatgctaactggaaaagaggaaaaaagaaaagccacagtcctctccacaaaaatacctggtccaaacaagaaaaacaaaaagacaagcaaaactaaagaactgcagtcttctgatctttatttctgaagagctagcctttaacatatatgtttatatagtttaaatttcttactactgttagatcccaggaattcattaataatcatccttggctttccttttaaaggctattttgaaatggtcttttcactttcattcagtcatcaccccccaaaatgctctgcagcctctctgctctttgagaaagggcacaccatgcgctcggcaaccattcaaatgcaggaattaagcagcaatggctgcagtgtccttctcagttatggaggacatcgtctcattagggaacttttacagttcaaattaatttgcagaagttgccataaatgtttgcataatgacatagctttaagcactacatgattttaatctgctcacattataacaggaccaaatacacaagagcgtaatcaaatcatctgtaacttcttaattacagtttacctatttctgacatgcagcactgccatctcttccagcaccatcagggttttaatggccctctagaattaccactgagatacactatttgatccatggataaccggtaatgggaaaatgctccgaccctcaatgcagtaaatatttacttgcaggcaactgggttctcatctcttgatttgcttttgtaatcagcaataataaaatagcaggtagatggatgacagttgctcattctgagaaacttcactcttttcacttatgcatcacgaggaaataactaaaatacataccaagagaaaaataccttgccatcggatcatcaacaagtcttctatttacaaacttcaaaaaacacaaaacaacattcatgttttaaatgctttctacttgtggttcaagaagcactagatttagtaagaaactctacctatatacttagtttgaagttagtaacttcctgagatgctaaagacttacagcctgcgattatacaaggatttacacatgcttcctctggtgctttacttcccaaacctaaaaaagcaatgaaatagatgtaaggaaggagggatttaaaccttttaaaaaacttttgctgacttatattactgtaaagatttgtttgctcaatagtaatcattaaactacaaagtaattcaattttaaatggcaaaattgctttatttcagactaaataaattccttttcttgaagcctaa

SEQ ID NO: 196027 - DNA, 1595 bp, Homo sapiens
  Payload ID: 18680
  Gene Name: tubulin, beta 2A class IIa
  Uniprot ID: Q13885
  ENST ID: ENST00000333628
  CDS Start-End: 64-1401
gcccgccggtccacgccgcgcaccgctccgagggccagcgccacccgctccgcagccggcaccatgcgcgagatcgtgcacatccaggcgggccagtgcggcaaccagatcggcgccaagttttgggaggtcatcagcgatgagcatgggatcgaccccacaggcagttaccatggagacagtgacttgcagctggagagaatcaacgtgtactacaatgaggctgctggtaacaaatatgtacctcgggccatcctggtggatctggagcctggcaccatggactctgtcaggtctggacccttcggccagatcttcagaccagacaacttcgtgttcggccagagtggagccgggaataactgggccaagggccactacacagagggagccgagctggtcgactcggtcctggatgtggtgaggaaggagtcagagagctgtgactgtctccagggcttccagctgacccactctctggggggcggcacggggtccgggatgggcaccctgctcatcagcaagatccgggaagagtacccagaccgcatcatgaacaccttcagcgtcatgccctcacccaaggtgtcagacacggtggtggagccctacaacgccaccctctctgtccaccagctggtggaaaacacagatgaaacctactccattgataacgaggccctgtatgacatctgcttccgcaccctgaagctgaccacccccacctacggggacctcaaccacctggtgtcggccaccatgagcggggtcaccacctgcctgcgcttcccgggccagctgaacgcagacctgcgcaagctggcggtgaacatggtgcccttccctcgcctgcacttcttcatgcccggcttcgcgcccctgaccagccggggcagccagcagtaccgggcgctcacggtgcccgagctcacccagcagatgttcgactccaagaacatgatggccgcctgcgacccgcgccacggccgctacctgacggtggctgccatcttccggggccgcatgtccatgaaggaggtggacgagcagatgctcaacgtgcagaacaagaacagcagctacttcgtggagtggatccccaacaacgtgaagacggccgtgtgcgacatcccgccccgcggcctgaagatgtcggccaccttcatcggcaacagcacggccatccaggagctgttcaagcgcatctccgagcagttcacggccatgttccggcgcaaggccttcctgcactggtacacgggcgagggcatggacgagatggagttcaccgaggccgagagcaacatgaacgacctggtgtccgagtaccagcagtaccaggacgccacggccgacgaacaaggggagttcgaggaggaggagggcgaggacgaggcttaaaaacttctcagatcaatcgtgcatccttagtgaacttctgttgtcctcaagcatggtctttctacttgtaaactatggtgctcagttttgcctctgttagaaattcacactgttgatgtaatgatgtggaactcctctaaaaattacagtattgtctgtgaaggtatctatactaataaaaaagcatgtgtaga

SEQ ID NO: 196028 - DNA, 2020 bp, Homo sapiens
  Payload ID: 18681
  Gene Name: tubulin, beta 2B class IIb
  Uniprot ID: Q9BVA1
  ENST ID: ENST00000259818
  CDS Start-End: 193-1530
ggggggctcgggctgggggcgcggcctgtgccggccgccccaccctccttgcataaaagccggagcccgcggggccggcgctctcagcccgtcggttcccgagcgccttcccggtgaccccgcagtgggtgtgtgaggggaggacggacagacccagacgccgccggaccaggaggacgctgacgaggcaccatgcgtgagatcgtgcacatccaggcgggccagtgcggcaaccagatcggcgccaagttttgggaggtcatcagtgatgagcatgggattgaccccactggcagttaccatggagacagtgatttgcagctggagagaatcaatgtttactacaatgaagccactggtaacaaatatgttcctcgggccatcctcgtggatctggagccaggcacgatggattcggttaggtctggaccattcggccagatcttcagaccagacaatttcgtgtttggccagagtggagccgggaataactgggccaagggccactacacagagggagccgagctggtcgactcggtcctggatgtggtgaggaaggagtcagagagctgtgactgtctccagggcttccagctgacccactctctggggggcggcacggggtccgggatgggcaccctgctcatcagcaagatccgggaagagtacccagaccgcatcatgaacaccttcagcgtcatgccctcacccaaggtgtcagacacggtggtggagccctacaacgccaccctctcggtccaccagctggtggaaaacacagatgaaacctactgcattgacaacgaggccctgtatgacatctgcttccgcaccctgaagctgaccacccccacctacggggacctcaaccacctggtgtcggccaccatgagcggggtcaccacctgcctgcgcttcccgggccagctgaacgcagacctgcgcaagctggcggtgaacatggtgcccttccctcgcctgcacttcttcatgcccggcttcgcgcccctgaccagccggggcagccagcagtaccgggcgctcacggtgcccgagctcacccagcagatgttcgactccaagaacatgatggccgcctgcgacccgcgccacggccgctacctgacggtggctgccatcttccggggccgcatgtccatgaaggaggtggacgagcagatgctcaacgtgcagaacaagaacagcagctacttcgtggagtggatccccaacaacgtgaagacggccgtgtgcgacatcccgccccgcggcctgaagatgtcggccaccttcatcggcaacagcacggccatccaggagctgttcaagcgcatctccgagcagttcacggccatgttccggcgcaaggccttcctgcactggtacacgggcgagggcatggacgagatggagttcaccgaggccgagagcaacatgaacgacctggtgtccgagtaccagcagtaccaggacgccacggccgacgaacaaggggagttcgaggaggaggagggcgaggacgaggcgtagatgcccccgcgagacgggttagggaaagcggaggaggaaagcgagggggtggggggcttcccgggacgataacctggcagtggaaggaaagaagcatggtctactttaggtgtgcgctgggtctctggtgctcttcactgttgcctgtcactttttttttccttttttgtaatattgatgacatcaatgtaacatttgagatatttctgaattactgttgtaatggctaaaatcacataaacgtttgtgtcggaatggtgtcctctctttctcttcctttttctctttattaacgatttaaatgtaactttctgaacacattgcattgaattcttcctttaacaaaaagcaaaggcgtaggtaaaagctcaaatgaatttattctttcggtatggtaaaattgaaccaatcacagttaagatgagagatcaacctgagttttaaaatacctttaataaatattagttgaaaaaatgtctacttgaaagca

SEQ ID NO: 196029 - DNA, 1769 bp, Homo sapiens
  Payload ID: 18682
  Gene Name: tubulin, beta 3 class III
  Uniprot ID: Q13509
  ENST ID: ENST00000315491
  CDS Start-End: 124-1476
gacatcagccgatgcgaagggcggggccgcggctataagagcgcgcggccgcggtccccgaccctcagcagccagcccggcccgcccgcgcccgtccgcagccgcccgccagacgcgcccagtatgagggagatcgtgcacatccaggccggccagtgcggcaaccagatcggggccaagttctgggaagtcatcagtgatgagcatggcatcgaccccagcggcaactacgtgggcgactcggacttgcagctggagcggatcagcgtctactacaacgaggcctcttctcacaagtacgtgcctcgagccattctggtggacctggaacccggaaccatggacagtgtccgctcaggggcctttggacatctcttcaggcctgacaatttcatctttggtcagagtggggccggcaacaactgggccaagggtcactacacggagggggcggagctggtggattcggtcctggatgtggtgcggaaggagtgtgaaaactgcgactgcctgcagggcttccagctgacccactcgctggggggcggcacgggctccggcatgggcacgttgctcatcagcaaggtgcgtgaggagtatcccgaccgcatcatgaacaccttcagcgtcgtgccctcacccaaggtgtcagacacggtggtggagccctacaacgccacgctgtccatccaccagctggtggagaacacggatgagacctactgcatcgacaacgaggcgctctacgacatctgcttccgcaccctcaagctggccacgcccacctacggggacctcaaccacctggtatcggccaccatgagcggagtcaccacctccttgcgcttcccgggccagctcaacgctgacctgcgcaagctggccgtcaacatggtgcccttcccgcgcctgcacttcttcatgcccggcttcgcccccctcacagcccggggcagccagcagtaccgggccctgaccgtgcccgagctcacccagcagatgttcgatgccaagaacatgatggccgcctgcgacccgcgccacggccgctacctgacggtggccaccgtgttccggggccgcatgtccatgaaggaggtggacgagcagatgctggccatccagagcaagaacagcagctacttcgtggagtggatccccaacaacgtgaaggtggccgtgtgtgacatcccgccccgcggcctcaagatgtcctccaccttcatcgggaacagcacggccatccaggagctgttcaagcgcatctccgagcagttcacggccatgttccggcgcaaggccttcctgcactggtacacgggcgagggcatggacgagatggagttcaccgaggccgagagcaacatgaacgacctggtgtccgagtaccagcagtaccaggacgccacggccgaggaagagggcgagatgtacgaagacgacgaggaggagtcggaggcccagggccccaagtgaagctgctcgcagctggagtgagaggcaggtggcggccggggccgaagccagcagtgtctaaacccccggagccatcttgctgccgacaccctgctttcccctcgccctagggctcccttgccgccctcctgcagtatttatggcctcgtcctccccacctaggccacgtgtgagctgctcctgtctctgtcttattgcagctccaggcctgacgttttacggttttgttttttactggtttgtgtttatattttcggggatacttaataaatctattgctgtcagataccctt

SEQ ID NO: 196030 - DNA, 767 bp, Homo sapiens
  Payload ID: 18682
  Gene Name: tubulin, beta 3 class III
  ENST ID: ENST00000555810
  CDS Start-End: 200-767
cctgtccactctgagatgcctggaagggggctcagtgcagttctgggaagtcatcagtgatgagcatggcatcgaccccagcggcaactacgtgggcgactcggacttgcagctggagcggatcagcgtctactacaacgaggcctcttctcacaagtacgtgcctcgagccattctggtggacctggaacccggaaccatggacagtgtccgctcaggggcctttggacatctcttcaggcctgacaatttcatctttggtcagagtggggccggcaacaactgggccaagggtcactacacggagggggcggagctggtggattcggtcctggatgtggtgcggaaggagtgtgaaaactgcgactgcctgcagggcttccagctgacccactcgctggggggcggcacgggctccggcatgggcacgttgctcatcagcaaggtgcgtgaggagtatcccgaccgcatcatgaacaccttcagcgtcgtgccctcacccaaggtgtcagacacggtggtggagccctacaacgccacgctgtccatccaccagctggtggagaacacggatgagacctactgcatcgacaacgaggcgctctacgacatctgcttccgcaccctcaagctggccacgcccacctacggggacctcaaccacctggtatcggccaccatgagcggagtcaccacctccttgcgcttcccgggccagctcaacgctgacctgcgcaagctggccgtcaacatggtgcccttcccgc

SEQ ID NO: 196031 - DNA, 736 bp, Homo sapiens
  Payload ID: 18682
  Gene Name: tubulin, beta 3 class III
  ENST ID: ENST00000553967
  CDS Start-End: 37-531
gcgcccgtccgcagccgcccgccagacgcgcccagtatgagggagatcgtgcacatccaggccggccagtgcggcaaccagatcggggccaagttctgggaagtcatcagtgatgagcatggcatcgaccccagcggcaactacgtgggcgactcggacttgcagctggagcggatcagcgtctactacaacgaggcctcttctcacaagtacgtgcctcgagccattctggtggacctggaacccggaaccatggacagtgtccgctcaggggcctttggacatctcttcaggcctgacaatttcatctttggtaagttccccctgctccaagctctgatggcagaccccatcacaggcaagcccaggtcggtggacggggacggctgtgagaaacaaggaatggtcagctcctcacatgatcctgaatggtgggaactcatctctccattttacagctgggcattggaggcccagagaaagggttctgtggggagaacagaaaccactcatgcatttcaagtggaatgaagtgtaaagcagacagaagcttacagaattgctagagagctggtgagacagaacggggcctccagaggactccggggtccaggagcacgaggccttgctgcggtcaagagatcaggacgttcccatgcctgtgtcctggggttgggccgtggatgccacgttcccatgtctgtgtcctggggcggggccgtggatgccacgttcc

SEQ ID NO: 196032 - DNA, 903 bp, Homo sapiens
  Payload ID: 18682
  Gene Name: tubulin, beta 3 class III
  ENST ID: ENST00000554336
  CDS Start-End: 49-405
cccggcccgcccgcgcccgtccgcagccgcccgccagacgcgcccagtatgagggagatcgtgcacatccaggccggccagtgcggcaaccagatcggggccaagttctgggaagtcatcagtgatgagcatggcatcgaccccagcggcaactacgtgggcgactcggacttgcagctggagcggatcagcgtctactacaacgaggcctcttctcacaagtacgtgcctcgagccattctggtggacctggaacccggaaccatggacagtgtccgctcaggggcctttggacatctcttcaggcctgacaatttcatctttgctgggcattggaggcccagagaaagggttctgtggggagaacagaaaccactcatgcatttcaagtggaatgaagtgtaaagcagacagaagcttacagaattgctagagagctggtgagacagaacggggcctccagaggactccggggtccaggagcacgaggccttgctgcggtcaagagatcaggacgttcccatgcctgtgtcctggggttgggccgtggatgccacgttcccatgtctgtgtcctggggcggggccgtggatgccacgttcccacgtctgtgtcctggggcggggccgtggatgccacgttcccacgtctgtgtcctggggcggggccgtggatgccacgttcccacgcctgtgtcctggggcggggccgtggatgccacgttcccacgcctgtgtcctggggcggggccgtggatgccacgttcccatgcctgtgtcctggggcggggccgtggatgccacgttcccatgcctgtgtcctggggcggggccgtggatgccacgttcccatgtctgtgtcctggggcggggccgtggacgcgccacagaaacaggagggcct

SEQ ID NO: 196033 - DNA, 1855 bp, Homo sapiens
  Payload ID: 18682
  Gene Name: tubulin, beta 3 class III
  ENST ID: ENST00000555609
  CDS Start-End: 44-211
cccgcccgcgcccgtccgcagccgcccgccagacgcgcccagtatgagggagatcgtgcacatccaggccggccagtgcggcaaccagatcggggccaagttctgggaagtcatcagtgatgagcatggcatcgaccccagcggcaactacgtgggcgactcggacttgcagctggagcggatcagcgtctactacaacgaggcctcttagacagtctcgatatgttgcccaggctggtctcgaactcctggactcaagcgatccacctgccttggcctcccaaagtgttgggagtgcagacacgagcccctgcatctggtggacgtctgactgaatcctgcctgtcctgctccgtcctgtcctgctccgtccttaaacacagtgaggcttaagggtgaagaaagttgctgaagcttgcctttggtccaggactctgacttcagagtacaggctcttaggatctcacaagtacgtgcctcgagccattctggtggacctggaacccggaaccatggacagtgtccgctcaggggcctttggacatctcttcaggcctgacaatttcatctttggtcagagtggggccggcaacaactgggccaagggtcactacacggagggggcggagctggtggattcggtcctggatgtggtgcggaaggagtgtgaaaactgcgactgcctgcagggcttccagctgacccactcgctggggggcggcacgggctccggcatgggcacgttgctcatcagcaaggtgcgtgaggagtatcccgaccgcatcatgaacaccttcagcgtcgtgccctcacccaaggtgtcagacacggtggtggagccctacaacgccacgctgtccatccaccagctggtggagaacacggatgagacctactgcatcgacaacgaggcgctctacgacatctgcttccgcaccctcaagctggccacgcccacctacggggacctcaaccacctggtatcggccaccatgagcggagtcaccacctccttgcgcttcccgggccagctcaacgctgacctgcgcaagctggccgtcaacatggtgcccttcccgcgcctgcacttcttcatgcccggcttcgcccccctcacagcccggggcagccagcagtaccgggccctgaccgtgcccgagctcacccagcagatgttcgatgccaagaacatgatggccgcctgcgacccgcgccacggccgctacctgacggtggccaccgtgttccggggccgcatgtccatgaaggaggtggacgagcagatgctggccatccagagcaagaacagcagctacttcgtggagtggatccccaacaacgtgaaggtggccgtgtgtgacatcccgccccgcggcctcaagatgtcctccaccttcatcgggaacagcacggccatccaggagctgttcaagcgcatctccgagcagttcacggccatgttccggcgcaaggccttcctgcactggtacacgggcgagggcatggacgagatggagttcaccgaggccgagagcaacatgaacgacctggtgtccgagtaccagcagtaccaggacgccacggccgaggaagagggcgagatgtacgaagacgacgaggaggagtcggaggcccagggccccaagtgaagctgctcgcagctggagtgagaggcaggtggcggccggggccgaagccagcagtgtctaaacccccggagccatcttgctgccgacaccctgctttcccctcgccctagggctcccttgccgccctcctgcagtatttatggcctcgtcctccccacctaggccacgtgtgagctgctcctgtctctgtcttattgcagctccag

SEQ ID NO: 196034 - DNA, 925 bp, Homo sapiens
  Payload ID: 18682
  Gene Name: tubulin, beta 3 class III
  ENST ID: ENST00000556536
  CDS Start-End: 61-507
ctcagcagccagcccggcccgcccgcgcccgtccgcagccgcccgccagacgcgcccagtatgagggagatcgtgcacatccaggccggccagtgcggcaaccagatcggggccaagttctgggaagtcatcagtgatgagcatggcatcgaccccagcggcaactacgtgggcgactcggacttgcagctggagcggatcagcgtctactacaacgaggcctcttctcacaagtacgtgcctcgagccattctggtggacctggaacccggaaccatggacagtgtccgctcaggggcctttggacatctcttcaggcctgacaatttcatctttgcacatccagctggtagatgccaactcgcatccagcccccagctgccagggattctggggtggctgtttgggctcctggcactgccagtcggaaggaaggtatgctggagcaggagggctgatccattcacccaggatcccctcaggaggcagagcctcgctctgctgtgaccccaagttctcaagactctgtccagagccctcgtcctgagcactcagcagcatcggctcagggaagccacggcgggtcagagtggggccggcaacaactgggccaagggtcactacacggagggggcggagctggtggattcggtcctggatgtggtgcggaaggagtgtgaaaactgcgactgcctgcagggcttccagctgacccactcgctggggggcggcacgggctccggcatgggcacgttgctcatcagcaaggtgcgtgaggagtatcccgaccgcatcatgaacaccttcagcgtcgtgccctcacccaaggtgtcagacacggtggtggagccctacaacgccacgctgtccatccaccagctggtggagaacacggatgagacctactgcatcgacaacgaggcgc

SEQ ID NO: 196035 - DNA, 806 bp, Homo sapiens
  Payload ID: 18682
  Gene Name: tubulin, beta 3 class III
  ENST ID: ENST00000557490
  CDS Start-End: 58-321
agcagccagcccggcccgcccgcgcccgtccgcagccgcccgccagacgcgcccagtatgagggagatcgtgcacatccaggccggccagtgcggcaaccagatcggggccaagttctgggaagtcatcagtgatgagcatggcatcgaccccagcggcaactacgtgggcgactcggacttgcagctggagcggatcagcgtctactacaacgaggcctcttgctggtctcgaactcctggactcaagcgatccacctgccttggcctcccaaagtgttgggagtgcagacacgagcccctgcatctggtggacgtctgactgaatcctgcctgtcctgctccgtcctgtcctgctccgtccttaaacacagtgaggcttaagggtgaagaaagttgctgaagcttgcctttggtccaggactctgacttcagagtacaggctcttaggatctcacaagtacgtgcctcgagccattctggtggacctggaacccggaaccatggacagtgtccgctcaggggcctttggacatctcttcaggcctgacaatttcatctttggtcagagtggggccggcaacaactgggccaagggtcactacacggagggggcggagctggtggattcggtcctggatgtggtgcggaaggagtgtgaaaactgcgactgcctgcagggcttccagctgacccactcgctggggggcggcacgggctccggcatgggcacgttgctcatcagcaaggtgcgtgaggagtatcccgaccgcatcatgaacaccttcagcgtcgtgccctcaccca

SEQ ID NO: 196036 - DNA, 1978 bp, Homo sapiens
  Payload ID: 18682
  Gene Name: tubulin, beta 3 class III
  Uniprot ID: Q13509
  ENST ID: ENST00000554444
  CDS Start-End: 555-1691
agaactgggagctgcttcctggcagggcccgcctctgctgggagaccggacggtgagtcagccttaagcccggcaccagacccctctgaggatggagcaggagctggctgccctgaggctgcaaaacttcttccctcgtggagacagggaggcacctcagacactcaccccggactcccttgaacagggacagggaggaaccccaggcagctagaccccagcagcagccacacgagcacactgtggggcagggaggggcatctcttgagaacaaaagatccatttctcgactttccaaactggagagcttcttgagagaaaagagagagacaggtacaggtccacgccacccacacacagccctgtgcacacagaccggacacaggcgtccacagttctgggaagtcatcagtgatgagcatggcatcgaccccagcggcaactacgtgggcgactcggacttgcagctggagcggatcagcgtctactacaacgaggcctcttctcacaagtacgtgcctcgagccattctggtggacctggaacccggaaccatggacagtgtccgctcaggggcctttggacatctcttcaggcctgacaatttcatctttggtcagagtggggccggcaacaactgggccaagggtcactacacggagggggcggagctggtggattcggtcctggatgtggtgcggaaggagtgtgaaaactgcgactgcctgcagggcttccagctgacccactcgctggggggcggcacgggctccggcatgggcacgttgctcatcagcaaggtgcgtgaggagtatcccgaccgcatcatgaacaccttcagcgtcgtgccctcacccaaggtgtcagacacggtggtggagccctacaacgccacgctgtccatccaccagctggtggagaacacggatgagacctactgcatcgacaacgaggcgctctacgacatctgcttccgcaccctcaagctggccacgcccacctacggggacctcaaccacctggtatcggccaccatgagcggagtcaccacctccttgcgcttcccgggccagctcaacgctgacctgcgcaagctggccgtcaacatggtgcccttcccgcgcctgcacttcttcatgcccggcttcgcccccctcacagcccggggcagccagcagtaccgggccctgaccgtgcccgagctcacccagcagatgttcgatgccaagaacatgatggccgcctgcgacccgcgccacggccgctacctgacggtggccaccgtgttccggggccgcatgtccatgaaggaggtggacgagcagatgctggccatccagagcaagaacagcagctacttcgtggagtggatccccaacaacgtgaaggtggccgtgtgtgacatcccgccccgcggcctcaagatgtcctccaccttcatcgggaacagcacggccatccaggagctgttcaagcgcatctccgagcagttcacggccatgttccggcgcaaggccttcctgcactggtacacgggcgagggcatggacgagatggagttcaccgaggccgagagcaacatgaacgacctggtgtccgagtaccagcagtaccaggacgccacggccgaggaagagggcgagatgtacgaagacgacgaggaggagtcggaggcccagggccccaagtgaagctgctcgcagctggagtgagaggcaggtggcggccggggccgaagccagcagtgtctaaacccccggagccatcttgctgccgacaccctgctttcccctcgccctagggctcccttgccgccctcctgcagtatttatggcctcgtcctccccacctaggccacgtgtgagctgctcctgtctctgtcttattgcagctccaggcctgacgttttacggttttgttttttactggtttgtgtttatattttcggggatacttaataaatctattgctgtcagat

SEQ ID NO: 196037 - DNA, 888 bp, Homo sapiens
  Payload ID: 18682
  Gene Name: tubulin, beta 3 class III
  ENST ID: ENST00000557262
  CDS Start-End: 58-213
agcagccagcccggcccgcccgcgcccgtccgcagccgcccgccagacgcgcccagtatgagggagatcgtgcacatccaggccggccagtgcggcaaccagatcggggccaagctgtcatgggagcagagtccgagaagcactgcaggcacctgctctagggggagagaggtggaggtggcaggtagagagaggacgacccctgggagctgagacgatgccagcctcacacggacaggctgggtgacctcagttctgggaagtcatcagtgatgagcatggcatcgaccccagcggcaactacgtgggcgactcggacttgcagctggagcggatcagcgtctactacaacgaggcctcttctcacaagtacgtgcctcgagccattctggtggacctggaacccggaaccatggacagtgtccgctcaggggcctttggacatctcttcaggcctgacaatttcatctttgctgggcattggaggcccagagaaagggttctgtggggagaacagaaaccactcatgcatttcaagtggaatgaagtgtaaagcagacagaagcttacagaattgctagagagctggtgagacagaacggggcctccagaggactccggggtccaggagcacgaggccttgctgcggtcaagagatcaggacgttcccatgcctgtgtcctggggttgggccgtggatgccacgttcccatgtctgtgtcctggggcggggccgtggatgccacgttcccacgtctgtgtcctggggcggggccgtggatgccacgttcccacgtctgtgtcctggggcggggccgtggatgccacgttcccacgcctgtgtcctggggcggggccgtggatgccacgttcccacgcctgtgtcct

SEQ ID NO: 196038 - DNA, 550 bp, Homo sapiens
  Payload ID: 18682
  Gene Name: tubulin, beta 3 class III
  ENST ID: ENST00000553656
  CDS Start-End: 65-220
gaccctcagcagccagcccggcccgcccgcgcccgtccgcagccgcccgccagacgcgcccagtatgagggagatcgtgcacatccaggccggccagtgcggcaaccagatcggggccaagctgtcatgggagcagagtccgagaagcactgcaggcacctgctctagggggagagaggtggaggtggcaggtagagagaggacgacccctgggagctgagacgatgccagcctcacacggacaggctgggtgacctcagttctgggaagtcatcagtgatgagcatggcatcgaccccagcggcaactacgtgggcgactcggacttgcagctggagcggatcagcgtctactacaacgaggcctcttctcacaagtacgtgcctcgagccattctggtggacctggaacccggaaccatggacagtgtccgctcaggggcctttggacatctcttcaggcctgacaatttcatctttggtcagagtggggccggcaacaactgggccaagggtcactacacggagggggcggagctggtggattcggt

SEQ ID NO: 196039 - DNA, 566 bp, Homo sapiens
  Payload ID: 18682
  Gene Name: tubulin, beta 3 class III
  ENST ID: ENST00000556565
  CDS Start-End: 428-566
aagcccggcaccagacccctctgaggatggagcaggagctggctgccctgaggctgcaaaacttcttccctcgtggagacagggaggcacctcagacactcaccccggactcccttgaacagggacagggaggaaccccaggcagctagaccccagcagcagccacacgagcacactgtggggcagggaggggcatctcttgagaacaaaagatccatttctcgactttccaaactggagagcttcttgagagaaaagagagagacagttctgggaagtcatcagtgatgagcatggcatcgaccccagcggcaactacgtgggcgactcggacttgcagctggagcggatcagcgtctactacaacgaggcctcttctcacaagtacgtgcctcgagccattctggtggacctggaacccggaaccatggacagtgtccgctcaggggcctttggacatctcttcaggcctgacaatttcatctttggtcagagtggggccggcaacaactgggccaagggtcactacacggagggggcggagctggtggattcggtcctggatg

SEQ ID NO: 196040 - DNA, 572 bp, Homo sapiens
  Payload ID: 18682
  Gene Name: tubulin, beta 3 class III
  ENST ID: ENST00000555576
  CDS Start-End: 58-351
agcagccagcccggcccgcccgcgcccgtccgcagccgcccgccagacgcgcccagtatgagggagatcgtgcacatccaggccggccagtgcggcaaccagatcggggccaagttctgggaagtcatcagtgatgagcatggcatcgaccccagcggcaactacgtgggcgactcggacttgcagctggagcggatcagcgtctactacaacgaggcctcttctcacaagtacgtgcctcgagccattctggtggacctggaacccggaaccatggacagtgtccgctcaggggcctttggacatctcttcaggcctgacaatttcatctttggtccacatctgctttgacagcaaatctggccagctgcaccttcagaacacgcccacagcccagcacccctcatgtctgctgctgcctcgggtcttcctcgtcccgtccgtgcgattgtctcctcactgggctcccacagctgcctggccgctcctcacatgcaatttggcatctgctcccgtgccacgctgtccttcatatcctcttgttatatatgccccgtccacaccacgtccct

SEQ ID NO: 196041 - DNA, 570 bp, Homo sapiens
  Payload ID: 18682
  Gene Name: tubulin, beta 3 class III
  ENST ID: ENST00000625617
  CDS Start-End: 124-570
gacatcagccgatgcgaagggcggggccgcggctataagagcgcgcggccgcggtccccgaccctcagcagccagcccggcccgcccgcgcccgtccgcagccgcccgccagacgcgcccagtatgagggagatcgtgcacatccaggccggccagtgcggcaaccagatcggggccaagttctgggaagtcatcagtgatgagcatggcatcgaccccagcggcaactacgtgggcgactcggacttgcagctggagcggatcagcgtctactacaacgaggcctcttctcacaagtacgtgcctcgagccattctggtggacctggaacccggaaccatggacagtgtccgctcaggggcctttggacatctcttcaggcctgacaatttcatctttgcacatccagctggtagatgccaactcgcatccagcccccagctgccagggattctggggtggctgtttgggctcctggcactgccagtcggaaggaaggtatgctggagcaggagggctgatccattcacccaggatcccctcaggaggcagagcctcgctctgctgtga

SEQ ID NO: 196042 - DNA, 2552 bp, Homo sapiens
  Payload ID: 18683
  Gene Name: tubulin, beta 4A class IVa
  Uniprot ID: P04350
  ENST ID: ENST00000264071
  CDS Start-End: 373-1707
atttctgcgggtggccaagcctggctgggggctgggacgggggagactgcactggtggctccctaaggggcctcacccccaaggcaggggtcggagcacgtggcgtcccggacttctctgggaggccccctggggagggaggtccctgcaccacctccccccaccccagccccctccatcatcccggggcgggaccaaggggcggagcgggagggtgaccggccgtgacgcgtgccccgcccgctcatatagcggctcccgggggcgcagggaccgtgctccgccgtctccgccgcatcttccaccctcgccgccgccgcagctccccgcgctcgtgccaccgccgccgcgtccaccctcagcgccaccgccatgcgggagatcgtgcacctgcaggccggccagtgcggcaaccagatcggggccaagttttgggaggttatcagtgacgaacatggcatcgaccccacaggcacataccatggggacagtgacctgcaactggagaggatcaacgtgtactacaacgaggccacaggaggaaattatgtccccagagcggtgctggtggacctggaacccggcaccatggactctgtccgttctggccccttcggtcagatctttcggccggacaacttcgtgtttggccaatccggagccggcaacaactgggcaaaggggcactacacggagggcgcagagctggtggacgctgtcctggacgtagtccggaaggaggccgagagctgcgactgccttcagggcttccagctgacccactcgctggggggtggcacggggtccggaatgggcacgctgctcatcagtaagatccgcgaggagttcccagaccgcatcatgaacaccttcagcgtggtgccctcgcccaaagtgtcagacacggtggtggagccctacaacgccacgctgtctgtgcaccagctggtggagaatacggatgagacctactgcatcgacaacgaggcactctacgacatctgtttccgcaccctcaagctgaccacccccacctacggggacctcaaccacctggtgtcggccaccatgagcggggtcaccacctgcctgcgcttcccgggccagctgaacgccgacctgcgcaagctggccgtcaacatggttccctttcctcgcctgcacttcttcatgcccggcttcgcacccctgaccagccggggcagccagcagtaccgggccctgacggtgcccgagctcacccagcagatgttcgatgccaagaacatgatggcggcgtgcgacccgcgccacggccgctacctgaccgtggccgccgtgttccggggccgcatgtccatgaaggaggtggacgagcagatgctgagcgtgcagagcaagaacagcagctacttcgtggagtggatccccaacaacgtgaagacggccgtgtgcgacatcccgccccgcggcctgaagatggccgcgaccttcatcggcaacagcacggccatccaggagctgttcaagcgcatctccgagcagttcacggccatgttccggcgcaaggccttcttgcactggtacacgggcgagggcatggacgagatggagttcaccgaggccgagagcaacatgaatgacctggtatctgagtaccagcagtaccaggacgccacggccgaggagggcgagttcgaggaggaggcggaggaggaggtggcctaggctgctcccatcgcttcccacctgtcccctcgaggcttctgacctttgatccgctaggccccccatctctgaaccctagagccccgctttccctccaaggctgactccccgctgaccctaacaatacctttggagctcgctttacctctggctacttcatctccgaccctggctcccctttgagccctaatttatctttaacccccttgagctcttccaaccttgacattcccaggaggagccccgcttcaccccttctgactctggaaaccgcacctttaactttgcagaccttccttcacccctgacttctgcttcacctttgacctctgccccccatgaatcccattttacctctagacctataagttctggtttatgtttgacccctccctctgagctgcacttcaccgctgaccttgcctcacctttaaccccccacctgagccccagctcctacctctgaccccaacttctctttgatctctgaatcccctctgactccaacttctctttcaccctctatgagtcccattttacttctacacctgcaagtcctggtttatattggacccctccctccgagctgcagttcacctttgaccttgcctcacctttcaccccccaccccccacagcgtcagctcctacctctgaccccagcttctctctgattcccacaggccccatgcatcctccctgcctcactcccctcagcccctgccgaccttagcttatctgggagagaaacaaggcctggtgcctgtgaggaagagaggtcacccctaccctccctccccgcttccctgcctcaccctcaataaataaattaattgttgtcatgga

SEQ ID NO: 196043 - DNA, 2224 bp, Homo sapiens
  Payload ID: 18683
  Gene Name: tubulin, beta 4A class IVa
  Uniprot ID: P04350
  ENST ID: ENST00000540257
  CDS Start-End: 82-1416
gccgcatcttccaccctcgccgccgccgcagctccccgcgctcgtgccaccgccgccgcgtccaccctcagcgccaccgccatgcgggagatcgtgcacctgcaggccggccagtgcggcaaccagatcggggccaagttttgggaggttatcagtgacgaacatggcatcgaccccacaggcacataccatggggacagtgacctgcaactggagaggatcaacgtgtactacaacgaggccacaggaggaaattatgtccccagagcggtgctggtggacctggaacccggcaccatggactctgtccgttctggccccttcggtcagatctttcggccggacaacttcgtgtttggccaatccggagccggcaacaactgggcaaaggggcactacacggagggcgcagagctggtggacgctgtcctggacgtagtccggaaggaggccgagagctgcgactgccttcagggcttccagctgacccactcgctggggggtggcacggggtccggaatgggcacgctgctcatcagtaagatccgcgaggagttcccagaccgcatcatgaacaccttcagcgtggtgccctcgcccaaagtgtcagacacggtggtggagccctacaacgccacgctgtctgtgcaccagctggtggagaatacggatgagacctactgcatcgacaacgaggcactctacgacatctgtttccgcaccctcaagctgaccacccccacctacggggacctcaaccacctggtgtcggccaccatgagcggggtcaccacctgcctgcgcttcccgggccagctgaacgccgacctgcgcaagctggccgtcaacatggttccctttcctcgcctgcacttcttcatgcccggcttcgcacccctgaccagccggggcagccagcagtaccgggccctgacggtgcccgagctcacccagcagatgttcgatgccaagaacatgatggcggcgtgcgacccgcgccacggccgctacctgaccgtggccgccgtgttccggggccgcatgtccatgaaggaggtggacgagcagatgctgagcgtgcagagcaagaacagcagctacttcgtggagtggatccccaacaacgtgaagacggccgtgtgcgacatcccgccccgcggcctgaagatggccgcgaccttcatcggcaacagcacggccatccaggagctgttcaagcgcatctccgagcagttcacggccatgttccggcgcaaggccttcttgcactggtacacgggcgagggcatggacgagatggagttcaccgaggccgagagcaacatgaatgacctggtatctgagtaccagcagtaccaggacgccacggccgaggagggcgagttcgaggaggaggcggaggaggaggtggcctaggctgctcccatcgcttcccacctgtcccctcgaggcttctgacctttgatccgctaggccccccatctctgaaccctagagccccgctttccctccaaggctgactccccgctgaccctaacaatacctttggagctcgctttacctctggctacttcatctccgaccctggctcccctttgagccctaatttatctttaacccccttgagctcttccaaccttgacattcccaggaggagccccgcttcaccccttctgactctggaaaccgcacctttaactttgcagaccttccttcacccctgacttctgcttcacctttgacctctgccccccatgaatcccattttacctctagacctataagttctggtttatgtttgacccctccctctgagctgcacttcaccgctgaccttgcctcacctttaaccccccacctgagccccagctcctacctctgactccaacttctctttcaccctctatgagtcccattttacttctacacctgcaagtcctggtttatattggacccctccctccgagctgcagttcacctttgaccttgcctcacctttcaccccccaccccccacagcgtcagctcctacctctgaccccagcttctctctgattcccacaggccccatgcatcctccctgcctcactcccctcagcccctgccgaccttagcttatctgggagagaaacaaggcctggtgcctgtgaggaagagaggtcacccctaccctccctccccgcttccctgcctcaccctcaataaataaattaattgttgtcatg

SEQ ID NO: 196044 - DNA, 548 bp, Homo sapiens
  Payload ID: 18683
  Gene Name: tubulin, beta 4A class IVa
  ENST ID: ENST00000596926
  CDS Start-End: 98-430
gtgctccgccgtctccgccgcatcttccaccctcgccgccgccgcagctccccgcgctcgtgccaccgccgccgcgtccaccctcagcgccaccgccatgcgggagatcgtgcacctgcaggccggccagtgcggcaaccagatcggggccaagttttgggaggttatcagtgacgaacatggcatcgaccccacaggcacataccatggggacagtgacctgcaactggagaggatcaacgtgtactacaacgaggccacaggaggaaattatgtccccagagcggtgctggtggacctggaacccggcaccatggactctgtccgttctggccccttcggtcagatctttcggccggacaacttcgtgtttgtagagacggggtttcaccgtgttagccaggatggtctcgatctcctgacctcgtgatccgcccacctcggcctcccaaagtgctgggattacaggccaatccggagccggcaacaactgggcaaaggggcactacacggagggcgcagagctggtggacgctgtcctggacgta

SEQ ID NO: 196045 - DNA, 1050 bp, Homo sapiens
  Payload ID: 18683
  Gene Name: tubulin, beta 4A class IVa
  ENST ID: ENST00000595324
  CDS Start-End: 98-427
gtgctccgccgtctccgccgcatcttccaccctcgccgccgccgcagctccccgcgctcgtgccaccgccgccgcgtccaccctcagcgccaccgccatgcgggagatcgtgcacctgcaggccggccagtgcggcaaccagatcggggccaagttttgggaggttatcagtgacgaacatggcatcgaccccacaggcacataccatggggacagtgacctgcaactggagaggatcaacgtgtactacaacgaggccacaggaggaaattatgtccccagagcggtgctggtggacctggaacccggcaccatggactctgtccgttctggccccttcggtcagatctttcggccggacaacttcgtgtttggtgagtcccccagcagggagccagaggctggaaaacctccttattcctgctaacaccacagagtcaacagccaccaccggggcccacagaccagagatggggtggacagggcaccaggcaccagccctgcatccagggctgtgatgaggggatgctcaggccactgtgagagccctgaggagggcggatacagagaaggattcagggaagtcttcctggaggaggtggcattttaattcaacggtctgaaccggaaccagactgcctgggtgcacatcccaattctgccacttcatgcattcaacaaacagtgagcactcactgcataccaggccctgttctagaagctggagatccaggccaatccggagccggcaacaactgggcaaaggggcactacacggagggcgcagagctggtggacgctgtcctggacgtagtccggaaggaggccgagagctgcgactgccttcagggcttccagctgacccactcgctggggggtggcacggggtccggaatgggcacgctgctcatcagtaagatccgcgaggagttcccagaccgcatcatgaacaccttcagcgtggtgccctcgcccaaagtgtcagacacggtggtggagccctacaacgccacgctgtctgtgcaccagctggtggagaatacggatgag

SEQ ID NO: 196046 - DNA, 543 bp, Homo sapiens
  Payload ID: 18683
  Gene Name: tubulin, beta 4A class IVa
  ENST ID: ENST00000601640
  CDS Start-End: 221-543
actatgcagcttcaggacaagccctccaggaacctaccgccccccacccgcaaaccagatcgccgctccggagcccccagcccactgggagggctcgcggttactgcaaggattctggcgaatgaggtctaaatagaatgagaaggggggctgcggaccgagaaactgagctccccgcgctcgtgccaccgccgccgcgtccaccctcagcgccaccgccatgcgggagatcgtgcacctgcaggccggccagtgcggcaaccagatcggggccaagttttgggaggttatcagtgacgaacatggcatcgaccccacaggcacataccatggggacagtgacctgcaactggagaggatcaacgtgtactacaacgaggccacaggaggaaattatgtccccagagcggtgctggtggacctggaacccggcaccatggactctgtccgttctggccccttcggtcagatctttcggccggacaacttcgtgtttggccaatccggagccggcaacaactgggcaaaggggcactacacgga

SEQ ID NO: 196047 - DNA, 579 bp, Homo sapiens
  Payload ID: 18683
  Gene Name: tubulin, beta 4A class IVa
  ENST ID: ENST00000594075
  CDS Start-End: 98-579
gtgctccgccgtctccgccgcatcttccaccctcgccgccgccgcagctccccgcgctcgtgccaccgccgccgcgtccaccctcagcgccaccgccatgcgggagatcgtgcacctgcaggccggccagtgcggcaaccagatcggggccaagttttgggaggttatcagtgacgaacatggcatcgaccccacaggcacataccatggggacagtgacctgcaactggagaggatcaacgtgtactacaacgaggccgagagctgcgactgccttcagggcttccagctgacccactcgctggggggtggcacggggtccggaatgggcacgctgctcatcagtaagatccgcgaggagttcccagaccgcatcatgaacaccttcagcgtggtgccctcgcccaaagtgtcagacacggtggtggagccctacaacgccacgctgtctgtgcaccagctggtggagaatacggatgagacctactgcatcgacaacgaggcactctacgacatctgtttccgcaccctcaagctgaccacccccacctacggggacctcaaccacctggtgtcggc

SEQ ID NO: 196048 - DNA, 565 bp, Homo sapiens
  Payload ID: 18683
  Gene Name: tubulin, beta 4A class IVa
  ENST ID: ENST00000598635
  CDS Start-End: 93-565
acccgcaaaccagatcgccgctccggagcccccagcccactgggagggctcgcggttactgcaaggattctggcgaatgaggtctaaatagaatgagaaggggggctgcggaccgagaaactgagcggctcccgggggcgcagggaccgtgctccgccgtctccgccgcatcttccaccctcgccgccgccgcagctccccgcgctcgtgccaccgccgccgcgtccaccctcagcgccaccgccatgcgggagatcgtgcacctgcaggccggccagtgcggcaaccagatcggggccaagttttgggaggttatcagtgacgaacatggcatcgaccccacaggcacataccatggggacagtgacctgcaactggagaggatcaacgtgtactacaacgaggccacaggaggaaattatgtccccagagcggtgctggtggacctggaacccggcaccatggactctgtccgttctggccccttcggtcagatctttcggccggacaacttcgtgtttggccaatccggagccggcaacaactgggcaaaggggcactacac

SEQ ID NO: 196049 - DNA, 530 bp, Homo sapiens
  Payload ID: 18683
  Gene Name: tubulin, beta 4A class IVa
  ENST ID: ENST00000600216
  CDS Start-End: 98-530
gtgctccgccgtctccgccgcatcttccaccctcgccgccgccgcagctccccgcgctcgtgccaccgccgccgcgtccaccctcagcgccaccgccatgcgggagatcgtgcacctgcaggccggccagtgcggcaaccagatcggggccaagttttgggagggcgcagagctggtggacgctgtcctggacgtagtccggaaggaggccgagagctgcgactgccttcagggcttccagctgacccactcgctggggggtggcacggggtccggaatgggcacgctgctcatcagtaagatccgcgaggagttcccagaccgcatcatgaacaccttcagcgtggtgccctcgcccaaagtgtcagacacggtggtggagccctacaacgccacgctgtctgtgcaccagctggtggagaatacggatgagacctactgcatcgacaacgaggcactctacgacatctgtttccgcaccctcaagctgaccacccccacctacggggacctcaaccacctggtgtcgg

SEQ ID NO: 196050 - DNA, 590 bp, Homo sapiens
  Payload ID: 18683
  Gene Name: tubulin, beta 4A class IVa
  ENST ID: ENST00000601152
  CDS Start-End: 127-408
atatagcggctcccgggggcgcagggaccgtgctccgccgtctccgccgcatcttccaccctcgccgccgccgcagctccccgcgctcgtgccaccgccgccgcgtccaccctcagcgccaccgccatgcgggagatcgtgcacctgcaggcacataccatggggacagtgacctgcaactggagaggatcaacgtgtactacaacgaggccacaggaggaaattatgtccccagagcggtgctggtggacctggaacccggcaccatggactctgtccgttctggccccttcggtcagatctttcggccggacaacttcgtgtttggccaatccggagccggcaacaactgggcaaaggggcactacacggagggcgcagagctggtggacgctgtcctggacgtagtccggaaggaggccgagagctgcgactgccttcagggcttccagctgacccactcgctggggggtggcacggggtccggaatgggcacgctgctcatcagtaagatccgcgaggagttcccagaccgcatcatgaacaccttcagcgtggtgccctcgcccaaagtgtcagacacggtggtg

SEQ ID NO: 196051 - DNA, 553 bp, Homo sapiens
  Payload ID: 18683
  Gene Name: tubulin, beta 4A class IVa
  ENST ID: ENST00000594290
  CDS Start-End: 98-409
gtgctccgccgtctccgccgcatcttccaccctcgccgccgccgcagctccccgcgctcgtgccaccgccgccgcgtccaccctcagcgccaccgccatgcgggagatcgtgcacctgcaggccggccagtgcggcaaccagatcggggccaagttttgggaggttatcagtgacgaacatggcatcgaccccacaggcacataccatggggacagtgacctgcaactggagaggatcaacgtgtactacaacgaggccacaggaggaaattatgtccccagagcggtgctggtggacctggaacccggcaccatggactctgtccgttctggccccttcggtcagatctttcggccggacaacttcgtgtttgacagggtctgtctgtcctgctgtcacccaggctagagtgcagtggcatgatcacggctcactgtcacctccacctctgggcacacgtgatcctcttgcctcagtctcccaagtagctggacctacaggccaatccggagccggcaacaactgggcaaaggggcactacacggagggcgc

SEQ ID NO: 196052 - DNA, 545 bp, Homo sapiens
  Payload ID: 18683
  Gene Name: tubulin, beta 4A class IVa
  ENST ID: ENST00000596291
  CDS Start-End: 324-545
cttcttgctgcctcatcctcgccccgacaccatgcctctaggtcccccgttcaccttgctgggggagaggtggcagctagggagctagttgggggctgggggcagtcctcggcttggccaccggcttcccctctctcaactcttccgaccacctctctctctagttttgggaggttatcagtgacgaacatggcatcgaccccacaggcacataccatggggacagtgacctgcaactggagaggatcaacgtgtactacaacgaggccacaggaggaaattatgtccccagagcggtgctggtggacctggaacccggcaccatggactctgtccgttctggccccttcggtcagatctttcggccggacaacttcgtgtttggccaatccggagccggcaacaactgggcaaaggggcactacacggagggcgcagagctggtggacgctgtcctggacgtagtccggaaggaggccgagagctgcgactgccttcagggcttccagctgacccactcgctggggggtggcacggggtccgga

SEQ ID NO: 196053 - DNA, 636 bp, Homo sapiens
  Payload ID: 18683
  Gene Name: tubulin, beta 4A class IVa
  ENST ID: ENST00000597686
  CDS Start-End: 134-636
tgcagcttcaggacaagccctccaggaacctaccgccccccacccgcaaaccagatcgccgctccggagcccccagcccactgggagggctcgcggttactgcaaggattctggcgaatgaggtctaaatagaatgagaaggggggctgcggaccgagaaactgagggaccgtgctccgccgtctccgccgcatcttccaccctcgccgccgccgcagctccccgcgctcgtgccaccgccgccgcgtccaccctcagcgccaccgccatgcgggagatcgtgcacctgcaggccggccagtgcggcaaccagatcggggccaagttttgggaggttatcagtgacgaacatggcatcgaccccacaggcacataccatggggacagtgacctgcaactggagaggatcaacgtgtactacaacgaggccacaggaggaaattatgtccccagagcggtgctggtggacctggaacccggcaccatggactctgtccgttctggccccttcggtcagatctttcggccggacaacttcgtgtttggccaatccggagccggcaacaactgggcaaaggggcactacacggagggcgcagagctggtggacgctgtcctggacgtagtccggaagga

SEQ ID NO: 196054 - DNA, 562 bp, Homo sapiens
  Payload ID: 18683
  Gene Name: tubulin, beta 4A class IVa
  ENST ID: ENST00000594276
  CDS Start-End: 98-562
gtgctccgccgtctccgccgcatcttccaccctcgccgccgccgcagctccccgcgctcgtgccaccgccgccgcgtccaccctcagcgccaccgccatgcgggagatcgtgcacctgcaggccggccagtgcggcaaccagatcggggccaagttttgggaggttatcagtgacgaacatggcatcgaccccacaggcacataccatggggacagtgacctgcaactggagaggatcaacgtgtactacaacgaggagttcccagaccgcatcatgaacaccttcagcgtggtgccctcgcccaaagtgtcagacacggtggtggagccctacaacgccacgctgtctgtgcaccagctggtggagaatacggatgagacctactgcatcgacaacgaggcactctacgacatctgtttccgcaccctcaagctgaccacccccacctacggggacctcaaccacctggtgtcggccaccatgagcggggtcaccacctgcctgcgcttcccgggccagctgaacgccgacctgcgcaagctggccgtcaacatggttccc

SEQ ID NO: 196055 - DNA, 565 bp, Homo sapiens
  Payload ID: 18683
  Gene Name: tubulin, beta 4A class IVa
  ENST ID: ENST00000598006
  CDS Start-End: 126-440
tatagcggctcccgggggcgcagggaccgtgctccgccgtctccgccgcatcttccaccctcgccgccgccgcagctccccgcgctcgtgccaccgccgccgcgtccaccctcagcgccaccgccatgcgggagatcgtgcacctgcaggccggccagtgcggcaaccagatcggggccaaggcacataccatggggacagtgacctgcaactggagaggatcaacgtgtactacaacgaggccacaggaggaaattatgtccccagagcggtgctggtggacctggaacccggcaccatggactctgtccgttctggccccttcggtcagatctttcggccggacaacttcgtgtttggccaatccggagccggcaacaactgggcaaaggggcactacacggagggcgcagagctggtggacgctgtcctggacgtagtccggaaggaggccgagagctgcgactgccttcagggcttccagctgacccactcgctggggggtggcacggggtccggaatgggcacgctgctcatcagtaagatccgcgaggagttcccagac

SEQ ID NO: 196056 - DNA, 1637 bp, Homo sapiens
  Payload ID: 18684
  Gene Name: tubulin, beta 4B class IVb
  Uniprot ID: P68371
  ENST ID: ENST00000340384
  CDS Start-End: 149-1486
gttctggcagcccattccgagactagcggaggcgggcagggagggtatataagcgttggcggagcgtcggttgtagcactctgcgcgcccgctcttctgctgctgtttgtctacttcctcctgcttccccgccgccgccgccgccatcatgagggaaatcgtgcacttgcaggccgggcagtgcggcaaccaaatcggcgccaagttttgggaggtgatcagcgatgagcacggcatcgaccccacgggcacctaccacggggacagcgacctgcagctggaacgcatcaacgtgtactacaatgaggccaccggcggcaagtacgtgccccgcgccgtgctcgtggatctggagcccggcaccatggactccgtgcgctcggggcccttcgggcagatcttccggccggacaacttcgttttcggtcagagtggtgctgggaacaactgggccaaggggcactacacagaaggcgcggagctggtggactcggtgctggatgttgtgagaaaggaggctgagagctgtgactgcctgcagggtttccagctgacccactccctgggtggggggactgggtctgggatgggtaccctcctcatcagcaagatccgggaggagtacccagacaggatcatgaacacgtttagtgtggtgccttcgcccaaagtgtcagacacagtggtggagccctacaacgccaccctctcagtccaccagctcgtagaaaacacagacgagacctactgcattgataacgaagctctctacgacatttgcttcagaaccctaaagctgaccacgcccacctatggtgacctgaaccacctggtgtctgctaccatgagtggggtcaccacctgcctgcgcttcccaggccagctcaatgctgacctgcggaagctggctgtgaacatggtcccgtttccccggctgcacttcttcatgcccggctttgccccactgaccagccggggcagccagcagtaccgggcgctgaccgtgcccgagctcacccagcagatgtttgatgccaagaacatgatggctgcctgcgacccccgccatggccgctacctgacggttgccgccgtgttcaggggccgcatgtccatgaaggaggtggatgagcaaatgcttaatgtccaaaacaaaaacagcagctattttgttgagtggatccccaacaatgtgaaaacggctgtctgtgacatcccacctcgggggctaaaaatgtccgccaccttcattggcaacagcacggccatccaggagctgttcaagcgcatctccgagcagttcacggccatgttccggcgcaaggccttcctgcactggtacacgggcgagggcatggacgagatggagttcaccgaggccgagagcaacatgaatgacctggtgtccgagtaccagcagtaccaggatgccacagccgaggaggagggcgagttcgaggaggaggctgaggaggaggtggcctagagccttcagtcactggggaaagcagggaagcagtgtgaactctttattcactcccagcctgtcctgtggcctgtcccactgtgtgcacttgctgttttccctgtccacatccatgctgtacagacaccaccattaaagcattttcatagtg

SEQ ID NO: 196057 - DNA, 2064 bp, Homo sapiens
  Payload ID: 18685
  Gene Name: tubulin, beta 6 class V
  Uniprot ID: Q9BUF5
  ENST ID: ENST00000317702
  CDS Start-End: 235-1575
ttttccgcccggctcccggcaagggtcccccgactggcgcccgcgcgtcctccctcggctgctgcaggccgggccgcggcgtcgagcgggggcggcggggcggggcccgcagccattggcgagcggcggggcgggggcgggggcgcggagggtcggccccgggacgcgcgcagccggcccgcagttgccgctgtcgtccgcagagccagttcctagcgcagagccgcgcccgccatgagggagatcgtgcacatccaggcgggccagtgcgggaaccagatcggcaccaagttttgggaagtgatcagcgatgagcacggcatcgacccggccggaggctacgtgggagactcggcgctgcagctggagagaatcaacgtctactacaatgagtcatcgtctcagaaatatgtgcccagggccgccctggtggacttagagccaggcaccatggacagcgtgcggtctgggccttttgggcagcttttccggcctgacaacttcatctttggccagacgggtgcagggaacaactgggcgaaagggcactacacggagggcgcggagctggtggacgcagtgctggacgtggtgcggaaggagtgcgagcactgcgactgcctgcagggcttccagctcacgcactcgctgggcggcggcacgggctcaggcatgggcacgctgctcatcagcaagatccgtgaggagttcccggaccgcatcatgaacaccttcagcgtcatgccctcgcccaaggtgtcggacacggtggtggagccctacaatgccacactgtcggtgcaccagctggtggagaatacagacgagacctactgcatcgacaacgaggcgctctatgacatctgcttccgcactctgaagctgacaacgcccacctacggggacctcaaccacctggtgtccgccaccatgagtggggtcaccacctcgctgcgcttcccgggccagctcaatgctgacctgcgcaagctggcggtgaacatggtgcccttcccgcgcctgcacttcttcatgcctggcttcgcgccgctcaccagccgcggcagccagcagtaccgggccctgaccgtgcccgagctcacccagcagatgttcgacgccaggaacatgatggccgcctgcgatccgcgccatggccgctacctgaccgtggccaccgtgttccgcgggcccatgtccatgaaggaggtggacgagcagatgctggccatccagagtaagaacagcagctacttcgtggagtggattcccaacaacgtgaaggtggccgtgtgcgacatcccgccccgcggcctgaagatggcctccaccttcatcggcaacagcacggccatccaggagctgttcaagcgcatctccgagcagttctcagccatgttccggcgcaaggccttcctgcactggttcacgggtgagggcatggatgaaatggagttcaccgaggcggagagcaacatgaacgacctggtatccgagtaccagcagtaccaggatgccaccgccaatgacggggaggaagcttttgaggatgaggaagaggagatcgatggatagtcggaatagagccgccccaactcagatcctacaacacgcaagttccttcttgaaccctggtgcctcctaccctatggccctgaatggtgcactggtttaattgtgttggtgtcggcccctcacaaatgcagccaagtcatgtaattagtcatctggaacaaagactaaaaacagcagagaattgcgggttctacccagtcagaagatcacaccatggagactttctactagaggacttgaaagagaactgaggggccacaaaataaacttcaccttccattaagtgttcaagcatgtctgcaaattaggagggagttagaaacagtctttttcatcctttgtgatgaagcctgaaattgtgccgtgttgccttatatgaatatgcagtatgggactttgaaataatgattcataataaaatactaaacgtgtgtcttcatctctctagccatgtgcataaatgacgtaagttactttgtatggttacaa

SEQ ID NO: 196058 - DNA, 1017 bp, Homo sapiens
  Payload ID: 18685
  Gene Name: tubulin, beta 6 class V
  ENST ID: ENST00000591909
  CDS Start-End: 60-374
ggcccgcagttgccgctgtcgtccgcagagccagttcctagcgcagagccgcgcccgccatgagggagatcgtgcacatccaggcgggccagtgcgggaaccagatcggcaccaagttttgggaagtgatcagcgatgagcacggcatcgacccggccggaggctacgtgggagactcggcgctgcagctggagagaatcaacgtctactacaatgagtcatcgtctcagaaatatgtgcccagggccgccctggtggacttagagccaggcaccatggacagcgtgcggtctgggccttttgggcagcttttccggcctgacaacttcatctttgcccatctgcacaggggaactgaggagaaacaggaatgaagagtgggcgacaaagagaaagcatcccttcccacacgccaagagtccagtgcaacgatccctgccacacggtcagccgaccccacttggtgccacagggtccagcctcggccactctgggctcaacctttccagcacgtctgggagcccaatgaggctatgggacagtgtgcatttccctcaaggcctccggaaagtcacctgccacccactgtgacctctgaggctgaaaggactaaggactcctttccccatcatttcagctgggccagtggctggctaaaatcagcgcagcattcccattcttctgaaagccacagctgaaataatgcaccagctgaaaccacagtggacagactgagatggcctccctctgggcctctagttggcaactttctcacccgggggctcctctttctccttttcccgctccttgttccagtccttaaggccttctggaagtgaggtgtcctcatccaagctgccagtgccttccacaaattcttcataggtagatttttccgcaaatggtctggggcccaaaagttcaaccatatcattcttatctaatacttctttttctaacaacagaagagcaacctgaaatatgaacaattttcattaaatacagttactcagcaaa

SEQ ID NO: 196059 - DNA, 430 bp, Homo sapiens
  Payload ID: 18685
  Gene Name: tubulin, beta 6 class V
  ENST ID: ENST00000590967
  CDS Start-End: 41-388
cgtccgcagagccagttcctagcgcagagccgcgcccgccatgagggagatcgtgcacatccaggcgggccagtgcgggaaccagatcggcaccaagttttgggaagtgatcagcgatgagcacggcatcgacccggccggaggctacgtgggagactcggcgctgcagctggagagaatcaacgtctactacaatgagtcatcgtctcagaaatatgtgcccagggccgccctggtggacttagagccaggcaccatggacagcgtgcggtctgggccttttgggcagcttttccggcctgacaacttcatctttgtcacattcctaagagccacaggagccgggacagtgtcaacttctgctcaccacattgcaacccccgcttgaagacagagcagacaacgaaacatcagaacgaacggacccatg

SEQ ID NO: 196060 - DNA, 359 bp, Homo sapiens
  Payload ID: 18685
  Gene Name: tubulin, beta 6 class V
  ENST ID: ENST00000586691
  CDS Start-End: 1-95
ccctggtggacttagagccaggcaccatggacagcgtgcggtctgggccttttgggcagcttttccggcctgacaacttcatctttggagtgtagcttgcttcttgagtgactgcagcgagcatctgctcacccatgcactggctgcctagtgcagctaccctgcttcacctttaaaagcgggtctgcgtgctccagataccagccggcaaccgcatggcctgcttcgtggtatgccacagtcttcttctcctcaggctgcagaacctgcgttttcttctctaagcctaacaaaataacaacaaaaaaacccaagccattgttacagtgacactgacattaaaagacagttatacagtg

SEQ ID NO: 196061 - DNA, 524 bp, Homo sapiens
  Payload ID: 18685
  Gene Name: tubulin, beta 6 class V
  ENST ID: ENST00000590693
  CDS Start-End: 133-524
actttagctaaacccggttccaaaggggtgggagtcgtcggagaggaatggcctctgtatctccggagacggaaacaccaggacgaagaggccctaagaacagccagttcctagcgcagagccgcgcccgccatgagggagatcgtgcacatccaggcgggccagtgcgggaaccagatcggcaccaagttttgggaagtgatcagcgatgagcacggcatcgacccggccggaggctacgtgggagactcggcgctgcagctggagagaatcaacgtctactacaatgagtcatcgtctcagaaatatgtgcccagggccgccctggtggacttagagccaggcaccatggacagcgtgcggtctgggccttttgggcagcttttccggcctgacaacttcatctttggccagacgggtgcagggaacaactgggcgaaagggcactacacggagggcgcggagctggtggacgcagtgctggacgtggtgcggaaggagtgcgagcactgcgactgcctgca

SEQ ID NO: 196062 - DNA, 1492 bp, Homo sapiens
  Payload ID: 18685
  Gene Name: tubulin, beta 6 class V
  ENST ID: ENST00000591208
  CDS Start-End: 32-442
agccagttcctagcgcagagccgcgcccgccatgagggagatcgtgcacatccaggcgggccagtgcgggaaccagatcggcaccaagttttgggaagtgatcagcgatgagcacggcatcgacccggccggaggctacgtgggagactcggcgctgcagctggagagaatcaacgtctactacaatgagtcatcgtctcagaaatatgtgcccagggccgccctggtggacttagagccaggcaccatggacagcgtgcggtctgggccttttgggcagcttttccggcctgacaacttcatctttggccagacgggtgcagggaacaactgggcgaaaggggcttccagctcacgcactcgctgggcggcggcacgggctcaggcatgggcacgctgctcatcagcaagatccgtgaggagttcccggaccgcatcatgaacaccttcagcgtcatgccctcgcccaaggtgtcggacacggtggtggagccctacaatgccacactgtcggtgcaccagctggtggagaatacagacgagacctactgcatcgacaacgaggcgctctatgacatctgcttccgcactctgaagctgacaacgcccacctacggggacctcaaccacctggtgtccgccaccatgagtggggtcaccacctcgctgcgcttcccgggccagctcaatgctgacctgcgcaagctggcggtgaacatggtgcccttcccgcgcctgcacttcttcatgcctggcttcgcgccgctcaccagccgcggcagccagcagtaccgggccctgaccgtgcccgagctcacccagcagatgttcgacgccaggaacatgatggccgcctgcgatccgcgccatggccgctacctgaccgtggccaccgtgttccgcgggcccatgtccatgaaggaggtggacgagcagatgctggccatccagagtaagaacagcagctacttcgtggagtggattcccaacaacgtgaaggtggccgtgtgcgacatcccgccccgcggcctgaagatggcctccaccttcatcggcaacagcacggccatccaggagctgttcaagcgcatctccgagcagttctcagccatgttccggcgcaaggccttcctgcactggttcacgggtgagggcatggatgaaatggagttcaccgaggcggagagcaacatgaacgacctggtatccgagtaccagcagtaccaggatgccaccgccaatgacggggaggaagcttttgaggatgaggaagaggagatcgatggatagtcggaatagagccgccccaactcagatcctacaacacgcaagttccttcttgaaccctggtgcctcctaccctatggccctgaatggtgcactggtttaattgtgttggtgtcggcccctcacaaatgcagccaagtcatgtaattagtcatctggaacaaagactaaaaacagcagagaattgcgggttctacccagtcag

SEQ ID NO: 196063 - DNA, 1493 bp, Homo sapiens
  Payload ID: 18685
  Gene Name: tubulin, beta 6 class V
  ENST ID: ENST00000586810
  CDS Start-End: 53-478
agttgccgctgtcgtccgcagagccagttcctagcgcagagccgcgcccgccatgagggagatcgtgcacatccaggcgggccagtgcgggaaccagatcggcaccaagttttgggaagtgatcagcgatgagcacggcatcgacccggccggaggctacgtgggagactcggcgctgcagctggagagaatcaacgtctactacaatgagtcatcgtctcagaaatatgtgcccagggccgccctggtggacttagagccaggcaccatggacagcgtgcggtctgggccttttgggcagcttttccggcctgacaacttcatctttggtatgttcaggcagacgcatatatttacacacatacaatggagccagctgtatacactgtttagtaccctagtgttcctccctggctccccagcaacgtattttgaagatctttccatttcacaagtatggctgcctcattcctgttgatggctgatagtatcctctgcagagataccgccgtggatttaaccagtcttcagttgatagaattacctctttaacatggaacaaccaggtcaaaatgtatatacatctttaaaattgaccagtagctactttgacttgcctaaaaacgtaccagtgcatctgctcagctgcaccgttggtgggtgcctgtttccccggcccctccctttggctaacagcacatcatggaatcacttcacaccctccttgtcggtgaccaagcatggtgatggcgcagccctttcctgtttaaacggcacgggactctctttgttgcaggccagacgggtgcagggaacaactgggcgaaagggcactacacggagggcgcggagctggtggacgcagtgctggacgtggtgcggaaggagtgcgagcactgcgactgcctgcagggcttccagctcacgcactcgctgggcggcggcacgggctcaggcatgggcacgctgctcatcagcaagatccgtgaggagttcccggaccgcatcatgaacaccttcagcgtcatgccctcgcccaaggtgtcggacacggtggtggagccctacaatgccacactgtcggtgcaccagctggtggagaatacagacgagacctactgcatcgacaacgaggcgctctatgacatctgcttccgcactctgaagctgacaacgcccacctacggggacctcaaccacctggtgtccgccaccatgagtggggtcaccacctcgctgcgcttcccgggccagctcaatgctgacctgcgcaagctggcggtgaacatggtgcccttcccgcgcctgcacttcttcatgcctggcttcgcgccgctcaccagccgcggcagccagcagtaccgggccctgaccgtgcccgagctcacccagcagatgttcgacgccaggaacatgatggccgcctgcgatccgcgccatggccgctacctgaccgtggccaccgtgttccgcgggcccatgtccatgaagga

SEQ ID NO: 196064 - DNA, 481 bp, Homo sapiens
  Payload ID: 18685
  Gene Name: tubulin, beta 6 class V
  ENST ID: ENST00000592683
  CDS Start-End: 47-361
cgctgtcgtccgcagagccagttcctagcgcagagccgcgcccgccatgagggagatcgtgcacatccaggcgggccagtgcgggaaccagatcggcaccaagttttgggaagtgatcagcgatgagcacggcatcgacccggccggaggctacgtgggagactcggcgctgcagctggagagaatcaacgtctactacaatgagtcatcgtctcagaaatatgtgcccagggccgccctggtggacttagagccaggcaccatggacagcgtgcggtctgggccttttgggcagcttttccggcctgacaacttcatctttgcacatcatggaatcacttcacaccctccttgtcggtgaccaagcatggtgatggcgcagccctttcctgtttaaacggcacgggactctctttgttgcaggccagacgggtgcagggaacaactgggcgaaagggcactacacggagggcgcggagct

SEQ ID NO: 196065 - DNA, 576 bp, Homo sapiens
  Payload ID: 18685
  Gene Name: tubulin, beta 6 class V
  ENST ID: ENST00000590388
  CDS Start-End: 53-385
agttgccgctgtcgtccgcagagccagttcctagcgcagagccgcgcccgccatgagggagatcgtgcacatccaggcgggccagtgcgggaaccagatcggcaccaagttttgggaagtgatcagcgatgagcacggcatcgacccggccggaggctacgtgggagactcggcgctgcagctggagagaatcaacgtctactacaatgagtcatcgtctcagaaatatgtgcccagggccgccctggtggacttagagccaggcaccatggacagcgtgcggtctgggccttttgggcagcttttccggcctgacaacttcatctttgcaacgtattttgaagatctttccatttcacaagtatggctgcctcattcctgttgatggctgatagtatcctctgcagagataccgccgtggatttaaccagtcttcagttgataggccagacgggtgcagggaacaactgggcgaaagggcactacacggagggcgcggagctggtggacgcagtgctggacgtggtgcggaaggagtgcgagcactgcgactgcctgcagggcttccagctcacg

SEQ ID NO: 196066 - DNA, 485 bp, Homo sapiens
  Payload ID: 18685
  Gene Name: tubulin, beta 6 class V
  ENST ID: ENST00000591463
  CDS Start-End: 138-485
gccagttcctagcgcagagccgcgcccgccatgagggagatcgtgcacatccaggcgggccagtgcgggaaccagatcggcaccaagctcagaaatatgtgcccagggccgccctggtggacttagagccaggcaccatggacagcgtgcggtctgggccttttgggcagcttttccggcctgacaacttcatctttggccagacgggtgcagggaacaactgggcgaaagggcactacacggagggcgcggagctggtggacgcagtgctggacgtggtgcggaaggagtgcgagcactgcgactgcctgcagggcttccagctcacgcactcgctgggcggcggcacgggctcaggcatgggcacgctgctcatcagcaagatccgtgaggagttcccggaccgcatcatgaacaccttcagcgtcatgccctcgcccaaggtgtcggacacggtggtggagccctacaatgccacactgtcg

SEQ ID NO: 196067 - DNA, 1075 bp, Homo sapiens
  Payload ID: 18685
  Gene Name: tubulin, beta 6 class V
  ENST ID: ENST00000590103
  CDS Start-End: 62-1075
ccggcccgcagttgccgctgtcgtccgcagagccagttcctagcgcagagccgcgcccgccatgagggagatcgtgcacatccaggcgggccagtgcgggaaccagatcggcaccaagttttgggaagtgatcagcgatgagcacggcatcgacccggccggaggctacgtgggagactcggcgctgcagctggagagaatcaacgtctactacaatgagtcatcgtgccagacgggtgcagggaacaactgggcgaaagggcactacacggagggcgcggagctggtggacgcagtgctggacgtggtgcggaaggagtgcgagcactgcgactgcctgcagggcttccagctcacgcactcgctgggcggcggcacgggctcaggcatgggcacgctgctcatcagcaagatccgtgaggagttcccggaccgcatcatgaacaccttcagcgtcatgccctcgcccaaggtgtcggacacggtggtggagccctacaatgccacactgtcggtgcaccagctggtggagaatacagacgagacctactgcatcgacaacgaggcgctctatgacatctgcttccgcactctgaagctgacaacgcccacctacggggacctcaaccacctggtgtccgccaccatgagtggggtcaccacctcgctgcgcttcccgggccagctcaatgctgacctgcgcaagctggcggtgaacatggtgcccttcccgcgcctgcacttcttcatgcctggcttcgcgccgctcaccagccgcggcagccagcagtaccgggccctgaccgtgcccgagctcacccagcagatgttcgacgccaggaacatgatggccgcctgcgatccgcgccatggccgctacctgaccgtggccaccgtgttccgcgggcccatgtccatgaaggaggtggacgagcagatgctggccatccagagtaagaacagcagctacttcgtggagtggattcccaacaacgtgaaggtggccgtgtgcgacatcccgccccgcggcctgaagatggcctccaccttcatcggcaacagcacggccatccag

SEQ ID NO: 196068 - DNA, 788 bp, Homo sapiens
  Payload ID: 18685
  Gene Name: tubulin, beta 6 class V
  ENST ID: ENST00000586653
  CDS Start-End: 53-343
agttgccgctgtcgtccgcagagccagttcctagcgcagagccgcgcccgccatgagggagatcgtgcacatccaggcgggccagtgcgggaaccagatcggcaccaagttttgggaagtgatcagcgatgagcacggcatcgacccggccggaggctacgtgggagactcggcgctgcagctggagagaatcaacgtctactacaatgagtcatcgtctcagaaatatgtgcccagggccgccctggtggacttagagccaggcaccatggacagcgtgcggtctgggccttttgggcagcttttccggcctgacaacttcatctttgaattacctctttaacatggaacaaccaggtcaaaatgtatatacatctttaaaattgaccagtagctactttgacttgcctaaaaacgtaccagtgcatctgctcagctgcaccgttggtgggtgcctgtttccccggcccctccctttggctaacagcacatcatggaatcacttcacaccctccttgtcggtgaccaagcatggtgatggcgcagccctttcctgtttaaacggcacgggactctctttgttgcaggccagacgggtgcagggaacaactgggcgaaagggcactacacggagggcgcggagctggtggacgcagtgctggacgtggtgcggaaggagtgcgagcactgcgactgcctgcagggcttccagctcacgcactcgctgggcggcggcacgggctcaggcatgggcacgctgctcatcagcaagatccgtgaggagttcc

SEQ ID NO: 196069 - DNA, 1413 bp, Homo sapiens
  Payload ID: 18686
  Gene Name: tubulin, beta 8 class VIII
  ENST ID: ENST00000561967
  CDS Start-End: 56-415
gcgcgtctgctcctccttctcacgtttctcctgccgtcctaatcccgccttggccatgagggagatcgtgctcacgcagatcgggcagtgcgggaatcagatcggcgccaagttctgggaggtgatctctgatgaacatgccatcgactccgctggcacctaccacggggacagccacctgcagctggagcgcatcaacgtgtactacaacgaggccagcggtggcaggtacgtgccccgcgctgtgctcgtggatctggagccgggcaccatggactctgtgcgctcggggcccttcgggcaggtcttcaggccagacaacttcatcttcgtgaccggctgtgctgtcttacaggtcagtgtggggccggaaacaactgggccaagggacactacaccgaaggcgcggagctgatggagtcagtgatggacgttgtcagaaaggaggctgagagctgtgactgcctgcagggtttccagctgacccactccctgggtggggggactgggtctgggatgggtacccttctgctcagtaagatccgggaggagtacccagacaggatcataaacacattcagcatcctgccctcgcccaaggtgtcggacaccgtggtggagccctacaacgccaccctctcagtccaccagctcatagaaaacgcagatgagaccttttgcatagataacgaagctctgtatgacatatgttccaagaccctaaaactgcccacacccacctatggtgacctgaaccacctggtgtctgctaccatgagtggggtcaccacgtgcctgcgcttcccgggccagctgaatgctgacctgcggaagctggccgtgaacatggtcccgtttccccggctgcatttcttcatgcccggctttgccccactgaccagccggggcagccagcagtaccgggccttgactgtggctgagcttacccagcagatgtttgatgctaagaacatgatggctgcctgtgacccccgtcacggccgctacctaacggcggctgccattttcaggggtcgcatgcccatgagggaggtggatgaacaaatgttcaacattcaagataagaacagcagttactttgctgactggctccccaacaacgtaaaaacagccgtctgtgacatcccaccccgggggctaaaaatgtcagccaccttcattgggaataatacggccatccaggaactcttcaagcgtgtctcagagcagtttacagcaatgttcaggcgcaaggccttcctccactggtacacgggcgagggcatggatgagatggaattcaccgaggccgagagcaacatgaacgacctggtgtctgaatatcagcaatatcaggatgccacggccgaggaggaggaggatgaggagtatgccgaggaggaggtggcctag

SEQ ID NO: 196070 - DNA, 1061 bp, Homo sapiens
  Payload ID: 18686
  Gene Name: tubulin, beta 8 class VIII
  ENST ID: ENST00000567466
  CDS Start-End: 134-403
cttactaaagacgcgggaggaagttctccagcgagcagctttccccaacgtggaaaggaccacgcaaggacacctgagctttccaacagatgttcagcgccaggggatccacagttctgggaggtgatctctgatgaacatgccatcgactccgctggcacctaccacggggacagccacctgcagctggagcgcatcaacgtgtactacaacgaggccagcggtggcaggtacgtgccccgcgctgtgctcgtggatctggagccgggcaccatggactctgtgcgctcggggcccttcgggcaggtcttcaggccagacaacttcatcttcggtgagctgcgggcgaggactggggtgcggctccttagccagggcagctcaaaatccaggagtgtgctaaggtcatcctctgggaactgtggagctagggcccctgaacaccctcctatcctccgagtcgagtcgctcaatctgcctctcctaaatgggcttcgggaggaaggccctggtgtctcctcaaggtcagtgtggggccggaaacaactgggccaagggacactacaccgaaggcgcggagctgatggagtcagtgatggacgttgtcagaaaggaggctgagagctgtgactgcctgcagggtttccagctgacccactccctgggtggggggactgggtctgggatgggtacccttctgctcagtaagatccgggaggagtacccagacaggatcataaacacattcagcatcctgccctcgcccaaggtgtcggacaccgtggtggagccctacaacgccaccctctcagtccaccagctcatagaaaacgcagatgagaccttttgcatagataacgaagctctgtatgacatatgttccaagaccctaaaactgcccacacccacctatggtgacctgaaccacctggtgtctgctaccatgagtggggtcaccacgtgcctgcgcttcccgggccagctgaatgctgacctgcggaagctggccgtgaacatggtcccgtttccccggctgcatttcttcatgcccggctttgccc

SEQ ID NO: 196071 - DNA, 1790 bp, Homo sapiens
  Payload ID: 18686
  Gene Name: tubulin, beta 8 class VIII
  Uniprot ID: Q3ZCM7
  ENST ID: ENST00000568584
  CDS Start-End: 352-1686
atggaaacaagagtcttcccctcccacatgggaggaaaattcagtttcagctcagctagggatttagtcttactaaagacgcgggaggaagttctccagcgagcagctttccccaacgtggaaaggaccacgcaaggacacctgagctttccaacagatgttcagcgccaggggatccacaggtgggtgcacctgtgtggaagtaaagctgttgcttattctgggagccgaatccgaggcggagggaggtgggcgcggggctatttaaacgttggcggagggcgggctgggtcgctgcgcgtctgctcctccttctcacgtttctcctgccgtcctaatcccgccttggccatgagggagatcgtgctcacgcagatcgggcagtgcgggaatcagatcggcgccaagttctgggaggtgatctctgatgaacatgccatcgactccgctggcacctaccacggggacagccacctgcagctggagcgcatcaacgtgtactacaacgaggccagcggtggcaggtacgtgccccgcgctgtgctcgtggatctggagccgggcaccatggactctgtgcgctcggggcccttcgggcaggtcttcaggccagacaacttcatcttcggtcagtgtggggccggaaacaactgggccaagggacactacaccgaaggcgcggagctgatggagtcagtgatggacgttgtcagaaaggaggctgagagctgtgactgcctgcagggtttccagctgacccactccctgggtggggggactgggtctgggatgggtacccttctgctcagtaagatccgggaggagtacccagacaggatcataaacacattcagcatcctgccctcgcccaaggtgtcggacaccgtggtggagccctacaacgccaccctctcagtccaccagctcatagaaaacgcagatgagaccttttgcatagataacgaagctctgtatgacatatgttccaagaccctaaaactgcccacacccacctatggtgacctgaaccacctggtgtctgctaccatgagtggggtcaccacgtgcctgcgcttcccgggccagctgaatgctgacctgcggaagctggccgtgaacatggtcccgtttccccggctgcatttcttcatgcccggctttgccccactgaccagccggggcagccagcagtaccgggccttgactgtggctgagcttacccagcagatgtttgatgctaagaacatgatggctgcctgtgacccccgtcacggccgctacctaacggcggctgccattttcaggggtcgcatgcccatgagggaggtggatgaacaaatgttcaacattcaagataagaacagcagttactttgctgactggctccccaacaacgtaaaaacagccgtctgtgacatcccaccccgggggctaaaaatgtcagccaccttcattgggaataatacggccatccaggaactcttcaagcgtgtctcagagcagtttacagcaatgttcaggcgcaaggccttcctccactggtacacgggcgagggcatggatgagatggaattcaccgaggccgagagcaacatgaacgacctggtgtctgaatatcagcaatatcaggatgccacggccgaggaggaggaggatgaggagtatgccgaggaggaggtggcctagaactctccttttctaggtaaaggggggaagcagtgtggattctttactgtgttctgacagccatgtgtcactatacgcttgttaatttgtgtcttcacatctcc

SEQ ID NO: 196072 - DNA, 820 bp, Homo sapiens
  Payload ID: 18686
  Gene Name: tubulin, beta 8 class VIII
  ENST ID: ENST00000562809
  CDS Start-End: 32-259
tttctcctgccgtcctaatcccgccttggccatgagggagatcgtgctcacgcagatcgggcagtgcgggaatcagatcggcgccaaggtggcaggtacgtgccccgcgctgtgctcgtggatctggagccgggcaccatggactctgtgcgctcggggcccttcgggcaggtcttcaggccagacaacttcatcttcggtcagtgtggggccggaaacaactgggccaagggacactacaccgaaggcgcggagctgatggagtcagtgatggacgttgtcagaaaggaggctgagagctgtgactgcctgcagggtttccagctgacccactccctgggtggggggactgggtctgggatgggtacccttctgctcagtaagatccgggaggagtacccagacaggatcataaacacattcagcatcctgccctcgcccaaggtgtcggacaccgtggtggagccctacaacgccaccctctcagtccaccagctcatagaaaacgcagatgagaccttttgcatagataacgaagctctgtatgacatatgttccaagaccctaaaactgcccacacccacctatggtgacctgaaccacctggtgtctgctaccatgagtggggtcaccacgtgcctgcgcttcccgggccagctgaatgctgacctgcggaagctggccgtgaacatggtcccgtttccccggctgcatttcttcatgcccggctttgccccactgaccagccggggcagccagcagtaccgggccttgactgtggctgagcttacccagcagatgtttgatgctaagaacatga

SEQ ID NO: 196073 - DNA, 1367 bp, Homo sapiens
  Payload ID: 18686
  Gene Name: tubulin, beta 8 class VIII
  ENST ID: ENST00000568866
  CDS Start-End: 40-1263
ttctcacgtttctcctgccgtcctaatcccgccttggccatgagggagatcgtgctcacgcagatcgggcagtgcgggaatcagatcggcgccaagttctgggaggtgatctctgatgaacatgccatcgactccgctggcacctaccacggggacagccacctgcagctggagcgcatcaacgtgtactacaacgaggccagcggtcagtgtggggccggaaacaactgggccaagggacactacaccgaaggcgcggagctgatggagtcagtgatggacgttgtcagaaaggaggctgagagctgtgactgcctgcagggtttccagctgacccactccctgggtggggggactgggtctgggatgggtacccttctgctcagtaagatccgggaggagtacccagacaggatcataaacacattcagcatcctgccctcgcccaaggtgtcggacaccgtggtggagccctacaacgccaccctctcagtccaccagctcatagaaaacgcagatgagaccttttgcatagataacgaagctctgtatgacatatgttccaagaccctaaaactgcccacacccacctatggtgacctgaaccacctggtgtctgctaccatgagtggggtcaccacgtgcctgcgcttcccgggccagctgaatgctgacctgcggaagctggccgtgaacatggtcccgtttccccggctgcatttcttcatgcccggctttgccccactgaccagccggggcagccagcagtaccgggccttgactgtggctgagcttacccagcagatgtttgatgctaagaacatgatggctgcctgtgacccccgtcacggccgctacctaacggcggctgccattttcaggggtcgcatgcccatgagggaggtggatgaacaaatgttcaacattcaagataagaacagcagttactttgctgactggctccccaacaacgtaaaaacagccgtctgtgacatcccaccccgggggctaaaaatgtcagccaccttcattgggaataatacggccatccaggaactcttcaagcgtgtctcagagcagtttacagcaatgttcaggcgcaaggccttcctccactggtacacgggcgagggcatggatgagatggaattcaccgaggccgagagcaacatgaacgacctggtgtctgaatatcagcaatatcaggatgccacggccgaggaggaggaggatgaggagtatgccgaggaggaggtggcctagaactctccttttctaggtaaaggggggaagcagtgtggattctttactgtgttctgacagccatgtgtcactatacgcttgttaatttgtgtcttcacatctcc

SEQ ID NO: 196074 - DNA, 2438 bp, Homo sapiens
  Payload ID: 18686
  Gene Name: tubulin, beta 8 class VIII
  ENST ID: ENST00000564130
  CDS Start-End: 1041-2273
gaaccgcacggcggcgtcctggggggtccactgtgaggacggggggtccactgtgaggacggggggtccaccgtgaggacggagcttcctctcctcagcacccacccaggaggggccggggcttgggacacctggggccgcgtccgctgtgaggacagggagacgctgctgcagctccgggacaccgaggcaaaagggtaaatcttttcaagacactaaaacaggtgactcagccctgtgagctttgtgcctgacatgactcaaatggccagcaattttctccttctccagttaaacctgtccaaaattgaggaacctatccaggtgagaactggccactctaatttacccggaagcctttctgcaggagattcaaatatttgctaatgcttactgacaccttcactggttagatcgaggcattccccaccccatctgaaaaatgtttaccagaagaaataactcctcagtttgggtaatccaaaagcctgcaaagtgacaatggcccatctttcacagcaggcgtatcccaaaacctgtcctcagctttaagaatccaatatgaccttcactctgctggagaccacagtcctctggaaaggtgaaagggctaaccctactctaaagaagactccagctaaatcagaggcctgactgtctctaacacccatagcttattgtgggttagaactgctccaaagtaaaacgtataattgagtcctgttgagttcacatgtggaaggcctttcctaaccacagatctcctaatagatgaaaagactcatcaattacaaaaatatgtcatcaatctaggacaggtgcaaaggcactccgtgcatatggaaacaagagtcttcccctcccacatgggaggaaaattcagtttcagctcagctagggatttagtcttactaaagacgcgggaggaagttctccagcgagcagctttccccaacgtggaaaggaccacgcaaggacacctgagctttccaacagatgttcagcgccaggggatccacagttctgggaggtgatctctgatgaacatgccatcgactccgctggcacctaccacggggacagccacctgcagctggagcgcatcaacgtgtactacaacgaggccagcggtgagacccccgtccttcccccaccgccctcctgggaacgcggccctcccctcgctcatgccctcccgccccacgcaggtggcaggtcagtgtggggccggaaacaactgggccaagggacactacaccgaaggcgcggagctgatggagtcagtgatggacgttgtcagaaaggaggctgagagctgtgactgcctgcagggtttccagctgacccactccctgggtggggggactgggtctgggatgggtacccttctgctcagtaagatccgggaggagtacccagacaggatcataaacacattcagcatcctgccctcgcccaaggtgtcggacaccgtggtggagccctacaacgccaccctctcagtccaccagctcatagaaaacgcagatgagaccttttgcatagataacgaagctctgtatgacatatgttccaagaccctaaaactgcccacacccacctatggtgacctgaaccacctggtgtctgctaccatgagtggggtcaccacgtgcctgcgcttcccgggccagctgaatgctgacctgcggaagctggccgtgaacatggtcccgtttccccggctgcatttcttcatgcccggctttgccccactgaccagccggggcagccagcagtaccgggccttgactgtggctgagcttacccagcagatgtttgatgctaagaacatgatggctgcctgtgacccccgtcacggccgctacctaacggcggctgccattttcaggggtcgcatgcccatgagggaggtggatgaacaaatgttcaacattcaagataagaacagcagttactttgctgactggctccccaacaacgtaaaaacagccgtctgtgacatcccaccccgggggctaaaaatgtcagccaccttcattgggaataatacggccatccaggaactcttcaagcgtgtctcagagcagtttacagcaatgttcaggcgcaaggccttcctccactggtacacgggcgagggcatggatgagatggaattcaccgaggccgagagcaacatgaacgacctggtgtctgaatatcagcaatatcaggatgccacggccgaggaggaggaggatgaggagtatgccgaggaggaggtggcctagaactctccttttctaggtaaaggggggaagcagtgtggattctttactgtgttctgacagccatgtgtcactatacgcttgttaatttgtgtcttcacatctcctgctgcgttttaaagcatttttatagtatgcggttttgactaataaagtattctcacagca

SEQ ID NO: 196075 - DNA, 2670 bp, Homo sapiens
  Payload ID: 18687
  Gene Name: tubulin, beta class I
  Uniprot ID: P07437
  ENST ID: ENST00000327892
  CDS Start-End: 307-1641
gtacatgaccggcatcgactaatcagggccaggctcgatgaggctttgtctccctaccgcgcgcggggccgattctcccgcctcccagccccggcgcacgcgcgccccgcccagcctgctttccctccgcgccctcccctctcctttctccctctcagaaccttcctgccgtcgcgtttgcacctcgctgctccagcctctggggcgcattccaaccttccagcctgcgacctgcggagaaaaaaaattacttattttcttgccccatacataccttgaggcgagcaaaaaaattaaattttaaccatgagggaaatcgtgcacatccaggctggtcagtgtggcaaccagatcggtgccaagttctgggaggtgatcagtgatgaacatggcatcgaccccaccggcacctaccacggggacagcgacctgcagctggaccgcatctctgtgtactacaatgaagccacaggtggcaaatatgttcctcgtgccatcctggtggatctagaacctgggaccatggactctgttcgctcaggtccttttggccagatctttagaccagacaactttgtatttggtcagtctggggcaggtaacaactgggccaaaggccactacacagagggcgccgagctggttgattctgtcctggatgtggtacggaaggaggcagagagctgtgactgcctgcagggcttccagctgacccactcactgggcgggggcacaggctctggaatgggcactctccttatcagcaagatccgagaagaataccctgatcgcatcatgaataccttcagtgtggtgccttcacccaaagtgtctgacaccgtggtcgagccctacaatgccaccctctccgtccatcagttggtagagaatactgatgagacctattgcattgacaacgaggccctctatgatatctgcttccgcactctgaagctgaccacaccaacctacggggatctgaaccaccttgtctcagccaccatgagtggtgtcaccacctgcctccgtttccctggccagctcaatgctgacctccgcaagttggcagtcaacatggtccccttcccacgtctccatttctttatgcctggctttgcccctctcaccagccgtggaagccagcagtatcgagctctcacagtgccggaactcacccagcaggtcttcgatgccaagaacatgatggctgcctgtgacccccgccacggccgatacctcaccgtggctgctgtcttccgtggtcggatgtccatgaaggaggtcgatgagcagatgcttaacgtgcagaacaagaacagcagctactttgtggaatggatccccaacaatgtcaagacagccgtctgtgacatcccacctcgtggcctcaagatggcagtcaccttcattggcaatagcacagccatccaggagctcttcaagcgcatctcggagcagttcactgccatgttccgccggaaggccttcctccactggtacacaggcgagggcatggacgagatggagttcaccgaggctgagagcaacatgaacgacctcgtctctgagtatcagcagtaccaggatgccaccgcagaagaggaggaggatttcggtgaggaggccgaagaggaggcctaaggcagagcccccatcacctcaggcttctcagttcccttagccgtcttactcaactgcccctttcctctccctcagaatttgtgtttgctgcctctatcttgttttttgttttttcttctggggggggtctagaacagtgcctggcacatagtaggcgctcaataaatacttgtttgttgaatgtctcctctctctttccactctgggaaacctaggtttctgccattctgggtgaccctgtatttctttctggtgcccattccatttgtccagttaatacttcctcttaaaaatctccaagaagctgggtctccagatcccatttagaaccaaccaggtgctgaaaacacatgtagataatggccatcatcctaagcccaaagtagaaaatggtagaaggtagtgggtagaagtcactatataaggaaggggatgggattttccattctaaaagttttggagagggaaatccaggctattaaagtcactaaatttctaagtatgtccatttcccatctcagcttcaagggaggtgtcagcagtattatctccactttcaatctccctccaagctctactctggaggagtctgtcccactctgtcaagtggaatccttccctttccaactctacctccctcactcagctcctttcccctgatcagagaaagggatcaagggggttgggaggggggaaagagaccagccttggtccctaagcctccagaaacgtcttcttaatccccaccttttcttactcccaaaaaagaatgaacacccctgactctggagtggtgtatactgccacatcagtgtttgagtcagtccccagaggagaggggaaccctcctccatcttttttgcaacatctcatttcttccttttgctgttgcttcccccctcacacacttggttttgttctatcctacatttgagatttctattttatgttgaacttgctgctttttttcatattgaaaagatgacatcgccccaagagccaaaaataaatgggaattgaaaaaagctg

SEQ ID NO: 196076 - DNA, 2632 bp, Homo sapiens
  Payload ID: 18687
  Gene Name: tubulin, beta class I
  ENST ID: ENST00000330914
  CDS Start-End: 485-1603
cgcgtgcgccgcagtcacgtggagggcggggggggtggtcgactgcggcggcagctctttcctcagacccccagccttttgtgcgccgcgcggtggggcggtgcccagcttgggggaaggagagcggcgcttatcgaagtgtggtcgacctccatccgcccaccgagcacttgggacccgctgcacatatccagagcagggaaagctgtggctttctcgggggagcgagtgtctaggggaagggtgtggcaggcccacgggatgccatgccctagaacaacggcctgagcgcttgtggaattaaaatgggagatgtggggccgagttctgggaggtgatcagtgatgaacatggcatcgaccccaccggcacctaccacggggacagcgacctgcagctggaccgcatctctgtgtactacaatgaagccacaggtggcaaatatgttcctcgtgccatcctggtggatctagaacctgggaccatggactctgttcgctcaggtccttttggccagatctttagaccagacaactttgtatttggtcagtctggggcaggtaacaactgggccaaaggccactacacagagggcgccgagctggttgattctgtcctggatgtggtacggaaggaggcagagagctgtgactgcctgcagggcttccagctgacccactcactgggcgggggcacaggctctggaatgggcactctccttatcagcaagatccgagaagaataccctgatcgcatcatgaataccttcagtgtggtgccttcacccaaagtgtctgacaccgtggtcgagccctacaatgccaccctctccgtccatcagttggtagagaatactgatgagacctattgcattgacaacgaggccctctatgatatctgcttccgcactctgaagctgaccacaccaacctacggggatctgaaccaccttgtctcagccaccatgagtggtgtcaccacctgcctccgtttccctggccagctcaatgctgacctccgcaagttggcagtcaacatggtccccttcccacgtctccatttctttatgcctggctttgcccctctcaccagccgtggaagccagcagtatcgagctctcacagtgccggaactcacccagcaggtcttcgatgccaagaacatgatggctgcctgtgacccccgccacggccgatacctcaccgtggctgctgtcttccgtggtcggatgtccatgaaggaggtcgatgagcagatgcttaacgtgcagaacaagaacagcagctactttgtggaatggatccccaacaatgtcaagacagccgtctgtgacatcccacctcgtggcctcaagatggcagtcaccttcattggcaatagcacagccatccaggagctcttcaagcgcatctcggagcagttcactgccatgttccgccggaaggccttcctccactggtacacaggcgagggcatggacgagatggagttcaccgaggctgagagcaacatgaacgacctcgtctctgagtatcagcagtaccaggatgccaccgcagaagaggaggaggatttcggtgaggaggccgaagaggaggcctaaggcagagcccccatcacctcaggcttctcagttcccttagccgtcttactcaactgcccctttcctctccctcagaatttgtgtttgctgcctctatcttgttttttgttttttcttctggggggggtctagaacagtgcctggcacatagtaggcgctcaataaatacttgtttgttgaatgtctcctctctctttccactctgggaaacctaggtttctgccattctgggtgaccctgtatttctttctggtgcccattccatttgtccagttaatacttcctcttaaaaatctccaagaagctgggtctccagatcccatttagaaccaaccaggtgctgaaaacacatgtagataatggccatcatcctaagcccaaagtagaaaatggtagaaggtagtgggtagaagtcactatataaggaaggggatgggattttccattctaaaagttttggagagggaaatccaggctattaaagtcactaaatttctaagtatgtccatttcccatctcagcttcaagggaggtgtcagcagtattatctccactttcaatctccctccaagctctactctggaggagtctgtcccactctgtcaagtggaatccttccctttccaactctacctccctcactcagctcctttcccctgatcagagaaagggatcaagggggttgggaggggggaaagagaccagccttggtccctaagcctccagaaacgtcttcttaatccccaccttttcttactcccaaaaaagaatgaacacccctgactctggagtggtgtatactgccacatcagtgtttgagtcagtccccagaggagaggggaaccctcctccatcttttttgcaacatctcatttcttccttttgctgttgcttcccccctcacacacttggttttgttctatcctacatttgagatttctattttatgttgaacttgctgctttttttcatattgaaaagatgacatcgccccaagagccaaaaataaatgggaattgaaaaaagctg

SEQ ID NO: 196077 - DNA, 2671 bp, Homo sapiens
  Payload ID: 18687
  Gene Name: tubulin, beta class I
  Uniprot ID: P07437
  ENST ID: ENST00000383564
  CDS Start-End: 307-1641
gtacatgaccggcatcgactaatcagggccaggctcgatgaggctttgtctccctaccgcgcgcggggccgattctcccgcctcccagccccggcgcacgcgcgccccgcccagcctgctttccctccgcgccctcccctctcctttctccctctcagaaccttcctgccgtcgcgtttgcacctcgctgctccagcctctggggcgcattccaaccttccagcctgcgacctgcggagaaaaaaaattacttattttcttgccccatacataccttgaggcgagcaaaaaaattaaattttaaccatgagggaaatcgtgcacatccaggctggtcagtgtggcaaccagatcggtgccaagttctgggaggtgatcagtgatgaacatggcatcgaccccaccggcacctaccacggggacagcgacctgcagctggaccgcatctctgtgtactacaatgaagccacaggtggcaaatatgttcctcgtgccatcctggtggatctagaacctgggaccatggactctgttcgctcaggtccttttggccagatctttagaccagacaactttgtatttggtcagtctggggcaggtaacaactgggccaaaggccactacacagagggcgccgagctggttgattctgtcctggatgtggtacggaaggaggcagagagctgtgactgcctgcagggcttccagctgacccactcactgggcgggggcacaggctctggaatgggcactctccttatcagcaagatccgagaagaataccctgatcgcatcatgaataccttcagtgtggtgccttcacccaaagtgtctgacaccgtggtcgagccctacaatgccaccctctccgtccatcagttggtagagaatactgatgagacctattgcattgacaacgaggccctctatgatatctgcttccgcactctgaagctgaccacaccaacctacggggatctgaaccaccttgtctcagccaccatgagtggtgtcaccacctgcctccgtttccctggccagctcaatgctgacctccgcaagttggcagtcaacatggtccccttcccacgtctccatttctttatgcctggctttgcccctctcaccagccgtggaagccagcagtatcgagctctcacagtgccggaactcacccagcaggtcttcgatgccaagaacatgatggctgcctgtgacccccgccacggccgatacctcaccgtggctgctgtcttccgtggtcggatgtccatgaaggaggtcgatgagcagatgcttaacgtgcagaacaagaacagcagctactttgtggaatggatccccaacaatgtcaagacagccgtctgtgacatcccacctcgtggcctcaagatggcagtcaccttcattggcaatagcacagccatccaggagctcttcaagcgcatctcggagcagttcactgccatgttccgccggaaggccttcctccactggtacacaggcgagggcatggacgagatggagttcaccgaggctgagagcaacatgaacgacctcgtctctgagtatcagcagtaccaggatgccaccgcagaagaggaggaggatttcggtgaggaggccgaagaggaggcctaaggcagagcccccatcacctcaggcttctcagttcccttagccgtcttactcaactgcccctttcctctccctcagaatttgtgtttgctgcctctatcttgttttttgttttttcttctgggggggggtctagaacagtgcctggcacatagtaggcgctcaataaatacttgtttgttgaatgtctcctctctctttccactctgggaaacctaggtttctgccattctgggtgaccctgtatttctttctggtgcccattccatttgtccagttaatacttcctcttaaaaatctccaagaagctgggtctccagatcccatttagaaccaaccaggtgctgaaaacacatgtagataatggccatcatcctaagcccaaagtagaaaatggtagaaggtagtgggtagaagtcactatataaggaaggggatgggattttccattctaaaagttttggagagggaaatccaggctattaaagtcactaaatttctaagtatgtccatttcccatctcagcttcaagggaggtgtcagcagtattatctccactttcaatctccctccaagctctactctggaggagtctgtcccactctgtcaagtggaatccttccctttccaactctacctccctcactcagctcctttcccctgatcagagaaagggatcaagggggttgggaggggggaaagagaccagccttggtccctaagcctccagaaacgtcttcttaatccccaccttttcttactcccaaaaaagaatgaacacccctgactctggagtggtgtatactgccacatcagtgtttgagtcagtccccagaggagaggggaaccctcctccatcttttttgcaacatctcatttcttccttttgctgttgcttcccccctcacacacttggttttgttctatcctacatttgagatttctattttatgttgaacttgctgctttttttcatattgaaaagatgacatcgccccaagagccaaaaataaatgggaattgaaaaaagctg

SEQ ID NO: 196078 - DNA, 2823 bp, Homo sapiens
  Payload ID: 18687
  Gene Name: tubulin, beta class I
  ENST ID: ENST00000396384
  CDS Start-End: 676-1794
ggcgcttatcgaagtgtggtcgacctccatccgcccaccgagcacttgggacccgctgcacatatccagagcagggaaagctgtggctttctcgggggagcgagtgtctaggggaagggtgtggcaggcccacgggatgccatgccctagaacaacggcctgagcgcttgtggaattaaaatgggagatgtggggccgaggtgggcgaattgggatccctccaggtcaggggttcgagaccatcctgggcaacaaagcgagaccctcccccatgccacgtttctacaaaaaataaaagtaaaaaattagctgggcgtggtggcgcgcgtctgtggtcccagctactcgagaggctgagatgggaggatcggttgagcctgggagttccacgctgtagtcatccgtgattgcaccactgcactgcaggctgggcaacaggaagaccctgtcttaaaaattagaagaagctgggcgcggtggctcacccttgtaatcccagcactttgggaggccaagttctgggaggtgatcagtgatgaacatggcatcgaccccaccggcacctaccacggggacagcgacctgcagctggaccgcatctctgtgtactacaatgaagccacaggtggcaaatatgttcctcgtgccatcctggtggatctagaacctgggaccatggactctgttcgctcaggtccttttggccagatctttagaccagacaactttgtatttggtcagtctggggcaggtaacaactgggccaaaggccactacacagagggcgccgagctggttgattctgtcctggatgtggtacggaaggaggcagagagctgtgactgcctgcagggcttccagctgacccactcactgggcgggggcacaggctctggaatgggcactctccttatcagcaagatccgagaagaataccctgatcgcatcatgaataccttcagtgtggtgccttcacccaaagtgtctgacaccgtggtcgagccctacaatgccaccctctccgtccatcagttggtagagaatactgatgagacctattgcattgacaacgaggccctctatgatatctgcttccgcactctgaagctgaccacaccaacctacggggatctgaaccaccttgtctcagccaccatgagtggtgtcaccacctgcctccgtttccctggccagctcaatgctgacctccgcaagttggcagtcaacatggtccccttcccacgtctccatttctttatgcctggctttgcccctctcaccagccgtggaagccagcagtatcgagctctcacagtgccggaactcacccagcaggtcttcgatgccaagaacatgatggctgcctgtgacccccgccacggccgatacctcaccgtggctgctgtcttccgtggtcggatgtccatgaaggaggtcgatgagcagatgcttaacgtgcagaacaagaacagcagctactttgtggaatggatccccaacaatgtcaagacagccgtctgtgacatcccacctcgtggcctcaagatggcagtcaccttcattggcaatagcacagccatccaggagctcttcaagcgcatctcggagcagttcactgccatgttccgccggaaggccttcctccactggtacacaggcgagggcatggacgagatggagttcaccgaggctgagagcaacatgaacgacctcgtctctgagtatcagcagtaccaggatgccaccgcagaagaggaggaggatttcggtgaggaggccgaagaggaggcctaaggcagagcccccatcacctcaggcttctcagttcccttagccgtcttactcaactgcccctttcctctccctcagaatttgtgtttgctgcctctatcttgttttttgttttttcttctggggggggtctagaacagtgcctggcacatagtaggcgctcaataaatacttgtttgttgaatgtctcctctctctttccactctgggaaacctaggtttctgccattctgggtgaccctgtatttctttctggtgcccattccatttgtccagttaatacttcctcttaaaaatctccaagaagctgggtctccagatcccatttagaaccaaccaggtgctgaaaacacatgtagataatggccatcatcctaagcccaaagtagaaaatggtagaaggtagtgggtagaagtcactatataaggaaggggatgggattttccattctaaaagttttggagagggaaatccaggctattaaagtcactaaatttctaagtatgtccatttcccatctcagcttcaagggaggtgtcagcagtattatctccactttcaatctccctccaagctctactctggaggagtctgtcccactctgtcaagtggaatccttccctttccaactctacctccctcactcagctcctttcccctgatcagagaaagggatcaagggggttgggaggggggaaagagaccagccttggtccctaagcctccagaaacgtcttcttaatccccaccttttcttactcccaaaaaagaatgaacacccctgactctggagtggtgtatactgccacatcagtgtttgagtcagtccccagaggagaggggaaccctcctccatcttttttgcaacatctcatttcttccttttgctgttgcttcccccctcacacacttggttttgttctatcctacatttgagatttctattttatgttgaacttgctgctttttttcatattgaaaagatgacatcgccccaagagccaaaaataaatgggaattgaaaaaagctg

SEQ ID NO: 196079 - DNA, 2903 bp, Homo sapiens
  Payload ID: 18687
  Gene Name: tubulin, beta class I
  ENST ID: ENST00000396389
  CDS Start-End: 594-1874
tggggcggtgcccagcttgggggaaggagagcggcgcttatcgaagtgtggtcgacctccatccgcccaccgagcacttgggacccgctgcacatatccagagcagggaaagctgtggctttctcgggggagcgagtgtctaggggaagggtgtggcaggcccacgggatgccatgccctagaacaacggcctgagcgcttgtggaattaaaatgggagatgtggggccgaggtgggcgaattgggatccctccaggtcaggggttcgagaccatcctgggcaacaaagcgagaccctcccccatgccacgtttctacaaaaaataaaagtaaaaaattagctgggcgtggtggcgcgcgtctgtggtcccagctactcgagaggctgagatgggaggatcggttgagcctgggagttccacgctgtagtcatccgtgattgcaccactgcactgcaggctgggcaacaggaagaccctgtcttaaaaattagaagaagctgggcgcggtggctcacccttgtaatcccagcactttgggaggccaaggtgggcggatcacgaggtcaagagatctagaccatcctggccaacatgttctgggaggtgatcagtgatgaacatggcatcgaccccaccggcacctaccacggggacagcgacctgcagctggaccgcatctctgtgtactacaatgaagccacaggtggcaaatatgttcctcgtgccatcctggtggatctagaacctgggaccatggactctgttcgctcaggtccttttggccagatctttagaccagacaactttgtatttggtcagtctggggcaggtaacaactgggccaaaggccactacacagagggcgccgagctggttgattctgtcctggatgtggtacggaaggaggcagagagctgtgactgcctgcagggcttccagctgacccactcactgggcgggggcacaggctctggaatgggcactctccttatcagcaagatccgagaagaataccctgatcgcatcatgaataccttcagtgtggtgccttcacccaaagtgtctgacaccgtggtcgagccctacaatgccaccctctccgtccatcagttggtagagaatactgatgagacctattgcattgacaacgaggccctctatgatatctgcttccgcactctgaagctgaccacaccaacctacggggatctgaaccaccttgtctcagccaccatgagtggtgtcaccacctgcctccgtttccctggccagctcaatgctgacctccgcaagttggcagtcaacatggtccccttcccacgtctccatttctttatgcctggctttgcccctctcaccagccgtggaagccagcagtatcgagctctcacagtgccggaactcacccagcaggtcttcgatgccaagaacatgatggctgcctgtgacccccgccacggccgatacctcaccgtggctgctgtcttccgtggtcggatgtccatgaaggaggtcgatgagcagatgcttaacgtgcagaacaagaacagcagctactttgtggaatggatccccaacaatgtcaagacagccgtctgtgacatcccacctcgtggcctcaagatggcagtcaccttcattggcaatagcacagccatccaggagctcttcaagcgcatctcggagcagttcactgccatgttccgccggaaggccttcctccactggtacacaggcgagggcatggacgagatggagttcaccgaggctgagagcaacatgaacgacctcgtctctgagtatcagcagtaccaggatgccaccgcagaagaggaggaggatttcggtgaggaggccgaagaggaggcctaaggcagagcccccatcacctcaggcttctcagttcccttagccgtcttactcaactgcccctttcctctccctcagaatttgtgtttgctgcctctatcttgttttttgttttttcttctggggggggtctagaacagtgcctggcacatagtaggcgctcaataaatacttgtttgttgaatgtctcctctctctttccactctgggaaacctaggtttctgccattctgggtgaccctgtatttctttctggtgcccattccatttgtccagttaatacttcctcttaaaaatctccaagaagctgggtctccagatcccatttagaaccaaccaggtgctgaaaacacatgtagataatggccatcatcctaagcccaaagtagaaaatggtagaaggtagtgggtagaagtcactatataaggaaggggatgggattttccattctaaaagttttggagagggaaatccaggctattaaagtcactaaatttctaagtatgtccatttcccatctcagcttcaagggaggtgtcagcagtattatctccactttcaatctccctccaagctctactctggaggagtctgtcccactctgtcaagtggaatccttccctttccaactctacctccctcactcagctcctttcccctgatcagagaaagggatcaagggggttgggaggggggaaagagaccagccttggtccctaagcctccagaaacgtcttcttaatccccaccttttcttactcccaaaaaagaatgaacacccctgactctggagtggtgtatactgccacatcagtgtttgagtcagtccccagaggagaggggaaccctcctccatcttttttgcaacatctcatttcttccttttgctgttgcttcccccctcacacacttggttttgttctatcctacatttgagatttctattttatgttgaacttgctgctttttttcatattgaaaagatgacatcgccccaagagccaaaaataaatgggaattgaaaaaagctg

SEQ ID NO: 196080 - DNA, 2824 bp, Homo sapiens
  Payload ID: 18687
  Gene Name: tubulin, beta class I
  ENST ID: ENST00000400530
  CDS Start-End: 676-1794
ggcgcttatcgaagtgtggtcgacctccatccgcccaccgagcacttgggacccgctgcacatatccagagcagggaaagctgtggctttctcgggggagcgagtgtctaggggaagggtgtggcaggcccacgggatgccatgccctagaacaacggcctgagcgcttgtggaattaaaatgggagatgtggggccgaggtgggcgaattgggatccctccaggtcaggggttcgagaccatcctgggcaacaaagcgagaccctcccccatgccacgtttctacaaaaaataaaagtaaaaaattagctgggcgtggtggcgcgcgtctgtggtcccagctactcgagaggctgagatgggaggatcggttgagcctgggagttccacgctgtagtcatccgtgattgcaccactgcactgcaggctgggcaacaggaagaccctgtcttaaaaattagaagaagctgggcgcggtggctcacccttgtaatcccagcactttgggaggccaagttctgggaggtgatcagtgatgaacatggcatcgaccccaccggcacctaccacggggacagcgacctgcagctggaccgcatctctgtgtactacaatgaagccacaggtggcaaatatgttcctcgtgccatcctggtggatctagaacctgggaccatggactctgttcgctcaggtccttttggccagatctttagaccagacaactttgtatttggtcagtctggggcaggtaacaactgggccaaaggccactacacagagggcgccgagctggttgattctgtcctggatgtggtacggaaggaggcagagagctgtgactgcctgcagggcttccagctgacccactcactgggcgggggcacaggctctggaatgggcactctccttatcagcaagatccgagaagaataccctgatcgcatcatgaataccttcagtgtggtgccttcacccaaagtgtctgacaccgtggtcgagccctacaatgccaccctctccgtccatcagttggtagagaatactgatgagacctattgcattgacaacgaggccctctatgatatctgcttccgcactctgaagctgaccacaccaacctacggggatctgaaccaccttgtctcagccaccatgagtggtgtcaccacctgcctccgtttccctggccagctcaatgctgacctccgcaagttggcagtcaacatggtccccttcccacgtctccatttctttatgcctggctttgcccctctcaccagccgtggaagccagcagtatcgagctctcacagtgccggaactcacccagcaggtcttcgatgccaagaacatgatggctgcctgtgacccccgccacggccgatacctcaccgtggctgctgtcttccgtggtcggatgtccatgaaggaggtcgatgagcagatgcttaacgtgcagaacaagaacagcagctactttgtggaatggatccccaacaatgtcaagacagccgtctgtgacatcccacctcgtggcctcaagatggcagtcaccttcattggcaatagcacagccatccaggagctcttcaagcgcatctcggagcagttcactgccatgttccgccggaaggccttcctccactggtacacaggcgagggcatggacgagatggagttcaccgaggctgagagcaacatgaacgacctcgtctctgagtatcagcagtaccaggatgccaccgcagaagaggaggaggatttcggtgaggaggccgaagaggaggcctaaggcagagcccccatcacctcaggcttctcagttcccttagccgtcttactcaactgcccctttcctctccctcagaatttgtgtttgctgcctctatcttgttttttgttttttcttctgggggggggtctagaacagtgcctggcacatagtaggcgctcaataaatacttgtttgttgaatgtctcctctctctttccactctgggaaacctaggtttctgccattctgggtgaccctgtatttctttctggtgcccattccatttgtccagttaatacttcctcttaaaaatctccaagaagctgggtctccagatcccatttagaaccaaccaggtgctgaaaacacatgtagataatggccatcatcctaagcccaaagtagaaaatggtagaaggtagtgggtagaagtcactatataaggaaggggatgggattttccattctaaaagttttggagagggaaatccaggctattaaagtcactaaatttctaagtatgtccatttcccatctcagcttcaagggaggtgtcagcagtattatctccactttcaatctccctccaagctctactctggaggagtctgtcccactctgtcaagtggaatccttccctttccaactctacctccctcactcagctcctttcccctgatcagagaaagggatcaagggggttgggaggggggaaagagaccagccttggtccctaagcctccagaaacgtcttcttaatccccaccttttcttactcccaaaaaagaatgaacacccctgactctggagtggtgtatactgccacatcagtgtttgagtcagtccccagaggagaggggaaccctcctccatcttttttgcaacatctcatttcttccttttgctgttgcttcccccctcacacacttggttttgttctatcctacatttgagatttctattttatgttgaacttgctgctttttttcatattgaaaagatgacatcgccccaagagccaaaaataaatgggaattgaaaaaagctg

SEQ ID NO: 196081 - DNA, 2633 bp, Homo sapiens
  Payload ID: 18687
  Gene Name: tubulin, beta class I
  ENST ID: ENST00000400531
  CDS Start-End: 485-1603
cgcgtgcgccgcagtcacgtggagggcggggggggtggtcgactgcggcggcagctctttcctcagacccccagccttttgtgcgccgcgcggtggggcggtgcccagcttgggggaaggagagcggcgcttatcgaagtgtggtcgacctccatccgcccaccgagcacttgggacccgctgcacatatccagagcagggaaagctgtggctttctcgggggagcgagtgtctaggggaagggtgtggcaggcccacgggatgccatgccctagaacaacggcctgagcgcttgtggaattaaaatgggagatgtggggccgagttctgggaggtgatcagtgatgaacatggcatcgaccccaccggcacctaccacggggacagcgacctgcagctggaccgcatctctgtgtactacaatgaagccacaggtggcaaatatgttcctcgtgccatcctggtggatctagaacctgggaccatggactctgttcgctcaggtccttttggccagatctttagaccagacaactttgtatttggtcagtctggggcaggtaacaactgggccaaaggccactacacagagggcgccgagctggttgattctgtcctggatgtggtacggaaggaggcagagagctgtgactgcctgcagggcttccagctgacccactcactgggcgggggcacaggctctggaatgggcactctccttatcagcaagatccgagaagaataccctgatcgcatcatgaataccttcagtgtggtgccttcacccaaagtgtctgacaccgtggtcgagccctacaatgccaccctctccgtccatcagttggtagagaatactgatgagacctattgcattgacaacgaggccctctatgatatctgcttccgcactctgaagctgaccacaccaacctacggggatctgaaccaccttgtctcagccaccatgagtggtgtcaccacctgcctccgtttccctggccagctcaatgctgacctccgcaagttggcagtcaacatggtccccttcccacgtctccatttctttatgcctggctttgcccctctcaccagccgtggaagccagcagtatcgagctctcacagtgccggaactcacccagcaggtcttcgatgccaagaacatgatggctgcctgtgacccccgccacggccgatacctcaccgtggctgctgtcttccgtggtcggatgtccatgaaggaggtcgatgagcagatgcttaacgtgcagaacaagaacagcagctactttgtggaatggatccccaacaatgtcaagacagccgtctgtgacatcccacctcgtggcctcaagatggcagtcaccttcattggcaatagcacagccatccaggagctcttcaagcgcatctcggagcagttcactgccatgttccgccggaaggccttcctccactggtacacaggcgagggcatggacgagatggagttcaccgaggctgagagcaacatgaacgacctcgtctctgagtatcagcagtaccaggatgccaccgcagaagaggaggaggatttcggtgaggaggccgaagaggaggcctaaggcagagcccccatcacctcaggcttctcagttcccttagccgtcttactcaactgcccctttcctctccctcagaatttgtgtttgctgcctctatcttgttttttgttttttcttctgggggggggtctagaacagtgcctggcacatagtaggcgctcaataaatacttgtttgttgaatgtctcctctctctttccactctgggaaacctaggtttctgccattctgggtgaccctgtatttctttctggtgcccattccatttgtccagttaatacttcctcttaaaaatctccaagaagctgggtctccagatcccatttagaaccaaccaggtgctgaaaacacatgtagataatggccatcatcctaagcccaaagtagaaaatggtagaaggtagtgggtagaagtcactatataaggaaggggatgggattttccattctaaaagttttggagagggaaatccaggctattaaagtcactaaatttctaagtatgtccatttcccatctcagcttcaagggaggtgtcagcagtattatctccactttcaatctccctccaagctctactctggaggagtctgtcccactctgtcaagtggaatccttccctttccaactctacctccctcactcagctcctttcccctgatcagagaaagggatcaagggggttgggaggggggaaagagaccagccttggtccctaagcctccagaaacgtcttcttaatccccaccttttcttactcccaaaaaagaatgaacacccctgactctggagtggtgtatactgccacatcagtgtttgagtcagtccccagaggagaggggaaccctcctccatcttttttgcaacatctcatttcttccttttgctgttgcttcccccctcacacacttggttttgttctatcctacatttgagatttctattttatgttgaacttgctgctttttttcatattgaaaagatgacatcgccccaagagccaaaaataaatgggaattgaaaaaagctg

SEQ ID NO: 196082 - DNA, 2904 bp, Homo sapiens
  Payload ID: 18687
  Gene Name: tubulin, beta class I
  ENST ID: ENST00000400534
  CDS Start-End: 594-1874
tggggcggtgcccagcttgggggaaggagagcggcgcttatcgaagtgtggtcgacctccatccgcccaccgagcacttgggacccgctgcacatatccagagcagggaaagctgtggctttctcgggggagcgagtgtctaggggaagggtgtggcaggcccacgggatgccatgccctagaacaacggcctgagcgcttgtggaattaaaatgggagatgtggggccgaggtgggcgaattgggatccctccaggtcaggggttcgagaccatcctgggcaacaaagcgagaccctcccccatgccacgtttctacaaaaaataaaagtaaaaaattagctgggcgtggtggcgcgcgtctgtggtcccagctactcgagaggctgagatgggaggatcggttgagcctgggagttccacgctgtagtcatccgtgattgcaccactgcactgcaggctgggcaacaggaagaccctgtcttaaaaattagaagaagctgggcgcggtggctcacccttgtaatcccagcactttgggaggccaaggtgggcggatcacgaggtcaagagatctagaccatcctggccaacatgttctgggaggtgatcagtgatgaacatggcatcgaccccaccggcacctaccacggggacagcgacctgcagctggaccgcatctctgtgtactacaatgaagccacaggtggcaaatatgttcctcgtgccatcctggtggatctagaacctgggaccatggactctgttcgctcaggtccttttggccagatctttagaccagacaactttgtatttggtcagtctggggcaggtaacaactgggccaaaggccactacacagagggcgccgagctggttgattctgtcctggatgtggtacggaaggaggcagagagctgtgactgcctgcagggcttccagctgacccactcactgggcgggggcacaggctctggaatgggcactctccttatcagcaagatccgagaagaataccctgatcgcatcatgaataccttcagtgtggtgccttcacccaaagtgtctgacaccgtggtcgagccctacaatgccaccctctccgtccatcagttggtagagaatactgatgagacctattgcattgacaacgaggccctctatgatatctgcttccgcactctgaagctgaccacaccaacctacggggatctgaaccaccttgtctcagccaccatgagtggtgtcaccacctgcctccgtttccctggccagctcaatgctgacctccgcaagttggcagtcaacatggtccccttcccacgtctccatttctttatgcctggctttgcccctctcaccagccgtggaagccagcagtatcgagctctcacagtgccggaactcacccagcaggtcttcgatgccaagaacatgatggctgcctgtgacccccgccacggccgatacctcaccgtggctgctgtcttccgtggtcggatgtccatgaaggaggtcgatgagcagatgcttaacgtgcagaacaagaacagcagctactttgtggaatggatccccaacaatgtcaagacagccgtctgtgacatcccacctcgtggcctcaagatggcagtcaccttcattggcaatagcacagccatccaggagctcttcaagcgcatctcggagcagttcactgccatgttccgccggaaggccttcctccactggtacacaggcgagggcatggacgagatggagttcaccgaggctgagagcaacatgaacgacctcgtctctgagtatcagcagtaccaggatgccaccgcagaagaggaggaggatttcggtgaggaggccgaagaggaggcctaaggcagagcccccatcacctcaggcttctcagttcccttagccgtcttactcaactgcccctttcctctccctcagaatttgtgtttgctgcctctatcttgttttttgttttttcttctgggggggggtctagaacagtgcctggcacatagtaggcgctcaataaatacttgtttgttgaatgtctcctctctctttccactctgggaaacctaggtttctgccattctgggtgaccctgtatttctttctggtgcccattccatttgtccagttaatacttcctcttaaaaatctccaagaagctgggtctccagatcccatttagaaccaaccaggtgctgaaaacacatgtagataatggccatcatcctaagcccaaagtagaaaatggtagaaggtagtgggtagaagtcactatataaggaaggggatgggattttccattctaaaagttttggagagggaaatccaggctattaaagtcactaaatttctaagtatgtccatttcccatctcagcttcaagggaggtgtcagcagtattatctccactttcaatctccctccaagctctactctggaggagtctgtcccactctgtcaagtggaatccttccctttccaactctacctccctcactcagctcctttcccctgatcagagaaagggatcaagggggttgggaggggggaaagagaccagccttggtccctaagcctccagaaacgtcttcttaatccccaccttttcttactcccaaaaaagaatgaacacccctgactctggagtggtgtatactgccacatcagtgtttgagtcagtccccagaggagaggggaaccctcctccatcttttttgcaacatctcatttcttccttttgctgttgcttcccccctcacacacttggttttgttctatcctacatttgagatttctattttatgttgaacttgctgctttttttcatattgaaaagatgacatcgccccaagagccaaaaataaatgggaattgaaaaaagctg

SEQ ID NO: 196083 - DNA, 2632 bp, Homo sapiens; identical to SEQ ID NO: 196076
  Payload ID: 18687
  Gene Name: tubulin, beta class I
  ENST ID: ENST00000437490
  CDS Start-End: 485-1603

SEQ ID NO: 196084 - DNA, 2823 bp, Homo sapiens; identical to SEQ ID NO: 196078
  Payload ID: 18687
  Gene Name: tubulin, beta class I
  ENST ID: ENST00000420618
  CDS Start-End: 676-1794

SEQ ID NO: 196085 - DNA, 2823 bp, Homo sapiens; identical to SEQ ID NO: 196078
  Payload ID: 18687
  Gene Name: tubulin, beta class I
  ENST ID: ENST00000444441
  CDS Start-End: 676-1794

SEQ ID NO: 196086 - DNA, 2823 bp, Homo sapiens; identical to SEQ ID NO: 196078
  Payload ID: 18687
  Gene Name: tubulin, beta class I
  ENST ID: ENST00000454620
  CDS Start-End: 676-1794

SEQ ID NO: 196087 - DNA, 2823 bp, Homo sapiens; identical to SEQ ID NO: 196078
  Payload ID: 18687
  Gene Name: tubulin, beta class I
  ENST ID: ENST00000425102
  CDS Start-End: 676-1794

SEQ ID NO: 196088 - DNA, 2823 bp, Homo sapiens; identical to SEQ ID NO: 196078
  Payload ID: 18687
  Gene Name: tubulin, beta class I
  ENST ID: ENST00000446385
  CDS Start-End: 676-1794

SEQ ID NO: 196089 - DNA, 2632 bp, Homo sapiens
  Payload ID: 18687
  Gene Name: tubulin, beta class I
  ENST ID: ENST00000435546
  CDS Start-End: 485-1603
cgcgtgcgccgcagtcacgtggagggcggggggggtggtcgactgcggcggcagctctttcctcagacccccagccttttgtgcgccgcgcggtggggcggtgcccagcttgggggaaggagagcggcgcttatcgaagtgtggtcgacctccatccgcccaccgagcacttgggacccgctgcacatatccagagcagggaaagctgtggctttctcgggggagcgagtgtctaggggaagggtgtggcaggcccacgggatgccatgccctagaacaacggcctgagcgcttgtggaattaaaatgggagatgtggggccgagttctgggaggtgatcagtgatgaacatggcatcgaccccaccggcacctaccacggggacagcgacctgcagctggaccgcatctctgtgtactacaatgaagccacaggtggcaaatatgttcctcgtgccatcctggtggatctagaacctgggaccatggactctgttcgctcaggtccttttggccagatctttagaccagacaactttgtatttggtcagtctggggcaggtaacaactgggccaaaggccactacacagagggcgccgagctggttgattctgtcctggatgtggtacggaaggaggcagagagctgtgactgcctgcagggcttccagctgacccactcactgggcgggggcacaggctctggaatgggcactctccttatcagcaagatccgagaagaataccctgatcgcatcatgaataccttcagtgtggtgccttcacccaaagtgtctgacaccgtggtcgagccctacaatgccaccctctccgtccatcagttggtagagaatactgatgagacctattgcattgacaacgaggccctctatgatatctgcttccgcactctgaagctgaccacaccaacctacggggatctgaaccaccttgtctcagccaccatgagtggtgtcaccacctgcctccgtttccctggccagctcaatgctgacctccgcaagttggcagtcaacatggtccccttcccacgtctccatttctttatgcctggctttgcccctctcaccagccgtggaagccagcagtatcgagctctcacagtgccggaactcacccagcaggtcttcgatgccaagaacatgatggctgcctgtgacccccgccacggccgatacctcaccgtggctgctgtcttccgtggtcggatgtccatgaaggaggtcgatgagcagatgcttaacgtgcagaacaagaacagcagctactttgtggaatggatccccaacaatgtcaagacagccgtctgtgacatcccacctcgtggcctcaagatggcagtcaccttcattggcaatagcacagccatccaggagctcttcaagcgcatctcggagcagttcactgccatgttccgccggaaggccttcctccactggtacacaggcgagggcatggacgagatggagttcaccgaggctgagagcaacatgaacgacctcgtctctgagtatcagcagtaccaggatgccaccgcagaagaggaggaggatttcggtgaggaggccgaagaggaggcctaaggcagagcccccatcacctcaggcttctcagttcccttagccgtcttactcaactgcccctttcctctccctcagaatttgtgtttgctgcctctatcttgttttttgttttttcttctggggggggtctagaacagtgcctggcacatagtaggcgctcaataaatacttgtttgttgaatgtctcctctctctttccactctgggaaacctaggtttctgccattctgggtgaccctgtatttctttctggtgcccattccatttgtccagttaatacttcctcttaaaaatctccaagaagctgggtctccagatcccatttagaaccaaccaggtgctgaaaacacatgtagataatggccatcatcctaagcccaaagtagaaaatggtagaaggtagtgggtagaagtcactatataaggaaggggatgggattttccattctaaaagttttggagagggaaatccaggctattaaagtcactaaatttctaagtatgtccatttcccatctcagcttcaagggaggtgtcagcagtattatctccactttcaatctccctccaagctctactctggaggagtctgtcccactctgtcaagtggaatccttccctttccaactctacctccctcactcagctcctttcccctgatcagagaaagggatcaagggggttgggaggggggaaagagaccagccttggtccctaagcctccagaaacgtcttcttaatccccaccttttcttactcccaaaaaagaatgaacacccctgactctggaatggtgtatactgccacatcagtgtttgagtcagtccccagaggagaggggaaccctcctccatcttttttgcaacatctcatttcttccttttgctgttgcttcccccctcacacacttggttttgttctatcctacatttgagatttctattttgtgttgaacttgctgctttttttcatattgaaaagatgacatcgccccaagagccaaaaataaatgggaattgaaaaaagctg

SEQ ID NO: 196090 - DNA, 2670 bp, Homo sapiens; identical to SEQ ID NO: 196075
  Payload ID: 18687
  Gene Name: tubulin, beta class I
  Uniprot ID: P07437
  ENST ID: ENST00000421473
  CDS Start-End: 307-1641

SEQ ID NO: 196091 - DNA, 2903 bp, Homo sapiens; identical to SEQ ID NO: 196079
  Payload ID: 18687
  Gene Name: tubulin, beta class I
  ENST ID: ENST00000426754
  CDS Start-End: 594-1874

SEQ ID NO: 196092 - DNA, 2903 bp, Homo sapiens; identical to SEQ ID NO: 196079
  Payload ID: 18687
  Gene Name: tubulin, beta class I
  ENST ID: ENST00000412136
  CDS Start-End: 594-1874

SEQ ID NO: 196093 - DNA, 2670 bp, Homo sapiens; identical to SEQ ID NO: 196075
  Payload ID: 18687
  Gene Name: tubulin, beta class I
  Uniprot ID: P07437
  ENST ID: ENST00000422650
  CDS Start-End: 307-1641

SEQ ID NO: 196094 - DNA, 2670 bp, Homo sapiens; identical to SEQ ID NO: 196075
  Payload ID: 18687
  Gene Name: tubulin, beta class I
  Uniprot ID: P07437
  ENST ID: ENST00000419792
  CDS Start-End: 307-1641

SEQ ID NO: 196095 - DNA, 2903 bp, Homo sapiens; identical to SEQ ID NO: 196079
  Payload ID: 18687
  Gene Name: tubulin, beta class I
  ENST ID: ENST00000419551
  CDS Start-End: 594-1874

SEQ ID NO: 196096 - DNA, 2632 bp, Homo sapiens; identical to SEQ ID NO: 196076
  Payload ID: 18687
  Gene Name: tubulin, beta class I
  ENST ID: ENST00000454454
  CDS Start-End: 485-1603

SEQ ID NO: 196097 - DNA, 2903 bp, Homo sapiens; identical to SEQ ID NO: 196079
  Payload ID: 18687
  Gene Name: tubulin, beta class I
  ENST ID: ENST00000425136
  CDS Start-End: 594-1874

SEQ ID NO: 196098 - DNA, 2670 bp, Homo sapiens
  Payload ID: 18687
  Gene Name: tubulin, beta class I
  Uniprot ID: P07437
  ENST ID: ENST00000422674
  CDS Start-End: 307-1641
gtacatgaccggcatcgactaatcagggccaggctcgatgaggctttgtctccctaccgcgcgcggggccgattctcccgcctcccagccccggcgcacgcgcgccccgcccagcctgctttccctccgcgccctcccctctcctttctccctctcagaaccttcctgccgtcgcgtttgcacctcgctgctccagcctctggggcgcattccaaccttccagcctgcgacctgcggagaaaaaaaattacttattttcttgccccatacataccttgaggcgagcaaaaaaattaaattttaaccatgagggaaatcgtgcacatccaggctggtcagtgtggcaaccagatcggtgccaagttctgggaggtgatcagtgatgaacatggcatcgaccccaccggcacctaccacggggacagcgacctgcagctggaccgcatctctgtgtactacaatgaagccacaggtggcaaatatgttcctcgtgccatcctggtggatctagaacctgggaccatggactctgttcgctcaggtccttttggccagatctttagaccagacaactttgtatttggtcagtctggggcaggtaacaactgggccaaaggccactacacagagggcgccgagctggttgattctgtcctggatgtggtacggaaggaggcagagagctgtgactgcctgcagggcttccagctgacccactcactgggcgggggcacaggctctggaatgggcactctccttatcagcaagatccgagaagaataccctgatcgcatcatgaataccttcagtgtggtgccttcacccaaagtgtctgacaccgtggtcgagccctacaatgccaccctctccgtccatcagttggtagagaatactgatgagacctattgcattgacaacgaggccctctatgatatctgcttccgcactctgaagctgaccacaccaacctacggggatctgaaccaccttgtctcagccaccatgagtggtgtcaccacctgcctccgtttccctggccagctcaatgctgacctccgcaagttggcagtcaacatggtccccttcccacgtctccatttctttatgcctggctttgcccctctcaccagccgtggaagccagcagtatcgagctctcacagtgccggaactcacccagcaggtcttcgatgccaagaacatgatggctgcctgtgacccccgccacggccgatacctcaccgtggctgctgtcttccgtggtcggatgtccatgaaggaggtcgatgagcagatgcttaacgtgcagaacaagaacagcagctactttgtggaatggatccccaacaatgtcaagacagccgtctgtgacatcccacctcgtggcctcaagatggcagtcaccttcattggcaatagcacagccatccaggagctcttcaagcgcatctcggagcagttcactgccatgttccgccggaaggccttcctccactggtacacaggcgagggcatggacgagatggagttcaccgaggctgagagcaacatgaacgacctcgtctctgagtatcagcagtaccaggatgccaccgcagaagaggaggaggatttcggtgaggaggccgaagaggaggcctaaggcagagcccccatcacctcaggcttctcagttcccttagccgtcttactcaactgcccctttcctctccctcagaatttgtgtttgctgcctctatcttgttttttgttttttcttctggggggggtctagaacagtgcctggcacatagtaggcgctcaataaatacttgtttgttgaatgtctcctctctctttccactctgggaaacctaggtttctgccattctgggtgaccctgtatttctttctggtgcccattccatttgtccagttaatacttcctcttaaaaatctccaagaagctgggtctccagatcccatttagaaccaaccaggtgctgaaaacacatgtagataatggccatcatcctaagcccaaagtagaaaatggtagaaggtagtgggtagaagtcactatataaggaaggggatgggattttccattctaaaagttttggagagggaaatccaggctattaaagtcactaaatttctaagtatgtccatttcccatctcagcttcaagggaggtgtcagcagtattatctccactttcaatctccctccaagctctactctggaggagtctgtcccactctgtcaagtggaatccttccctttccaactctacctccctcactcagctcctttcccctgatcagagaaagggatcaagggggttgggaggggggaaagagaccagccttggtccctaagcctccagaaacgtcttcttaatccccaccttttcttactcccaaaaaagaatgaacacccctgactctggaatggtgtatactgccacatcagtgtttgagtcagtccccagaggagaggggaaccctcctccatcttttttgcaacatctcatttcttccttttgctgttgcttcccccctcacacacttggttttgttctatcctacatttgagatttctattttgtgttgaacttgctgctttttttcatattgaaaagatgacatcgccccaagagccaaaaataaatgggaattgaaaaaagctg

SEQ ID NO: 196099 - DNA, 2823 bp, Homo sapiens
  Payload ID: 18687
  Gene Name: tubulin, beta class I
  ENST ID: ENST00000453350
  CDS Start-End: 676-1794
ggcgcttatcgaagtgtggtcgacctccatccgcccaccgagcacttgggacccgctgcacatatccagagcagggaaagctgtggctttctcgggggagcgagtgtctaggggaagggtgtggcaggcccacgggatgccatgccctagaacaacggcctgagcgcttgtggaattaaaatgggagatgtggggccgaggtgggcgaattgggatccctccaggtcaggggttcgagaccatcctgggcaacaaagcgagaccctcccccatgccacgtttctacaaaaaataaaagtaaaaaattagctgggcgtggtggcgcgcgtctgtggtcccagctactcgagaggctgagatgggaggatcggttgagcctgggagttccacgctgtagtcatccgtgattgcaccactgcactgcaggctgggcaacaggaagaccctgtcttaaaaattagaagaagctgggcgcggtggctcacccttgtaatcccagcactttgggaggccaagttctgggaggtgatcagtgatgaacatggcatcgaccccaccggcacctaccacggggacagcgacctgcagctggaccgcatctctgtgtactacaatgaagccacaggtggcaaatatgttcctcgtgccatcctggtggatctagaacctgggaccatggactctgttcgctcaggtccttttggccagatctttagaccagacaactttgtatttggtcagtctggggcaggtaacaactgggccaaaggccactacacagagggcgccgagctggttgattctgtcctggatgtggtacggaaggaggcagagagctgtgactgcctgcagggcttccagctgacccactcactgggcgggggcacaggctctggaatgggcactctccttatcagcaagatccgagaagaataccctgatcgcatcatgaataccttcagtgtggtgccttcacccaaagtgtctgacaccgtggtcgagccctacaatgccaccctctccgtccatcagttggtagagaatactgatgagacctattgcattgacaacgaggccctctatgatatctgcttccgcactctgaagctgaccacaccaacctacggggatctgaaccaccttgtctcagccaccatgagtggtgtcaccacctgcctccgtttccctggccagctcaatgctgacctccgcaagttggcagtcaacatggtccccttcccacgtctccatttctttatgcctggctttgcccctctcaccagccgtggaagccagcagtatcgagctctcacagtgccggaactcacccagcaggtcttcgatgccaagaacatgatggctgcctgtgacccccgccacggccgatacctcaccgtggctgctgtcttccgtggtcggatgtccatgaaggaggtcgatgagcagatgcttaacgtgcagaacaagaacagcagctactttgtggaatggatccccaacaatgtcaagacagccgtctgtgacatcccacctcgtggcctcaagatggcagtcaccttcattggcaatagcacagccatccaggagctcttcaagcgcatctcggagcagttcactgccatgttccgccggaaggccttcctccactggtacacaggcgagggcatggacgagatggagttcaccgaggctgagagcaacatgaacgacctcgtctctgagtatcagcagtaccaggatgccaccgcagaagaggaggaggatttcggtgaggaggccgaagaggaggcctaaggcagagcccccatcacctcaggcttctcagttcccttagccgtcttactcaactgcccctttcctctccctcagaatttgtgtttgctgcctctatcttgttttttgttttttcttctggggggggtctagaacagtgcctggcacatagtaggcgctcaataaatacttgtttgttgaatgtctcctctctctttccactctgggaaacctaggtttctgccattctgggtgaccctgtatttctttctggtgcccattccatttgtccagttaatacttcctcttaaaaatctccaagaagctgggtctccagatcccatttagaaccaaccaggtgctgaaaacacatgtagataatggccatcatcctaagcccaaagtagaaaatggtagaaggtagtgggtagaagtcactatataaggaaggggatgggattttccattctaaaagttttggagagggaaatccaggctattaaagtcactaaatttctaagtatgtccatttcccatctcagcttcaagggaggtgtcagcagtattatctccactttcaatctccctccaagctctactctggaggagtctgtcccactctgtcaagtggaatccttccctttccaactctacctccctcactcagctcctttcccctgatcagagaaagggatcaagggggttgggaggggggaaagagaccagccttggtccctaagcctccagaaacgtcttcttaatccccaccttttcttactcccaaaaaagaatgaacacccctgactctggaatggtgtatactgccacatcagtgtttgagtcagtccccagaggagaggggaaccctcctccatcttttttgcaacatctcatttcttccttttgctgttgcttcccccctcacacacttggttttgttctatcctacatttgagatttctattttgtgttgaacttgctgctttttttcatattgaaaagatgacatcgccccaagagccaaaaataaatgggaattgaaaaaagctg

SEQ ID NO: 196100 - DNA, 2632 bp, Homo sapiens; identical to SEQ ID NO: 196076
  Payload ID: 18687
  Gene Name: tubulin, beta class I
  ENST ID: ENST00000427480
  CDS Start-End: 485-1603

SEQ ID NO: 196101 - DNA, 2903 bp, Homo sapiens
  Payload ID: 18687
  Gene Name: tubulin, beta class I
  ENST ID: ENST00000420400
  CDS Start-End: 594-1874
tggggcggtgcccagcttgggggaaggagagcggcgcttatcgaagtgtggtcgacctccatccgcccaccgagcacttgggacccgctgcacatatccagagcagggaaagctgtggctttctcgggggagcgagtgtctaggggaagggtgtggcaggcccacgggatgccatgccctagaacaacggcctgagcgcttgtggaattaaaatgggagatgtggggccgaggtgggcgaattgggatccctccaggtcaggggttcgagaccatcctgggcaacaaagcgagaccctcccccatgccacgtttctacaaaaaataaaagtaaaaaattagctgggcgtggtggcgcgcgtctgtggtcccagctactcgagaggctgagatgggaggatcggttgagcctgggagttccacgctgtagtcatccgtgattgcaccactgcactgcaggctgggcaacaggaagaccctgtcttaaaaattagaagaagctgggcgcggtggctcacccttgtaatcccagcactttgggaggccaaggtgggcggatcacgaggtcaagagatctagaccatcctggccaacatgttctgggaggtgatcagtgatgaacatggcatcgaccccaccggcacctaccacggggacagcgacctgcagctggaccgcatctctgtgtactacaatgaagccacaggtggcaaatatgttcctcgtgccatcctggtggatctagaacctgggaccatggactctgttcgctcaggtccttttggccagatctttagaccagacaactttgtatttggtcagtctggggcaggtaacaactgggccaaaggccactacacagagggcgccgagctggttgattctgtcctggatgtggtacggaaggaggcagagagctgtgactgcctgcagggcttccagctgacccactcactgggcgggggcacaggctctggaatgggcactctccttatcagcaagatccgagaagaataccctgatcgcatcatgaataccttcagtgtggtgccttcacccaaagtgtctgacaccgtggtcgagccctacaatgccaccctctccgtccatcagttggtagagaatactgatgagacctattgcattgacaacgaggccctctatgatatctgcttccgcactctgaagctgaccacaccaacctacggggatctgaaccaccttgtctcagccaccatgagtggtgtcaccacctgcctccgtttccctggccagctcaatgctgacctccgcaagttggcagtcaacatggtccccttcccacgtctccatttctttatgcctggctttgcccctctcaccagccgtggaagccagcagtatcgagctctcacagtgccggaactcacccagcaggtcttcgatgccaagaacatgatggctgcctgtgacccccgccacggccgatacctcaccgtggctgctgtcttccgtggtcggatgtccatgaaggaggtcgatgagcagatgcttaacgtgcagaacaagaacagcagctactttgtggaatggatccccaacaatgtcaagacagccgtctgtgacatcccacctcgtggcctcaagatggcagtcaccttcattggcaatagcacagccatccaggagctcttcaagcgcatctcggagcagttcactgccatgttccgccggaaggccttcctccactggtacacaggcgagggcatggacgagatggagttcaccgaggctgagagcaacatgaacgacctcgtctctgagtatcagcagtaccaggatgccaccgcagaagaggaggaggatttcggtgaggaggccgaagaggaggcctaaggcagagcccccatcacctcaggcttctcagttcccttagccgtcttactcaactgcccctttcctctccctcagaatttgtgtttgctgcctctatcttgttttttgttttttcttctggggggggtctagaacagtgcctggcacatagtaggcgctcaataaatacttgtttgttgaatgtctcctctctctttccactctgggaaacctaggtttctgccattctgggtgaccctgtatttctttctggtgcccattccatttgtccagttaatacttcctcttaaaaatctccaagaagctgggtctccagatcccatttagaaccaaccaggtgctgaaaacacatgtagataatggccatcatcctaagcccaaagtagaaaatggtagaaggtagtgggtagaagtcactatataaggaaggggatgggattttccattctaaaagttttggagagggaaatccaggctattaaagtcactaaatttctaagtatgtccatttcccatctcagcttcaagggaggtgtcagcagtattatctccactttcaatctccctccaagctctactctggaggagtctgtcccactctgtcaagtggaatccttccctttccaactctacctccctcactcagctcctttcccctgatcagagaaagggatcaagggggttgggaggggggaaagagaccagccttggtccctaagcctccagaaacgtcttcttaatccccaccttttcttactcccaaaaaagaatgaacacccctgactctggaatggtgtatactgccacatcagtgtttgagtcagtccccagaggagaggggaaccctcctccatcttttttgcaacatctcatttcttccttttgctgttgcttcccccctcacacacttggttttgttctatcctacatttgagatttctattttgtgttgaacttgctgctttttttcatattgaaaagatgacatcgccccaagagccaaaaataaatgggaattgaaaaaagctg

SEQ ID NO: 196102 - DNA, 2670 bp, Homo sapiens; identical to SEQ ID NO: 196075
  Payload ID: 18687
  Gene Name: tubulin, beta class I
  Uniprot ID: P07437
  ENST ID: ENST00000436628
  CDS Start-End: 307-1641

SEQ ID NO: 196103 - DNA, 2670 bp, Homo sapiens; identical to SEQ ID NO: 196075
  Payload ID: 18687
  Gene Name: tubulin, beta class I
  Uniprot ID: P07437
  ENST ID: ENST00000432462
  CDS Start-End: 307-1641

SEQ ID NO: 196104 - DNA, 2903 bp, Homo sapiens; identical to SEQ ID NO: 196079
  Payload ID: 18687
  Gene Name: tubulin, beta class I
  ENST ID: ENST00000424734
  CDS Start-End: 594-1874

SEQ ID NO: 196105 - DNA, 2632 bp, Homo sapiens; identical to SEQ ID NO: 196076
  Payload ID: 18687
  Gene Name: tubulin, beta class I
  ENST ID: ENST00000413547
  CDS Start-End: 485-1603

SEQ ID NO: 196106 - DNA, 2632 bp, Homo sapiens; identical to SEQ ID NO: 196076
  Payload ID: 18687
  Gene Name: tubulin, beta class I
  ENST ID: ENST00000436335
  CDS Start-End: 485-1603

SEQ ID NO: 196107 - DNA, 2490 bp, Homo sapiens
  Payload ID: 18688
  Gene Name: tubulin, delta 1
  Uniprot ID: Q9UJT1
  ENST ID: ENST00000325752
  CDS Start-End: 289-1650
gcgcattgtcagctggagcgttcggtggacagtgagcatgcgtaccatatctgaagttcgtaaattgaaattgaacatgcgtaattaatctttctgaataggaaaaaatatatacacaacaaaactctccgtttatggaacatgcgcatttgttctcagtaagtttttcgttttgaaagtgagcatgcgcatggtgagtaggttggtccgaagtttgaaccggacagaagcgctggtcggcgtctggcggttgtttttagaggtaatacacctagtttgtggctcagcatgtcaattgtaacagtgcaacttggtcagtgtggcaatcagattggttttgaagtttttgatgctttgcttagtgactcacacagttcccagggactctgctctatgagagagaatgaggcatatcaagcatcttgcaaagaaagattcttcagtgaggaggagaatggagttccaattgcccgggctgttcttgttgacatggaacccaaagttatcaatcaaatgctgtcaaaggctgcccagtctggccaatggaaatatggtcaacatgcatgcttctgtcaaaaacaaggttctggaaacaactgggcatatggttactctgttcatggacccaggcatgaagaatctataatgaacataatccggaaggaagtggagaaatgtgactctttcagtggttttttcatcataatgagtatggctgggggcacaggatcaggattaggagctttcgttacacagaatttagaagatcagtactcaaactcattgaaaatgaatcagattatttggccttatggaactggtgaggttattgttcaaaactacaactccattttgacactttctcacttgtaccgatcttcagacgccctccttcttcatgagaatgatgccatccataagatctgtgcaaaactgatgaatatcaagcagatctcctttagtgatatcaatcaagtcctcgcacatcagctgggaagtgtgttccagcctacttattctgcagaaagctcatttcactacagacgaaatccactaggagacttaatggagcatttagttccccatcctgaattcaagatgctgagtgttcgtaacattcctcacatgtctgagaattcattggcatacaccacatttacttgggctggcctcctcaagcatttgagacagatgctcatttctaatgcaaagatggaagaaggtattgataggcatgtatggcctcctttatcaggacttcctcctcttagtaaaatgtctctcaacaaggacctgcattttaacacttccattgctaacttggtcattcttcgtgggaaagatgtgcaaagtgcagatgtggagggatttaaagatccagctctgtatacttcctggttgaagcctgttaatgctttcaacgtgtggaaaacccagcgggcctttagcaaatatgagaagtctgcagtgttggtcagcaacagccagttcttagtaaaaccacttgatatgattgttgggaaggcatggaatatgtttgcttcaaaagcctacattcatcagtacacaaaatttggaatcgaagaagaggactttttagacagtttcacgtcattagagcaggttgttgccagttactgtaatctctgatcttgaacaatgggaaaagtataccttaaggcatttctggactaaaatattttcaatactattttctctgtaaagttttcaaagttctccatcctggctaacacggtgaaacaccgtctctaccagaaaatacaaaaaattagccaggcgcggtggcgggtgcctgtagtcccagctactcgggaggctgaggcaggagaatgacgtgaacccaggaggcggagcttgcagtgagccgagatcgcgccactgcactccagcctgggcgacagagcgagactccgtctcaaaaaaaaaaaaaaaaaaaaatgttttcaaagttccattctgttaaagtaaccacgtagaatgctgagtctattctgcatactatgcccacagaaaaggaagaaaactttttaaaatggagaatcgcatgttttcaatgaaaacattcacttggtatttcatttgtaagaaaaaaaaatggtgcttttataaagaactttggggaaacactttgctgaaatgttgggactctggaactagccaagaaaagagaatattctctttgtctacatgttcctaaatctttactccaaaacaactccaaaaacaactcacaaagcatgaaccaaactttcacagcataatttcaagctaaggaattgtaattctgtacttaatatattcatgtttgaaatgaatgctttgaaccacaggagggagatgttgtcaaatgctacagtgtgaacatgtattttgaatattctgtaacagggcaagtttccactctaagcagctatttaaaaataaatatgaggattttggtaataaatgcttatgcttaagtacaaaagt

SEQ ID NO: 196108 - DNA, 1769 bp, Homo sapiens
  Payload ID: 18688
  Gene Name: tubulin, delta 1
  Uniprot ID: Q9UJT1
  ENST ID: ENST00000340993
  CDS Start-End: 264-1460
tggacagtgagcatgcgtaccatatctgaagttcgtaaattgaaattgaacatgcgtaattaatctttctgaataggaaaaaatatatacacaacaaaactctccgtttatggaacatgcgcatttgttctcagtaagtttttcgttttgaaagtgagcatgcgcatggtgagtaggttggtccgaagtttgaaccggacagaagcgctggtcggcgtctggcggttgtttttagaggtaatacacctagtttgtggctcagcatgtcaattgtaacagtgcaacttggtcagtgtggcaatcagattggttttgaagtttttgatgctttgcttagtgactcacacagttcccagggactctgctctatgagagagaatgaggcatatcaagcatcttgcaaagaaagattcttcagtgaggaggagaatggagttccaattgcccgggctgttcttgttgacatggaacccaaagttatcaatcaaatgctgtcaaaggctgcccagtctggccaatggaaatatggtcaacatgcatgcttctgtcaaaaacaaggttctggaaacaactgggcatatggttactctgttcatggacccaggcatgaagaatctataatgaacataatccggaaggaagtggagaaatgtgactctttcagtggttttttcatcataatgagtatggctgggggcacaggatcaggattaggagctttcgttacacagaatttagaagatcagtactcaaactcattgaaaatgaatcagattatttggccttatggaactggtgaggttattgttcaaaactacaactccattttgacactttctcacttgtaccgatcttcagacgccctccttcttcatgagaatgatgccatccataagatctgtgcaaaactgatgaatatcaagcagatctcctttagtgatatcaatcaagtcctcgcacatcagctgggaagtgtgttccagcctacttattctgcagaaagctcatttcactacagacgaaatccactaggtattgataggcatgtatggcctcctttatcaggacttcctcctcttagtaaaatgtctctcaacaaggacctgcattttaacacttccattgctaacttggtcattcttcgtgggaaagatgtgcaaagtgcagatgtggagggatttaaagatccagctctgtatacttcctggttgaagcctgttaatgctttcaacgtgtggaaaacccagcgggcctttagcaaatatgagaagtctgcagtgttggtcagcaacagccagttcttagtaaaaccacttgatatgattgttgggaaggcatggaatatgtttgcttcaaaagcctacattcatcagtacacaaaatttggaatcgaagaagaggactttttagacagtttcacgtcattagagcaggttgttgccagttactgtaatctctgatcttgaacaatgggaaaagtataccttaaggcatttctggactaaaatattttcaatactattttctctgtaaagttttcaaagttctccatcctggctaacacggtgaaacaccgtctctaccagaaaatacaaaaaattagccaggcgcggtggcgggtgcctgtagtcccagctactcgggaggctgaggcaggagaatgacgtgaacccaggaggcggagcttgcagtgagccgagatcgcgccactgcactccagcctgggcgacagagcgagactccgtctcaaaaaaaaaaaaaaaaaaaaa

SEQ ID NO: 196109 - DNA, 1490 bp, Homo sapiens
  Payload ID: 18688
  Gene Name: tubulin, delta 1
  Uniprot ID: Q9UJT1
  ENST ID: ENST00000346141
  CDS Start-End: 59-658
cgctggtcggcgtctggcggttgtttttagaggtaatacacctagtttgtggctcagcatgtcaattgtaacagtgcaacttggtcagtgtggcaatcagattggttttgaagtttttgatgctttgcttagtgactcacacagttcccagggactctgctctatgagagagaatgaggcatatcaagcatcttgcaaagaaagattcttcagtgaggaggagaatggaggtattgataggcatgtatggcctcctttatcaggacttcctcctcttagtaaaatgtctctcaacaaggacctgcattttaacacttccattgctaacttggtcattcttcgtgggaaagatgtgcaaagtgcagatgtggagggatttaaagatccagctctgtatacttcctggttgaagcctgttaatgctttcaacgtgtggaaaacccagcgggcctttagcaaatatgagaagtctgcagtgttggtcagcaacagccagttcttagtaaaaccacttgatatgattgttgggaaggcatggaatatgtttgcttcaaaagcctacattcatcagtacacaaaatttggaatcgaagaagaggactttttagacagtttcacgtcattagagcaggttgttgccagttactgtaatctctgatcttgaacaatgggaaaagtataccttaaggcatttctggactaaaatattttcaatactattttctctgtaaagttttcaaagttctccatcctggctaacacggtgaaacaccgtctctaccagaaaatacaaaaaattagccaggcgcggtggcgggtgcctgtagtcccagctactcgggaggctgaggcaggagaatgacgtgaacccaggaggcggagcttgcagtgagccgagatcgcgccactgcactccagcctgggcgacagagcgagactccgtctcaaaaaaaaaaaaaaaaaaaaatgttttcaaagttccattctgttaaagtaaccacgtagaatgctgagtctattctgcatactatgcccacagaaaaggaagaaaactttttaaaatggagaatcgcatgttttcaatgaaaacattcacttggtatttcatttgtaagaaaaaaaaatggtgcttttataaagaactttggggaaacactttgctgaaatgttgggactctggaactagccaagaaaagagaatattctctttgtctacatgttcctaaatctttactccaaaacaactccaaaaacaactcacaaagcatgaaccaaactttcacagcataatttcaagctaaggaattgtaattctgtacttaatatattcatgtttgaaatgaatgctttgaaccacaggagggagatgttgtcaaatgctacagtgtgaacatgtattttgaatattctgtaacagggcaagtttccactctaagcagctatttaaaaataaatatgaggattttggtaataaatgcttatgcttaagt

SEQ ID NO: 196110 - DNA, 1154 bp, Homo sapiens
  Payload ID: 18688
  Gene Name: tubulin, delta 1
  Uniprot ID: Q9UJT1
  ENST ID: ENST00000376094
  CDS Start-End: 2-1057
catgtcaattgtaacagtgcaacttggtcagtgtggcaatcagattggttttgaagtttttgatgctttgcttagtgactcacacagttcccagggactctgctctatgagagagaatgaggcatatcaagcatcttgcaaagaaagattcttcagtgaggaggagaatggagttccaattgcccgggctgttcttgttgacatggaacccaaagttatcaatcaaatgctgtcaaaggctgcccagtctggccaatggaaatatggtcaacatgcatgcttctgtcaaaaacaaggttctggaaacaactgggcatatggttactctgttcatggacccaggcatgaagaatctataatgaacataatccggaaggaagtggagaaatgtgactctttcagtggttttttcatcataatgagtatggctgggggcacaggatcaggattaggagctttcgttacacagaatttagaagatcagtactcaaactcattgaaaatgaatcagattatttggccttatggaactggtgaggttattgttcaaaactacaactccattttgacactttctcacttgtaccgatcttcagacgccctccttcttcatgagaatgatgccatccataagatctgtgcaaaactgatgaatatcaagcagatctcctttagtgatatcaatcaagtcctcgcacatcagctgggaagtgtgttccagcctacttattctgcagaaagctcatttcactacagacgaaatccactagagggatttaaagatccagctctgtatacttcctggttgaagcctgttaatgctttcaacgtgtggaaaacccagcgggcctttagcaaatatgagaagtctgcagtgttggtcagcaacagccagttcttagtaaaaccacttgatatgattgttgggaaggcatggaatatgtttgcttcaaaagcctacattcatcagtacacaaaatttggaatcgaagaagaggactttttagacagtttcacgtcattagagcaggttgttgccagttactgtaatctctgatcttgaacaatgggaaaagtataccttaaggcatttctggactaaaatattttcaatactattttctctgtaaagttttcaaagttctccatcctgg

SEQ ID NO: 196111 - DNA, 1680 bp, Homo sapiens
  Payload ID: 18688
  Gene Name: tubulin, delta 1
  Uniprot ID: Q9UJT1
  ENST ID: ENST00000394239
  CDS Start-End: 202-1392
atctttctgaataggaaaaaatatatacacaacaaaactctccgtttatggaacatgcgcatttgttctcagtaagtttttcgttttgaaagtgagcatgcgcatggtgagtaggttggtccgaagtttgaaccggacagaagcgctggtcggcgtctggcggttgtttttagaggtaatacacctagtttgtggctcagcatgtcaattgtaacagtgcaacttggtcagtgtggcaatcagattggttttgaagtttttgatgctttgcttagtgactcacacagttcccagggactctgctctatgagagagaatgaggcatatcaagcatcttgcaaagaaagattcttcagtgaggaggagaatggagttccaattgcccgggctgttcttgttgacatggaacccaaagttatcaatcaaatgctgtcaaaggctgcccagtctggccaatggaaatatggtcaacatgcatgcttctgtcaaaaacaaggttctggaaacaactgggcatatggttactctgttcatggacccaggcatgaagaatctataatgaacataatccggaaggaagtggagaaatgtgactctttcagtggttttttcatcataatgagtatggctgggggcacaggatcaggattaggagctttcgttacacagaatttagaagatcagtactcaaactcattgaaaatgaatcagattatttggccttatggaactggtgaggttattgttcaaaactacaactccattttgacactttctcacttgtaccgatcttcagacgccctccttcttcatgagaatgatgccatccataagatctgtgcaaaactgatgaatatcaagcagatctcctttagtgatatcaatcaagtcctcgcacatcagctgggaagtgtgttccagcctacttattctgcagaaagctcatttcactacagacgaaatccactaggagacttaatggagcatttagttccccatcctgaattcaagatgctgagtgttcgtaacattcctcacatgtctgagaattcattggcatacaccacatttacttgggctggcctcctcaagcatttgagacagatgctcatttctaatgcaaagatggaagaaggtattgataggcatgtatggcctcctttatcaggacttcctcctcttagtaaaatgtctctcaacaaggacctgcattttaacacttccattgctaacttggtcattcttcgtgggaaagatgtgcaaagtgcagatgtgggtaagaaattcagagcctacattcatcagtacacaaaatttggaatcgaagaagaggactttttagacagtttcacgtcattagagcaggttgttgccagttactgtaatctctgatcttgaacaatgggaaaagtataccttaaggcatttctggactaaaatattttcaatactattttctctgtaaagttttcaaagttctccatcctggctaacacggtgaaacaccgtctctaccagaaaatacaaaaaattagccaggcgcggtggcgggtgcctgtagtcccagctactcgggaggctgaggcaggagaatgacgtgaacccaggaggcggagcttgcagtgagccgagatcgcgccactgcactccagcctgggcgacagagcgagactccgtctc

SEQ ID NO: 196112 - DNA, 1027 bp, Homo sapiens
  Payload ID: 18688
  Gene Name: tubulin, delta 1
  Uniprot ID: Q9UJT1
  ENST ID: ENST00000539018
  CDS Start-End: 309-1022
gaagttcgtaaattgaaattgaacatgcgtaattaatctttctgaataggaaaaaatatatacacaacaaaactctccgtttatggaacatgcgcatttgttctcagtaagtttttcgttttgaaagtgagcatgcgcatggtgagtaggttggtccgaagtttgaaccggacagaagcgctggtcggcgtctggcggttattgttcaaaactacaactccattttgacactttctcacttgtaccgatcttcagacgccctccttcttcatgagaatgatgccatccataagatctgtgcaaaactgatgaatatcaagcagatctcctttagtgatatcaatcaagtcctcgcacatcagctgggaagtgtgttccagcctacttattctgcagaaagctcatttcactacagacgaaatccactaggagacttaatggagcatttagttccccatcctgaattcaagatgctgagtgttcgtaacattcctcacatgtctgagaattcattggcatacaccacatttacttgggctggcctcctcaagcatttgagacagatgctcatttctaatgcaaagatggaagaaggtattgataggcatgtatggcctcctttatcaggacttcctcctcttagtaaaatgtctctcaacaaggacctgcattttaacacttccattgctaacttggtcattcttcgtgggaaagatgtgcaaagtgcagatgtggagggatttaaagatccagctctgtatacttcctggttgaagcctgttaatgctttcaacgtgtggaaaacccagcgggcctttagcaaatatgagaagtctgcagtgttggtcagcaacagccagttcttagtaaaaccacttgatatgattgttgggaaggcatggaatatgtttgcttcaaaagcctacattcatcagtacacaaaatttggaatcgaagaagaggactttttagacagtttcacgtcattagagcaggttgttgccagttactgtaatctctgatcttg

SEQ ID NO: 196113 - DNA, 560 bp, Homo sapiens
  Payload ID: 18688
  Gene Name: tubulin, delta 1
  ENST ID: ENST00000590498
  CDS Start-End: 269-560
agctggagcgttcggtggacagtgagcatgcgtaccatatctgaagttcgtaaattgaaattgaacatgcgtaattaatctttctgaataggaaaaaatatatacacaacaaaactctccgtttatggaacatgcgcatttgttctcagtaagtttttcgttttgaaagtgagcatgcgcatggtgagtaggttggtccgaagtttgaaccggacagaagcgctggtcggcgtctggcgttccaattgcccgggctgttcttgttgacatggaacccaaagttatcaatcaaatgctgtcaaaggctgcccagtctggccaatggaaatatggtcaacatgcatgcttctgtcaaaaacaaggttctggaaacaactgggcatatggttactctgttcatggacccaggcatgaagaatctataatgaacataatccggaaggaagtggagaaatgtgactctttcagtggttttttcatcataatgagtatggctgggggcacaggatcaggattaggagctttcgttacacagaatttagaagatcagtactcaaact

SEQ ID NO: 196114 - DNA, 551 bp, Homo sapiens
  Payload ID: 18688
  Gene Name: tubulin, delta 1
  ENST ID: ENST00000593110
  CDS Start-End: 227-352
gaagttcgtaaattgaaattgaacatgcgtaattaatctttctgaataggaaaaaatatatacacaacaaaactctccgtttatggaacatgcgcatttgttctcagtaagtttttcgttttgaaagtgagcatgcgcatggtgagtaggttggtccgaagtttgaaccggacagaagcgctggtcggcgtctggcgttccaattgcccgggctgttcttgttgacatggaacccaaagttatcaatcaaatgctgtcaaaggctgcccagtctggccaatggaaatatggtcaacatgcatgcttctgtcaaaaacaaggttctggaaacaactgggcatatgggtattgataggcatgtatggcctcctttatcaggacttcctcctcttagtaaaatgtctctcaacaaggacctgcattttaacacttccattgctaacttggtcattcttcgtgggaaagatgtgcaaagtgcagatgtggagggatttaaagatccagctctgtatacttcctggttgaagcctgttaatgctttcaacgtgtgg

SEQ ID NO: 196115 - DNA, 544 bp, Homo sapiens
  Payload ID: 18688
  Gene Name: tubulin, delta 1
  ENST ID: ENST00000592145
  CDS Start-End: 384-544
agctggagcgttcggtggacagtgagcatgcgtaccatatctgaagttcgtaaattgaaattgaacatgcgtaattaatctttctgaataggaaaaaatatatacacaacaaaactctccgtttatggaacatgcgcatttgttctcagtaagtttttcgttttgaaagtgagcatgcgcatggtgagtaggttggtccgaagtttgaaccggacagaagcgctggtcggcgtctggcggaggatgtcactttgtcacccaggctggagtgcggtggcaagatcttggctcactgcagcctggacctcccaggctcaggggatcctcccacctcagcctcccgagtagctgggactgcaggcgcacaccaccacgccaagctaatggttgtttttagaggtaatacacctagtttgtggctcagcatgtcaattgtaacagtgcaacttggtcagtgtggcaatcagattggttttgaagtttttgatgctttgcttagtgactcacacagttcccagggactctgctctatgagagagaatga

SEQ ID NO: 196116 - DNA, 1577 bp, Homo sapiens
  Payload ID: 18688
  Gene Name: tubulin, delta 1
  ENST ID: ENST00000591548
  CDS Start-End: 285-662
attgtcagctggagcgttcggtggacagtgagcatgcgtaccatatctgaagttcgtaaattgaaattgaacatgcgtaattaatctttctgaataggaaaaaatatatacacaacaaaactctccgtttatggaacatgcgcatttgttctcagtaagtttttcgttttgaaagtgagcatgcgcatggtgagtaggttggtccgaagtttgaaccggacagaagcgctggtcggcgtctggcggttgtttttagaggtaatacacctagtttgtggctcagcatgtcaattgtaacagtgcaacttggtcagtgtggcaatcagattggttttgaagtttttgatgctttgcttagtgactcacacagttcccagggactctgctctatgagagagaatgaggcatatcaagcatcttgcaaagaaagattcttcagtgaggaggagaatggagttccaattgcccgggctgttcttgttgacatggaacccaaagttatcaatcaaatgctgtcaaaggctgcccagtctggccaatggaaatatggtcaacatgcatgcttctgtcaaaaacaaggttctggaaacaactgggcatatggtagagacaaggattcagcatgttacccagactggtctggaactcctggcctccagtgatccacctgcctcggcctcccaaagtgctgagattacagttactctgttcatggacccaggcatgaagaatctataatgaacataatccggaaggaagtggagaaatgtgactctttcagtggttttttcatcataatgagtatggctgggggcacaggatcaggattaggagctttcgttacacagaatttagaagatcagtactcaaactcattgaaaatgaatcagattatttggccttatggaactggtgaggttattgttcaaaactacaactccattttgacactttctcacttgtaccgatcttcagacgccctccttcttcatgagaatgatgccatccataagatctgtgcaaaactgatgaatatcaagcagatctcctttagtgatatcaatcaagtcctcgcacatcagctgggaagtgtgttccagcctacttattctgcagaaagctcatttcactacagacgaaatccactaggtattgataggcatgtatggcctcctttatcaggacttcctcctcttagtaaaatgtctctcaacaaggacctgcattttaacacttccattgctaacttggtcattcttcgtgggaaagatgtgcaaagtgcagatgtggagggatttaaagatccagctctgtatacttcctggttgaagcctgttaatgctttcaacgtgtggaaaacccagcgggcctttagcaaatatgagaagtctgcagtgttggtcagcaacagccagttcttagtaaaaccacttgatatgattgttgggaaggcatggaatatgtttgcttcaaaagcctacattcatcagtacacaaaatttggaatcgaagaagaggactttttagacagtttcacgtcattagagcaggttgttgccagttactgtaatctctga

SEQ ID NO: 196117 - DNA, 1460 bp, Homo sapiens
  Payload ID: 18688
  Gene Name: tubulin, delta 1
  Uniprot ID: Q9UJT1
  ENST ID: ENST00000592426
  CDS Start-End: 2-1363
catgtcaattgtaacagtgcaacttggtcagtgtggcaatcagattggttttgaagtttttgatgctttgcttagtgactcacacagttcccagggactctgctctatgagagagaatgaggcatatcaagcatcttgcaaagaaagattcttcagtgaggaggagaatggagttccaattgcccgggctgttcttgttgacatggaacccaaagttatcaatcaaatgctgtcaaaggctgcccagtctggccaatggaaatatggtcaacatgcatgcttctgtcaaaaacaaggttctggaaacaactgggcatatggttactctgttcatggacccaggcatgaagaatctataatgaacataatccggaaggaagtggagaaatgtgactctttcagtggttttttcatcataatgagtatggctgggggcacaggatcaggattaggagctttcgttacacagaatttagaagatcagtactcaaactcattgaaaatgaatcagattatttggccttatggaactggtgaggttattgttcaaaactacaactccattttgacactttctcacttgtaccgatcttcagacgccctccttcttcatgagaatgatgccatccataagatctgtgcaaaactgatgaatatcaagcagatctcctttagtgatatcaatcaagtcctcgcacatcagctgggaagtgtgttccagcctacttattctgcagaaagctcatttcactacagacgaaatccactaggagacttaatggagcatttagttccccatcctgaattcaagatgctgagtgttcgtaacattcctcacatgtctgagaattcattggcatacaccacatttacttgggctggcctcctcaagcatttgagacagatgctcatttctaatgcaaagatggaagaaggtattgataggcatgtatggcctcctttatcaggacttcctcctcttagtaaaatgtctctcaacaaggacctgcattttaacacttccattgctaacttggtcattcttcgtgggaaagatgtgcaaagtgcagatgtggagggatttaaagatccagctctgtatacttcctggttgaagcctgttaatgctttcaacgtgtggaaaacccagcgggcctttagcaaatatgagaagtctgcagtgttggtcagcaacagccagttcttagtaaaaccacttgatatgattgttgggaaggcatggaatatgtttgcttcaaaagcctacattcatcagtacacaaaatttggaatcgaagaagaggactttttagacagtttcacgtcattagagcaggttgttgccagttactgtaatctctgatcttgaacaatgggaaaagtataccttaaggcatttctggactaaaatattttcaatactattttctctgtaaagttttcaaagttctccatcctgg

SEQ ID NO: 196118 - DNA, 2184 bp, Homo sapiens
  Payload ID: 18688
  Gene Name: tubulin, delta 1
  Uniprot ID: Q9UJT1
  ENST ID: ENST00000613721
  CDS Start-End: 289-1344
gcgcattgtcagctggagcgttcggtggacagtgagcatgcgtaccatatctgaagttcgtaaattgaaattgaacatgcgtaattaatctttctgaataggaaaaaatatatacacaacaaaactctccgtttatggaacatgcgcatttgttctcagtaagtttttcgttttgaaagtgagcatgcgcatggtgagtaggttggtccgaagtttgaaccggacagaagcgctggtcggcgtctggcggttgtttttagaggtaatacacctagtttgtggctcagcatgtcaattgtaacagtgcaacttggtcagtgtggcaatcagattggttttgaagtttttgatgctttgcttagtgactcacacagttcccagggactctgctctatgagagagaatgaggcatatcaagcatcttgcaaagaaagattcttcagtgaggaggagaatggagttccaattgcccgggctgttcttgttgacatggaacccaaagttatcaatcaaatgctgtcaaaggctgcccagtctggccaatggaaatatggtcaacatgcatgcttctgtcaaaaacaaggttctggaaacaactgggcatatggttactctgttcatggacccaggcatgaagaatctataatgaacataatccggaaggaagtggagaaatgtgactctttcagtggttttttcatcataatgagtatggctgggggcacaggatcaggattaggagctttcgttacacagaatttagaagatcagtactcaaactcattgaaaatgaatcagattatttggccttatggaactggtgaggttattgttcaaaactacaactccattttgacactttctcacttgtaccgatcttcagacgccctccttcttcatgagaatgatgccatccataagatctgtgcaaaactgatgaatatcaagcagatctcctttagtgatatcaatcaagtcctcgcacatcagctgggaagtgtgttccagcctacttattctgcagaaagctcatttcactacagacgaaatccactagagggatttaaagatccagctctgtatacttcctggttgaagcctgttaatgctttcaacgtgtggaaaacccagcgggcctttagcaaatatgagaagtctgcagtgttggtcagcaacagccagttcttagtaaaaccacttgatatgattgttgggaaggcatggaatatgtttgcttcaaaagcctacattcatcagtacacaaaatttggaatcgaagaagaggactttttagacagtttcacgtcattagagcaggttgttgccagttactgtaatctctgatcttgaacaatgggaaaagtataccttaaggcatttctggactaaaatattttcaatactattttctctgtaaagttttcaaagttctccatcctggctaacacggtgaaacaccgtctctaccagaaaatacaaaaaattagccaggcgcggtggcgggtgcctgtagtcccagctactcgggaggctgaggcaggagaatgacgtgaacccaggaggcggagcttgcagtgagccgagatcgcgccactgcactccagcctgggcgacagagcgagactccgtctcaaaaaaaaaaaaaaaaaaaaatgttttcaaagttccattctgttaaagtaaccacgtagaatgctgagtctattctgcatactatgcccacagaaaaggaagaaaactttttaaaatggagaatcgcatgttttcaatgaaaacattcacttggtatttcatttgtaagaaaaaaaaatggtgcttttataaagaactttggggaaacactttgctgaaatgttgggactctggaactagccaagaaaagagaatattctctttgtctacatgttcctaaatctttactccaaaacaactccaaaaacaactcacaaagcatgaaccaaactttcacagcataatttcaagctaaggaattgtaattctgtacttaatatattcatgtttgaaatgaatgctttgaaccacaggagggagatgttgtcaaatgctacagtgtgaacatgtattttgaatattctgtaacagggcaagtttccactctaagcagctatttaaaaataaatatgaggattttggtaataaatgcttatgcttaagtacaaaagt

SEQ ID NO: 196119 - DNA, 2142 bp, Homo sapiens
  Payload ID: 18689
  Gene Name: tubulin, epsilon 1
  Uniprot ID: Q9UJT0
  ENST ID: ENST00000368662
  CDS Start-End: 80-1507
ctctagcagagcgccgttgctgggggaatgcagaagcggccgcgggctagcaagctcccggagccggcggcgcaccaccatgacccagtcggtggtcgtacaggtcggccagtgcggaaaccagatcggctgctgcttctgggacctggcactaagggagcacgccgcggtcaaccagaaaggaatttatgatgaggcaataagcagcttctttagaaatgtggacaccagagtggttggtgatggtggaagtatttccaagggaaaaatatgttctttaaaagcacgagcagtcttgattgatatggaagaaggggtagtgaatgaaattctgcagggaccactgagagatgtatttgatacgaaacagctcatcactgatatttctggctcaggaaataattgggccgtgggtcacaaagttttcggcagtctttaccaagaccagattttagagaaattcagaaagtcggcagagcactgtgattgcttgcagtgtttctttataatacattccatgggaggaggaacaggatctggacttggcacatttcttttaaaggtgcttgaagacgaattcccagaagtatacagatttgtgacttccatttatccttctggtgaggatgatgtcataacctcaccttataatagcatcttggcaatgaaggaacttaatgagcatgcagactgtgtattgcccattgacaatcaatctttatttgacatcattagcaaaatcgacctcatggtgaattctggaaagttgggtacaactgtgaagccaaagagtctggttacttcaagttctggggctttaaaaaagcagcataagaagccctttgatgcaatgaataacattgtggcaaatttgctcctcaacctaacgagctctgcaagatttgaagggtcccttaatatggaccttaatgaaatcagcatgaatttagttccttttcctcaacttcattatctcgtgtcaagcctaacacctctgtatacactgacagatgttaacattcctcctagaagattggatcagatgttttcagatgcctttagtaaagatcaccagctgcttcgggcagaccccaaacacagtctttacctcgcctgtgcactcatggttagaggaaatgtacaaatttcagatcttcgtagaaatattgaaagattaaaaccatctctacaatttgtctcctggaatcaagaaggctggaagaccagcctgtgttccgtacctcctgtgggccattctcattcgttattagctttagcaaataacacatgtgtgaagcccaccttcatggaactgaaagagagattcatgaggctctacaagaaaaaggctcaccttcatcactatctacaagttgaagggatggaagaaagctgtttcacagaagctgtgtcatctttatcagcactcatacaggaatatgaccaactggacgccacaaaaaacatgcctgtgcaggatttacccagactaagcatagctatgtgaaaaagaaaccctcaaaaatactttcttaatttcacattgttttttctgacctttctgtttcaacatttttgtaatttggaaactccagttttttcatattatcgggaaatatttttgtctaaaagagtgatttctgtttaatcgcaatttgttggtaataccaatgtgtgaaattagtgaaatcttagtaccttaacttcaaacatttctcttcagaaaagttcccttttctaaaattgagataacatagttcttgaatattttgctgtatttatagcctcatatttaggcatttatgcactgatgtgtcttcaataaaaatcttgtacagatatatttttataattatttataatttatattttgatattctatttaagttatcctgattctttaaaagtagttattgggagtagaagaacacaatataaatatttccgtgtaatagccaccaacttttcaggcataggttttattacaactgttaaggaggttttgcttcttctttagataacaacttgtttgcccaaaagaatcctaatttgtacacttaacatgtatttgtattaaactttttaaataattgctttcttatcaaaccaattgattttataataaatgtctatatttttcaa

SEQ ID NO: 196120 - DNA, 1645 bp, Homo sapiens
  Payload ID: 18689
  Gene Name: tubulin, epsilon 1
  ENST ID: ENST00000605457
  CDS Start-End: 76-738
agcagagcgccgttgctgggggaatgcagaagcggccgcgggctagcaagctcccggagccggcggcgcaccaccatgacccagtcggtggtcgtacaggtcggccagtgcggaaaccagatcggctgctgcttctgggacctggcactaagggagcacgccgcggtcaaccagaaaggaatttatgatgaggcaataagcagcttctttagaaatgtggacaccagagtggttggtgatggtggaagtatttccaagggaaaaatatgttctttaaaagcacgagcagtcttgattgatatggaagaaggggtagtgaatgaaattctgcagggaccactgagagatgtatttgatacgaaacagctcatcactgatatttctggctcaggaaataattgggccgtgggtcacaaagttttcggcagtctttaccaagaccagattttagagaaattcagaaagtcggcagagcactgtgattgcttgcagtgtttctttataatacattccatgggaggaggaacaggatctggacttggcacatttcttttaaaggtgcttgaagacgaattcccagaagtatacagatttgtgacttccatttatccttctggtgaggatgatgtcataacctcaccttataatagcatcttggcaatgaaggaacttaatgagcatgcagactgtgtattgcccattgacaatcaaaatatcatctacatccactcttcttaatagcttctctcccaatgtttttccctcaaaagtctttatttgacatcattagcaaaatcgacctcatggtgaattctggaaagttgggtacaactgtgaagccaaagagtctggttacttcaagttctggggctttaaaaaagcagcataagaagccctttgatgcaatgaataacattgtggcaaatttgctcctcaacctaacgagctctgcaagatttgaagggtcccttaatatggaccttaatgaaatcagcatgaatttagttccttttcctcaacttcattatctcgtgtcaagcctaacacctctgtatacactgacagatgttaacattcctcctagaagattggatcagatgttttcagatgcctttagtaaagatcaccagctgcttcgggcagaccccaaacacagtctttacctcgcctgtgcactcatggttagaggaaatgtacaaatttcagatcttcgtagaaatattgaaagattaaaaccatctctacaatttgtctcctggaatcaagaaggctggaagaccagcctgtgttccgtacctcctgtgggccattctcattcgttattagctttagcaaataacacatgtgtgaagcccaccttcatggaactgaaagagagattcatgaggctctacaagaaaaaggctcaccttcatcactatctacaagttgaagggatggaagaaagctgtttcacagaagctgtgtcatctttatcagcactcatacaggaatatgaccaactggacgccacaaaaaacatgcctgtgcaggatttacccagactaagcatagctatgtgaaaaagaaaccctcaaaaatactttcttaatttcacattgttttttctgacctttctgtttcaacatttttgtaatttggaaac

SEQ ID NO: 196121 - DNA, 582 bp, Homo sapiens
  Payload ID: 18689
  Gene Name: tubulin, epsilon 1
  ENST ID: ENST00000604967
  CDS Start-End: 33-197
tagcaagctcccggagccggcggcgcaccaccatgacccagtcggtggtcgtacaggtcggccagtgcggaaaccagatcggctgctgcttctgggacctggcactaagggagcacgccgcggtcaaccagaaaggaatttatgatgaggcaataagcagcttctttagaaatgtggacaccaggaaatctaactgaaaagctgtgtaataatctgaaggttgcttggtgaccatggaatcagaccaaaggaagttagttactttaatggctgtcttgattgatatggaagaaggggtagtgaatgaaattctgcagggaccactgagagatgtatttgatacgaaacagctcatcactgatatttctggctcaggaaataattgggccgtgggtcacaaagttttcggcagtctttaccaagaccagattttagagaaattcagaaagtcggcagagcactgtgattgcttgcagtgtttctttataatacattccatgggaggaggaacaggatctggacttggcacatttcttttaaaggtgcttgaagacgaattcccagaagtatacagatttgtga

SEQ ID NO: 196122 - DNA, 959 bp, Homo sapiens
  Payload ID: 18689
  Gene Name: tubulin, epsilon 1
  ENST ID: ENST00000604743
  CDS Start-End: 65-226
gttgctgggggaatgcagaagcggccgcgggctagcaagctcccggagccggcggcgcaccaccatgacccagtcggtggtcgtacaggtcggccagtgcggaaaccagatcggctgctgcttctgggacctggcactaagggagcacgccgcggtcaaccagaaaggaatttatgatgaggcaataagcagcttctttagaaatgtggacaccaggcagtcttgattgatatggaagaaggggtagtgaatgaaattctgcagggaccactgagagatgtatttgatacgaaacagctcatcactgatatttctggctcaggaaataattgggccgtgggtcacaaagttttcggcagtctttaccaagaccagattttagagaaattcagaaagtcggcagagcactgtgattgcttgcagtgtttctttataatacattccatgggaggaggaacaggatctggacttggcacatttcttttaaaggtgcttgaagacgaattcccagaagtatacagatttgtgacttccatttatccttctggtgaggatgatgtcataacctcaccttataatagcatcttggcaatgaaggaacttaatgagcatgcagactgtgtattgcccattgacaatcaatctttatttgacatcattagcaaaatcgacctcatggtgaattctggaaagttgggtacaactgtgaagccaaagagtctggttacttcaagttctggggctttaaaaaagcagcataagaagccctttgatgcaatgaataacattgtggcaaatttgctcctcaacctaacgagctctgcaagatttgaagggtcccttaatatggaccttaatgaaatcagcatgaatttagttccttttcctcaacttcattatctcgtgtcaagcctaacacctctgtatacactgacagatgttaacattcctcctagaag

SEQ ID NO: 196123 - DNA, 1611 bp, Homo sapiens
  Payload ID: 18690
  Gene Name: tubulin, gamma 1
  Uniprot ID: P23258
  ENST ID: ENST00000251413
  CDS Start-End: 63-1418
gcgggctggcgtgcggcgccgttgcgggcgggagcggctgcaacgccggtgcctgaggagcgatgccgagggaaatcatcaccctacagttgggccagtgcggcaatcagattgggttcgagttctggaaacagctgtgcgccgagcatggtatcagccccgagggcatcgtggaggagttcgccaccgagggcactgaccgcaaggacgtctttttctaccaggcagacgatgagcactacatcccccgggccgtgctgctggacttggaaccccgggtgatccactccatcctcaactccccctatgccaagctctacaacccagagaacatctacctgtcggaacatggaggaggagctggcaacaactgggccagcggattctcccagggagaaaagatccatgaggacatttttgacatcatagaccgggaggcagatggtagtgacagtctagagggctttgtgctgtgtcactccattgctggggggacaggctctggactgggttcctacctcttagaacggctgaatgacaggtatcctaagaagctggtgcagacatactcagtgtttcccaaccaggacgagatgagcgatgtggtggtccagccttacaattcactcctcacactcaagaggctgacgcagaatgcagactgtgtggtggtgctggacaacacagccctgaaccggattgccacagaccgcctgcacatccagaacccatccttctcccagatcaaccagctggtgtctaccatcatgtcagccagcaccaccaccctgcgctaccctggctacatgaacaatgacctcatcggcctcatcgcctcgctcattcccaccccacggctccacttcctcatgaccggctacacccctctcactacggaccagtcagtggccagcgtgaggaagaccacggtcctggatgtcatgaggcggctgctgcagcccaagaacgtgatggtgtccacaggccgagaccgccagaccaaccactgctacatcgccatcctcaacatcatccagggagaggtggaccccacccaggtccacaagagcttgcagaggatccgggaacgcaagttggccaacttcatcccgtggggccccgccagcatccaggtggccctgtcgaggaagtctccctacctgccctcggcccaccgggtcagcgggctcatgatggccaaccacaccagcatctcctcgctcttcgagagaacctgtcgccagtatgacaagctgcgtaagcgggaggccttcctggagcagttccgcaaggaggacatgttcaaggacaactttgatgagatggacacatccagggagattgtgcagcagctcatcgatgagtaccatgcggccacacggccagactacatctcctggggcacccaggagcagtgagtcccccaggacagggaccctcatctgccttactggttggcccaagccctgcctgactgaccaccccctcagagcacagatcagggacctcacgcatctctttctcatatacatggactctctgttggcctgcaaacacatttacttctcctcttatgagactatttatctttaataaagcactggatataaa

SEQ ID NO: 196124 - DNA, 847 bp, Homo sapiens
  Payload ID: 18690
  Gene Name: tubulin, gamma 1
  ENST ID: ENST00000591509
  CDS Start-End: 53-847
gtgcggcgccgttgcgggcgggagcggctgcaacgccggtgcctgaggagcgatgccgagggaaatcatcaccctacagttgggccagtgcggcaatcagattgggttcgagttctggaaacagctgtgcgccgagcatggtatcagccccgagggcatcgtggaggagttcgccaccgagggcactgaccgcaaggacgtctttttctaccaggcagacgatgagcactacatcccccgggccgtgctgctggacttggaaccccgggtgatccactccatcctcaactccccctatgccaagctctacaacccagagaacatctacctgtcggaacatggaggaggagctggcaacaactgggccagcggattctcccaggtcgtttcctattccctggcagggcccacaactcgctggggagaaaagatccatgaggacatttttgacatcatagaccgggaggcagatggtagtgacagtctagagggctttgtgctgtgtcactccattgctggggggacaggctctggactgggttcctacctcttagaacggctgaatgacaggtatcctaagaagctggtgcagacatactcagtgtttcccaaccaggacgagatgagcgatgtggtggtccagccttacaattcactcctcacactcaagaggctgacgcagaatgcagactgtgtggtggtgctggacaacacagccctgaaccggattgccacagaccgcctgcacatccagaacccatccttctcccagatcaaccagctggtgtctaccatcatgtcagccagcaccaccaccctgcgctaccctggctacatgaacaatgac

SEQ ID NO: 196125 - DNA, 1505 bp, Homo sapiens
  Payload ID: 18690
  Gene Name: tubulin, gamma 1
  ENST ID: ENST00000589688
  CDS Start-End: 50-457
cggcgccgttgcgggcgggagcggctgcaacgccggtgcctgaggagcgatgccgagggaaatcatcaccctacagttgggccagtgcggcaatcagattgggttcgagttctggaaacagctgtgcgccgagcatggtatcagccccgagggcatcgtggaggagttcgccaccgagggcactgaccgcaaggacgtctttttctaccaggcagacgatgagcactacatcccccgggccgtgctgctggacttggaaccccgggtgatccactccatcctcaactccccctatgccaagctctacaacccagagaacatctacctgtcggaacatggaggaggagctggcaacaactgggccagcggattctcccagggagaaaagatccatgaggacatttttgacatcatagaccgggaggcagatggtagtgacagtctagaggtatcctaagaagctggtgcagacatactcagtgtttcccaaccaggacgagatgagcgatgtggtggtccagccttacaattcactcctcacactcaagaggctgacgcagaatgcagactgtgtggtggtgctggacaacacagccctgaaccggattgccacagaccgcctgcacatccagaacccatccttctcccagatcaaccagctggtgtctaccatcatgtcagccagcaccaccaccctgcgctaccctggctacatgaacaatgacctcatcggcctcatcgcctcgctcattcccaccccacggctccacttcctcatgaccggctacacccctctcactacggaccagtcagtggccagcgtgaggaagaccacggtcctggatgtcatgaggcggctgctgcagcccaagaacgtgatggtgtccacaggccgagaccgccagaccaaccactgctacatcgccatcctcaacatcatccagggagaggtggaccccacccaggtccacaagagcttgcagaggatccgggaacgcaagttggccaacttcatcccgtggggccccgccagcatccaggtggccctgtcgaggaagtctccctacctgccctcggcccaccgggtcagcgggctcatgatggccaaccacaccagcatctcctcgctcttcgagagaacctgtcgccagtatgacaagctgcgtaagcgggaggccttcctggagcagttccgcaaggaggacatgttcaaggacaactttgatgagatggacacatccagggagattgtgcagcagctcatcgatgagtaccatgcggccacacggccagactacatctcctggggcacccaggagcagtgagtcccccaggacagggaccctcatctgccttactggttggcccaagccctgcctgactgaccaccccctcagagcacagatcagggacctcacgcatctctttctcatatacatggactctctgttggcctgcaaacacatttacttctcctcttatgagactatttatctttaataaag

SEQ ID NO: 196126 - DNA, 1761 bp, Homo sapiens
  Payload ID: 18691
  Gene Name: tubulin, gamma 2
  Uniprot ID: Q9NRH3
  ENST ID: ENST00000251412
  CDS Start-End: 200-1555
ggagaaaatgatgcccaggttgggctccccggcccaccggccgaggagaggcctgcgctgcacacgcgcagaccgagcatccgcgtcaagaggcgaagagagcgcgcgctccccacgtcctgcgctcctggctgccgggcattcgtctcagccgtgactctcgccaggccggggctggcgcgcccacgtctgaagagcgatgccccgggagatcatcaccctgcagctgggccagtgcggcaaccagattgggttcgagttctggaaacagctgtgcgccgagcatggtatcagccccgagggcatcgtggaggaattcgccaccgagggcactgaccgcaaggacgtctttttctaccaggcagacgatgagcactacatcccccgggccgtgctgctggacttggaaccccgggtgatccactccatcctcaactccccctatgccaagctctacaacccagagaacatctacctgtcggaacatggaggaggagctggcaacaactgggccagcggattctcccagggtgagaaaattcatgaagacatctttgacatcatagaccgagaagcagatggaagtgacagtttggagggcttcgtgctgtgtcactccatcgctgggggtacgggttctggcctgggctcctacctcctggagcgactgaatgacaggtaccccaagaagctagtgcagacttattcagtgtttccctaccaggacgagatgagcgacgtagtggttcagccctacaattcactcctgacactcaagaggctgacgcagaacgcagattgtgtggtggtgctggacaacacagccctgaaccggattgccacagaccgcctgcacatccagaacccgtccttctcccagatcaaccagctggtgtccaccatcatgtcggccagcaccaccaccctgcgctaccccggctacatgaacaatgacctcatcggcctcatcgcctcgctcattcccaccccacggctccacttcctcatgaccggctacaccccgctcactacagaccagtcagtggccagcgtgaggaagaccacggtcctggatgtcatgaggcggctgctgcagcccaagaacgtgatggtgtccacaggccgagaccgccagaccaaccactgctacatcgccatcctcaacatcatccagggagaggtggaccccacccaggtccacaagagcctgcagaggatccgggaacggaagttggccaacttcatcccgtggggccccgccagcatccaggtggccctgtcgaggaagtctccctacctgccctcggcccaccgggtcagcgggctcatgatggccaaccacaccagcatctcctcgctctttgaaagttcctgccagcagtttgacaagctgcggaagcgggatgccttcctcgagcagttccgtaaggaggacatgttcaaggacaactttgatgagatggacaggtctagggaggttgttcaggagctcattgatgagtaccatgcggccacccagccagactacatttcctggggcacccaggagcagtgatttccctccccactactccttctccttctagatggtaaccacagcctcgaccatgcctgctccctctgacccagcttcacctcatggacaacccttcttggttcatctccagcccgtgagctggtcctgcttcctcccttccatgccctaacttttaatatgcttgttcagctctaataaagtaataaagcttggttgtcagtata

SEQ ID NO: 196127 - DNA, 3885 bp, Homo sapiens
  Payload ID: 18692
  Gene Name: tubulin, gamma complex associated protein 2
  Uniprot ID: Q9BSJ2
  ENST ID: ENST00000252936
  CDS Start-End: 41-2749
ggagaacatattgtgatgttcgtgcctcagagctaaaactatgagtgaatttcggattcaccatgacgtcaatgaactgcttagcctgctgcgtgtccacggaggagatggggctgaggtctacattgacctgcttcaaaagaacaggaccccgtacgtcactaccactgtctctgctcacagtgccaaggttaaaattgcagagttttctcgtactccagaagactttctaaagaaatatgatgaactgaaatctaaaaatacaaggaaccttgacccgctggtgtacctgttgtcaaagctcacggaagacaaagagactctgcagtacttacaacagaatgcaaaagaaagagctgagcttgcagccgctgctgtgggcagcagtaccaccagcatcaacgtccctgccgcggcctccaagatctccatgcaggagcttgaggaactgaggaagcagcttggcagcgtggccacaggctccacgctgcagcagtctctggaacttaaaagaaagatgcttcgagacaagcagaacaaaaaaaattcaggccagcacctccccatcttcccagcatgggtgtatgagagacctgccctgatcggggatttcctgattggtgctggcatcagcacagacaccgctttgccgataggcacgttgcccctggcctcgcaggagtcggccgtggtggaggacctgctgtacgtgctggtgggcgtggacgggaggtacgtcagtgctcagcccctggctgggaggcagagccggaccttcctcgtggaccccaacctggacctgtccatcagggagctggtgcacaggatcctcccagtggccgccagctactccgctgtgaccaggttcattgaagagaagtcttccttcgagtacgggcaggtgaaccacgccctggcggccgccatgcgcaccctggtgaaggagcacctgattctggtgtcacagctggagcagctgcacaggcagggcctcctttcgctgcagaagctctggttctacatccagccagccatgcgcaccatggacatcctggcctccctcgccacctcggtggacaaaggcgaatgtcttggggggtccacgctgagcctgctccacgacaggagcttcagctacacaggggacagccaggcgcaggagctatgcctgtacctaaccaaggcggccagtgctccctacttcgaggttctggagaagtggatctacaggggcatcatccacgacccatacagtgagtttatggtcgaggagcacgagctgcggaaggagaggatccaggaggattacaacgacaagtactgggaccagcggtacaccatcgtccagcagcagatcccgtccttcctgcagaaaatggcggacaagatcctcagcacaggaaaatatctaaatgtggtcagagagtgtggccatgacgtcacctgcccggtggctaaagagatcatctacacgttaaaagagcgggcgtatgtggagcagatcgagaaggcgtttaactacgccagcaaggtgctgctggacttcctgatggaggagaaggagctggtggctcacctcaggtccatcaagcgctacttcctcatggaccagggcgacttcttcgtgcacttcatggacctcgcggaggaggagctccggaagccggtggaggacatcacgccccctcgcctggaagcgctcctggagctggcgctgcgcatgagcacggccaacactgaccccttcaaggacgacctcaagatcgacctgatgccccatgacctcatcactcagctcttgcgcgtcctggccatcgagaccaagcaggagaaggcgatggcgcacgccgaccccacggagctggcgctgagcggcctggaggccttctctttcgactacatcgtcaagtggcccctttcgctcatcatcaacaggaaagccctcactcgctaccagatgctcttcaggcacatgttctactgcaagcacgtggagcggcagctctgcagcgtctggatcagcaacaaaaccgccaagcagcactcgctgcactccgcccagtggtttgctggggctttcactctgcggcagcgaatgctcaacttcgtccagaatattcaatactacatgatgtttgaagtgatggaaccgacctggcacatcctggagaaaaacctgaaatccgcctccaacattgacgacgtccttggccaccacacaggcttcctggacacctgcctgaaggactgcatgctcaccaaccccgagctgctgaaggtcttctccaagctcatgtctgtgtgcgtcatgttcaccaactgcatgcagaaatttacacagagcatgaaattagatggcgagctgggcgggcagacgctggagcacagcaccgtcctggggctgcccgcaggggccgaggagcgggcccggaaggagctcgccaggaagcacctggctgagcacgcagacactgtgcagctggtgtccggcttcgaggccaccatcaacaagtttgacaagaacttctcagcccacctgctggacctcctggcccggctgagcatctatagcaccagtgactgtgagcacggcatggccagcgtcatctccaggcttgacttcaatggtttctacacggagcgcctggagcgcctgtctgcagagaggagccagaaggccaccccccaagtgcctgtcctgcgggggcccccggctcctgcacccagggtcgcagtcaccgcacagtgagccctggctgtgacaggaaggaagggtgtggggtcagcagggactggtgcaaatgggtccagaattttcaaatcgaatgctctgtgttctgtctttgcagtttaaatataaagcaggaatgattgactcagctcactttgtttctcaaggcgctgggtttcgttttatagaagctgcccaggcagggtggatgtctccctggatttgctaatctgtttgctttttgaaattacactatcacctttttgggtgtttttggcctcaaagtggaaatacatggtgtttaagccaggagcaagcaaagatgcatgtggggtaagatccaggcctggtgtccacatctttccgggtgagctggggccgggcttcctgaggtctgtcggaaccgggacaagcctctggaaacggtcagggagttgtggaaacccaccgggcatcgggtgtcgggtttgctttggccccagaggcagccccgttccttctcctgaggactcacccgcctccacgaccctcctcctgctgctgctccaactggtccagggcaggaggccacagacagggccctcaggcaccctgggagcccacacctccccctccgtgggagtgggtcgaggggcaggctctgctgctggctggaaaccccaccccgccctatccggtaccgccttgttacgtagaacttactcagcagactgacacccaatccccctcgggcgatcatctgccctgtcttcccacctccagggctacagtgggcagcaccgccatccccagtgtgacagggccctgggagcctcagggctgcccggccaggttggtctgctctggttacattctggccaagctgccccttcctgctgacctgcatgtgtattgttgtcaccttcagctctcagcacctcggcccccttgggcagtgaggaagggccctggaggcgaggttgggagaaaggatagctagaacaggatcctgcggggaacaagggttgtgggcagctctcacccggggctgcctcactgagagcaccgccgagtgggggtgggggtgtccaactctccagccacaaaccgcttcctccttgtctgcaggctgtgcaggtctggcctgtgagtaaacacatttatcagcaacccaa

SEQ ID NO: 196128 - DNA, 2685 bp, Homo sapiens
  Payload ID: 18692
  Gene Name: tubulin, gamma complex associated protein 2
  ENST ID: ENST00000368562
  CDS Start-End: 1073-2560
ctggtggggtctgtcggcttctcttcagtgcgatatatttaaatggataaaaatatgttagttcccaaagaattgtattatgtctattacgtcaagataccgttgttgaaatattttcaaaaaatacattagtgatgtggaaatgttatttctttactaatggaccaaataaaatctggtataatgggcacctttaaagaaagcaccttcacacttgaagtgcgtaaatgatgtttgaagttgttcagatgatgacgtggagatgtctggtttctgtcaatgttggccccgcctaccccacacgagcatcattttgggtgtcagggccccacgcaccccacacgagcatcattttgttgcctgggctcatcatggaaggaaatgctaaattccaaaaagaggtgggtgcagataaagacaaatcagtttcccacctatctctgcggaccgtacattctccctgagcccaggttaaatactccgttccagagcgaggtttgtaggtttgttggttttcttttttttttttttctttttttttttgaggcagagtctcgctccattgccaggctggagtgcagtggcatgatctcggctcgctgcaacccccacctcccaggttcaagcgattcccctgccttaacctcccaagtagctgggactacaggtgcacaccaccacgcccagctgattttttgtattttagtagagacggggtttcactgtgttggccaggatggtcttgatctcttgacttcgtgatctgcccacctcagcctcccaaagtgctggggttacaggcgtgagccactgtgcccggcccctaggttcgttttagccgagaagtgttggggttacaggcgtgagccaccgtgcccggcccctaggttcgttttagcccacagttgagaagtaactggtagattaggctcggcccttgtggaacgttacttggaagtgtgctggcctctgttaatgtccctgcgcgctgccggcctggagaagtgtcgcctgcctcaggcgcccttgctttgcctgtgaccgaagcgctccctgtggttttagtgagtttatggtcgaggagcacgagctgcggaaggagaggatccaggaggattacaacgacaagtactgggaccagcggtacaccatcgtccagcagcagatcccgtccttcctgcagaaaatggcggacaagatcctcagcacaggaaaatatctaaatgtggtcagagagtgtggccatgacgtcacctgcccggtggctaaagagatcatctacacgttaaaagagcgggcgtatgtggagcagatcgagaaggcgtttaactacgccagcaaggtgctgctggacttcctgatggaggagaaggagctggtggctcacctcaggtccatcaagcgctacttcctcatggaccagggcgacttcttcgtgcacttcatggacctcgcggaggaggagctccggaagccggtggaggacatcacgccccctcgcctggaagcgctcctggagctggcgctgcgcatgagcacggccaacactgaccccttcaaggacgacctcaagatcgacctgatgccccatgacctcatcactcagctcttgcgcgtcctggccatcgagaccaagcaggagaaggcgatggcgcacgccgaccccacggagctggcgctgagcggcctggaggccttctctttcgactacatcgtcaagtggcccctttcgctcatcatcaacaggaaagccctcactcgctaccagatgctcttcaggcacatgttctactgcaagcacgtggagcggcagctctgcagcgtctggatcagcaacaaaaccgccaagcagcactcgctgcactccgcccagtggtttgctggggctttcactctgcggcagcgaatgctcaacttcgtccagaatattcaatactacatgatgtttgaagtgatggaaccgacctggcacatcctggagaaaaacctgaaatccgcctccaacattgacgacgtccttggccaccacacaggcttcctggacacctgcctgaaggactgcatgctcaccaaccccgagctgctgaaggtcttctccaagctcatgtctgtgtgcgtcatgttcaccaactgcatgcagaaatttacacagagcatgaaattagatggcgagctgggcgggcagacgctggagcacagcaccgtcctggggctgcccgcaggggccgaggagcgggcccggaaggagctcgccaggaagcacctggctgagcacgcagacactgtgcagctggtgtccggcttcgaggccaccatcaacaagtttgacaagaacttctcagcccacctgctggacctcctggcccggctgagcatctatagcaccagtgactgtgagcacggcatggccagcgtcatctccaggcttgacttcaatggtttctacacggagcgcctggagcgcctgtctgcagagaggagccagaaggccaccccccaagtgcctgtcctgcgggggcccccggctcctgcacccagggtcgcagtcaccgcacagtgagccctggctgtgacaggaaggaagggtgtggggtcagcagggactggtgcaaatgggtccagaattttcaaatcgaatgctctgtgttctgtctttgcagtttaaatataaagcaggaatgattg

SEQ ID NO: 196129 - DNA, 4218 bp, Homo sapiens
  Payload ID: 18692
  Gene Name: tubulin, gamma complex associated protein 2
  Uniprot ID: Q9BSJ2
  ENST ID: ENST00000368563
  CDS Start-End: 374-3082
ctcgccgccgtaggccccactggatcctacaactactttttccctcttttgctcacgcacctcgaagaactggtgctcccgcgggaagcgcacggggcgcgcaacgaagcgaaagggcgcggccccagccgcgggatcccgctctacaggcagcggctccgccgccccgggccccgcagcgaggcgggcgcacagcgcggggggcaactgcatcaccccgggcgcgggcgggcgcagcctgtcggccaccgtccgcgagccgagccggacgtgacgtcacgctcacttccgccgccgtcgggggctgcgcgggggctgtggctccgggactgcggagaacatattgtgatgttcgtgcctcagagctaaaactatgagtgaatttcggattcaccatgacgtcaatgaactgcttagcctgctgcgtgtccacggaggagatggggctgaggtctacattgacctgcttcaaaagaacaggaccccgtacgtcactaccactgtctctgctcacagtgccaaggttaaaattgcagagttttctcgtactccagaagactttctaaagaaatatgatgaactgaaatctaaaaatacaaggaaccttgacccgctggtgtacctgttgtcaaagctcacggaagacaaagagactctgcagtacttacaacagaatgcaaaagaaagagctgagcttgcagccgctgctgtgggcagcagtaccaccagcatcaacgtccctgccgcggcctccaagatctccatgcaggagcttgaggaactgaggaagcagcttggcagcgtggccacaggctccacgctgcagcagtctctggaacttaaaagaaagatgcttcgagacaagcagaacaaaaaaaattcaggccagcacctccccatcttcccagcatgggtgtatgagagacctgccctgatcggggatttcctgattggtgctggcatcagcacagacaccgctttgccgataggcacgttgcccctggcctcgcaggagtcggccgtggtggaggacctgctgtacgtgctggtgggcgtggacgggaggtacgtcagtgctcagcccctggctgggaggcagagccggaccttcctcgtggaccccaacctggacctgtccatcagggagctggtgcacaggatcctcccagtggccgccagctactccgctgtgaccaggttcattgaagagaagtcttccttcgagtacgggcaggtgaaccacgccctggcggccgccatgcgcaccctggtgaaggagcacctgattctggtgtcacagctggagcagctgcacaggcagggcctcctttcgctgcagaagctctggttctacatccagccagccatgcgcaccatggacatcctggcctccctcgccacctcggtggacaaaggcgaatgtcttggggggtccacgctgagcctgctccacgacaggagcttcagctacacaggggacagccaggcgcaggagctatgcctgtacctaaccaaggcggccagtgctccctacttcgaggttctggagaagtggatctacaggggcatcatccacgacccatacagtgagtttatggtcgaggagcacgagctgcggaaggagaggatccaggaggattacaacgacaagtactgggaccagcggtacaccatcgtccagcagcagatcccgtccttcctgcagaaaatggcggacaagatcctcagcacaggaaaatatctaaatgtggtcagagagtgtggccatgacgtcacctgcccggtggctaaagagatcatctacacgttaaaagagcgggcgtatgtggagcagatcgagaaggcgtttaactacgccagcaaggtgctgctggacttcctgatggaggagaaggagctggtggctcacctcaggtccatcaagcgctacttcctcatggaccagggcgacttcttcgtgcacttcatggacctcgcggaggaggagctccggaagccggtggaggacatcacgccccctcgcctggaagcgctcctggagctggcgctgcgcatgagcacggccaacactgaccccttcaaggacgacctcaagatcgacctgatgccccatgacctcatcactcagctcttgcgcgtcctggccatcgagaccaagcaggagaaggcgatggcgcacgccgaccccacggagctggcgctgagcggcctggaggccttctctttcgactacatcgtcaagtggcccctttcgctcatcatcaacaggaaagccctcactcgctaccagatgctcttcaggcacatgttctactgcaagcacgtggagcggcagctctgcagcgtctggatcagcaacaaaaccgccaagcagcactcgctgcactccgcccagtggtttgctggggctttcactctgcggcagcgaatgctcaacttcgtccagaatattcaatactacatgatgtttgaagtgatggaaccgacctggcacatcctggagaaaaacctgaaatccgcctccaacattgacgacgtccttggccaccacacaggcttcctggacacctgcctgaaggactgcatgctcaccaaccccgagctgctgaaggtcttctccaagctcatgtctgtgtgcgtcatgttcaccaactgcatgcagaaatttacacagagcatgaaattagatggcgagctgggcgggcagacgctggagcacagcaccgtcctggggctgcccgcaggggccgaggagcgggcccggaaggagctcgccaggaagcacctggctgagcacgcagacactgtgcagctggtgtccggcttcgaggccaccatcaacaagtttgacaagaacttctcagcccacctgctggacctcctggcccggctgagcatctatagcaccagtgactgtgagcacggcatggccagcgtcatctccaggcttgacttcaatggtttctacacggagcgcctggagcgcctgtctgcagagaggagccagaaggccaccccccaagtgcctgtcctgcgggggcccccggctcctgcacccagggtcgcagtcaccgcacagtgagccctggctgtgacaggaaggaagggtgtggggtcagcagggactggtgcaaatgggtccagaattttcaaatcgaatgctctgtgttctgtctttgcagtttaaatataaagcaggaatgattgactcagctcactttgtttctcaaggcgctgggtttcgttttatagaagctgcccaggcagggtggatgtctccctggatttgctaatctgtttgctttttgaaattacactatcacctttttgggtgtttttggcctcaaagtggaaatacatggtgtttaagccaggagcaagcaaagatgcatgtggggtaagatccaggcctggtgtccacatctttccgggtgagctggggccgggcttcctgaggtctgtcggaaccgggacaagcctctggaaacggtcagggagttgtggaaacccaccgggcatcgggtgtcgggtttgctttggccccagaggcagccccgttccttctcctgaggactcacccgcctccacgaccctcctcctgctgctgctccaactggtccagggcaggaggccacagacagggccctcaggcaccctgggagcccacacctccccctccgtgggagtgggtcgaggggcaggctctgctgctggctggaaaccccaccccgccctatccggtaccgccttgttacgtagaacttactcagcagactgacacccaatccccctcgggcgatcatctgccctgtcttcccacctccagggctacagtgggcagcaccgccatccccagtgtgacagggccctgggagcctcagggctgcccggccaggttggtctgctctggttacattctggccaagctgccccttcctgctgacctgcatgtgtattgttgtcaccttcagctctcagcacctcggcccccttgggcagtgaggaagggccctggaggcgaggttgggagaaaggatagctagaacaggatcctgcggggaacaagggttgtgggcagctctcacccggggctgcctcactgagagcaccgccgagtgggggtgggggtgtccaactctccagccacaaaccgcttcctccttgtctgcaggctgtgcaggtctggcctgtgagtaaacacatttatcagcaacccaa

SEQ ID NO: 196130 - DNA, 4029 bp, Homo sapiens
  Payload ID: 18692
  Gene Name: tubulin, gamma complex associated protein 2
  Uniprot ID: Q9BSJ2
  ENST ID: ENST00000417178
  CDS Start-End: 575-2893
ctcgccgccgtaggccccactggatcctacaactactttttccctcttttgctcacgcacctcgaagaactggtgctcccgcgggaagcgcacggggcgcgcaacgaagcgaaagggcgcggccccagccgcgggatcccgctctacaggcagcggctccgccgccccgggccccgcagcgaggcgggcgcacagcgcggggggcaactgcatcaccccgggcgcgggcgggcgcagcctgtcggccaccgtccgcgagccgagccggacgtgacgtcacgctcacttccgccgccgtcgggggctgcgcgggggctgtggctccgggactgcggttaaaattgcagagttttctcgtactccagaagactttctaaagaaatatgatgaactgaaatctaaaaatacaaggaaccttgacccgctggtgtacctgttgtcaaagctcacggaagacaaagagactctgcagtacttacaacagaatgcaaaagaaagagctgagcttgcagccgctgctgtgggcagcagtaccaccagcatcaacgtccctgccgcggcctccaagatctccatgcaggagcttgaggaactgaggaagcagcttggcagcgtggccacaggctccacgctgcagcagtctctggaacttaaaagaaagatgcttcgagacaagcagaacaaaaaaaattcaggccagcacctccccatcttcccagcatgggtgtatgagagacctgccctgatcggggatttcctgattggtgctggcatcagcacagacaccgctttgccgataggcacgttgcccctggcctcgcaggagtcggccgtggtggaggacctgctgtacgtgctggtgggcgtggacgggaggtacgtcagtgctcagcccctggctgggaggcagagccggaccttcctcgtggaccccaacctggacctgtccatcagggagctggtgcacaggatcctcccagtggccgccagctactccgctgtgaccaggttcattgaagagaagtcttccttcgagtacgggcaggtgaaccacgccctggcggccgccatgcgcaccctggtgaaggagcacctgattctggtgtcacagctggagcagctgcacaggcagggcctcctttcgctgcagaagctctggttctacatccagccagccatgcgcaccatggacatcctggcctccctcgccacctcggtggacaaaggcgaatgtcttggggggtccacgctgagcctgctccacgacaggagcttcagctacacaggggacagccaggcgcaggagctatgcctgtacctaaccaaggcggccagtgctccctacttcgaggttctggagaagtggatctacaggggcatcatccacgacccatacagtgagtttatggtcgaggagcacgagctgcggaaggagaggatccaggaggattacaacgacaagtactgggaccagcggtacaccatcgtccagcagcagatcccgtccttcctgcagaaaatggcggacaagatcctcagcacaggaaaatatctaaatgtggtcagagagtgtggccatgacgtcacctgcccggtggctaaagagatcatctacacgttaaaagagcgggcgtatgtggagcagatcgagaaggcgtttaactacgccagcaaggtgctgctggacttcctgatggaggagaaggagctggtggctcacctcaggtccatcaagcgctacttcctcatggaccagggcgacttcttcgtgcacttcatggacctcgcggaggaggagctccggaagccggtggaggacatcacgccccctcgcctggaagcgctcctggagctggcgctgcgcatgagcacggccaacactgaccccttcaaggacgacctcaagatcgacctgatgccccatgacctcatcactcagctcttgcgcgtcctggccatcgagaccaagcaggagaaggcgatggcgcacgccgaccccacggagctggcgctgagcggcctggaggccttctctttcgactacatcgtcaagtggcccctttcgctcatcatcaacaggaaagccctcactcgctaccagatgctcttcaggcacatgttctactgcaagcacgtggagcggcagctctgcagcgtctggatcagcaacaaaaccgccaagcagcactcgctgcactccgcccagtggtttgctggggctttcactctgcggcagcgaatgctcaacttcgtccagaatattcaatactacatgatgtttgaagtgatggaaccgacctggcacatcctggagaaaaacctgaaatccgcctccaacattgacgacgtccttggccaccacacaggcttcctggacacctgcctgaaggactgcatgctcaccaaccccgagctgctgaaggtcttctccaagctcatgtctgtgtgcgtcatgttcaccaactgcatgcagaaatttacacagagcatgaaattagatggcgagctgggcgggcagacgctggagcacagcaccgtcctggggctgcccgcaggggccgaggagcgggcccggaaggagctcgccaggaagcacctggctgagcacgcagacactgtgcagctggtgtccggcttcgaggccaccatcaacaagtttgacaagaacttctcagcccacctgctggacctcctggcccggctgagcatctatagcaccagtgactgtgagcacggcatggccagcgtcatctccaggcttgacttcaatggtttctacacggagcgcctggagcgcctgtctgcagagaggagccagaaggccaccccccaagtgcctgtcctgcgggggcccccggctcctgcacccagggtcgcagtcaccgcacagtgagccctggctgtgacaggaaggaagggtgtggggtcagcagggactggtgcaaatgggtccagaattttcaaatcgaatgctctgtgttctgtctttgcagtttaaatataaagcaggaatgattgactcagctcactttgtttctcaaggcgctgggtttcgttttatagaagctgcccaggcagggtggatgtctccctggatttgctaatctgtttgctttttgaaattacactatcacctttttgggtgtttttggcctcaaagtggaaatacatggtgtttaagccaggagcaagcaaagatgcatgtggggtaagatccaggcctggtgtccacatctttccgggtgagctggggccgggcttcctgaggtctgtcggaaccgggacaagcctctggaaacggtcagggagttgtggaaacccaccgggcatcgggtgtcgggtttgctttggccccagaggcagccccgttccttctcctgaggactcacccgcctccacgaccctcctcctgctgctgctccaactggtccagggcaggaggccacagacagggccctcaggcaccctgggagcccacacctccccctccgtgggagtgggtcgaggggcaggctctgctgctggctggaaaccccaccccgccctatccggtaccgccttgttacgtagaacttactcagcagactgacacccaatccccctcgggcgatcatctgccctgtcttcccacctccagggctacagtgggcagcaccgccatccccagtgtgacagggccctgggagcctcagggctgcccggccaggttggtctgctctggttacattctggccaagctgccccttcctgctgacctgcatgtgtattgttgtcaccttcagctctcagcacctcggcccccttgggcagtgaggaagggccctggaggcgaggttgggagaaaggatagctagaacaggatcctgcggggaacaagggttgtgggcagctctcacccggggctgcctcactgagagcaccgccgagtgggggtgggggtgtccaactctccagccacaaaccgcttcctccttgtctgcaggctgtgcaggtctggcctgtgagtaaacacatttatcagcaacccaa

SEQ ID NO: 196131 - DNA, 3553 bp, Homo sapiens
  Payload ID: 18692
  Gene Name: tubulin, gamma complex associated protein 2
  ENST ID: ENST00000482278
  CDS Start-End: 758-2923
taaaatcaactttaactagaaaggcagacggcacaggtgacgctagaaaggcagacagtacaggtcatgctagaaaggcagacggcacaggtcatgctaggaaggcagacggcacaggtgacgctagaaacgcagacggcacaggtgacgctagaaacgcagacggcacaggtgatgctattaaggcagacgcctgggttgtgactgaagcaactgcaagtgagactctttccatcccactcagacaatgaggaaaagtgagtggtgcttggcattcctgcgcttcaatggctcaaaaacagagtatgcgagagaaactaagttattcacaggacctgagatatctggactttcttctctggcggaagccgattttcttacccagcgttacctttctgaattcagtatgagaagagctgcggcccaggtgcagcccagaatcctcagcaccgaacacatgttgagaacgggtttcagaaagagctcagacactgacctatgtctgtagatccgcctctcacctgccggtgcaggggaggctgccacaggctcagagcagatttccatggcctccccttctgaccgctctccactgtcccctggggcttctgctgaggctgggctgcggggagagagcagtgagtaactgccctgcacggctcccacagcccctgtgttccccagaaatgaacatgcaagaaagaaactggatttccctgagaacatattgtgatgttcgtgcctcagagctaaaactatgagtgaatttcggattcaccatgacgtcaatgaactgcttagcctgctgcgtgtccacggaggagatggggctgaggtctacattgacctgcttcaaaagaacaggaccccgtacgtcactaccactgtctctgctcacagtgccaaggttaaaattgcagagttttctcgtactccagaagactttctaaagaaatatgatgaactgaaatctaaaaatacaaggaaccttgacccgctggtgtacctgttgtcaaagctcacggaagacaaagagactctgcagtacttacaacagaatgcaaaagaaagagctgagcttgcagccgctgctgtgggcagcagtaccaccagcatcaacgtccctgccgcggcctccaagatctccatgcaggagcttgaggaactgaggaagcagcttggcagcgtggccacaggctccacgctgcagcagtctctggaacttaaaagaaagatgcttcgagacaagcagaacaaaaaaaattcaggccagcacctccccatcttcccagcatgggtgtatgagagacctgccctgatcggggatttcctgattggtgctggcatcagcacagacaccgctttgccgataggcacgttgcccctggcctcgcaggagtcggccgtggtggaggacctgctgtacgtgctggtgggcgtggacgggaggtacgtcagtgctcagcccctggctgggaggcagagccggaccttcctcgtggaccccaacctggacctgtccatcagggagctggtgcacaggatcctcccagtggccgccagctactccgctgtgaccaggttcattgaagagaagtcttccttcgagtacgggcaggtgaaccacgccctggcggccgccatgcgcaccctggtgaaggagcacctgattctggtgtcacagctggagcagctgcacaggcagggcctcctttcgctgcagaagctctggttctacatccagccagccatgcgcaccatggacatcctggcctccctcgccacctcggtggacaaaggcgaatgtcttggggggtccacgctgagcctgctccacgacaggagcttcagctacacaggggacagccaggcgcaggagctatgcctgtacctaaccaaggcggccagtgctccctacttcgaggttctggagaagtggatctacaggggcatcatccacgacccatacagtgagtttatggtcgaggagcacgagctgcggaaggagaggatccaggaggattacaacgacaagtactgggaccagcggtacaccatcgtccagcagcagatcccgtccttcctgcagaaaatggcggacaagatcctcagcacaggaaaatatctaaatgtggtcagagagtgtggccatgacgtcacctgcccggtggctaaagagatcatctacacgttaaaagagcgggcgtatgtggagcagatcgagaaggcgtttaactacgccagcaaggtgctgctggacttcctgatggaggagaaggagctggtggctcacctcaggtccatcaagcgctacttcctcatggaccagggcgacttcttcgtgcacttcatggacctcgcggaggaggagctccggaagccggtggaggacatcacgccccctcgcctggaagcgctcctggagctggcgctgcgcatgagcacggccaacactgaccccttcaaggacgacctcaagatcgacctgatgccccatgacctcatcactcagctcttgcgcgtcctggccatcgagaccaagcaggagaaggcgatggcgcacgccgaccccacggagctggcgctgagcggcctggaggccttctctttcgactacatcgtcaagtggcccctttcgctcatcatcaacaggaaagccctcactcgctaccagatgctcttcaggcacatgttctactgcaagcacgtggagcggcagctctgcagcgtctggatcagcaacaaaaccgccaagcagcactcgctgcactccgcccagtggtttgctggggctttcactctgcggcagcgaatgctcaacttcgtccagaatattcaatactacatgatgtttgaagtgatggaaccgacctggcacatcctggagaaaaacctgaaatccgcttcctggacacctgcctgaaggactgcatgctcaccaaccccgagctgctgaaggtcttctccaagctcatgtctgtgtgcgtcatgttcaccaactgcatgcagaaatttacacagagcatgaaattagatggcgagctgggcgggcagacgctggagcacagcaccgtcctggggctgcccgcaggggccgaggagcgggcccggaaggagctcgccaggaagcacctggctgagcacgcagacactgtgcagctggtgtccggcttcgaggccaccatcaacaagtttgacaagaacttctcagcccacctgctggacctcctggcccggctgagcatctatagcaccagtgactgtgagcacggcatggccagcgtcatctccaggcttgacttcaatggtttctacacggagcgcctggagcgcctgtctgcagagaggagccagaaggccaccccccaagtgcctgtcctgcgggggcccccggctcctgcacccagggtcgcagtcaccgcacagtgagccctggctgtgacaggaaggaagggtgtggggtcagcagggactggtgcaaatgggtccagaattttcaaatcgaatgctctgtgttctgtctttgcagtttaaatataaagcaggaatgatt

SEQ ID NO: 196132 - DNA, 4302 bp, Homo sapiens
  Payload ID: 18692
  Gene Name: tubulin, gamma complex associated protein 2
  Uniprot ID: Q9BSJ2
  ENST ID: ENST00000543663
  CDS Start-End: 374-3166
ctcgccgccgtaggccccactggatcctacaactactttttccctcttttgctcacgcacctcgaagaactggtgctcccgcgggaagcgcacggggcgcgcaacgaagcgaaagggcgcggccccagccgcgggatcccgctctacaggcagcggctccgccgccccgggccccgcagcgaggcgggcgcacagcgcggggggcaactgcatcaccccgggcgcgggcgggcgcagcctgtcggccaccgtccgcgagccgagccggacgtgacgtcacgctcacttccgccgccgtcgggggctgcgcgggggctgtggctccgggactgcggagaacatattgtgatgttcgtgcctcagagctaaaactatgagtgaatttcggattcaccatgacgtcaatgaactgcttagcctgctgcgtgtccacggaggagatggggctgaggtctacattgacctgcttcaaaagaacaggaccccgtacgtcactaccactgtctctgctcacagtgccaaggttaaaattgcagagttttctcgtactccagaagactttctaaagaaatatgatgaactgaaatctaaaaatacaaggaaccttgacccgctggtgtacctgttgtcaaagctcacggaagacaaagagactctgcagtacttacaacagaatgcaaaagaaagagctgagcttgcagccgctgctgtgggcagcagtaccaccagcatcaacgtccctgccgcggcctccaagatctccatgcaggagcttgaggaactgaggaagcagcttggcagcgtggccacaggctccacgctgcagcagtctctggaacttaaaagaaagatgcttcgagacaagcagaacaaaaaaaattcaggccagcacctccccatcttcccagcatgggtgtatgagagacctgccctgatcggggatttcctgattggtgctggcatcagcacagacaccgctttgccgatagttcttttgagatggaatctcgctctgtcgcccaggctgaagtgcagtggcgtgatctcggcacactgcaacctccacctcccaggcacgttgcccctggcctcgcaggagtcggccgtggtggaggacctgctgtacgtgctggtgggcgtggacgggaggtacgtcagtgctcagcccctggctgggaggcagagccggaccttcctcgtggaccccaacctggacctgtccatcagggagctggtgcacaggatcctcccagtggccgccagctactccgctgtgaccaggttcattgaagagaagtcttccttcgagtacgggcaggtgaaccacgccctggcggccgccatgcgcaccctggtgaaggagcacctgattctggtgtcacagctggagcagctgcacaggcagggcctcctttcgctgcagaagctctggttctacatccagccagccatgcgcaccatggacatcctggcctccctcgccacctcggtggacaaaggcgaatgtcttggggggtccacgctgagcctgctccacgacaggagcttcagctacacaggggacagccaggcgcaggagctatgcctgtacctaaccaaggcggccagtgctccctacttcgaggttctggagaagtggatctacaggggcatcatccacgacccatacagtgagtttatggtcgaggagcacgagctgcggaaggagaggatccaggaggattacaacgacaagtactgggaccagcggtacaccatcgtccagcagcagatcccgtccttcctgcagaaaatggcggacaagatcctcagcacaggaaaatatctaaatgtggtcagagagtgtggccatgacgtcacctgcccggtggctaaagagatcatctacacgttaaaagagcgggcgtatgtggagcagatcgagaaggcgtttaactacgccagcaaggtgctgctggacttcctgatggaggagaaggagctggtggctcacctcaggtccatcaagcgctacttcctcatggaccagggcgacttcttcgtgcacttcatggacctcgcggaggaggagctccggaagccggtggaggacatcacgccccctcgcctggaagcgctcctggagctggcgctgcgcatgagcacggccaacactgaccccttcaaggacgacctcaagatcgacctgatgccccatgacctcatcactcagctcttgcgcgtcctggccatcgagaccaagcaggagaaggcgatggcgcacgccgaccccacggagctggcgctgagcggcctggaggccttctctttcgactacatcgtcaagtggcccctttcgctcatcatcaacaggaaagccctcactcgctaccagatgctcttcaggcacatgttctactgcaagcacgtggagcggcagctctgcagcgtctggatcagcaacaaaaccgccaagcagcactcgctgcactccgcccagtggtttgctggggctttcactctgcggcagcgaatgctcaacttcgtccagaatattcaatactacatgatgtttgaagtgatggaaccgacctggcacatcctggagaaaaacctgaaatccgcctccaacattgacgacgtccttggccaccacacaggcttcctggacacctgcctgaaggactgcatgctcaccaaccccgagctgctgaaggtcttctccaagctcatgtctgtgtgcgtcatgttcaccaactgcatgcagaaatttacacagagcatgaaattagatggcgagctgggcgggcagacgctggagcacagcaccgtcctggggctgcccgcaggggccgaggagcgggcccggaaggagctcgccaggaagcacctggctgagcacgcagacactgtgcagctggtgtccggcttcgaggccaccatcaacaagtttgacaagaacttctcagcccacctgctggacctcctggcccggctgagcatctatagcaccagtgactgtgagcacggcatggccagcgtcatctccaggcttgacttcaatggtttctacacggagcgcctggagcgcctgtctgcagagaggagccagaaggccaccccccaagtgcctgtcctgcgggggcccccggctcctgcacccagggtcgcagtcaccgcacagtgagccctggctgtgacaggaaggaagggtgtggggtcagcagggactggtgcaaatgggtccagaattttcaaatcgaatgctctgtgttctgtctttgcagtttaaatataaagcaggaatgattgactcagctcactttgtttctcaaggcgctgggtttcgttttatagaagctgcccaggcagggtggatgtctccctggatttgctaatctgtttgctttttgaaattacactatcacctttttgggtgtttttggcctcaaagtggaaatacatggtgtttaagccaggagcaagcaaagatgcatgtggggtaagatccaggcctggtgtccacatctttccgggtgagctggggccgggcttcctgaggtctgtcggaaccgggacaagcctctggaaacggtcagggagttgtggaaacccaccgggcatcgggtgtcgggtttgctttggccccagaggcagccccgttccttctcctgaggactcacccgcctccacgaccctcctcctgctgctgctccaactggtccagggcaggaggccacagacagggccctcaggcaccctgggagcccacacctccccctccgtgggagtgggtcgaggggcaggctctgctgctggctggaaaccccaccccgccctatccggtaccgccttgttacgtagaacttactcagcagactgacacccaatccccctcgggcgatcatctgccctgtcttcccacctccagggctacagtgggcagcaccgccatccccagtgtgacagggccctgggagcctcagggctgcccggccaggttggtctgctctggttacattctggccaagctgccccttcctgctgacctgcatgtgtattgttgtcaccttcagctctcagcacctcggcccccttgggcagtgaggaagggccctggaggcgaggttgggagaaaggatagctagaacaggatcctgcggggaacaagggttgtgggcagctctcacccggggctgcctcactgagagcaccgccgagtgggggtgggggtgtccaactctccagccacaaaccgcttcctccttgtctgcaggctgtgcaggtctggcctgtgagtaaacacatttatcagcaacccaa

SEQ ID NO: 196133 - DNA, 1092 bp, Homo sapiens
  Payload ID: 18692
  Gene Name: tubulin, gamma complex associated protein 2
  ENST ID: ENST00000487796
  CDS Start-End: 78-314
gtcgggggctgcgcgggggctgtggctccgggactgcggagaacatattgtgatgttcgtgcctcagagctaaaactatgagtgaatttcggattcaccatgacgtcaatgaactgcttagcctgctgcgtgtccacggaggagatggggctgaggtctacattgacctgcttcaaaagaacaggaccccgtacgtcactaccactgtctctgctcacagtgccaaggctggaatgcatgtggcacgatcttgtcttactgcagtctcaacctcccaggctgatgtgatcctcccatctcagcttcccaagtagtgaccacaggcaagtgccaccacgcctcgctaatttttgaatctttttgtagaaatggggttttgttattttggccaggctggtcttgaactcctggactcaagcagtctaccagcctcggcctcccaaagtgctgggattacagtcatgagccactgcctagctcaaaacatggataagtttaacacaatatggagatgagttttgttagtttatttcagagggataattatttaacctacccaatttaattccattggcttattgtgttcaattttcgtaaaggtttttttttacagtgctttattaattaccgtcattaaatcactcatgtttgtgcttttgaggttaaaattgcagagttttctcgtactccagaagactttctaaagaaatatgatgaactgaaatctaaaaatacaaggaaccttgacccgctggtgtacctgttgtcaaagctcacggaagacaaagagactctgcagtacttacaacagaatgcaaaagaaagagctgagcttgcagccgctgctgtgggcagcagtaccaccagcatcaacgtccctgccgcggcctccaagatctccatgcaggagcttgaggaactgaggaagcagcttggcagcgtggccacaggctccacgctgcagcagtctctggaacttaaaagaaagatgcttcgagacaagcagaacaaaaaaaattcaggccagcacctccccatcttcccagcatgggtgtatgagagacctgccctgatcggggatttcctgattgg

SEQ ID NO: 196134 - DNA, 3899 bp, Homo sapiens
  Payload ID: 18693
  Gene Name: tubulin, gamma complex associated protein 3
  Uniprot ID: Q96CW5
  ENST ID: ENST00000261965
  CDS Start-End: 188-2911
tgtgggaagcgcccgcgctttcggcgggttccgttaaaatggcgccctggtggccggcggcgcccgcgccttagcctgtcaggagcagggagcttgcggggcgcaggaagggcgcgggccgcggtccctgcgcgtgcggcggcagtggcggctctgcccggaccaccgtgcacggctccgggcgaggatggcgaccccggaccagaagtcgccgaacgttctgctgcagaacctgtgctgcaggatcctgggcaggagcgaagctgatgtagcccagcagttccagtatgctgtgcgggtgattggcagcaacttcgccccaactgttgaaagagatgaatttttagtagctgaaaaaatcaagaaagagcttattcgacaacgaagagaagcagatgctgcattattttcagaactccacagaaaacttcattcacagggagttttgaaaaataaatggtcaatactctacctcttgctgagcctcagtgaggacccacgcaggcagccaagcaaggtttctagctatgctacgttatttgctcaggccttaccaagagatgcccactcaaccccttactactatgccaggcctcagacccttcccctgagctaccaagatcggagtgcccagtcagcccagagctccggcagcgtgggcagcagtggcatcagcagcattggcctgtgtgccctcagtggccccgcgcctgcgccacaatctctcctcccaggacagtctaatcaagctccaggagtaggagattgccttcgacagcagttggggtcacgactcgcatggactttaactgcaaatcagccttcttcacaagccactacctcaaaaggtgtccccagtgctgtgtctcgcaacatgacaaggtccaggagagaaggggatacgggtggtactatggaaattacagaagcagctctggtaagggacattttgtacgtctttcagggcatagatggcaaaaacatcaaaatgaacaacactgaaaattgttacaaagtagaaggaaaggcaaatctaagtaggtctttgagagacacagcagtcaggctttctgagttgggatggttgcataataaaatcagaagatacacggaccagaggagcctggaccgctcattcggactcgtcgggcagagcttttgtgctgccttgcaccaggaactcagagaatactatcgattgctctctgttttacattctcagctacaactagaggatgaccagggtgtgaatttgggacttgagagtagtttaacacttcggcgcctcctggtttggacctatgatcccaaaatacgactgaagacccttgcggccctagtggaccactgccaaggaaggaaaggaggtgagctggcctcagctgtccacgcctacacaaaaacaggagacccgtacatgcggtctctggtgcagcacatcctcagcctcgtgtctcatcctgttttgagcttcctgtaccgctggatatatgatggggagcttgaggacacttaccacgaattttttgtagcatcagatccaacagttaaaacagatcgactgtggcacgacaagtatactttgaggaaatcgatgattccttcgtttatgacgatggatcagtctaggaaggtccttttgataggaaaatcaataaatttcttgcaccaagtttgtcatgatcagactcccactacaaagatgatagctgtgaccaagtctgcagagtcaccccaggacgctgcagacctattcacagacttggaaaatgcatttcaggggaagattgatgctgcttattttgagaccagcaaatacctgttggatgttctcaataaaaagtacagcttgctggaccacatgcaggcaatgaggcggtacctgcttcttggtcaaggagactttataaggcacttaatggacttgctaaaaccagaacttgtccgtccagctacgactttgtatcagcataacttgactggaattctagaaaccgctgtcagagccaccaacgcacagtttgacagtcctgagatcctgcgaaggctggacgtgcggctgctggaggtctctccaggtgacactggatgggatgtcttcagcctcgattatcatgttgacggaccaattgcaactgtgtttactcgagaatgtatgagccactacctaagagtatttaacttcctctggagggcgaagcggatggaatacatcctcactgacatacggaagggacacatgtgcaatgcaaagctcctgagaaacatgccagagttctccggggtgctgcaccagtgtcacattttggcctctgagatggtccatttcattcatcagatgcagtattacatcacatttgaggtgcttgaatgttcttgggatgagctttggaacaaagtccagcaggcccaggatttggatcacatcattgctgcacacgaggtgttcttagacaccatcatctcccgctgcctgctggacagtgactccagggcacttttaaatcaacttagagctgtgtttgatcaaattattgaacttcagaatgctcaagatgcaatatacagagctgctctggaagaattgcagagacgattacagtttgaagagaaaaagaaacagcgtgaaattgagggccagtggggagtgacggcagcagaggaagaggaggaaaataagaggattggagaatttaaagaatctataccaaaaatgtgctcacagttgcgaatattgacccatttctaccagggtatcgtgcagcagtttttggtgttactgacgaccagctctgacgagagtcttcggtttcttagcttcaggctggacttcaacgagcattacaaagccagggagcccaggctccgtgtgtctctgggtaccagggggcggcgcagctcccacacgtgaagctcgcggtcctcccagggagctgcgggtgatgttcgttgcactgctagacacgaaattcccattgacgtcctgcaggaactgcatgctgcaggtgtcctgcccttccgcccacgagtgcgccatgtttcagcggagcggcgtgtgggagaagccacgtcgtgtttcacatgtcggagtcgaatgcatttgtaaatccctaagtcaagtaggctggctgcactgttcacatttgtctctaaaagtcttcatcgctaaaagataccataatttgctgaggcttcttaagctttctatgttataatttatatttgtcactttaaaaaatccatttcttttagaaaaaattagggtgataggatattcattagttaagatggtaacgtcattgctatttttttaacatcctctttagaggtaatttttgttaacataaccaaaaattaaattgaaacaaaatgtcccaactaagaaaatatatagagcattttatttttttttagtgttgtaaaatattaacctctgtgagatcctttgtatcttaatgcattacctttacacatatttattcttattttctctcctttcagagtttacatttttatatttaatttactatttcagatttttaaaatagtatagaaaaaagtaggagtgatagagaacaaaaatactcttatacagtgcaacccaaataccgcgaatgcatcagctaaagcagcgtgtaaataggagtgacgagaaagttaatggagtattttattttcaaagttcctgataagcattggaaagaaatcgacatggataatgaagatttcctttttccttgcctattttttcattgtaaatatttatatactactgaccaagatgttggggtgggggggattgttttttgtaaaaatgtcattatcaggtcacataaatctgcctttatgttgcataagtgaaaatttagaaaattaaaagcaattatctttcagatgca

SEQ ID NO: 196135 - DNA, 2723 bp, Homo sapiens
  Payload ID: 18693
  Gene Name: tubulin, gamma complex associated protein 3
  Uniprot ID: Q96CW5
  ENST ID: ENST00000375669
  CDS Start-End: 146-2620
cgccctggtggccggcggcgcccgcgccttagcctgtcaggagcagggagcttgcggggcgcaggaagggcgcgggccgcggtccctgcgcgtgcggcggcagtggcggctctgcccggaccaccgtgcacggctccgggcgaggatggcgaccccggaccagaagtcgccgaacgttctgctgcagaacctgtgctgcaggatcctgggcaggagcgaagctgatgtagcccagcagttccagtatgctgtgcgggtgattggcagcaacttcgccccaactgttgaaagagatgaatttttagtagctgaaaaaatcaagaaagagcttattcgacaacgaagagaagcagatgctgcattattttcagaactccacagaaaacttcattcacagggagttttgaaaaataaatggtcaatactctacctcttgctgagcctcagtgaggacccacgcaggcagccaagcaaggtttctagctatgctacgttatttgctcaggccttaccaagagatgcccactcaaccccttactactatgccaggcctcagacccttcccctgagctaccaagatcggagtgcccagtcagcccagagctccggcagcgtgggcagcagtggcatcagcagcattggcctgtgtgccctcagtggccccgcgcctgcgccacaatctctcctcccaggacagtctaatcaagctccaggagtaggagattgccttcgacagcagttggggtcacgactcgcatggactttaactgcaaatcagccttcttcacaagccactacctcaaaaggtgtccccagtgctgtgtctcgcaacatgacaaggtccaggagagaaggggatacgggtggtactatggaaattacagaagcagctctggtaagggacattttgtacgtctttcagggcatagatggcaaaaacatcaaaatgaacaacactgaaaattgttacaaagtagaaggaaaggcaaatctaagtaggtctttgagagacacagcagtcaggctttctgagttgggatggttgcataataaaatcagaagatacacggaccagaggagcctggaccgctcattcggactcgtcgggcagagcttttgtgctgccttgcaccaggaactcagagaatactatcgattgctctctgttttacattctcagctacaactagaggatgaccagggtgtgaatttgggacttgagagtagtttaacacttcggcgcctcctggtttggacctatgatcccaaaatacgactgaagacccttgcggccctagtggaccactgccaaggaaggaaaggaggtgagctggcctcagctgtccacgcctacacaaaaacaggagacccgtacatgcggtctctggtgcagcacatcctcagcctcgtgtctcatcctgttttgagcttcctgtaccgctggatatatgatggggagcttgaggacacttaccacgaattttttgtagcatcagatccaacagttaaaacagatcgactgtggcacgacaagtatactttgaggaaatcgatgattccttcgtttatgacgatggatcagtctaggaaggtccttttgataggaaaatcaataaatttcttgcaccaagtttgtcatgatcagactcccactacaaagatgatagctgtgaccaagtctgcagagtcaccccaggacgctgcagacctattcacagacttggaaaatgcatttcaggggaagattgatgctgcttattttgagaccagcaaatacctgttggatgttctcaataaaaagtacagcttgctggaccacatgcaggcaatgaggcggtacctgcttcttggtcaaggagactttataaggcacttaatggacttgctaaaaccagaacttgtccgtccagctacgactttgtatcagcataacttgactggaattctagaaaccgctgtcagagccaccaacgcacagtttgacagtcctgagatcctgcgaaggctggacgtgcggctgctggaggtctctccaggtgacactggatgggatgtcttcagcctcgattatcatgttgacggaccaattgcaactgtgtttactcgagaatgtatgagccactacctaagagtatttaacttcctctggagggcgaagcggatggaatacatcctcactgacatacggaagggacacatgtgcaatgcaaagctcctgagaaacatgccagagttctccggggtgctgcaccagtgtcacattttggcctctgagatggtccatttcattcatcagatgcagtattacatcacatttgaggtgcttgaatgttcttgggatgagctttggaacaaagtccagcaggcccaggatttggatcacatcattgctgcacacgaggtgttcttagacaccatcatctcccgctgcctgctggacagtgactccagggcacttttaaatcaacttagagctgtgtttgatcaaattattgaacttcagaatgctcaagatgcaatatacagagctgctctggaagaattgcagagacgattacagtttgaagagaaaaagaaacagcgtgaaattgaggttgagatgtgcctatactgcgtttgaagtcccgagaaatcactgacagttgtaaagagggaggggccaccctcactggcatcatcatcctgtttcacaaaataaataaaaacagcagcattcatgagaa

SEQ ID NO: 196136 - DNA, 2461 bp, Homo sapiens
  Payload ID: 18693
  Gene Name: tubulin, gamma complex associated protein 3
  ENST ID: ENST00000464139
  CDS Start-End: 156-1475
gttaaaatggcgccctggtggccggcggcgcccgcgccttagcctgtcaggagcagggagcttgcggggcgcaggaagggcgcgggccgcggtccctgcgcgtgcggcggcagtggcggctctgcccggaccaccgtgcacggctccgggcgaggatggcgaccccggaccagaagtcgccgaacgttctgctgcagaacctgtgctgcaggatcctgggcaggagcgaagctgatgtagcccagcagttccagtatgctgtgcgggtgattggcagcaacttcgccccaactgttgaaagagatgaatttttagtagctgaaaaaatcaagaaagagcttattcgacaacgaagagaagcagatgctgcattattttcagaactccacagaaaacttcattcacagggagttttgaaaaataaatggtcaatactctacctcttgctgagcctcagtgaggacccacgcaggcagccaagcaaggtttctagctatgctacgttatttgctcaggccttaccaagagatgcccactcaaccccttactactatgccaggcctcagacccttcccctgagctaccaagatcggagtgcccagtcagcccagagctccggcagcgtgggcagcagtggcatcagcagcattggcctgtgtgccctcagtggccccgcgcctgcgccacaatctctcctcccaggacagtctaatcaagctccaggagtaggagattgccttcgacagcagttggggtcacgactcgcatggactttaactgcaaatcagccttcttcacaagccactacctcaaaaggtgtccccagtgctgtgtctcgcaacatgacaaggtccaggagagaaggggatacgggtggtactatggaaattacagaagcagctctggtaagggacattttgtacgtctttcagggcatagatggcaaaaacatcaaaatgaacaacactgaaaattgttacaaagtagaaggaaaggcaaatctaagtaggtctttgagagacacagcagtcaggctttctgagttgggatggttgcataataaaatcagaagatacacggaccagaggagcctggaccgctcattcggactcgtcgggcagagcttttgtgctgccttgcaccaggaactcagagaatactatcgattgctctctgttttacattctcagctacaactagaggatgaccagggtgtgaatttgggacttgagagtagtttaacacttcggcgcctcctggtttggacctatgatcccaaaatacgactgaagacccttgcggccctagtggaccactgccaaggtcccacgcgcgtctttcccacgcacgtctttcccacgcgcgactttcccacgcgcgactttcccacgcgcgactttcccatgcacgtctttcccacgcgcgtctttcccacgcgcgtctggcactcgctttgtttcagaactcgtttgtagggtgcgccatccaggcttgcttttgtgtcctgcccgtttttgtccttaatggccgtgttgattcgataggaatcgacagatgggagccaagaggggacgtaaccacttgccagtgtggcccagtatttatatggtagaagctcgggctggcattgagatggaggtgggaaagaggagggtgtctcgtgtttaaagatttctctcttgtgtggtccttggttatggctccccatggtgcttgctgctcccttggtcgcctttccttgcattttgctttttgcctttagtccttctgcagtcagggaccatgttggtgactctcggtcagatgttcccatatttgcatgtcttgctttggcctctctggctctaggttctgtattgctagttgctttctgacattttttctcattgtttgtgctaccttggccaagaacctctttgccttctccctcgtttgtaacattgagatcctagtagcagttacttcttagggttgttaggatgacatgagatgggcgagttggccatctgccacacaagagttcccttctcactgccatcctctgcccagggtgttccccagaatctgcagggccccattggtcatcttgctgtctgcacaccttcctctctcacctcttggcacttccctcaaaaaagagagaagtggagcacagtaaataaacgccagcgttttctccagttcccagcacctctccggaactggatcccccaaactcctctgtcactttctgtgtccagcgggcccctggggtccttcactgtcttcactctgctcagcctgtgcgcttggccttggtgctgtagggactgttataagagctgctgtccgatccccatattcaatctcacagccccactttgtgtacacacaccagagccatcttcttaaaatcagatcctgtcactcctctccctaaaatctaccagtggtctaataaaatcttgaatttttagcataa

SEQ ID NO: 196137 - DNA, 2451 bp, Homo sapiens
  Payload ID: 18693
  Gene Name: tubulin, gamma complex associated protein 3
  ENST ID: ENST00000618439
  CDS Start-End: 156-1469
gttaaaatggcgccctggtggccggcggcgcccgcgccttagcctgtcaggagcagggagcttgcggggcgcaggaagggcgcgggccgcggtccctgcgcgtgcggcggcagtggcggctctgcccggaccaccgtgcacggctccgggcgaggatggcgaccccggaccagaagtcgccgaacgttctgctgcagaacctgtgctgcaggatcctgggcaggagcgaagctgatgtagcccagcagttccagtatgctgtgcgggtgattggcagcaacttcgccccaactgttgaaagagatgaatttttagtagctgaaaaaatcaagaaagagcttattcgacaacgaagagaagcagatgctgcattattttcagaactccacagaaaacttcattcacagggagttttgaaaaataaatggtcaatactctacctcttgctgagcctcagtgaggacccacgcaggcagccaagcaaggtttctagctatgctacgttatttgctcaggccttaccaagagatgcccactcaaccccttactactatgccaggcctcagacccttcccctgagctaccaagatcggagtgcccagtcagcccagagctccggcagcgtgggcagcagtggcatcagcagcattggcctgtgtgccctcagtggccccgcgcctgcgccacaatctctcctcccaggacagtctaatcaagctccaggagtaggagattgccttcgacagcagttggggtcacgactcgcatggactttaactgcaaatcagccttcttcacaagccactacctcaaaaggtgtccccagtgctgtgtctcgcaacatgacaaggtccaggagagaaggggatacgggtggtactatggaaattacagaagcagctctggtaagggacattttgtacgtctttcagggcatagatggcaaaaacatcaaaatgaacaacactgaaaattgttacaaagtagaaggaaaggcaaatctaagtaggtctttgagagacacagcagtcaggctttctgagttgggatggttgcataataaaatcagaagatacacggaccagaggagcctggaccgctcattcggactcgtcgggcagagcttttgtgctgccttgcaccaggaactcagagaatactatcgattgctctctgttttacattctcagctacaactagaggatgaccagggtgtgaatttgggacttgagagtagtttaacacttcggcgcctcctggtttggacctatgatcccaaaatacgactgaagacccttgcggccctagtggaccactgccaaggtcccacgcgcgtctttcccacgcacgtctttcccacgcgcgactttcccacgcgcgactttcccacgcgcgactttcccacgtctttcccacgcgtctttcccacgcgcgtctggcactcgctttgtttcagaactcgtttgtagggtgcgccatccaggcttgcttttgtgtcctgcccgtttttgtccttaatggccgtgttgattcgataggaatcgacagatgggagccaagaggggacgtaaccacttgccagtgtggcccagtatttatatggtagaagctcgggctggcattgagatggaggtgggaaagaggagggtgtctcgtgtttaaagatttctctcttgtgtggtccttggttatggctccccatggtgcttgctgctcccttggtcgcctttccttgcattttgctttttgcctttagtccttctgcagtcagggaccatgttggtgactctcggtcagatgttcccatatttgcatgtcttgctttggcctctctggctctaggttctgtattgctagttgctttctgacattttttctcattgtttgtgctaccttggccaagaacctctttgccttctccctcgtttgtaacattgagatcctagtagcagttacttcttagggttgttaggatgacatgagatgggcgagttggccatctgccacacaagagttcccttctcactgccatcctctgcccagggtgttccccagaatctgcagggccccattggtcatcttgctgtctgcacaccttcctctctcacctcttggcacttccctcaaaaaagagagaagtggagcacagtaaataaacgccagcgttttctccagttcccagcacctctccggaactggatcccccaaactcctctgtcactttctgtgtccagcgggcccctggggtccttcactgtcttcactctgctcagcctgtgcgcttggccttggtgctgtagggactgttataagagctgctgtccgatccccatattcaatctcacagccccactttgtgtacacacaccagagccatcttcttaaaatcagatcctgtcactcctctccctaaaatctaccagtggtctaataaaatcttgaatttttagc

SEQ ID NO: 196138 - DNA, 1508 bp, Homo sapiens
  Payload ID: 18693
  Gene Name: tubulin, gamma complex associated protein 3
  ENST ID: ENST00000611152
  CDS Start-End: 1-389
tttgtgctgccttgcaccaggaactcagagaatactatcgattgctctctgttttacattctcagctacaactagaggatgaccagggtgtgaatttgggacttgagagtagtttaacacttcggcgcctcctggtttggacctatgatcccaaaatacgactgaagacccttgcggccctagtggaccactgccaaggaaggaaaggaggtgagctggcctcagctgtccacgcctacacaaaaacaggagacccgtacatgcggtctctggtgcagcacatcctcagcctcgtgtctcatcctgttttgagcttcctgtaccgctggatatatgatggggagcttgaggacacttaccacgaagtaaggatcggtgttcggttctgagacttggatttaaaaagcatgggcacgcagttatgctgtttcatttttcccctcatgattaccatgttctcctaacaggaatgcaactgcacttccattgaataccatatacattttacacagtgcctcgacagctggttatctcactgaacagcagataagttcacgagttctttggttagtggagaattgtcccagtttattcctcagcaaggtggaatcactcgtccgagtttactagcacgtggatggcaaaacaggacgaggcctcctgagtcttggggcagtcatcatcgcagattctgctgctttgccatgattactttgcaaactcactttggtgctaacagcttaatgaaacaagttagttgtgtatgtagctattgaaatagggtcagttctgtaacgcagcatgtgctgcttaaaaatcactgttgtgtaaatcacatgatagaaatgatagggcttttggtggaaggtagggtgaggggcaccacactcaaaacctttgtcagtaagacaggaatctaacaaaagttgtagtgcagtttaacacgttaaagtttaagaaatacataagcactgccataaatatcacattggccttggaaaaaccctggcgctttcttgtgggagtgggccgtcggggccgcagactgtgtgtggcgggaagtggcggaggcctggccatctgaaacaggtgtgccttgtgtgggcgctgctggctgcagtggcctgtgttctcctgccgtttctcatggatgaaattgcaaataagcaagcgtgaggtttgtattacattcaatttgttttctaatttattgtttgtgctgttacaagttgtttttaaagcaagcgtttgggcagaatggagtctctggtgctctgtgtgcttttgaaacacatgggcggcatggcgtgtgtgcatctgcgttgggcgagttgcttagcctgtcttgtagcactttcccgatggtgtgtgtagtttttctttattactgcatattatttcacagtagggacagatatgtttttatctagctactgtcctgttgatggagatgatgttttctttgtagtttttaatcttatgaacagtattaaaatgaacatcctttt

SEQ ID NO: 196139 - DNA, 492 bp, Homo sapiens
  Payload ID: 18693
  Gene Name: tubulin, gamma complex associated protein 3
  ENST ID: ENST00000633234
  CDS Start-End: 1-389
agttctccggggtgctgcaccagtgtcacattttggcctctgagatggtccatttcattcatcagatgcagtattacatcacatttgaggtgcttgaatgttcttgggatgagctttggaacaaagtccagcaggcccaggatttggatcacatcattgctgcacacgaggtgttcttagacaccatcatctcccgctgcctgctggacagtgactccagggcacttttaaatcaacttagagctgtgtttgatcaaattattgaacttcagaatgctcaagatgcaatatacagagctgctctggaagaattgcagagacgattacagtttgaagagaaaaagaaacagcgtgaaattgaggttgagatgtgcctatactgcgtttgaagtcccgagaaatcactgacagttgtaaagagggaggggccaccctcactggcatcatcatcctgtttcacaaaataaataaaaacagcagcattcatgagaa

SEQ ID NO: 196140 - DNA, 1622 bp, Homo sapiens
  Payload ID: 18693
  Gene Name: tubulin, gamma complex associated protein 3
  ENST ID: ENST00000631451
  CDS Start-End: 1-638
agttctccggggtgctgcaccagtgtcacattttggcctctgagatggtccatttcattcatcagatgcagtattacatcacatttgaggtgcttgaatgttcttgggatgagctttggaacaaagtccagcaggcccaggatttggatcacatcattgctgcacacgaggtgttcttagacaccatcatctcccgctgcctgctggacagtgactccagggcacttttaaatcaacttagagctgtgtttgatcaaattattgaacttcagaatgctcaagatgcaatatacagagctgctctggaagaattgcagagacgattacagtttgaagagaaaaagaaacagcgtgaaattgagggccagtggggagtgacggcagcagaggaagaggaggaaaataagaggattggagaatttaaagaatctataccaaaaatgtgctcacagttgcgaatattgacccatttctaccagggtatcgtgcagcagtttttggtgttactgacgaccagctctgacgagagtcttcggtttcttagcttcaggctggacttcaacgagcattacaaagccagggagcccaggctccgtgtgtctctgggtaccagggggcggcgcagctcccacacgtgaagctcgcggtcctcccagggagctgcgggtgatgttcgttgcactgctagacacgaaattcccattgacgtcctgcaggaactgcatgctgcaggtgtcctgcccttccgcccacgagtgcgccatgtttcagcggagcggcgtgtgggagaagccacgtcgtgtttcacatgtcggagtcgaatgcatttgtaaatccctaagtcaagtaggctggctgcactgttcacatttgtctctaaaagtcttcatcgctaaaagataccataatttgctgaggcttcttaagctttctatgttataatttatatttgtcactttaaaaaatccatttcttttagaaaaaattagggtgataggatattcattagttaagatggtaacgtcattgctatttttttaacatcctctttagaggtaatttttgttaacataaccaaaaattaaattgaaacaaaatgtcccaactaagaaaatatatagagcattttatttttttttagtgttgtaaaatattaacctctgtgagatcctttgtatcttaatgcattacctttacacatatttattcttattttctctcctttcagagtttacatttttatatttaatttactatttcagatttttaaaatagtatagaaaaaagtaggagtgatagagaacaaaaatactcttatacagtgcaacccaaataccgcgaatgcatcagctaaagcagcgtgtaaataggagtgacgagaaagttaatggagtattttattttcaaagttcctgataagcattggaaagaaatcgacatggataatgaagatttcctttttccttgcctattttttcattgtaaatatttatatactactgaccaagatgttggggtgggggggattgttttttgtaaaaatgtcattatcaggtcacataaatctgcctttatgttgcataagtgaaaatttagaaaattaaaagcaattatctttcaga

SEQ ID NO: 196141 - DNA, 2617 bp, Homo sapiens
  Payload ID: 18694
  Gene Name: tubulin, gamma complex associated protein 4
  Uniprot ID: Q9UGJ1
  ENST ID: ENST00000260383
  CDS Start-End: 255-2258
agtctccgcagagcccgggcgggagtagctggtggaccccgttgagctgccgaacttccgggactcccccgcgaccccttcccagcttcccgtccgctccgccgcagcgattgtctcggtgggttgattcggcacaaaccgcccgacccaggggccggtgcgcgtgtggaaggggaagcactcccctcgtggtcgcctggaggtgcgctggaggagggggtgacataaccagggactcgaggtccgccgtgggaatgatccacgaactgctcttggctctgagcgggtaccctgggtccattttcacctggaacaagcggagtggcctgcaggtatcgcaggacttccctttcctccaccccagtgagaccagtgtcctgaatcgactctgccggctcggcacagactatattcgcttcactgagttcattgaacagtacacgggccatgtgcaacagcaggatcaccatccatctcaacagggccaaggtgggttacatggaatctacctgcgggccttctgcacagggctggattctgttttgcagccttatcgccaagcactgcttgatttggaacaagagttcctgggtgatccccatctctccatatcacatgtcaactacttcctagaccagttccagcttctttttccctctgtgatggttgtagtagaacaaattaaaagtcaaaagattcatggttgtcaaatcctggaaacagtctacaaacacagctgtggggggttgcctcctgttcgaagtgcactggaaaaaatcctggccgtttgtcatggggtcatgtataaacagctctcagcctggatgctccatggactcctcttggaccagcatgaagaattctttatcaaacaggggccatcttctggtaatgtcagtgcccagccagaagaggacgaggaggatctgggcattgggggactgacaggaaaacaactgagagaactgcaggacttgcgcctgattgaggaagagaacatgctggcaccatctctgaagcagttttccctacgagtggagattttgccatcctacattccagtgagggttgctgaaaaaatcctatttgttggagaatctgtccagatgtttgagaatcaaaatgtgaacctgactagaaaaggatccattttgaaaaaccaggaagacacttttgctgcagagctgcaccgtctcaagcagcagccactcttcagcttggtggactttgaacaggtggtggatcgcattcgcagcactgtggctgagcatctctggaagttgatggtagaagaatccgatttactgggtcagctgaagatcattaaagacttttaccttctgggacgtggagaactgtttcaggccttcattgacacagctcaacacatgttgaaaacaccacccactgcagtaactgagcatgatgtgaatgtggcctttcaacagtcagcacacaaggtattgctagatgatgacaaccttctccctctgttgcacttgacaatcgagtatcacggaaaggagcacaaagcagatgctactcaggcaagagaagggccttctcgggaaacttctccccgggaagcccctgcatctggctgggcagccctaggtctttcctacaaagtacagtggccactacatattctcttcaccccagctgtcctggaaaagtacaatgttgtttttaagtacttactgagtgtgcgccgggtgcaagctgagctgcagcactgctgggccctacaaatgcagcgcaagcacctcaagtcgaaccagactgatgcaatcaagtggcgcctaagaaatcacatggcatttttggtggataatcttcagtactatctccaggtagatgtgttggagtctcagttctcccagctgcttcatcagatcaattctacccgagactttgaaagcatccgattggctcatgaccacttcctgagcaatttgctggctcaatcctttatcctattgaaacctgtgtttcactgcctgaatgaaatcctagatctctgtcacagtttttgttcgctggtcagtcagaacctaggcccactggatgagcgtggagccgcccagctgagcattctcgtgaagggctttagccgccagtcttcactcctgttcaagattctctccagtgttcggaatcatcagatcaactcagatttggctcaactactgttacgactagattataacaaatactatacccaggctggtggaactctgggcagtttcgggatgtgaaaatttctggctcataaattgaaataacagccacgttcccaaggttgtaacagaagattcaaaacatcccattctagccacacacaaataaatatctgcggcttagtgataggactctaccttttctcctagaagcagttactgaacatccaggagtacaactccttcccatcattcccatgtggaagggtctctcccatcaaggagaacatgtggcatctctgatcctttacattgagaacatttgttggatatgttcatttattcaatagtcatttattgagcacctactacgtaccttggtactgttcaagctgtgggagatacagcggtaaacaaacaatatagagcagaaagtt

SEQ ID NO: 196142 - DNA, 771 bp, Homo sapiens
  Payload ID: 18694
  Gene Name: tubulin, gamma complex associated protein 4
  ENST ID: ENST00000563517
  CDS Start-End: 283-531
gcatgcgcgagggcagcgaccgcgactcagtctccgcagagcccgggcgggagtagctggtggaccccgttgagctgccgaacttccgggactcccccgcgaccccttcccagcttcccgtccgctccgccgcagcgattgtctcggtgggttgattcggcacaaaccgcccgacccaggggccggtgcgcgtgtggaaggggaagcactcccctcgtggtcgcctggaggtgcgctggaggagggggtgacataaccagggactcgaggtccgccgtgggaatgatccacgaactgctcttggctctgagcgggtaccctgggtccattttcacctggaacaagcggagtggcctgcaggtatcgcaggacttccctttcctccaccccagtgagaccagtgtcctgaatcgactctgccggctcggcacagactatattcgcttcactgagttcattgaacagtacacgggccatgtgcaacagcaggtttcagggcctgagctgagaagttggcttctgtttgtttgatttcaggatcaccatccatctcaacagggccaaggtgggttacatggaatctacctgcgggccttctgcacagggctggattctgttttgcagccttatcgccaagcactgcttgatttggaacaagagttcctgggtgatccccatctctccatatcacatgtcaactacttcctagaccagttccagcttctttttccctctgtgatggttgtagtagaacaaattaaaagtcaaaag

SEQ ID NO: 196143 - DNA, 846 bp, Homo sapiens
  Payload ID: 18694
  Gene Name: tubulin, gamma complex associated protein 4
  ENST ID: ENST00000563147
  CDS Start-End: 1-516
aaagtacagtggccactacatattctcttcaccccagctgtcctggaaaagtacaatgttgtttttaagtacttactgagtgtgcgccgggtgcaagctgagctgcagcactgctgggccctacaaatgcagcgcaagcacctcaagtcgaaccagactgatgcaatcaagtggcgcctaagaaatcacatggcatttttggtggataatcttcagtactatctccaggtagatgtgttggagtctcagttctcccagctgcttcatcagatcaattctacccgagactttgaaagcatccgattggctcatgaccacttcctgagcaatttgctggctcaatcctttatcctattgaaacctggctttagccgccagtcttcactcctgttcaagattctctccagtgttcggaatcatcagatcaactcagatttggctcaactactgttacgactagattataacaaatactatacccaggctggtggaactctgggcagtttcgggatgtgaaaatttctggctcataaattgaaataacagccacgttcccaaggttgtaacagaagattcaaaacatcccattctagccacacacaaataaatatctgcggcttagtgataggactctaccttttctcctagaagcagttactgaacatccaggagtacaactccttcccatcattcccatgtggaagggtctctcccatcaaggagaacatgtggcatctctgatcctttacattgagaacatttgttggatatgttcatttattcaatagtcatttattgagcacctactacgtaccttggtactgttcaagctgtgggagatacagc

SEQ ID NO: 196144 - DNA, 1928 bp, Homo sapiens
  Payload ID: 18694
  Gene Name: tubulin, gamma complex associated protein 4
  ENST ID: ENST00000561691
  CDS Start-End: 1-1193
atggaatctacctgcgggccttctgcacagggctggattctgttttgcagccttatcgccaagcactgcttgatttggaacaagagttcctgggtgatccccatctctccatatcacatgtcaactacttcctagaccagttccagcttctttttccctctgtgatggttgtagtagaacaaattaaaagtcaaaagattcatggttgtcaaatcctggaaacagtctacaaacacagctgtggggggttgcctcctgttcgaagtgcactggaaaaaatcctggccgtttgtcatggggtcatgtataaacagctctcagcctggatgctccatggactcctcttggaccagcatgaagaattctttatcaaacaggggccatcttctggtaatgtcagtgcccagccagaagaggacgaggaggatctgggcattgggggactgacaggaaaacaactgagagaactgcaggacttgcgcctgattgaggaagagaacatgctggcaccatctctgaagcagttttccctacgagtggagattttgccatcctacattccagtgagggttgctgaaaaaatcctatttgttggagaatctgtccagatgtttgagaatcaaaatgtgaacctgactagaaaaggatccattttgaaaaaccaggaagacacttttgctgcagagctgcaccgtctcaagcagcagccactcttcagcttggtggactttgaacaggtggtggatcgcattcgcagcactgtggctgagcatctctggaagttgatggtagaagaatccgatttactgggtcagctgaagatcattaaagacttttaccttctgggacgtggagaactgtttcaggccttcattgacacagctcaacacatgttgaaaacaccacccactgcagtaactgagcatgatgtgaatgtggcctttcaacagtcagcacacaaggtattgctagatgatgacaaccttctccctctgttgcacttgacaatcgagtatcacggaaaggagcacaaagcagatgctactcaggcaagagaagggccttctcgggaaacttctccccgggaagcccctgcatctggctgggcagccctaggtctttcctacaaagtacagtggccactacatattctcttcaccccagctgtcctggaaaaaaatagacaattttaaaaaccaaacagaatgggactgtcttctgcaagcctacctacaaacaggtacaatgttgtttttaagtacttactgagtgtgcgccgggtgcaagctgagctgcagcactgctgggccctacaaatgcagcgcaagcacctcaagtcgaaccagactgatgcaatcaagtggcgcctaagaaatcacatggcatttttggtggataatcttcagtactatctccaggtagatgtgttggagtctcagttctcccagctgcttcatcagatcaattctacccgagactttgaaagcatccgattggctcatgaccacttcctgagcaatttgctggctcaatcctttatcctattgaaacctgtgtttcactgcctgaatgaaatcctagatctctgtcacagtttttgttcgctggtcagtcagaacctaggcccactggatgagcgtggagccgcccagctgagcattctcgtgaagggctttagccgccagtcttcactcctgttcaagattctctccagtgttcggaatcatcagatcaactcagatttggctcaactactgttacgactagattataacaaatactatacccaggctggtggaactctgggcagtttcgggatgtgaaaatttctggctcataaattgaaataacagccacgttcccaaggttgtaacagaagattcaaaacatcccattctagccacacacaaataaatatctgcggctta

SEQ ID NO: 196145 - DNA, 460 bp, Homo sapiens
  Payload ID: 18694
  Gene Name: tubulin, gamma complex associated protein 4
  ENST ID: ENST00000566251
  CDS Start-End: 1-201
ttgctggctcaatcctttatcctattgaaacctgtgtttcactgcctgaatgaaatcctagatctctgtcacagtttttgttcgctggtcagtcagaacctaggcccactggatgagcgtggagccgcccagctgagcattctcgtgaaggtgcgtctgcctggaagtatgcagccttgccgaaaggacagagggctttagccgccagtcttcactcctgttcaagattctctccagtgttcggaatcatcagatcaactcagatttggctcaactactgttacgactagattataacaaatactatacccaggctggtggaactctgggcagtttcgggatgtgaaaatttctggctcataaattgaaataacagccacgttcccaaggttgtaacagaagattcaaaacatcccattctagccacacacaaataaatatctgcggcttagtgatagga

SEQ ID NO: 196146 - DNA, 561 bp, Homo sapiens
  Payload ID: 18694
  Gene Name: tubulin, gamma complex associated protein 4
  ENST ID: ENST00000563412
  CDS Start-End: 1-312
aaaagtcaaaagattcatggttgtcaaatcctggaaacagtctacaaacacagctgtggggggttgcctcctgttcgaagtgcactggaaaaaatcctggccgtttgtcatggggtcatgtataaacagctctcagcctggatgctccatggactcctcttggaccagcatgaagaattctttatcaaacaggggccatcttctggtaatgtcagtgcccagccagaagaggacgaggaggatctgggcattgggggactgacaggaaaacaactgagagaactgcaggacttgtcacagaagacgatgtgattgtataggaagtgtaggctgagaggaaaagacagtctgggacagtgccctgaggagcaccagcagagaagacatagagagaagacctggaaaacaaaaaagaccacctctttcatcgtacaacgcctgattgaggaagagaacatgctggcaccatctctgaagcagttttccctacgagtggagattttgccatcctacattccagtgagggttgctgaaaaaatcctatttgttggagaatctgtc

SEQ ID NO: 196147 - DNA, 762 bp, Homo sapiens
  Payload ID: 18694
  Gene Name: tubulin, gamma complex associated protein 4
  ENST ID: ENST00000565548
  CDS Start-End: 1-318
ttcctgagcaatttgctggctcaatcctttatcctattgaaacctgtgtttcactgcctgaatgaaatcctagatctctgtcacagtttttgttcgctggtcagtcagaacctaggcccactggatgagcgtggagccgcccagctgagcattctcgtgaagggctttagccgccagtcttcactcctgttcaagattctctccagtgttcggaatcatcagatcaactcagatttggctcaactactgttacgactagattataacaaatactatacccaggctggtggaactctgggcagaaaaaaaccttgttgacccctgctttagagaatgagaagccatgcagggatcagtgatgccagaggaagggaaggaactgcttccagctattgtgacaataataataataataatattgggtctttgactagaacgtgtaacatttccaggtgttctcacttgtgcttcccatgtttatcttacggaaggtcattccatcaagcttatggtcactgtcccttcatggcagttggtcctttcgttctccctttagctctaagagttggggagtacccacaggtgagctgtgatctcagctcagagagagagcatgaggtcttttttaactgtcaggaaacagagctgtgcccaattccactcaacttttggcacaactgttaatctgggccttcacctaccttaaactgagtttctgcaagcatagcattttagacaccctggaataaccttttgggaatg

SEQ ID NO: 196148 - DNA, 6798 bp, Homo sapiens
  Payload ID: 18694
  Gene Name: tubulin, gamma complex associated protein 4
  Uniprot ID: Q9UGJ1
  ENST ID: ENST00000564079
  CDS Start-End: 241-2241
ccgggcgggagtagctggtggaccccgttgagctgccgaacttccgggactcccccgcgaccccttcccagcttcccgtccgctccgccgcagcgattgtctcggtgggttgattcggcacaaaccgcccgacccaggggccggtgcgcgtgtggaaggggaagcactcccctcgtggtcgcctggaggtgcgctggaggagggggtgacataaccagggactcgaggtccgccgtgggaatgatccacgaactgctcttggctctgagcgggtaccctgggtccattttcacctggaacaagcggagtggcctgcaggtatcgcaggacttccctttcctccaccccagtgagaccagtgtcctgaatcgactctgccggctcggcacagactatattcgcttcactgagttcattgaacagtacacgggccatgtgcaacagcaggatcaccatccatctcaacagggccaaggtgggttacatggaatctacctgcgggccttctgcacagggctggattctgttttgcagccttatcgccaagcactgcttgatttggaacaagagttcctgggtgatccccatctctccatatcacatgtcaactacttcctagaccagttccagcttctttttccctctgtgatggttgtagtagaacaaattaaaagtcaaaagattcatggttgtcaaatcctggaaacagtctacaaacacagctgtggggggttgcctcctgttcgaagtgcactggaaaaaatcctggccgtttgtcatggggtcatgtataaacagctctcagcctggatgctccatggactcctcttggaccagcatgaagaattctttatcaaacaggggccatcttctggtaatgtcagtgcccagccagaagaggacgaggaggatctgggcattgggggactgacaggaaaacaactgagagaactgcaggacttgcgcctgattgaggaagagaacatgctggcaccatctctgaagcagttttccctacgagtggagattttgccatcctacattccagtgagggttgctgaaaaaatcctatttgttggagaatctgtccagatgtttgagaatcaaaatgtgaacctgactagaaaaggatccattttgaaaaaccaggaagacacttttgctgcagagctgcaccgtctcaagcagcagccactcttcagcttggtggactttgaacaggtggtggatcgcattcgcagcactgtggctgagcatctctggaagttgatggtagaagaatccgatttactgggtcagctgaagatcattaaagacttttaccttctgggacgtggagaactgtttcaggccttcattgacacagctcaacacatgttgaaaacaccacccactgcagtaactgagcatgatgtgaatgtggcctttcaacagtcagcacacaaggtattgctagatgatgacaaccttctccctctgttgcacttgacaatcgagtatcacggaaaggagcacaaagatgctactcaggcaagagaagggccttctcgggaaacttctccccgggaagcccctgcatctggctgggcagccctaggtctttcctacaaagtacagtggccactacatattctcttcaccccagctgtcctggaaaagtacaatgttgtttttaagtacttactgagtgtgcgccgggtgcaagctgagctgcagcactgctgggccctacaaatgcagcgcaagcacctcaagtcgaaccagactgatgcaatcaagtggcgcctaagaaatcacatggcatttttggtggataatcttcagtactatctccaggtagatgtgttggagtctcagttctcccagctgcttcatcagatcaattctacccgagactttgaaagcatccgattggctcatgaccacttcctgagcaatttgctggctcaatcctttatcctattgaaacctgtgtttcactgcctgaatgaaatcctagatctctgtcacagtttttgttcgctggtcagtcagaacctaggcccactggatgagcgtggagccgcccagctgagcattctcgtgaagggctttagccgccagtcttcactcctgttcaagattctctccagtgttcggaatcatcagatcaactcagatttggctcaactactgttacgactagattataacaaatactatacccaggctggtggaactctgggcagtttcgggatgtgaaaatttctggctcataaattgaaataacagccacgttcccaaggttgtaacagaagattcaaaacatcccattctagccacacacaaataaatatctgcggcttagtgataggactctaccttttctcctagaagcagttactgaacatccaggagtacaactccttcccatcattcccatgtggaagggtctctcccatcaaggagaacatgtggcatctctgatcctttacattgagaacatttgttggatatgttcatttattcaatagtcatttattgagcacctactacgtaccttggtactgttcaagctgtgggagatacagcggtaaacaaacaatatagagcagaaagttaaatattttatggttcatatgtgaaaaagtaattatgtttataaatagactaactgctggatgttaccaccaagtaagaaagcaacaggtaagataggctttctctctccctataccaagtaatttatacctacacagattgggcaattctagctaatgaaaatatacttaaaagtatttcttaggccgggcatggtggctcacacctgtaatcccagcactttgggaggccgaggcgggcggatcacctgaagtcaggagtttgagaccagcctgaccaacatgatgaaacctcgattctactaaaaatacaaaaattagccaggtgtggtggcatgtgcctgtaatcccagctactcaggaggctgagacaggagaattgcttgaacctgggaagcagacgctgcagtgagctgagattgtgccattgcattccagcccgggcaacaagagcgaaattccgtctcaaaaaaaaaaaaaaaaaaaaaaaaagtattattctccaagaaaaaggtccttaagaaaaaattgagatcaagttgttagatttttaaatactgaagattgcaggcccaattacccatcttacacaaaccataggggttgaagttatcttaatatggcccagccatcactggtaatcaatattcatatcagtgtaagtaaaaagaaatattcactgaacaacgccctccaaactgaaaaagaatgcagtgttctggcatcaggttatagtcactgcatctggttttcatcactacatattctacacacactgggaagctctgacaacttattccctgctattatcaactaaagatcaccctttctactgctgtctctggagcaggagctggcaaactatggcctgctgtctgtttttgtacagttttactgaaacacagccatgcccatttgtttactcattgtctatggttgctttcatgccctcacagcaaaggcgagtagttgtgatggatcaaatggcccacaaagcctgaaatatttactctttgaccctttacagaaaaaaaccttgttgacccctgctttagagaatgagaagccatgcagggatcagtgatgccagaggaagggaaggaactgcttccagctattgtgacaataataataataataatattgggtctttgactagaacgtgtaacatttccaggtgttctcacttgtgcttcccatgtttatcttacggaaggtcattccatcaagcttatggtcactgtcccttcatggcagttggtcctttcgttctccctttagctctaagagttggggagtacccacaggtgagctgtgatctcagctcagagagagagcatgaggtcttttttaactgtcaggaaacagagctgtgcccaattccactcaacttttggcacaactgttaatctgggccttcacctaccttaaactgagtttctgcaagcatagcattttagacaccctggaataaccttttgggaatgatgccacagaataaagttcactcttaacttttcaatttccttggccagctgtcctccgtaagtgaataagcctgttgaaagactcagagaaagtactatgtcttgtcatttgttctgagattaagctcaaaaaaacagatgaagaaatcccagttactacaaccaaagagattcaacatttattttatcataaaagttcagcaaataaaactatatacaagatccatgcaaggaatccagttacacacaagacacatttaaaacctggttaaaacacaatctccacgatagcagggaataaaaccagtaagaccaagtatctttagtgagaaacataatcgtgtttatattttggatgctgcttgaatccaattctctccccaacaatgaggcactggatcacccactcttgtgacaccacaggcagctgcaatgcttcagcacacttcagcaccgaggctgggcatgaggggtccgtcaccaccacatcaaatacccctaaagcaatatctgcaaggagcaagggaaagtgaagaaggaaaggacactcaacttagccctccattagaaagagagatttgattctaaccaatacatcccactctgcacaaaccaaagccctattatgtcaaacacactgctactgatcatgaccaaaggcagagttataatcactatgtgctgaccttgtagaaatatttaacaaatatacgtccagtgcttcacttatgttgactcacctcttgaaggtggtacttttcttctctaagaaacatggatacggtcaacctattaggcctgagccttggaccacaaggcctaacacctacaggtctaaggagatccctggaacaaagacactacacacactctttcaggtacctttgttatgggcacttgaatggtgctgcttcacagaggctgcaccaccagtcatgaggatctcagaccagagctccaggaagttctgctgttggtctgataccaagagtaccttcagattctggaaaggattttcacggggttgcctatgaaggagacaggaaaggaccttagcatgacaagtaatatccaacaaactgcctttctgcaaagggactcatgtacatctgaatgctttcaaaaataaatgccccatcagacatagtgtctcaagcctgtaatcccagcactttgggaggctgtcgtggttggatctcttgggcctgggagttcgagaccagcctgggcaatgtggtgagaccccatctctacaaaagacaacaaaaaaattagctgggtgtggtggcgagtgcctgtagtcccagcagcttgggaggctgaggtagggggatcacttcagcctgggaggttgaggctgcagtaagtcgtcactgcgccactgtactccagcctaggtgacagagcaagacttcatcttaaaaaactaagccctatattagggtcccccttctcttccttctttctatgaatgatctgtattccttgcattcctggctttctaatttccatgtttgttctggggctgagaataatccaaatcatgctcctgagcctatatatttttaatgcttgcttaaaacttagttctctgactttacaggttgagaatattgaacctatatacaaatcttcacacatttgcaaaaggttcctagccaatgtaacctagggaaataaactagataaactcctgaagtcatttcaaacccactcaaatttatcccacagacattccaatttctagaaagctttactctctcacctagattctcttccctccaaagcttgctgtcctcctgcctatacaattctggatgggcttcaaatacttaccagtccagaattctttgctcctcaaggctgtacccagctggcaacagataattacggtagttctggagctggttggcatggcaactatcatggacccagacatgagacacacaaggaatcccactggcaaggcacaggaagtacttccgggttcgacaatgctgatccgcaattagaagacactggtaagctgtgttacactgcaagaaaagaagcagagccaatgggtttggtgacttctgtggaaagctcctaagcagcagccataatgagccatgaagagcagatctgaagactcccaactactacccaaaatgtgatttagtctatcctgcccaaggccactcttctcactggaaggcccaagtaatttccatagatgttctctctgcctcacctgcagcatactgaggacctaaatcctcaacggacaaccaaaacctatgaactcagcctttcaggctaaaaatcagcaaccctaataggggtttctactactaaacataaacatcaatcttcttttgtcccagcaacagaaccatagccattaactaacccaaggtcctaccttctcttccctatacacaacaaaaattctatttcatgcaaaaacattttggcagtttctcagttcctgaaatctctggctactttatccaggttccccaacccctcccaggcctcttctcaacacagcaagttggctcttatcattgccactatattaggttacacaaagaaactcctcacctgggcttcattgaaatcttcaaggatatagccagctcctgctcgaagctgggattctgtatactgcttgttgaaaggaggaatttccaaaaattctatattaaaaaaaaaaaccaagataataa

SEQ ID NO: 196149 - DNA, 582 bp, Homo sapiens
  Payload ID: 18695
  Gene Name: tubulin, gamma complex associated protein 5
  ENST ID: ENST00000612085
  CDS Start-End: 1-582
ctgctagttggaagagattaacggaggaatttctaaatgcaccacttcccagtataaaggaaataaagacagatgcacattattccatactgtcacttcttctgtgtctgtcagactctccttcaaacagcagttatgtggagacaccaagaaataaagaagtggaaaagaaagatgatttcgactggggaaaatacttgatggaagatgaagaaatggacattggtccgtacatggacacaccaaattggtctgaagaaagtgaagaggaaaatgatcaacagcccttaagcagagaggactctggaattcaggtagacaggacaccgttagaagaacaagatcaaaacagaaaactggatccttgtatcagttggaaagcagatgagccagatgaccgaagctggctggaacatcatgtggtccatcagtactggacagccaggccctcccagtttcctcatagtttacatttgcactctaatttagctgctgtctgggaccaacacttgtacagcagtgatccattgtatgttccagatgacagggttttggttactgagactcaggttattcgggaaa

SEQ ID NO: 196150 - DNA, 500 bp, Homo sapiens
  Payload ID: 18695
  Gene Name: tubulin, gamma complex associated protein 5
  ENST ID: ENST00000622507
  CDS Start-End: 1-500
attaacggaggaatttctaaatgcaccacttcccagtataaaggaaataaagacagatgcacattattccatactgtcacttcttctgtgtctgtcagactctccttcaaacagcagttatgtggagacaccaagaaataaagaagtggaaaagaaagatgatttcgactggggaaaatacttgatggaagatgaagaaatggacattggtccgtacatggacacaccaaattggtctgaagaaagtgaagaggaaaatgatcaacagcccttaagcagagaggactctggaattcaggtagacaggacaccgttagaagaacaagatcaaaacagaaaactggatccttgtatcagttggaaagatgaccgaagctggctggaacatcatgtggtccatcagtactggacagccaggccctcccagtttcctcatagtttacatttgcactctaatttagctgctgtctgggaccaacacttgtacagcagtgatccat

SEQ ID NO: 196151 - DNA, 3849 bp, Homo sapiens
  Payload ID: 18695
  Gene Name: tubulin, gamma complex associated protein 5
  Uniprot ID: Q96RT8
  ENST ID: ENST00000615383
  CDS Start-End: 131-3205
gaagtcgcccggcgcgggagcgcgaactctcgcgagaatgccgccagctccggaggcgactgcggcaggagcccgagctctcgcgcgacaggcaccaattcgttagacgcgcgctgcaggagcgcggaacatggcgcggcacgggccaccgtggagtcggttggacgcgcagcaggagcgcgacgtgcgggagctcgtccggggtgtcgccggcctccaggacgaggcagaccccaacttccagctcgccctaaacttcgcctggtccaacttcagatttcatcgtttcttggatgtcaacagccacaaaatagaaaaaacaatcgaaggaatttatgaaaaatttgtcattcattctgatctaagcaaagctgctagttggaagagattaacggaggaatttctaaatgcaccacttcccagtataaaggaaataaagacagatgcacattattccatactgtcacttcttctgtgtctgtcagactctccttcaaacagcagttatgtggagacaccaagaaataaagaagtggaaaagaaagatgatttcgactggggaaaatacttgatggaagatgaagaaatggacattggtccgtacatggacacaccaaattggtctgaagaaagtgaagaggaaaatgatcaacagcccttaagcagagaggactctggaattcaggtagacaggacaccgttagaagaacaagatcaaaacagaaaactggatccttgtatcagttggaaagatgagccagatgaccgaagctggctggaacatcatgtggtccatcagtactggacagccaggccctcccagtttcctcatagtttacatttgcactctaatttagctgctgtctgggaccaacacttgtacagcagtgatccattgtatgttccagatgacagggttttggttactgagactcaggttattcgggaaaccctatggttactttcaggagtgaaaaagctctttatatttcagttgatagatgggaaggtaactgtgagaaacaatattatagtaactcatttaacacatagctgtttacgatctgtgctggaacaaatagcagcatatggccaggttgtgtttcgactccaggagttcattgatgaagtcatgggacacagttctgagagcatgctgcctggaagtgggtctgttcctaagaagtcaactgaagctccctttagaacctaccaggctttcatgtgggccctgtacaaatatttcattagtttcaaagaggaacttgcagaaattgagaagtgcatcatcaataatgatactacaataactcttgcaatagtggtggacaagttggcacctcgattgtctcagctcaaggttctgcacaaagtgtttagtactggagtagcagaagttccacctgatactcgaaatgtcgtccgggcctctcacctgcttaacaccctgtacaaggccattcttgaatatgacaatgttggagaagcctctgagcaaaccgtctccctccttttctctctctgggtggaaacggtgcggccttacctgcagacggtggacgagtggatcgtgcacgggcacctgtgggatggcgccagggagttcatcatccagagaaacaaaaatgttccagttaatcacagagacttctggtatgcaacttacacgttatatagcgtatcagaaaagacagaaaatgaagaaaaaatgagtgataacgctagtgcgagttccggcagtgaccaggggccctccagcaggcagcacaccatggtgtccttcctcaaacctgtcctgaagcagatcataatggctggcaagtcgatgcagctgctgaagaacctgcagtgtgcggagagcaccacctgccaggcaggagccagagatgcagaaagaaaaagtttatacactctctttctggaatctgtacagtcccgtcttcgacatggagaagattccactccacaggttcttactgagcaacaggcaaccaaggagaacctgatgaagatgcagtccattgctgaaagccatcttgaactggatgatgttcatgatccactgcttgccattaactttgcaaggatgtatttggagcagagtgactttcacgagaagtttgctggtggtgatgtatgtgtggatagatcatcggaatctgtgacatgccagacttttgaattaacgctgagatcctgcctctatcctcatattgacaagcagtatctagattgctgtggaaatctcatgcaaactctaaaaaaagattacaggttggtagaatacttgcaagctatgaggaattttttcttaatggaaggaggagataccatgtatgacttctacacgtcaatttttgataaaataagagaaaaggaaacatggcagaatgtgtcttttcttaatgtccaactccaagaagcagtaggacagcgttatcctgaagatagttcacgtctatctatatcttttgaaaatgttgacacagctaagaagaagctgcctgttcatatcttagatggtctgaccctcagctacaaggtcccatggcccgtggacattgttataagtttggaatgtcaaaaaatttataatcaagtgtttcttctcttattgcaaataaagtgggcaaaatatagtctggatgttttactttttggtgaactggttagtactgcagaaaaaccacgacttaaagaaggccttatacatgaacaagacacagttgctcagttcggaccacaaaaagaaccagtaagacagcagattcatcgcatgttcctcttaagagtgaagctcatgcatttcgtgaacagcttgcacaactacatcatgaccaggattctacacagtacagggctggagtttcaacatcaagtcgaggaagccaaggatttagatcaattgattaaaattcactataggtatctgtcaaccatccatgaccggtgtctgctgagagaaaaggtcagctttgtgaaagaagctatcatgaaggtgttgaacttggctctcatgtttgcagacggttggcaggcaggcctgggcacttggcgaatggaatctatagagaaaatggaatctgattttaaaaactgccatatgtttcttgtaaccattttaaacaaagccgtctgtagaggatcctttccccatttggaatctctagcgttgtcactcatggctggcatggaacaaagttaaatgtcttcagcgtaataaatatctccgactttgtcatcatacatgtacatttccaccatgtgcagctgaaaagtgaaaatatttttattttggtttatttgtaaaacttgtccacagtcagcctggcacagtcgctcatgcctctaatcccagcacgatgggaggccaagacaggcagatcacttgagcccaggagtttgaggccagcctgggcaacatggtgaaacccggtgtctaccaaaaatacaaaatgtatccagacatggtggtgtgtacctgtagtcccagctactcaggaggcaaagatgggaggattacttgagcccaggaggtcaaggctacagtgagccatgattgcactactgcagtgcaacctgggtgacagagtgagaccctgactcagaaagaaccacttgcccacagtccagacagatggattgtaggtgggttttctggagattagtagatactgtatagagttgtatacataaaattgtgtcagtagtacaaagtgtatataggctgtttactcttacatttcctactgtaagatacagatttatggtactgatacctttaaattatatcatattttgaaaatgtaattactgatattcaaaataaattaaaggacttaaaatcat

SEQ ID NO: 196152 - DNA, 3342 bp, Homo sapiens
  Payload ID: 18695
  Gene Name: tubulin, gamma complex associated protein 5
  Uniprot ID: Q96RT8
  ENST ID: ENST00000620435
  CDS Start-End: 30-3104
gttagacgcgcgctgcaggagcgcggaacatggcgcggcacgggccaccgtggagtcggttggacgcgcagcaggagcgcgacgtgcgggagctcgtccggggtgtcgccggcctccaggacgaggcagaccccaacttccagctcgccctaaacttcgcctggtccaacttcagatttcatcgtttcttggatgtcaacagccacaaaatagaaaaaacaatcgaaggaatttatgaaaaatttgtcattcattctgatctaagcaaagctgctagttggaagagattaacggaggaatttctaaatgcaccacttcccagtataaaggaaataaagacagatgcacattattccatactgtcacttcttctgtgtctgtcagactctccttcaaacagcagttatgtggagacaccaagaaataaagaagtggaaaagaaagatgatttcgactggggaaaatacttgatggaagatgaagaaatggacattggtccgtacatggacacaccaaattggtctgaagaaagtgaagaggaaaatgatcaacagcccttaagcagagaggactctggaattcaggtagacaggacaccgttagaagaacaagatcaaaacagaaaactggatccttgtatcagttggaaagatgagccagatgaccgaagctggctggaacatcatgtggtccatcagtactggacagccaggccctcccagtttcctcatagtttacatttgcactctaatttagctgctgtctgggaccaacacttgtacagcagtgatccattgtatgttccagatgacagggttttggttactgagactcaggttattcgggaaaccctatggttactttcaggagtgaaaaagctctttatatttcagttgatagatgggaaggtaactgtgagaaacaatattatagtaactcatttaacacatagctgtttacgatctgtgctggaacaaatagcagcatatggccaggttgtgtttcgactccaggagttcattgatgaagtcatgggacacagttctgagagcatgctgcctggaagtgggtctgttcctaagaagtcaactgaagctccctttagaacctaccaggctttcatgtgggccctgtacaaatatttcattagtttcaaagaggaacttgcagaaattgagaagtgcatcatcaataatgatactacaataactcttgcaatagtggtggacaagttggcacctcgattgtctcagctcaaggttctgcacaaagtgtttagtactggagtagcagaagttccacctgatactcgaaatgtcgtccgggcctctcacctgcttaacaccctgtacaaggccattcttgaatatgacaatgttggagaagcctctgagcaaaccgtctccctccttttctctctctgggtggaaacggtgcggccttacctgcagacggtggacgagtggatcgtgcacgggcacctgtgggatggcgccagggagttcatcatccagagaaacaaaaatgttccagttaatcacagagacttctggtatgcaacttacacgttatatagcgtatcagaaaagacagaaaatgaagaaaaaatgagtgataacgctagtgcgagttccggcagtgaccaggggccctccagcaggcagcacaccatggtgtccttcctcaaacctgtcctgaagcagatcataatggctggcaagtcgatgcagctgctgaagaacctgcagtgtgcggagagcaccacctgccaggcaggagccagagatgcagaaagaaaaagtttatacactctctttctggaatctgtacagtcccgtcttcgacatggagaagattccactccacaggttcttactgagcaacaggcaaccaaggagaacctgatgaagatgcagtccattgctgaaagccatcttgaactggatgatgttcatgatccactgcttgccattaactttgcaaggatgtatttggagcagagtgactttcacgagaagtttgctggtggtgatgtatgtgtggatagatcatcggaatctgtgacatgccagacttttgaattaacgctgagatcctgcctctatcctcatattgacaagcagtatctagattgctgtggaaatctcatgcaaactctaaaaaaagattacaggttggtagaatacttgcaagctatgaggaattttttcttaatggaaggaggagataccatgtatgacttctacacgtcaatttttgataaaataagagaaaaggaaacatggcagaatgtgtcttttcttaatgtccaactccaagaagcagtaggacagcgttatcctgaagatagttcacgtctatctatatcttttgaaaatgttgacacagctaagaagaagctgcctgttcatatcttagatggtctgaccctcagctacaaggtcccatggcccgtggacattgttataagtttggaatgtcaaaaaatttataatcaagtgtttcttctcttattgcaaataaagtgggcaaaatatagtctggatgttttactttttggtgaactggttagtactgcagaaaaaccacgacttaaagaaggccttatacatgaacaagacacagttgctcagttcggaccacaaaaagaaccagtaagacagcagattcatcgcatgttcctcttaagagtgaagctcatgcatttcgtgaacagcttgcacaactacatcatgaccaggattctacacagtacagggctggagtttcaacatcaagtcgaggaagccaaggatttagatcaattgattaaaattcactataggtatctgtcaaccatccatgaccggtgtctgctgagagaaaaggtcagctttgtgaaagaagctatcatgaaggtgttgaacttggctctcatgtttgcagacggttggcaggcaggcctgggcacttggcgaatggaatctatagagaaaatggaatctgattttaaaaactgccatatgtttcttgtaaccattttaaacaaagccgtctgtagaggatcctttccccattgtgagtatatcatgttaaaatatttctacctctgtatttccttgtaactaagtgtatgtgtcattgttttgttactgatcccatgaagaattagaaattctcaccattttcaaaactgaaaagtcccttagcagttgtcccatgctttgaattgctttttaagcattacggtgaggtgagtgtaagcctgaggatcttactttctggtataccatttattacaacagatttctaaaactcctattaaataaagttgatggcagaatagatttctgtcacacttca

SEQ ID NO: 196153 - DNA, 676 bp, Homo sapiens
  Payload ID: 18695
  Gene Name: tubulin, gamma complex associated protein 5
  ENST ID: ENST00000610294
  CDS Start-End: 1-676
gttggtagaatacttgcaagctatgaggaattttttcttaatggaaggaggagataccatgtatgacttctacacgtcaatttttgataaaataagagaaaaggaaacatggcagaatgtgtcttttcttaatgtccaactccaagaagcagtaggacagcgttatcctgaagatagttcacgaaaatggaggccaggcacggtggctcacacctgtaatgccagcactttgggaggcagaggcggtggatcacctgaggtcaggagttcgagaccagcctggccaacatgtctatctatatcttttgaaaatgttgacacagctaagaagaagctgcctgttcatatcttagatggtctgaccctcagctacaaggtcccatggcccgtggacattgttataagtttggaatgtcaaaaaatttataatcaagtgtttcttctcttattgcaaataaagtgggcaaaatatagtctggatgttttactttttggtgaactggttagtactgcagaaaaaccacgacttaaagaaggccttatacatgaacaagacacagttgctcagttcggaccacaaaaagaaccagtaagacagcagattcatcgcatgttcctcttaagagtgaagctcatgcatttcgtgaacagcttgcacaactacatcatgaccagg

SEQ ID NO: 196154 - DNA, 3848 bp, Homo sapiens
  Payload ID: 18695
  Gene Name: tubulin, gamma complex associated protein 5
  ENST ID: ENST00000620361
  CDS Start-End: 131-3205
gaagtcgcccggcgcgggagcgcgaactctcgcgagaatgccgccagctccggaggcgactgcggcaggagcccgagctctcgcgcgacaggcaccaattcgttagacgcgcgctgcaggagcgcggaacatggcgcggcacgggccaccgtggagtcggttggacgcgcagcaggagcgcgacgtgcgggagctcgtccggggtgtcgccggcctccaggacgaggcagaccccaacttccagctcgccctaaacttcgcctggtccaacttcagatttcatcgtttcttggatgtcaacagccacaaaatagaaaaaacaatcgagggaatttatgaaaaatttgtcattcattctgatctaagcaaagctgctagttggaagagattaacggaggaatttctaaatgcaccacttcccagtataaaggaaataaagacagatgcacattattccatactgtcacttcttctgtgtctgtcagactctccttcaaacagcagttatgtggagacaccaagaaataaagaagtggaaaagaaagatgatttcgactggggaaaatacttgatggaagatgaagaaatggacattggtccgtacatggacacaccaaattggtctgaagaaagtgaagaggaaaatgatcaacagcccttaagcagagaggactctggaattcaggtagacaggacaccgttagaagaacaagatcaaaacagaaaactggatccttgtatcagttggaaagatgagccagatgaccgaagctggctggaacatcatgtggtccatcagtactggacagccaggccctcccattttcctcatagtttacatttgcactctaatttagctgctgtctgggaccaacacttgtacagcagtgatccattgtatgttccagatgacagggttttggttactgagactcaggttattcgggaaaccctatggttactttcaggagtgaaaaagctctttatatttcagttgatagatgggaaggtaactgtgagaaacaatattatagtaactcatttaacacatagctgtttacgatctgtgctggaacaaatagcagcatatggccaggttgtgtttcgactccaggagttcattgatgaagtcatgggacacagttctgagagcatgctgcctggaagtgggtctgttcctaagaagtcaactgaagctccctttagaacctaccaggctttcatgtgggccctgtacaaatatttcattagtttcaaagaggaacttgcagaaattgagaagtgcatcatcaataatgatactacaataactcttgcaatagtggtggacaagttggcacctcgattgtctcagctcaaggttctgcacaaagtgtttagtactggagtagcagaagttccacctgatactcgaaatgtcgtccgggcctctcacctgcttaacaccctgtacaaggccattcttgaatatgacaatgttggagaagcctctgagcaaaccgtctccctccttttctctctctgggtggaaacggtgcggccttacctgcagacggtggacgagtggatcgtgcacgggcacctgtgggatggcgccagggagttcatcatccagagaaacaaaaatgttccagttaatcacagagacttctggtatgcaacttacacgttatatagcgtatcagaaaagacagaaaatgaagaaaaaatgagtgataacgctagtgcgagttccggcagtgaccaggggccctccagcaggcagcacaccatggtgtccttcctcaaacctgtcctgaagcagatcataatggctggcaagtcgatgcagctgctgaagaacctgcagtgtgcggagagcaccacctgccaggcaggagccagagatgcagaaagaaaaagtttatacactctctttctggaatctgtacagtcccgtcttcgacatggagaagattccactccacaggttcttactgagcaacaggcaaccaaggagaacctgatgaagatgcagtccattgctgaaagccatcttgaactggatgatgttcatgatccactgcttgccattaactttgcaaggatgtatttggagcagagtgactttcacgagaagtttgctggtggtgatgtatgtgtggatagatcatcggaatctgtgacatgccagacttttgaattaacgctgagatcctgcctctatcctcatattgacaagcagtatctagattgctgtggaaatctcatgcaaactctaaaaaaagattacaggttggtagaatacttgcaagctatgaggaattttttcttaatggaaggaggagataccatgtatgacttctacacgtcaatttttgataaaataagagaaaaggaaacatggcagaatgtgtcttttcttaatgtccaactccaagaagcagtaggacagcgttatcctgaagatagttcacgtctatctatatcttttgaaaatgttgacacagctaagaagaagctgcctgttcatatcttagatggtctgaccctcagctacaaggtcccatggcccgtggacattgttataagtttggaatgtcaaaaaatttataatcaagtgtttcttctcttattgcaaataaagtgggcaaaatatagtctggatgttttactttttggtgaactggttagtactgcagaaaaaccacgacttaaagaaggccttatacatgaacaagacacagttgctcagttcggaccacaaaaagaaccagtaagacagcagattcatcgcatgttcctcttaagagtgaagctcatgcatttcgtgaacagcttgcacaactacatcatgaccaggattctacacagtacagggctggagtttcaacatcaagtcgaggaagccaaggatttagatcaattgattaaaattcactataggtatctgtcaaccatccatgaccggtgtctgctgagagaaaaggtcagctttgtgaaagaagctatcatgaaggtgttgaacttggctctcatgtttgcagacggttggcaggcaggcctgggcacttggcgaatggaatctatagagaaaatggaatctgattttaaaaactgccatatgtttcttgtaaccattttaaacaaagccgtctgtagaggatcctttccccatttggaatctctagcgttgtcactcatggctggcatggaacaaagttaaatgtcttcagcgtaataaatatctccgactttgtcatcatacatgtacatttccaccatgtgcagctgaaaagtgagaatatttttattttggtttatttgtaaaacttgtccacagtcagcctggcacagtcgctcatgcctctaatcccagcacgatgggaggccaagacaggcagatcacttgagcccaggagtttgaggccagcctgggcaacatggtgaaacccggtgtctaccaaaaatacaaaatgtatccagacatggtggtgtgtacctgtagtcccagctactcaggaggcaaagatgggaggattacttgagcccaggaggtcaaggctacagtgagccatgattgcactactgcagtgcaacctgggtgacagagtgagaccctgactcagaaagaaccacttgcccacagtccagacagatggattgtaggtgggttttctggagattagtagatactgtatagagttgtatacataaaattgtgtcagtagtacaaagtgtatataggctgtttactcttatatttcctactgtaagatacagatttatggtactgatacctttaaattatatcatattttgaaaatgtaattactgatattcaaaataaattaaaggacttaaaatca

SEQ ID NO: 196155 - DNA, 3588 bp, Homo sapiens
  Payload ID: 18695
  Gene Name: tubulin, gamma complex associated protein 5
  ENST ID: ENST00000614508
  CDS Start-End: 27-3107
agacgcgcgctgcaggagcgcggaacatggcgcggcacgggccaccgtggagtcggttggacgcgcagcaggagcgcgacgtgcgggagctcgtccggggtgtcgccggcctccaggacgaggcagaccccaacttccagctcgccctaaacttcgcctggtccaacttcagatttcatcgtttcttggatgtcaacagccacaaaatagaaaaaacaatcgaaggaatttatgaaaaatttgtcattcattctgatctaagcaaagctgctagttggaagagattaacggaggaatttctaaatgcaccacttcccagtataaaggaaataaagacagatgcacattattccatactgtcacttcttctgtgtctgtcagactctccttcaaacagcagttatgtggagacaccaagaaataaagaagtggaaaagaaagatgatttcgactggggaaaatacttgatggaagatgaagaaatggacattggtccgtacatggacacaccaaattggtctgaagaaagtgaagaggaaaatgatcaacagcccttaagcagagaggactctggaattcaggtagacaggacaccgttagaagaacaagatcaaaacagaaaactggatccttgtatcagttggaaagatgagccagatgaccgaagctggctggaacatcatgtggtccatcagtactggacagccaggccctcccagtttcctcatagtttacatttgcactctaatttagctgctgtctgggaccaacacttgtacagcagtgatccattgtatgttccagatgacagggttttggttactgagactcaggttattcgggaaaccctatggttactttcaggagtgaaaaagctctttatatttcagttgatagatgggaaggtaactgtgagaaacaatattatagtaactcatttaacacatagctgtttacgatctgtgctggaacaaatagcagcatatggccaggttgtgtttcgactccaggagttcattgatgaagtcatgggacacagttctgagagcatgctgcctggaagtgggtctgttcctaagaagtcaactgaagctccctttagaacctaccaggctttcatgtgggccctgtacaaatatttcattagtttcaaagaggaacttgcagaaattgagaagtgcatcatcaataatgatactacaataactcttgcaatagtggtggacaagttggcacctcgattgtctcagctcaaggttctgcacaaagtgtttagtactggagtagcagaagttccacctgatactcgaaatgtcgtccgggcctctcacctgcttaacaccctgtacaaggccattcttgaatatgacaatgttggagaagcctctgagcaaaccgtctccctccttttctctctctgggtggaaacggtgcggccttacctgcagacggtggacgagtggatcgtgcacgggcacctgtgggatggcgccagggagttcatcatccagagaaacaaaaatgttccagttaatcacagagacttctggtatgcaacttacacgttatatagcgtatcagaaaagacagaaaatgaagaaaaaatgagtgataacgctagtgcgagttccggcagtgaccaggggccctccagcaggcagcacaccatggtgtccttcctcaaacctgtcctgaagcagatcataatggctggcaagtcgatgcagctgctgaagaacctgcagtgtgcggagagcaccacctgccaggcaggagccagagatgcagaaagaaaaagtttatacactctctttctggaatctgtacagtcccgtcttcgacatggagaagattccactccacaggttcttactgagcaacaggcaaccaaggagaacctgatgaagatgcagtccattgctgaaagccatcttgaactggatgatgttcatgatccactgcttgccattaactttgcaaggatgtatttggagcagagtgactttcacgagaagtttgctggtggtgatgtatgtgtggatagatcatcggaatctgtgacatgccagacttttgaattaacgctgagatcctgcctctatcctcatattgacaagcagtatctagattgctgtggaaatctcatgcaaactctaaaaaaagattacaggttggtagaatacttgcaagctatgaggaattttttcttaatggaaggaggagataccatgtatgacttctacacgtcaatttttgataaaataagagaaaaggaaacatggcagaatgtgtcttttcttaatgtccaactccaagaagcagtaggacagcgttatcctgaagatagttcacgtctatctatatcttttgaaaatgttgacacagctaagaagaagctgcctgttcatatcttagatggtctgaccctcagctacaaggtcccatggcccgtggacattgttataagtttggaatgtcaaaaaatttataatcaagtgtttcttctcttattgcaaataaagtgggcaaaatatagtctggatgttttactttttggtgaactggttagtactgcagaaaaaccacgacttaaagaaggccttatacatgaacaagacacagttgctcagttcggaccacaaaaagaaccagtaagacagcagattcatcgcatgttcctcttaagagtgaagctcatgcatttcgtgaacagcttgcacaactacatcatgaccaggattctacacagtacagggctggagtttcaacatcaagtcgaggaagccaaggatttagatcaattgattaaaattcactataggtatctgtcaaccatccatgaccggtgtctgctgagagaaaaggtcagctttgtgaaagaagctatcatgaaggtgttgaacttggctctcatgtttgcagacggttggcaggcaggcctgggcacttggcgaatggaatctatagagaaaatggaatctgattttaaaaactgccatatgtttcttgtaaccattttaaacaaagccgtctgtagaggatcctttccccattgtcttgctttgttgcccatgctggagcgcattggcacagtcttggctcactgaagcctcaacctccggggagcaagcactcctccctcagcctcctgagtagctgagactacagatggaatctcactctgtgagtctcactctatcgcccaggctggagtgcagtggcacaatctcagctcactgcaacctctgcctccagagctcaagcaatccgcccaccttgacctcccaaaatgctgggattaccgacctgtgtgtactttataaattaaactttatcataggcctgcatatatagaaaaatatatagtctatacagtgtagagtgtgctactatctgtcctttcagacatccaccaggggtcttgaagcttatcccccagaagatgaggtgggaactactgtaaataattttgaccctttgaaatctgatgagacttgttttacttcctaacatatggtatattttgtgaatgttacgtgtttatttgaaaactttaattcctgtcagtaacagcttgaagtcttcagt

SEQ ID NO: 196156 - DNA, 676 bp, Homo sapiens; identical to SEQ ID NO: 196153
  Payload ID: 18695
  Gene Name: tubulin, gamma complex associated protein 5
  ENST ID: ENST00000625857
  CDS Start-End: 1-676

SEQ ID NO: 196157 - DNA, 1078 bp, Homo sapiens
  Payload ID: 18695
  Gene Name: tubulin, gamma complex associated protein 5
  ENST ID: ENST00000630135
  CDS Start-End: 1-446
taagagtgaagctcatgcatttcgtgaacagcttgcacaactacatcatgaccaggattctacacagtacagggctggagtttcaacatcaagtcgaggaagccaaggatttagatcaattgattaaaattcactataggtatctgtcaaccatccatgaccggtgtctgctgagagaaaaggtcagctttgtgaaagaagctatcatgaaggtgttgaacttggctctcatgtttgcagacggttggcaggcaggcctgggcacttggcgaatggaatctatagagaaaatggaatctgattttaaaaactgccatatgtttcttgtaaccattttaaacaaagccgtctgtagaggatcctttccccatttttccatagggctgcctgttgtctgcatccgacgctggagtctactgtccacaggaggtttgggagggacctaaacctgcgtcagttcttgctgcttctggccttggtggtgtggaggtgctgcagaagctagggcctctcatcatgaagatgagccagatgcctccttcgggagccacaggatccagagagtcaatgaaagtaaaacttcaggactgtctggatttattacgccagggaggaagttgagccctggagactgtcaggtcgtacgactgcaattcttctcagattcactcttttcctcattgttcttgttctgtaaatgactaagagagaccagagaccagacctccccacttccaatcactggttttgttgtagatgaactgcctcctttgctgtccggtacctaatgtggaccagacggtgctcaagaccctatcactagtacaacctcagtgtggaatgttaaatatgccttgcctggaagaaaaagaccaacttgactaatcagatcatcataactatgcatgaagtcttccacagaaagatgatgaaattttgttacacttccctaacctttgtctaaataagcattcccaaacatctacactttggaacactgacttctgttctttgagatgggtgcttcccaggtggcccatcctcaaactttttgcttgaataaactctctaaactaga

SEQ ID NO: 196158 - DNA, 582 bp, Homo sapiens
  Payload ID: 18695
  Gene Name: tubulin, gamma complex associated protein 5
  ENST ID: ENST00000626276
  CDS Start-End: 1-582
ctgctagttggaagagattaacggaggaatttctaaatgcaccacttcccagtataaaggaaataaagacagatgcacattattccatactgtcacttcttctgtgtctgtcagactctccttcaaacagcagttatgtggagacaccaagaaataaagaagtggaaaagaaagatgatttcgactggggaaaatacttgatggaagatgaagaaatggacattggtccgtacatggacacaccaaattggtctgaagaaagtgaagaggaaaatgatcaacagcccttaagcagagaggactctggaattcaggtagacaggacaccgttagaagaacaagatcaaaacagaaaactggatccttgtatcagttggaaagcagatgagccagatgaccgaagctggctggaacatcatgtggtccatcagtactggacagccaggccctcccattttcctcatagtttacatttgcactctaatttagctgctgtctgggaccaacacttgtacagcagtgatccattgtatgttccagatgacagggttttggttactgagactcaggttattcgggaaa

SEQ ID NO: 196159 - DNA, 68 bp, Homo sapiens
  Payload ID: 18695
  Gene Name: tubulin, gamma complex associated protein 5
  ENST ID: ENST00000625230
  CDS Start-End: 1-68
ctgctagttggaagagattaacggaggaatttctaaatgcaccacttcccagtataaaggaaataaag

SEQ ID NO: 196160 - DNA, 52 bp, Homo sapiens
  Payload ID: 18695
  Gene Name: tubulin, gamma complex associated protein 5
  ENST ID: ENST00000631056
  CDS Start-End: 1-52
attaacggaggaatttctaaatgcaccacttcccagtataaaggaaataaag

SEQ ID NO: 196161 - DNA, 3342 bp, Homo sapiens
  Payload ID: 18695
  Gene Name: tubulin, gamma complex associated protein 5
  ENST ID: ENST00000628386
  CDS Start-End: 30-3104
gttagacgcgcgctgcaggagcgcggaacatggcgcggcacgggccaccgtggagtcggttggacgcgcagcaggagcgcgacgtgcgggagctcgtccggggtgtcgccggcctccaggacgaggcagaccccaacttccagctcgccctaaacttcgcctggtccaacttcagatttcatcgtttcttggatgtcaacagccacaaaatagaaaaaacaatcgagggaatttatgaaaaatttgtcattcattctgatctaagcaaagctgctagttggaagagattaacggaggaatttctaaatgcaccacttcccagtataaaggaaataaagacagatgcacattattccatactgtcacttcttctgtgtctgtcagactctccttcaaacagcagttatgtggagacaccaagaaataaagaagtggaaaagaaagatgatttcgactggggaaaatacttgatggaagatgaagaaatggacattggtccgtacatggacacaccaaattggtctgaagaaagtgaagaggaaaatgatcaacagcccttaagcagagaggactctggaattcaggtagacaggacaccgttagaagaacaagatcaaaacagaaaactggatccttgtatcagttggaaagatgagccagatgaccgaagctggctggaacatcatgtggtccatcagtactggacagccaggccctcccattttcctcatagtttacatttgcactctaatttagctgctgtctgggaccaacacttgtacagcagtgatccattgtatgttccagatgacagggttttggttactgagactcaggttattcgggaaaccctatggttactttcaggagtgaaaaagctctttatatttcagttgatagatgggaaggtaactgtgagaaacaatattatagtaactcatttaacacatagctgtttacgatctgtgctggaacaaatagcagcatatggccaggttgtgtttcgactccaggagttcattgatgaagtcatgggacacagttctgagagcatgctgcctggaagtgggtctgttcctaagaagtcaactgaagctccctttagaacctaccaggctttcatgtgggccctgtacaaatatttcattagtttcaaagaggaacttgcagaaattgagaagtgcatcatcaataatgatactacaataactcttgcaatagtggtggacaagttggcacctcgattgtctcagctcaaggttctgcacaaagtgtttagtactggagtagcagaagttccacctgatactcgaaatgtcgtccgggcctctcacctgcttaacaccctgtacaaggccattcttgaatatgacaatgttggagaagcctctgagcaaaccgtctccctccttttctctctctgggtggaaacggtgcggccttacctgcagacggtggacgagtggatcgtgcacgggcacctgtgggatggcgccagggagttcatcatccagagaaacaaaaatgttccagttaatcacagagacttctggtatgcaacttacacgttatatagcgtatcagaaaagacagaaaatgaagaaaaaatgagtgataacgctagtgcgagttccggcagtgaccaggggccctccagcaggcagcacaccatggtgtccttcctcaaacctgtcctgaagcagatcataatggctggcaagtcgatgcagctgctgaagaacctgcagtgtgcggagagcaccacctgccaggcaggagccagagatgcagaaagaaaaagtttatacactctctttctggaatctgtacagtcccgtcttcgacatggagaagattccactccacaggttcttactgagcaacaggcaaccaaggagaacctgatgaagatgcagtccattgctgaaagccatcttgaactggatgatgttcatgatccactgcttgccattaactttgcaaggatgtatttggagcagagtgactttcacgagaagtttgctggtggtgatgtatgtgtggatagatcatcggaatctgtgacatgccagacttttgaattaacgctgagatcctgcctctatcctcatattgacaagcagtatctagattgctgtggaaatctcatgcaaactctaaaaaaagattacaggttggtagaatacttgcaagctatgaggaattttttcttaatggaaggaggagataccatgtatgacttctacacgtcaatttttgataaaataagagaaaaggaaacatggcagaatgtgtcttttcttaatgtccaactccaagaagcagtaggacagcgttatcctgaagatagttcacgtctatctatatcttttgaaaatgttgacacagctaagaagaagctgcctgttcatatcttagatggtctgaccctcagctacaaggtcccatggcccgtggacattgttataagtttggaatgtcaaaaaatttataatcaagtgtttcttctcttattgcaaataaagtgggcaaaatatagtctggatgttttactttttggtgaactggttagtactgcagaaaaaccacgacttaaagaaggccttatacatgaacaagacacagttgctcagttcggaccacaaaaagaaccagtaagacagcagattcatcgcatgttcctcttaagagtgaagctcatgcatttcgtgaacagcttgcacaactacatcatgaccaggattctacacagtacagggctggagtttcaacatcaagtcgaggaagccaaggatttagatcaattgattaaaattcactataggtatctgtcaaccatccatgaccggtgtctgctgagagaaaaggtcagctttgtgaaagaagctatcatgaaggtgttgaacttggctctcatgtttgcagacggttggcaggcaggcctgggcacttggcgaatggaatctatagagaaaatggaatctgattttaaaaactgccatatgtttcttgtaaccattttaaacaaagccgtctgtagaggatcctttccccattgtgagtatatcatgttaaaatatttctacctctgtatttccttgtaactaagtgtatgtgtcattgttttgttactgatcccatgaagaattagaaattctcaccattttcaaaactgaaaagtcccttagcagttgtcccatgctttgaattgctttttaagcattacggtgaggtgagtgtaagcctgaggatcttactttctggtataccatttattacaacagatttctaaaactcctattaaataaagttgatggcagaatagatttctgtcacacttca

SEQ ID NO: 196162 - DNA, 338 bp, Homo sapiens
  Payload ID: 18695
  Gene Name: tubulin, gamma complex associated protein 5
  ENST ID: ENST00000625645
  CDS Start-End: 30-338
gttagacgcgcgctgcaggagcgcggaacatggcgcggcacgggccaccgtggagtcggttggacgcgcagcaggagcgcgacgtgcgggagctcgtccggggtgtcgccggcctccaggacgaggcagaccccaacttccagctcgccctaaacttcgcctggtccaacttcagatttcatcgtttcttggatgtcaacagccacaaaatagaaaaaacaatcgaaggaatttatgaaaaatttgtcattcattctgatctaagcaaagctgctagttggaagagattaacggaggaatttctaaatgcaccacttcccagtataaaggaaataaag

SEQ ID NO: 196163 - DNA, 335 bp, Homo sapiens
  Payload ID: 18695
  Gene Name: tubulin, gamma complex associated protein 5
  ENST ID: ENST00000630031
  CDS Start-End: 27-335
agacgcgcgctgcaggagcgcggaacatggcgcggcacgggccaccgtggagtcggttggacgcgcagcaggagcgcgacgtgcgggagctcgtccggggtgtcgccggcctccaggacgaggcagaccccaacttccagctcgccctaaacttcgcctggtccaacttcagatttcatcgtttcttggatgtcaacagccacaaaatagaaaaaacaatcgaaggaatttatgaaaaatttgtcattcattctgatctaagcaaagctgctagttggaagagattaacggaggaatttctaaatgcaccacttcccagtataaaggaaataaag

SEQ ID NO: 196164 - DNA, 757 bp, Homo sapiens
  Payload ID: 18695
  Gene Name: tubulin, gamma complex associated protein 5
  ENST ID: ENST00000627961
  CDS Start-End: 24-461
cgcgcgctgcaggagcgcggaacatggcgcggcacgggccaccgtggagtcggttggacgcgcagcaggagcgcgacgtgcgggagctcgtccggggtgtcgccggcctccaggacgaggcagaccccaacttccagctcgccctaaacttcgcctggtccaacttcagatttcatcgtttcttggatgtcaacagccacaaaatagaaaaaacaatcgagggaatttatgaaaaatttgtcattcattctgatctaagcaaagctgctagttggaagagattaacggaggaatttctaaatgcaccacttcccagtataaaggaaataaagatgcacattattccatactgtcacttcttctgtgtctgtcagactctccttcaaacagcagttatgtggagacaccaagaaataaagaagtggaaaagaaagatgatttcgactggggaaaatacttgatggaagatgaagaaatggacattggtccgtacatggacacaccaaattggtctgaagaaagtgaagaggaaaatgatcaacagcccttaagcagagaggactctggaattcaggtagacaggacaccgttagaagaacaagatcaaaacagaaaactggatccttgtatcagttggaaagatgagccagatgaccgaagctggctggaacatcatgtggtccatcagtactggacagccaggccctcccattttcctcatagtttacatttgcactctaatttagctgctgtctgg

SEQ ID NO: 196165 - DNA, 439 bp, Homo sapiens
  Payload ID: 18695
  Gene Name: tubulin, gamma complex associated protein 5
  ENST ID: ENST00000625753
  CDS Start-End: 131-439
gaagtcgcccggcgcgggagcgcgaactctcgcgagaatgccgccagctccggaggcgactgcggcaggagcccgagctctcgcgcgacaggcaccaattcgttagacgcgcgctgcaggagcgcggaacatggcgcggcacgggccaccgtggagtcggttggacgcgcagcaggagcgcgacgtgcgggagctcgtccggggtgtcgccggcctccaggacgaggcagaccccaacttccagctcgccctaaacttcgcctggtccaacttcagatttcatcgtttcttggatgtcaacagccacaaaatagaaaaaacaatcgaaggaatttatgaaaaatttgtcattcattctgatctaagcaaagctgctagttggaagagattaacggaggaatttctaaatgcaccacttcccagtataaaggaaataaag

SEQ ID NO: 196166 - DNA, 500 bp, Homo sapiens
  Payload ID: 18695
  Gene Name: tubulin, gamma complex associated protein 5
  ENST ID: ENST00000626693
  CDS Start-End: 1-500
attaacggaggaatttctaaatgcaccacttcccagtataaaggaaataaagacagatgcacattattccatactgtcacttcttctgtgtctgtcagactctccttcaaacagcagttatgtggagacaccaagaaataaagaagtggaaaagaaagatgatttcgactggggaaaatacttgatggaagatgaagaaatggacattggtccgtacatggacacaccaaattggtctgaagaaagtgaagaggaaaatgatcaacagcccttaagcagagaggactctggaattcaggtagacaggacaccgttagaagaacaagatcaaaacagaaaactggatccttgtatcagttggaaagatgaccgaagctggctggaacatcatgtggtccatcagtactggacagccaggccctcccattttcctcatagtttacatttgcactctaatttagctgctgtctgggaccaacacttgtacagcagtgatccat

SEQ ID NO: 196167 - DNA, 3588 bp, Homo sapiens
  Payload ID: 18695
  Gene Name: tubulin, gamma complex associated protein 5
  ENST ID: ENST00000631187
  CDS Start-End: 27-3107
agacgcgcgctgcaggagcgcggaacatggcgcggcacgggccaccgtggagtcggttggacgcgcagcaggagcgcgacgtgcgggagctcgtccggggtgtcgccggcctccaggacgaggcagaccccaacttccagctcgccctaaacttcgcctggtccaacttcagatttcatcgtttcttggatgtcaacagccacaaaatagaaaaaacaatcgagggaatttatgaaaaatttgtcattcattctgatctaagcaaagctgctagttggaagagattaacggaggaatttctaaatgcaccacttcccagtataaaggaaataaagacagatgcacattattccatactgtcacttcttctgtgtctgtcagactctccttcaaacagcagttatgtggagacaccaagaaataaagaagtggaaaagaaagatgatttcgactggggaaaatacttgatggaagatgaagaaatggacattggtccgtacatggacacaccaaattggtctgaagaaagtgaagaggaaaatgatcaacagcccttaagcagagaggactctggaattcaggtagacaggacaccgttagaagaacaagatcaaaacagaaaactggatccttgtatcagttggaaagatgagccagatgaccgaagctggctggaacatcatgtggtccatcagtactggacagccaggccctcccattttcctcatagtttacatttgcactctaatttagctgctgtctgggaccaacacttgtacagcagtgatccattgtatgttccagatgacagggttttggttactgagactcaggttattcgggaaaccctatggttactttcaggagtgaaaaagctctttatatttcagttgatagatgggaaggtaactgtgagaaacaatattatagtaactcatttaacacatagctgtttacgatctgtgctggaacaaatagcagcatatggccaggttgtgtttcgactccaggagttcattgatgaagtcatgggacacagttctgagagcatgctgcctggaagtgggtctgttcctaagaagtcaactgaagctccctttagaacctaccaggctttcatgtgggccctgtacaaatatttcattagtttcaaagaggaacttgcagaaattgagaagtgcatcatcaataatgatactacaataactcttgcaatagtggtggacaagttggcacctcgattgtctcagctcaaggttctgcacaaagtgtttagtactggagtagcagaagttccacctgatactcgaaatgtcgtccgggcctctcacctgcttaacaccctgtacaaggccattcttgaatatgacaatgttggagaagcctctgagcaaaccgtctccctccttttctctctctgggtggaaacggtgcggccttacctgcagacggtggacgagtggatcgtgcacgggcacctgtgggatggcgccagggagttcatcatccagagaaacaaaaatgttccagttaatcacagagacttctggtatgcaacttacacgttatatagcgtatcagaaaagacagaaaatgaagaaaaaatgagtgataacgctagtgcgagttccggcagtgaccaggggccctccagcaggcagcacaccatggtgtccttcctcaaacctgtcctgaagcagatcataatggctggcaagtcgatgcagctgctgaagaacctgcagtgtgcggagagcaccacctgccaggcaggagccagagatgcagaaagaaaaagtttatacactctctttctggaatctgtacagtcccgtcttcgacatggagaagattccactccacaggttcttactgagcaacaggcaaccaaggagaacctgatgaagatgcagtccattgctgaaagccatcttgaactggatgatgttcatgatccactgcttgccattaactttgcaaggatgtatttggagcagagtgactttcacgagaagtttgctggtggtgatgtatgtgtggatagatcatcggaatctgtgacatgccagacttttgaattaacgctgagatcctgcctctatcctcatattgacaagcagtatctagattgctgtggaaatctcatgcaaactctaaaaaaagattacaggttggtagaatacttgcaagctatgaggaattttttcttaatggaaggaggagataccatgtatgacttctacacgtcaatttttgataaaataagagaaaaggaaacatggcagaatgtgtcttttcttaatgtccaactccaagaagcagtaggacagcgttatcctgaagatagttcacgtctatctatatcttttgaaaatgttgacacagctaagaagaagctgcctgttcatatcttagatggtctgaccctcagctacaaggtcccatggcccgtggacattgttataagtttggaatgtcaaaaaatttataatcaagtgtttcttctcttattgcaaataaagtgggcaaaatatagtctggatgttttactttttggtgaactggttagtactgcagaaaaaccacgacttaaagaaggccttatacatgaacaagacacagttgctcagttcggaccacaaaaagaaccagtaagacagcagattcatcgcatgttcctcttaagagtgaagctcatgcatttcgtgaacagcttgcacaactacatcatgaccaggattctacacagtacagggctggagtttcaacatcaagtcgaggaagccaaggatttagatcaattgattaaaattcactataggtatctgtcaaccatccatgaccggtgtctgctgagagaaaaggtcagctttgtgaaagaagctatcatgaaggtgttgaacttggctctcatgtttgcagacggttggcaggcaggcctgggcacttggcgaatggaatctatagagaaaatggaatctgattttaaaaactgccatatgtttcttgtaaccattttaaacaaagccgtctgtagaggatcctttccccattgtcttgctttgttgcccatgctggagcgcattggcacagtcttggctcactgaagcctcaacctccggggaccaagcactcctccctcagcctcctgagtagctgagactacagatggaatctcactctgtgagtctcactctatcgcccaggctggagtgcagtggcacaatctcagctcactgcaacctctgcctccagagctcaagcaatccgcccaccttgacctcccaaaatgctgggattaccgacctgtgtgtactttataaattaaactttatcataggcctgcatatatagaaaaatatatagtctatacagtgtagagtgtgctactatctgtcctttcagacatccaccaggggtcttgaagcttatcccccagaagatgaggtgggaactactgtaaataattttgaccctttgaaatctgatgagacttgttttacttcctaacatatggtatattttgtgaatgttacgtgtttatttgaaaactttaattcctgtcagtaacagcttgaagtcttcagt

SEQ ID NO: 196168 - DNA, 5612 bp, Homo sapiens
  Payload ID: 18696
  Gene Name: tubulin, gamma complex associated protein 6
  Uniprot ID: Q96RT7
  ENST ID: ENST00000248846
  CDS Start-End: 106-5565
attcagcctcttcggaccctctctcactccctgtcttccggagcgtgagtgaagcccgggtgaggtgttttcccacacgccgggggcccggagctgagaaggggcatggccagcatcacgcagctgttcgacgacctgtgtgaggccctcctgccggctgccaagactcacctgggccagcgcagtgtgaaccggaagagggcaaagcggagcctcaagaaggtggcctacaatgctcttttcacaaatctttttcaagatgagactcaacagctgcagcctgacatgtcaaaactaccagcgagaaacaagatcctcatgttgtcctttgacttgagagtgggtggcctgggccccaaggccgaccgtttggaggagcttgtggaggagctggaagcagccccttgctgtccgcttttggaggtggggtctgttttggacctcctggttcagctggcagggagtggtccccctcaagttctgccgagaaaacgagactacttccttaacaacaagcatgtggggagaaacgttccgtacagcggctatgattgcgacgacctgagtgtgtttgagatggacgttcagtctctgatctccagagaagagtgtttgtgtcacagcatgatccaggaaacacttcaggttatggaggctgctccaggcactggcctgcccaccgtcgggctcttctcatttggtgacccttgtggtgacaggttcgagagagacacccgggtctcgctcttcggggcccttgtgcacagccgcacttatgacatggacgtccgactgggcctgccccccgtgccagacaatgcggacctctctgggctggctattaaggtcccaccgagtgtggatcagtgggaagacgaaggattccagtcagcgtccaacttgactcctgattcccagtctgagcccagcgtgaccccagacgtggacctgtgggaagccgcacttacctatgaggccagcaagcggaggtgctgggagcgagttggctgcccccctggccacagagaggagccttacctgacggaggcgggaagggacgctttcgacaagttctgcaggctccaccaaggggagctccagctgcttgctgggggcgtcctacaggccccgcagcccgtgctggtgaaggagtgcgagctggtgaaagacgtgctgaacgtcttgattggggtcgtgtctgccacgttttcgctctgccagccggcccaggcctttgtggtgaagcggggcgtccacgtgtcaggagcgtctcccgagagcatcagcagcctgctctcggaagtggccgagtatgggacctgctacacgcgcctgagtcatttctctctgcagcccgtcctggactctttgtacagcaagggcctcgtgttccaggccttcaccagtggcctgaggaggtacctgcagtattaccgggcctgcgtcctttccactccgcccaccctgagcctcctcaccattggttttctcttcaagaaacttggccggcagctcaggtacctggccgagctctgtggcgttggcgctgtgctcccgggcacctgtggaggaggccccagggccgcgtttcccaccggcgtgaagctgctgtcctacctctaccaggaggctctgcacaactgcagcaacgagcactaccctgtactgctgtccctgctgaagaccagctgcgagccctacacccggttcatccacgactgggtgtacagcggggtgttcagagacgcttatggcgagttcatgattcaggtgaaccacgagtacctcagcttccgagataagttgtactggacacatggctacgtgctcatctccaaagaggtggaggactgtgttcccgtgtttctgaagcacattgcccacgacatatacgtctgcggaaagaccattaacctgctgaagctctgctgcccccggcattacctctgttggtccgacgtccctgtcccccggatctcggtgattttctcccttgaggagttgaaggagattgagaaggactgtgccgtctacgttgggcgcatggagagggtggcccgccacagctctgtcagcaaggaggagaaggaattacgtatggaaattgcaaaacaagaattaatcgctcatgcccgggaagcagcatccagggtcctgagtgcactgagtgaccggcagatgtcagaacggatggccttggatgcccggaagcgtgagcagtttcagaggctgaaagaacaatttgtgaaggaccaggagcgacgccaggcggccaggcaggaggagctggatgatgacttcagctacgcccgtgaactccgagacagggagagaaggctgaagtccctggaggaggagctggagaggaaggcgaggcaggcactggtcgaccactacagcaagctctctgcagaggcagctcgtcgggagcagaaggcactgtggagaatccagaggcaccgactggagagtgcacggcttcgttttctcttagaagatgagaaacacattcaggagatgctgaaagcagtgtctgaggctcaccagccccaggagccgccagacgtcctcttgagcgtgcacccccaggtcacgtctccgggccctgagcacccagagggaggccaaggctgtgattctgggtctgcagagcaacactcgcctgcctgggatggctggaacaggccaggcctgctgaccccacagccccttaagcctctagcagtgggggctggtggcagggggctgcagcaggcggagggggccagacccttctctgacagcctcagcattggagacttcctacctgtgggcccaggggctgagccgtccgtgcagactggcatggtccctctcctggaggtggcgctgcagaccattaacttggacctgcccccctcagctcctggggaggcacccgcagcagccagcactcagccctccaggccacaggagtacgactttagtactgtcctgaggccagctgtggccacctcacctgcaccagggcccctgcaggctgcagagtgcagcttgggcagctcagggctacagctgtgggaggacagttgtgggaagatggatgcctgtggctccgcctcgcgggagactctgctcccctcacacccacccaggcgtgctgctctggaggaggggagcagccagcccacagagcggctctttgggcaggtgtcagggggtggtcttcccacaggggactacgcttctgaaatagctcccacccggccacggtggaacacccacgggcacgtgtctgacgccagcatcagggtcggggagaatgtgtcagatgtggctcccacccagccacggtggaacacccacggacacgtatccaatgccagcatcagcttaggggagtctgtgtcagatgtggctcccactcggccacggtggaacatccatggacatgtgtccaacgccagcatcagggtcggggagaatgtgtcagatgtggctcccaccaggccacggtggaatacccacgggcacgtgtccaacgccagcatcagggttggggagaacgtgtcggacgtggctcccacccggccacggtggaacacccatggacacgtgtccgatgccagcatcagcttgggggagtctgtgtcagacatggctcccgcccggccacggtggaacacccatggacacgtgtctgatgccagcatcagcttgggggagtctgtgtcagacatggctcccacccggccacggtggaacacccacggacatgtgtctgacaccagcatcagggttggggagaacgtatcggacgtggctcccatccggtcacggtgcaacacccatggacacgtgtccgacgccagcatcagcttgggggagcctgtgtcggatgtggtttccacccggccacggtggaacacccatgtacccatccctccgccccacatggtgctgggggctctctcaccagaagctgagcccaacacacccaggccccaacagagcccccctggccacacgtcccagtcagcgctcagcctgggagcacagagcactgtgctggactgtgggccacggctgcctgtagaagtggggccatctctgtcctcccccagctcgggctgcggggaggggagcatcagcgtgggggagaacgtgtcagacgtggctcccacccaaccatggtggcccaacaccccgggagacagtgtctctgaagaactaggccctgggaggagcggggacactgaggacctctctccaaattggcctctcaactcacaggaagacacagctgcccagagcagcccaggccgtggtgaggaggcggaggcatcggcggcggaggctcagggtggggagcaggcctacctggcaggcctggcagggcagtaccacttggagcggtacccggacagttacgagtccatgtccgagccgcccattgctcatcttttgcgccccgtgcttccccgggccttcgccttccccgtggacccccaggtccagtctgccgctgatgagactgctgtgcagctgagcgagttgctgacgctgcccgtgctcatgaagcgctccatcacggcaccgctggccgcccacatctccttggtgaacaaggccgctgtcgactacttcttcgtggagctgcacctggaggcgcactatgaggcactgcggcacttcctgctgatggaggacggcgagttcgcccagtccctcagcgacctgctctttgagaagcttggagctgggcaaacgcccggagagctgctcaacccgctggtgctgaactctgtgctgagcaaggccctgcagtgcagcctgcatggggacaccccgcacgcctccaacctctccctcgctctcaagtacctgcccgaggtgtttgcccccaacgccccggatgtgctgagctgcctggagctcaggtacaaggtggactggcctctcaacattgtcatcaccgagggctgcgtgagcaagtacagcggcgtcttctccttcctgctgcagctgaagctcatgatgtgggcgctcaaggacgtctgcttccacctcaagcgcacagccctgctgagccacatggccggctctgtgcagttccgtcagctgcagctgttcaagcacgagatgcagcatttcgtgaaggtcatccagggctacatcgccaaccagatcctgcacgtcacctggtgcgagttcagggccaggttggccaccgtgggcgacctggaggagatccagcgtgcgcacgcagagtacctgcacaaggccgtcttcaggggcctgctcacggagaaggcggcgcccgtcatgaacgtcatccacagcatcttcagcctcgtgctcaagttccgcagccagctcatctcccaggcctgggggccccctgggggcccgcggggtgcagagcaccccaactttgcactcatgcagcagtcctacaacaccttcaagtactactcccactttctcttcaaagtggtgaccaagctggtgaaccgcggctaccagccccacctggaggactttctgctgcgcatcaacttcaacaactactaccaggacgcctgaggctgctctgcgggggacgtgcacaataaaggtgttctcggaccctg

SEQ ID NO: 196169 - DNA, 6078 bp, Homo sapiens
  Payload ID: 18696
  Gene Name: tubulin, gamma complex associated protein 6
  ENST ID: ENST00000439308
  CDS Start-End: 513-4994
actttccacgggtgaggcctggagaacgggtggacgtgcaggccagaacccgggacccacccggctgagcccccagactctccgctgcccacgaccctcggagtggcaccctctcctggccgtctcctctcgtgggtcccgaagaacgggtgcaaagccgagttcgtccgctgtactgcgcgggcgcgcgtttcgttcttcggttttgccacggttctgtgactccctaaaggttgagggctactgaattagaagaaacgccgagctggcttctggtgggctgccgggcgccgggcagcgtgcttggactggggagggcagggcgtgtttactctgagtagagcaaccgcaagacctcctttaaaaaataccagttctgagcttcggcattggagaggccgcctgtcattcagcctcttcggaccctctctcactccctgtcttccggagcgtgagtgaagcccgggtgaggtgttttcccacacgccgggggcccggagctgagaaggggcatggccagcatcacgcagctgttcgacgacctgtgtgaggccctcctgccggctgccaagactcacctgggccagcgcagtgtgaaccggaagagggcaaagcggagcctcaagaaggtggcctacaatgctcttttcacaaatctttttcaagatgagactcaacagctgcagcctgacatgtcaaaactaccagcgagaaacaagatcctcatgttgtcctttgacttgagagtgggtggcctgggccccaaggccgaccgtttggaggagcttgtggaggagctggaagcagccccttgctgtccgcttttggaggtggggtctgttttggacctcctggttcagctggcagggagtggtccccctcaagttctgccgagaaaacgagactacttccttaacaacaagcatgtggggagaaacgttccgtacagcggctatgattgcgacgacctgagtgtgtttgagatggacgttcagtctctgatctccagagaagagtgtttgtgtcacagcatgatccaggaaacacttcaggttatggaggctgctccaggcactggcctgcccaccgtcgggctcttctcatttggtgacccttgtggtgacaggttcgagagagacacccgggtctcgctcttcggggcccttgtgcacagccgcacttatgacatggacgtccgactgggcctgccccccgtgccagacaatgcggacctctctgggctggctattaaggtcccaccgagtgtggatcagtgggaagacgaaggattccagtcagcgtccaacttgactcctgattcccagtctgagcccagcgtgaccccagacgtggacctgtgggaagccgcacttacctatgaggccagcaagcggaggtgctgggagcgagttggctgcccccctggccacagagaggagccttacctgacggaggcgggaagggacgctttcgacaagttctgcaggctccaccaaggggagctccagctgcttgctgggggcgtcctacaggccccgcagcccgtgctggtgaaggagtgcgagctggtgaaagacgtgctgaacgtcttgattggggtcgtgtctgccacgttttcgctctgccagccggcccaggcctttgtggtgaagcggggcgtccacgtgtcaggagcgtctcccgagagcatcagcagcctgctctcggaagtggccgagtatgggacctgctacacgcgcctgagtcatttctctctgcagcccgtcctggactctttgtacagcaagggcctcgtgttccaggccttcaccagtggcctgaggaggtacctgcagtattaccgggcctgcgtcctttccactccgcccaccctgagcctcctcaccattggttttctcttcaagaaacttggccggcagctcaggtacctggccgagctctgtggcgttggcgctgtgctcccgggcacctgtggaggaggccccagggccgcgtttcccaccggcgtgaagctgctgtcctacctctaccaggaggctctgcacaactgcagcaacgagcactaccctgtactgctgtccctgctgaagaccagctgcgagccctacacccggttcatccacgactgggtgtacagcggggtgttcagagacgcttatggcgagttcatgattcaggtgaaccacgagtacctcagcttccgagataagttgtactggacacatggctacgtgctcatctccaaagaggtggaggactgtgttcccgtgtttctgaagcacattgcccacgacatatacgtctgcggaaagaccattaacctgctgaagctctgctgcccccggcattacctctgttggtccgacgtccctgtcccccggatctcggtgattttctcccttgaggagttgaaggagattgagaaggactgtgccgtctacgttgggcgcatggagagggtggcccgccacagctctgtcagcaaggaggagaaggaattacgtatggaaattgcaaaacaagaattaatcgctcatgcccgggaagcagcatccagggtcctgagtgcactgagtgaccggcagatgtcagaacggatggccttggatgcccggaagcgtgagcagtttcagaggctgaaagaacaatttgtgaaggaccaggagcgacgccaggcggccaggcaggaggagctggatgatgacttcagctacgcccgtgaactccgagacagggagagaaggctgaagtccctggaggaggagctggagaggaaggcgaggcaggcactggtcgaccactacagcaagctctctgcagaggcagctcgtcgggagcagaaggcactgtggagaatccagaggcaccgactggagagtgcacggcttcgttttctcttagaagatgagaaacacattcaggagatgctgaaagcagtgtctgaggctcaccagccccaggagccgccagacgtcctcttgagcgtgcacccccaggtcacgtctccgggccctgagcacccagagggaggccaaggctgtgattctgggtctgcagagcaacactcgcctgcctgggatggctggaacaggccaggcctgctgaccccacagccccttaagcctctagcagtgggggctggtggcagggggctgcagcaggcggagggggccagacccttctctgacagcctcagcattggagacttcctacctgtgggcccaggggctgagccgtccgtgcagactggcatggtccctctcctggaggtggcgctgcagaccattaacttggacctgcccccctcagctcctggggaggcacccgcagcagccagcactcagccctccaggccacaggagtacgactttagtactgtcctgaggccagctgtggccacctcacctgcaccagggcccctgcaggctgcagagtgcagcttgggcagctcagggctacagctgtgggaggacagttgtgggaagatggatgcctgtggctccgcctcgcgggagactctgctcccctcacacccacccaggcgtgctgctctggaggaggggagcagccagcccacagagcggctctttgggcaggtgtcagggggtggtcttcccacaggggactacgcttctgaaatagctcccacccggccacggtggaacacccacgggcacgtgtctgacgccagcatcagggtcggggagaatgtgtcagatgtggctcccacccagccacggtggaacacccacggacacgtatccaatgccagcatcagcttaggggagtctgtgtcagatgtggctcccactcggccacggtggaacatccatggacatgtgtccaacgccagcatcagggtcggggagaatgtgtcagatgtggctcccaccaggccacggtggaatacccacgggcacgtgtccaacgccagcatcagggttggggagaacgtgtcggacgtggctcccacccggccacggtggaacacccatggacacgtgtccgatgccagcatcagcttgggggagtctgtgtcagacatggctcccgcccggccacggtggaacacccatggacacgtgtctgatgccagcatcagcttgggggagtctgtgtcagacatggctcccacccggccacggtggaacacccacggacatgtgtctgacaccagcatcagggttggggagaacgtatcggacgtggctcccatccggtcacggtgcaacacccatggacacgtgtccgacgccagcatcagcttgggggagcctgtgtcggatgtggtttccacccggccacggtggaacacccatgtacccatccctccgccccacatggtgctgggggctctctcaccagaagctgagcccaacacacccaggccccaacagagcccccctggccacacgtcccagtcagcgctcagcctgggagcacagagcactgtgctggactgtgggccacggctgcctgtagaagtggggccatctctgtcctcccccagctcgggctgcggggaggggagcatcagcgtgggggagaacgtgtcagacgtggctcccacccaaccatggtggcccaacaccccgggagacagtgtctctgaagaactaggtcagagtagggtggctggtggtcaggagtgggactgtgggacgcacagagcctgggaggccctgggaggagcggggacactgaggacctctctccaaattggcctctcaactcacaggaagacacagctgcccagagcagcccaggccgtggtgaggaggcggaggcatcggcggcggaggctcagggtggggagcaggcctacctggcaggcctggcagggcagtaccacttggagcggtacccggacagttacgagtccatgtccgagccgcccattgctcatcttttgcgccccgtgcttccccgggccttcgccttccccgtggacccccaggtccagtctgccgctgatgagactgctgtgcagctgagcgagttgctgacgctgcccgtgctcatgaagcgctccatcacggcaccgctggccgcccacatctccttggtgaacaaggccgctgtcgactacttcttcgtggagctgcacctggaggcgcactatgaggcactgcggcacttcctgctgatggaggacggcgagttcgcccagtccctcagcgacctgctctttgagaagcttggagctgggcaaacgcccggagagctgctcaacccgctggtgctgaactctgtgctgagcaaggccctgcagtgcagcctgcatggggacaccccgcacgcctccaacctctccctcgctctcaagtacctgcccgaggtgtttgcccccaacgccccggatgtgctgagctgcctggagctcaggtacaaggtggactggcctctcaacattgtcatcaccgagggctgcgtgagcaagtacagcggcgtcttctccttcctgctgcagctgaagctcatgatgtgggcgctcaaggacgtctgcttccacctcaagcgcacagccctgctgagccacatggccggctctgtgcagttccgtcagctgcagctgttcaagcacgagatgcagcatttcgtgaaggtcatccagggctacatcgccaaccagatcctgcacgtcacctggtgcgagttcagggccaggttggccaccgtgggcgacctggaggagatccagcgtgcgcacgcagagtacctgcacaaggccgtcttcaggggcctgctcacggagaaggcggcgcccgtcatgaacgtcatccacagcatcttcagcctcgtgctcaagttccgcagccagctcatctcccaggcctgggggccccctgggggcccgcggggtgcagagcaccccaactttgcactcatgcagcagtcctacaacaccttcaagtactactcccactttctcttcaaagtggtgaccaagctggtgaaccgcggctaccagccccacctggaggactttctgctgcgcatcaacttcaacaactactaccaggacgcctgaggctgctctgcgggggacgtgcacaataaaggtgttctcggaccctg

SEQ ID NO: 196170 - DNA, 1509 bp, Homo sapiens
  Payload ID: 18696
  Gene Name: tubulin, gamma complex associated protein 6
  ENST ID: ENST00000425018
  CDS Start-End: 1-1467
ctggactgtgggccacggctgcctgtagaagtggggccatctctgtcctcccccagctcgggctgcggggaggggagcatcagcgtgggggagaacgtgtcagacgtggctcccacccaaccatggtggcccaacaccccgggagacagtgtctctgaagaactaggccctgggaggagcggggacactgaggacctctctccaaattggcctctcaactcacaggaagacacagctgcccagagcagcccaggccgtggtgaggaggcggaggcatcggcggcggaggctcagggtggggagcaggcctacctggcaggcctggcagggcagtaccacttggagcggtacccggacagttacgagtccatgtccgagccgcccattgctcatcttttgcgccccgtgcttccccgggccttcgccttccccgtggacccccaggtccagtctgccgctgatgagactgctgtgcagctgagcgagttgctgacgctgcccgtgctcatgaagcgctccatcacggcaccgctggccgcccacatctccttggtgaacaaggccgctgtcgactacttcttcgtggagctgcacctggaggcgcactatgaggcactgcggcacttcctgctgatggaggacggcgagttcgcccagtccctcagcgacctgctctttgagaagcttggagctgggcaaacgcccggagagctgctcaacccgctggtgctgaactctgtgctgagcaaggccctgcagtgcagcctgcatggggacaccccgcacgcctccaacctctccctcgctctcaagtacctgcccgaggtgtttgcccccaacgccccggatgtgctgagctgcctggagctcaggtacaaggtggactggcctctcaacattgtcatcaccgagggctgcgtgagcaagtacagcggcgtcttctccttcctgctgcagctgaagctcatgatgtgggcgctcaaggacgtctgcttccacctcaagcgcacagttccgtcagctgcagctgttcaagcacgagatgcagcatttcgtgaaggtcatccagggctacatcgccaaccagatcctgcacgtcacctggtgcgagttcagggccaggttggccaccgtgggcgacctggaggagatccagcgtgcgcacgcagagtacctgcacaaggccgtcttcaggcggcgcccgtcatgaacgtcatccacagcatcttcagcctcgtgctcaagttccgcagccagctcatctcccaggcctgggggccccctgggggcccgcggggtgcagagcaccccaactttgcactcatgcagcagtcctacaacaccttcaagtactactcccactttctcttcaaagtggtgaccaagctggtgaaccgcggctaccagccccacctggaggactttctgctgcgcatcaacttcaacaactactaccaggacgcctgaggctgctctgcgggggacgtgcacaataaaggtgttctcgga

SEQ ID NO: 196171 - DNA, 830 bp, Homo sapiens
  Payload ID: 18696
  Gene Name: tubulin, gamma complex associated protein 6
  ENST ID: ENST00000434349
  CDS Start-End: 1-830
cgagtgtggatcagtgggaagacgaaggattccagtcagcgtccaacttgactcctgattcccagtctgagcccagcgtgaccccagacgtggacctgtgggaagccgcacttacctatgaggccagcaagcggagcccccctggccacagagaggagccttacctgacggaggcgggaagggacgctttcgacaagttctgcaggctccaccaaggggagctccagctgcttgctgggggcgtcctacaggccccgcagcccgtgctggtgaaggagtgcgagctggtgaaagacgtgctgaacgtcttgattggggtcgtgtctgccacgttttcgctctgccagccggcccaggcctttgtggtgaagcggggcgtccacgtgtcaggagcgtctcccgagagcatcagcagcctgctctcggaagtggccgagtatgggacctgctacacgcgcctgagtcatttctctctgcagcccgtcctggactctttgtacagcaagggcctcgtgttccaggccttcaccagtggcctgaggaggtacctgcagtattaccgggcctgcgtcctttccactccgcccaccctgagcctcctcaccattggttttctcttcaagaaacttggccggcagctcaggtacctggccgagctctgtggcgttggcgctgtgctcccgggcacctgtggaggaggccccagggccgcgtttcccaccggcgtgaagctgctgtcctacctctaccaggaggctctgcacaactgcagcaacgagcactaccctgtactgctgtccctgctgaagaccagctgcgagccctacacc

SEQ ID NO: 196172 - DNA, 1754 bp, Homo sapiens
  Payload ID: 18697
  Gene Name: tubulointerstitial nephritis antigen
  Uniprot ID: Q9UJW2
  ENST ID: ENST00000259782
  CDS Start-End: 97-1527
gtcttaatgactagaattcaggttccaaggagaagcccacaaggctaagggtattggatataacggaaagtggaagctatacctgacttccagagaatgtggaccggatataagatcttaatcttctcttatcttactacagaaatctggatggagaagcagtatttatctcaaagagaagtggacctagaggcttatttcactaggaatcacaccgttttgcaaggtactcgattcaaaagagccattttccaagggcaatactgtagaaattttggctgttgtgaagacagagatgatggctgtgtcactgagttctatgcggcgaatgcgttgtgctactgtgataaattctgtgacagagaaaattctgattgctgtcctgactacaagtccttttgccgtgaagagaaagaatggcctcctcacacacagccttggtatccagaaggttgcttcaaagatggtcaacattatgaagagggatcagtaattaaagaaaactgcaactcctgcacatgctcaggacagcaatggaaatgttcccagcatgtatgccttgttcgttcagaattaattgaacaggtcaataaaggagactatggatggacagcacagaattacagccaattttggggaatgactttagaagatggttttaaatttcgccttggcactttgccacctagtcccatgctcctgagcatgaatgaaatgacagcttctttacctgcaacaactgatcttccagagttttttgttgcttcttataaatggcctggatggactcatggcccattggatcaaaaaaattgtgctgcatcctgggcattttccactgcaagtgtggctgctgaccgaatagcaattcagtctaagggtcgatacacggccaatctatcccctcagaatttgatctcttgctgtgccaagaaccgtcatggatgcaatagtggaagcatcgatagggcttggtggtacctgagaaaacgtggactggtatcccacgcatgctacccacttttcaaagaccaaaatgctaccaacaatggatgtgccatggcaagcaggtctgatgggcgaggaaaacggcatgccacgaagccatgtcccaacaacgtagaaaaatctaacaggatctatcaatgttctcctccatacagagtctcttccaacgaaactgagataatgaaagaaatcatgcaaaatggaccagttcaagccataatgcaagtccgtgaagatttcttccattataagacagggatatacagacatgttaccagcacaaataaagaatcagaaaaatatcgaaagcttcagacacatgcagtcaaactcactggatggggcacactgagaggagcacaagggcagaaagaaaaattttggattgctgccaattcctggggaaagtcatggggagagaatggctatttcaggattcttcgaggagtaaatgagtccgacattgaaaagttgattatcgcagcttggggccaactgacgagttctgatgaaccataacatatcattaaatttccataaggtcatgcctttaagtaaccccctaaattgaagtttagcaatatgacattcttggtgacagtggaatctttgtctcttcaccgtgttaacataatctatctattttcttattttcccctctggtctatgcttctgcttccttcatattactgagcattaacaacaccaataaaggacagcagagtccctaaatgtctttaaagttc

SEQ ID NO: 196173 - DNA, 692 bp, Homo sapiens
  Payload ID: 18697
  Gene Name: tubulointerstitial nephritis antigen
  ENST ID: ENST00000370864
  CDS Start-End: 33-644
taatcttctcttatcttactacagaaatctggatggagaagcagtatttatctcaaagagaagtggacctagaggcttatttcactaggaatcacaccgttttgcaaggtactcgattcaaaagagccattttccaagggcaatactgtagaaattttggctgttgtgaagacagagatgatggctgtgtcactgagttctatgcggcgaatgcgttgtgctactgtgataaattctgtgacagagaaaattctgattgctgtcctgactacaagtccttttgccgtgaagagaaagaatggcctcctcacacacagccttggtatccagaaggttgcttcaaagatggtcaacattatgaagagggatcagtaattaaagaaaactgcaactcctgcacatgctcaggacagcaatggaaatgttcccagcatgtatgccttgttcgttcagaattaattgaacaggtcaataaaggagactatggatggacagcacagaattacagccaattttggggaatgactttagaagatggttttaaatttcgccttggcactttgccacctagtcccatgctcctgagcatgaatgaaatgacagtaagtgttccttctgattcacgtatgtgcatgtatttgtaaaagtgtgtttgtgtgtgcattaaaagcaattataaatcactaaaataa

SEQ ID NO: 196174 - DNA, 782 bp, Homo sapiens
  Payload ID: 18697
  Gene Name: tubulointerstitial nephritis antigen
  ENST ID: ENST00000370869
  CDS Start-End: 101-718
ggtaggtaaatggagtacagatgggaaatcaaaccagtgtgtgactgggcatgatttagagcaactgttattgatatgacagatcctagcaggcaacctcatgagagcctggatgttcgtttcaatgcaggcagaaatctggatggagaagcagtatttatctcaaagagaagtggacctagaggcttatttcactaggaatcacaccgttttgcaaggtactcgattcaaaagagccattttccaagggcaatactgtagaaattttggctgttgtgaagacagagatgatggctgtgtcactgagttctatgcggcgaatgcgttgtgctactgtgataaattctgtgacagagaaaattctgattgctgtcctgactacaagtccttttgccgtgaagagaaagaatggcctcctcacacacagccttggtatccagaaggttgcttcaaagatggtcaacattatgaagagggatcagtaattaaagaaaactgcaactcctgcacatgctcaggacagcaatggaaatgttcccagcatgtatgccttgttcgttcagaattaattgaacaggtcaataaaggagactatggatggacagcacagaattacagccaattttggggaatgactttagaagatggttttaaatttcgccttggcactttgccacctagtcccatgctcctgagcatgaatgaaatgacagaatgattgaatgggctggcaagatggccgatcaagaacagctctggttggcagctcccagcgagaccaa

SEQ ID NO: 196175 - DNA, 2187 bp, Homo sapiens
  Payload ID: 18698
  Gene Name: tubulointerstitial nephritis antigen-like 1
  Uniprot ID: Q9GZM7
  ENST ID: ENST00000271064
  CDS Start-End: 77-1480
cgcagagccaggaggcggaggcgcgcgggccagcctgggccccagcccacaccttcaccagggcccaggagccaccatgtggcgatgtccactggggctactgctgttgctgccgctggctggccacttggctctgggtgcccagcagggtcgtgggcgccgggagctagcaccgggtctgcacctgcggggcatccgggacgcgggaggccggtactgccaggagcaggacctgtgctgccgcggccgtgccgacgactgtgccctgccctacctgggcgccatctgttactgtgacctcttctgcaaccgcacggtctccgactgctgccctgacttctgggacttctgcctcggcgtgccacccccttttcccccgatccaaggatgtatgcatggaggtcgtatctatccagtcttgggaacgtactgggacaactgtaaccgttgcacctgccaggagaacaggcagtggcagtgtgaccaagaaccatgcctggtggatccagacatgatcaaagccatcaaccagggcaactatggctggcaggctgggaaccacagcgccttctggggcatgaccctggatgagggcattcgctaccgcctgggcaccatccgcccatcttcctcggtcatgaacatgcatgaaatttatacagtgctgaacccaggggaggtgcttcccacagccttcgaggcctctgagaagtggcccaacctgattcatgagcctcttgaccaaggcaactgtgcaggctcctgggccttctccacagcagctgtggcatccgatcgtgtctcaatccattctctgggacacatgacgcctgtcctgtcgccccagaacctgctgtcttgtgacacccaccagcagcagggctgccgcggtgggcgtctcgatggtgcctggtggttcctgcgtcgccgaggggtggtgtctgaccactgctaccccttctcgggccgtgaacgagacgaggctggccctgcgcccccctgtatgatgcacagccgagccatgggtcggggcaagcgccaggccactgcccactgccccaacagctatgttaataacaatgacatctaccaggtcactcctgtctaccgcctcggctccaacgacaaggagatcatgaaggagctgatggagaatggccctgtccaagccctcatggaggtgcatgaggacttcttcctatacaagggaggcatctacagccacacgccagtgagccttgggaggccagagagataccgccggcatgggacccactcagtcaagatcacaggatggggagaggagacgctgccagatggaaggacgctcaaatactggactgcggccaactcctggggcccagcctggggcgagaggggccacttccgcatcgtgcgcggcgtcaatgagtgcgacatcgagagcttcgtgctgggcgtctggggccgcgtgggcatggaggacatgggtcatcactgaggctgcgggcaccacgcggggtccggcctgggatccaggctaagggccggcggaagaggccccaatggggcggtgaccccagcctcgcccgacagagcccggggcgcaggcgggcgccagggcgctaatcccggcgcgggttccgctgacgcagcgccccgcctgggagccgcgggcaggcgagactggcggagcccccagacctcccagtggggacggggcagggcctggcctgggaagagcacagctgcagatcccaggcctctggcgcccccactcaagactaccaaagccaggacacctcaagtctccagccccactaccccaccccactcctgtattcttttttttttttttttagacagggtcttgctccgttgcccaggttggagtgcagtggcccatcagggctcactgtaacctccgactcctgggttcaagtgaccctcccacctcagcctctcaagtagctgggactacaggtgcaccaccacacctggctaatttttgtattttttgtaaagaggggggtctcactgtgttgcccaggctggtctcgaactcctgggctcaagcggtccacctgcctccgcctcccaaagtgctgggattgcaggcatgagccactgcacccagccctgtattcttattcttcagatatttatttttcttttcactgttttaaaataaaaccaaagtattgataa

SEQ ID NO: 196176 - DNA, 2140 bp, Homo sapiens
  Payload ID: 18698
  Gene Name: tubulointerstitial nephritis antigen-like 1
  Uniprot ID: Q9GZM7
  ENST ID: ENST00000457433
  CDS Start-End: 127-1437
aaaaagcgccccgccccgcgctcctctcttgactttgagcgtccggcggtcgcagagccaggaggcggaggcgcgcgggccagcctgggccccagcccacaccttcaccagggcccaggagccaccatgtggcgatgtccactggggctactgctgttgctgccgctggctggccacttggctctgggtgcccagcagggtcgtgggcgccgggagctagcaccgggtctgcacctgcggggcatccgggacgcgggaggccggtactgccaggagcaggacctgtgctgccgcggccgtgccgacgactgtgccctgccctacctgggcgccatctgttactgtgacctcttctgcaaccgcacggtctccgactgctgccctgacttctgggacttctgcctcggcgtgccacccccttttcccccgatccaaggatgtatgcatggaggtcgtatctatccagtcttgggaacgtactgggacaactgtaaccgttgctggcaggctgggaaccacagcgccttctggggcatgaccctggatgagggcattcgctaccgcctgggcaccatccgcccatcttcctcggtcatgaacatgcatgaaatttatacagtgctgaacccaggggaggtgcttcccacagccttcgaggcctctgagaagtggcccaacctgattcatgagcctcttgaccaaggcaactgtgcaggctcctgggccttctccacagcagctgtggcatccgatcgtgtctcaatccattctctgggacacatgacgcctgtcctgtcgccccagaacctgctgtcttgtgacacccaccagcagcagggctgccgcggtgggcgtctcgatggtgcctggtggttcctgcgtcgccgaggggtggtgtctgaccactgctaccccttctcgggccgtgaacgagacgaggctggccctgcgcccccctgtatgatgcacagccgagccatgggtcggggcaagcgccaggccactgcccactgccccaacagctatgttaataacaatgacatctaccaggtcactcctgtctaccgcctcggctccaacgacaaggagatcatgaaggagctgatggagaatggccctgtccaagccctcatggaggtgcatgaggacttcttcctatacaagggaggcatctacagccacacgccagtgagccttgggaggccagagagataccgccggcatgggacccactcagtcaagatcacaggatggggagaggagacgctgccagatggaaggacgctcaaatactggactgcggccaactcctggggcccagcctggggcgagaggggccacttccgcatcgtgcgcggcgtcaatgagtgcgacatcgagagcttcgtgctgggcgtctggggccgcgtgggcatggaggacatgggtcatcactgaggctgcgggcaccacgcggggtccggcctgggatccaggctaagggccggcggaagaggccccaatggggcggtgaccccagcctcgcccgacagagcccggggcgcaggcgggcgccagggcgctaatcccggcgcgggttccgctgacgcagcgccccgcctgggagccgcgggcaggcgagactggcggagcccccagacctcccagtggggacggggcagggcctggcctgggaagagcacagctgcagatcccaggcctctggcgcccccactcaagactaccaaagccaggacacctcaagtctccagccccactaccccaccccactcctgtattcttttttttttttttttagacagggtcttgctccgttgcccaggttggagtgcagtggcccatcagggctcactgtaacctccgactcctgggttcaagtgaccctcccacctcagcctctcaagtagctgggactacaggtgcaccaccacacctggctaatttttgtattttttgtaaagaggggggtctcactgtgttgcccaggctggtctcgaactcctgggctcaagcggtccacctgcctccgcctcccaaagtgctgggattgcaggcatgagccactgcacccagccctgtattcttattcttcagatatttatttttcttttcactgttttaaaataaaaccaaagtattg

SEQ ID NO: 196177 - DNA, 1841 bp, Homo sapiens
  Payload ID: 18698
  Gene Name: tubulointerstitial nephritis antigen-like 1
  ENST ID: ENST00000537531
  CDS Start-End: 50-1138
gaatccaggttggaatcattgaagaacttcccaaacagcagttggatgtatgcatggaggtcgtatctatccagtcttgggaacgtactgggacaactgtaaccgttgcacctgccaggagaacaggcagtggcagtgtgaccaagaaccatgcctggtggatccagacatgatcaaagccatcaaccagggcaactatggctggcaggctgggaaccacagcgccttctggggcatgaccctggatgagggcattcgctaccgcctgggcaccatccgcccatcttcctcggtcatgaacatgcatgaaatttatacagtgctgaacccaggggaggtgcttcccacagccttcgaggcctctgagaagtggcccaacctgattcatgagcctcttgaccaaggcaactgtgcaggctcctgggccttctccacagcagctgtggcatccgatcgtgtctcaatccattctctgggacacatgacgcctgtcctgtcgccccagaacctgctgtcttgtgacacccaccagcagcagggctgccgcggtgggcgtctcgatggtgcctggtggttcctgcgtcgccgaggggtggtgtctgaccactgctaccccttctcgggccgtgaacgagacgaggctggccctgcgcccccctgtatgatgcacagccgagccatgggtcggggcaagcgccaggccactgcccactgccccaacagctatgttaataacaatgacatctaccaggtcactcctgtctaccgcctcggctccaacgacaaggagatcatgaaggagctgatggagaatggccctgtccaagccctcatggaggtgcatgaggacttcttcctatacaagggaggcatctacagccacacgccagtgagccttgggaggccagagagataccgccggcatgggacccactcagtcaagatcacaggatggggagaggagacgctgccagatggaaggacgctcaaatactggactgcggccaactcctggggcccagcctggggcgagaggggccacttccgcatcgtgcgcggcgtcaatgagtgcgacatcgagagcttcgtgctgggcgtctggggccgcgtgggcatggaggacatgggtcatcactgaggctgcgggcaccacgcggggtccggcctgggatccaggctaagggccggcggaagaggccccaatggggcggtgaccccagcctcgcccgacagagcccggggcgcaggcgggcgccagggcgctaatcccggcgcgggttccgctgacgcagcgccccgcctgggagccgcgggcaggcgagactggcggagcccccagacctcccagtggggacggggcagggcctggcctgggaagagcacagctgcagatcccaggcctctggcgcccccactcaagactaccaaagccaggacacctcaagtctccagccccactaccccaccccactcctgtattcttttttttttttttttagacagggtcttgctccgttgcccaggttggagtgcagtggcccatcagggctcactgtaacctccgactcctgggttcaagtgaccctcccacctcagcctctcaagtagctgggactacaggtgcaccaccacacctggctaatttttgtattttttgtaaagaggggggtctcactgtgttgcccaggctggtctcgaactcctgggctcaagcggtccacctgcctccgcctcccaaagtgctgggattgcaggcatgagccactgcacccagccctgtattcttattcttcagatatttatttttcttttcactgttttaaaataaaaccaaagtattg

SEQ ID NO: 196178 - DNA, 3093 bp, Homo sapiens
  Payload ID: 18699
  Gene Name: tudor and KH domain containing
  Uniprot ID: Q9Y2W6
  ENST ID: ENST00000368822
  CDS Start-End: 635-2320
aagcaaacttccgcctgcggagacccgctcccttcctcgcccccacagaaacgccccccgccaccaccccctcccccggcgtaggccttcacgctgtcgcctcgacccgtttcctcgaatccccagggaagggtgggcccctggcgcccctatggcccgccgcccccttaccaccgcggtcggagcccgggtctcactctcctgccgctgtttcgggccacaccgtgtgtccgtgcctccgcaaaggaatagaagagtgggtcctcgctctctgcggcgcaccgcttgtcccttgacttcctgtccatctacaaagcctatttcatgttttccagaaagaaaacgttttccgtgtctcttgagtcctcatcgccatatgcggggcgggaccgatctatgcaaaagatcgcaagagaaaactgatggagcatcgcccatcatgaggctgctctcccgatggtcactgagttgtgttgtggcactgtctttgtacaaagacaccaatttttgcgaacggtgccactcatgattcaacgctctcatgcctcggtcccagctgctggagcgcagattttcctccaagggttagaagatagaaaactcctcggatataagtcaaagagtacagcagaaaatgtctactgaacggacttcttggacaagcctgtccaccattcagaaaatagccctgggccttgggatcccagccagtgcaacagttgcctatatcctataccgcaggtatagggaaagcagagaagagcggctgacatttgttggggaagatgacattgagatagagatgcgggttccccaggaggctgtgaaactcatcattggccggcaaggagccaatattaaacagctgcggaaacagacaggtgctcggattgatgtggacacagaggatgtaggcgatgagcgagtgctgcttatcagtggttttcctgttcaggtgtgcaaggccaaagcagcaatccatcagatcctgacagagaataccccagtgtctgagcagctttcagttccccagagatctgtgggcagaatcatagggagaggcggcgagacaattcgttctatctgtaaggcatctggagccaaaattacctgtgacaaagaatcagaagggacattactactatcaagacttataaaaatctcaggaacacagaaggaagtggcagcagccaagcatttgatactggagaaagtttcagaagatgaagaacttcggaagagaattgctcattctgcagaaaccagggtcccacgcaaacagccaatcagtgtgagaagagaagacatgacagagccaggtggagctggagagccagcattatggaaaaacaccagttctagcatggagccgactgcacccctggtgactcctccacccaaaggaggaggcgacatggctgtggtagtgtcaaaggaaggttcctgggagaaacctagtgatgacagctttcagaagtctgaagcccaggccatcccagagatgcccatgtttgaaatccccagtcctgacttcagttttcatgctgatgagtacctagaagtctacgtttctgcttctgagcaccctaaccacttctggatccagatcgttggctcccgcagcctgcaattggataagcttgtcaatgagatgacccagcactatgagaatagtgtgcctgaagacttgactgtgcatgtaggagacattgtagcagcacctttacctacaaatggttcctggtatcgagcccgggtcctcggcaccttggagaatgggaacttggacctctattttgttgactttggagataatggagattgcccactgaaggacctcagggctctcaggagtgacttcctaagccttccatttcaagcaatagaatgtagtctggcacggattgctccctcaggtgaccagtgggaagaggaagctttggatgagtttgatagactcactcattgtgctgactggaagcctctggtagccaagatctctagctatgtccagactgggatctcaacttggccaaagatctacttatatgatactagcaatgggaagaaacttgatattgggctagaattagtacacaaaggatacgcaattgagcttcctgaagacatagaagaaaacagagctgtcccagacatgttgaaggacatggccacagaaacagatgcctctctcagcacgttgctcactgagaccaaaaagagctctggagagataacacataccctgtcctgcctcagcttatcagaagctgcttccatgtctggtgatgataaccttgaagatgactacttactctgaagtctgggcttcagtttgctcagccatctgctttgctgtgatttggcataggaattggtgcatggaggagaggagtgtatgataaaggatccatgcagtccttcctttattacacatatagtctggcttgctgtggaccaaattaatattctcctcccatcagactacaaaaaaattggactaccacgctacaagtgtgtctcccccattccacctccggatccctccccaaccctccagtgtttgaatactgctgtgttacttccaggccgttcaacgtcaggctcagtcccctctaccagtcatgattcacattactactaggctgtatcctttttgaggctgggaaacagtcaggctttcgtcattggaagtgattctgcagacttctgactcaccttatcaggtgactctggttaaggaaagcttttgagtggtgaactcaaagactccagttgaatcaggaggcaaaggcaaaaattagcataattatatttaaaagcctcaggaagtgggaagagaatactgcctcccagcctcaattgctgatatgttattggagacaggcttttgaaactgctccagctatttctctgtaacctttagttaaaatataagtagaaaggagacaggaggctcaggaaattttctaaattgctagtataatatctatatgtatacacacatatacacccgtggagagagaggaagagtatacagtcctgtttgaatcatttggaggatttttttgctgaataaagttctcaagaaaa

SEQ ID NO: 196179 - DNA, 2751 bp, Homo sapiens
  Payload ID: 18699
  Gene Name: tudor and KH domain containing
  ENST ID: ENST00000368823
  CDS Start-End: 118-1791
ggtgtgagtgggaggcggcggcgctggtggctgcagctggggtgaggcgcgaggcggcgcactcgacggctgactggagcagcggtaaaggatataagtcaaagagtacagcagaaaatgtctactgaacggacttcttggacaagcctgtccaccattcagaaaatagccctgggccttgggatcccagccagtgcaacagttgcctatatcctataccgcaggtatagggaaagcagagaagagcggctgacatttgttggggaagatgacattgagatagagatgcgggttccccaggaggctgtgaaactcatcattggccggcaaggagccaatattaaacagacaggtgctcggattgatgtggacacagaggatgtaggcgatgagcgagtgctgcttatcagtggttttcctgttcaggtgtgcaaggccaaagcagcaatccatcagatcctgacagagaataccccagtgtctgagcagctttcagttccccagagatctgtgggcagaatcatagggagaggcggcgagacaattcgttctatctgtaaggcatctggagccaaaattacctgtgacaaagaatcagaagggacattactactatcaagacttataaaaatctcaggaacacagaaggaagtggcagcagccaagcatttgatactggagaaagtttcagaagatgaagaacttcggaagagaattgctcattctgcagaaaccagggtcccacgcaaacagccaatcagtgtgagaagagaagacatgacagagccaggtggagctggagagccagcattatggaaaaacaccagttctagcatggagccgactgcacccctggtgactcctccacccaaaggaggaggcgacatggctgtggtagtgtcaaaggaaggttcctgggagaaacctagtgatgacagctttcagaagtctgaagcccaggccatcccagagatgcccatgtttgaaatccccagtcctgacttcagttttcatgctgatgagtacctagaagtctacgtttctgcttctgagcaccctaaccacttctggatccagatcgttggctcccgcagcctgcaattggataagcttgtcaatgagatgacccagcactatgagaatagtgtgcctgaagacttgactgtgcatgtaggagacattgtagcagcacctttacctacaaatggttcctggtatcgagcccgggtcctcggcaccttggagaatgggaacttggacctctattttgttgactttggagataatggagattgcccactgaaggacctcagggctctcaggagtgacttcctaagccttccatttcaagcaatagaatgtagtctggcacggattgctccctcaggtgaccagtgggaagaggaagctttggatgagtttgatagactcactcattgtgctgactggaagcctctggtagccaagatctctagctatgtccagactgggatctcaacttggccaaagatctacttatatgatactagcaatgggaagaaacttgatattgggctagaattagtacacaaaggatacgcaattgagcttcctgaagacatagaagaaaacagagctgtcccagacatgttgaaggacatggccacagaaacagatgcctctctcagcacgttgctcactgagaccaaaaagagctctggagagataacacataccctgtcctgcctcagcttatcagaagctgcttccatgtctggtgatgataaccttgaagatgactacttactctgaagtctgggcttcagtttgctcagccatctgctttgctgtgtgagtgcagctatcatctatctgtagcaacaggaaagtaatgagggcgacagtggggcacttgctttgattccctctttcccatgccctgtcttaatatacttctctgcagctgctttcctgcagcttaacttgctctcagattgagcactttcaagctttttgtgtatttctgtctttggcaggatttggcataggaattggtgcatggaggagaggagtgtatgataaaggatccatgcagtccttcctttattacacatatagtctggcttgctgtggaccaaattaatattctcctcccatcagactacaaaaaaattggactaccacgctacaagtgtgtctcccccattccacctccggatccctccccaaccctccagtgtttgaatactgctgtgttacttccaggccgttcaacgtcaggctcagtcccctctaccagtcatgattcacattactactaggctgtatcctttttgaggctgggaaacagtcaggctttcgtcattggaagtgattctgcagacttctgactcaccttatcaggtgactctggttaaggaaagcttttgagtggtgaactcaaagactccagttgaatcaggaggcaaaggcaaaaattagcataattatatttaaaagcctcaggaagtgggaagagaatactgcctcccagcctcaattgctgatatgttattggagacaggcttttgaaactgctccagctatttctctgtaacctttagttaaaatataagtagaaaggagacaggaggctcaggaaattttctaaattgctagtataatatctatatgtatacacacatatacacccgtggagagagaggaagagtatacagtcctgtttgaatcatttggaggatttttttgctgaataaagttctcaagaaaatt

SEQ ID NO: 196180 - DNA, 2824 bp, Homo sapiens
  Payload ID: 18699
  Gene Name: tudor and KH domain containing
  Uniprot ID: Q9Y2W6
  ENST ID: ENST00000368824
  CDS Start-End: 171-1856
cggctgaagcgccgccggcggggctcactgtggtggtgtgagtgggaggcggcggcgctggtggctgcagctggggtgaggcgcgaggcggcgcactcgacggctgactggagcagcggtaaaggcgaggatggagaccgaaggatataagtcaaagagtacagcagaaaatgtctactgaacggacttcttggacaagcctgtccaccattcagaaaatagccctgggccttgggatcccagccagtgcaacagttgcctatatcctataccgcaggtatagggaaagcagagaagagcggctgacatttgttggggaagatgacattgagatagagatgcgggttccccaggaggctgtgaaactcatcattggccggcaaggagccaatattaaacagctgcggaaacagacaggtgctcggattgatgtggacacagaggatgtaggcgatgagcgagtgctgcttatcagtggttttcctgttcaggtgtgcaaggccaaagcagcaatccatcagatcctgacagagaataccccagtgtctgagcagctttcagttccccagagatctgtgggcagaatcatagggagaggcggcgagacaattcgttctatctgtaaggcatctggagccaaaattacctgtgacaaagaatcagaagggacattactactatcaagacttataaaaatctcaggaacacagaaggaagtggcagcagccaagcatttgatactggagaaagtttcagaagatgaagaacttcggaagagaattgctcattctgcagaaaccagggtcccacgcaaacagccaatcagtgtgagaagagaagacatgacagagccaggtggagctggagagccagcattatggaaaaacaccagttctagcatggagccgactgcacccctggtgactcctccacccaaaggaggaggcgacatggctgtggtagtgtcaaaggaaggttcctgggagaaacctagtgatgacagctttcagaagtctgaagcccaggccatcccagagatgcccatgtttgaaatccccagtcctgacttcagttttcatgctgatgagtacctagaagtctacgtttctgcttctgagcaccctaaccacttctggatccagatcgttggctcccgcagcctgcaattggataagcttgtcaatgagatgacccagcactatgagaatagtgtgcctgaagacttgactgtgcatgtaggagacattgtagcagcacctttacctacaaatggttcctggtatcgagcccgggtcctcggcaccttggagaatgggaacttggacctctattttgttgactttggagataatggagattgcccactgaaggacctcagggctctcaggagtgacttcctaagccttccatttcaagcaatagaatgtagtctggcacggattgctccctcaggtgaccagtgggaagaggaagctttggatgagtttgatagactcactcattgtgctgactggaagcctctggtagccaagatctctagctatgtccagactgggatctcaacttggccaaagatctacttatatgatactagcaatgggaagaaacttgatattgggctagaattagtacacaaaggatacgcaattgagcttcctgaagacatagaagaaaacagagctgtcccagacatgttgaaggacatggccacagaaacagatgcctctctcagcacgttgctcactgagaccaaaaagagctctggagagataacacataccctgtcctgcctcagcttatcagaagctgcttccatgtctggtgatgataaccttgaagatgactacttactctgaagtctgggcttcagtttgctcagccatctgctttgctgtgtgagtgcagctatcatctatctgtagcaacaggaaagtaatgagggcgacagtggggcacttgctttgattccctctttcccatgccctgtcttaatatacttctctgcagctgctttcctgcagcttaacttgctctcagattgagcactttcaagctttttgtgtatttctgtctttggcaggatttggcataggaattggtgcatggaggagaggagtgtatgataaaggatccatgcagtccttcctttattacacatatagtctggcttgctgtggaccaaattaatattctcctcccatcagactacaaaaaaattggactaccacgctacaagtgtgtctcccccattccacctccggatccctccccaaccctccagtgtttgaatactgctgtgttacttccaggccgttcaacgtcaggctcagtcccctctaccagtcatgattcacattactactaggctgtatcctttttgaggctgggaaacagtcaggctttcgtcattggaagtgattctgcagacttctgactcaccttatcaggtgactctggttaaggaaagcttttgagtggtgaactcaaagactccagttgaatcaggaggcaaaggcaaaaattagcataattatatttaaaagcctcaggaagtgggaagagaatactgcctcccagcctcaattgctgatatgttattggagacaggcttttgaaactgctccagctatttctctgtaacctttagttaaaatataagtagaaaggagacaggaggctcaggaaattttctaaattgctagtataatatctatatgtatacacacatatacacccgtggagagagaggaagagtatacagtcctgtttgaatcatttggaggatttttttgctgaataaagttctcaagaaaattttctaaaa

SEQ ID NO: 196181 - DNA, 2651 bp, Homo sapiens
  Payload ID: 18699
  Gene Name: tudor and KH domain containing
  Uniprot ID: Q9Y2W6
  ENST ID: ENST00000368825
  CDS Start-End: 128-1678
gggaggcggcggcgctggtggctgcagctggggtgaggcgcgaggcggcgcactcgacggctgactggagcagcggtaaaggcgaggatggagaccgaaggatataagtcaaagagtacagcagaaaatgtctactgaacggacttcttggacaagcctgtccaccattcagaaaatagccctgggccttgggatcccagccagtgcaacagttgcctatatcctataccgcaggtatagggaaagcagagaagagcggctgacatttgttggggaagatgacattgagatagagatgcgggttccccaggaggctgtgaaactcatcattggccggcaaggagccaatattaaacagctgcggaaacagacaggtgctcggattgatgtggacacagaggatgtaggcgatgagcgagtgctgcttatcagtggttttcctgttcaggcatctggagccaaaattacctgtgacaaagaatcagaagggacattactactatcaagacttataaaaatctcaggaacacagaaggaagtggcagcagccaagcatttgatactggagaaagtttcagaagatgaagaacttcggaagagaattgctcattctgcagaaaccagggtcccacgcaaacagccaatcagtgtgagaagagaagacatgacagagccaggtggagctggagagccagcattatggaaaaacaccagttctagcatggagccgactgcacccctggtgactcctccacccaaaggaggaggcgacatggctgtggtagtgtcaaaggaaggttcctgggagaaacctagtgatgacagctttcagaagtctgaagcccaggccatcccagagatgcccatgtttgaaatccccagtcctgacttcagttttcatgctgatgagtacctagaagtctacgtttctgcttctgagcaccctaaccacttctggatccagatcgttggctcccgcagcctgcaattggataagcttgtcaatgagatgacccagcactatgagaatagtgtgcctgaagacttgactgtgcatgtaggagacattgtagcagcacctttacctacaaatggttcctggtatcgagcccgggtcctcggcaccttggagaatgggaacttggacctctattttgttgactttggagataatggagattgcccactgaaggacctcagggctctcaggagtgacttcctaagccttccatttcaagcaatagaatgtagtctggcacggattgctccctcaggtgaccagtgggaagaggaagctttggatgagtttgatagactcactcattgtgctgactggaagcctctggtagccaagatctctagctatgtccagactgggatctcaacttggccaaagatctacttatatgatactagcaatgggaagaaacttgatattgggctagaattagtacacaaaggatacgcaattgagcttcctgaagacatagaagaaaacagagctgtcccagacatgttgaaggacatggccacagaaacagatgcctctctcagcacgttgctcactgagaccaaaaagagctctggagagataacacataccctgtcctgcctcagcttatcagaagctgcttccatgtctggtgatgataaccttgaagatgactacttactctgaagtctgggcttcagtttgctcagccatctgctttgctgtgtgagtgcagctatcatctatctgtagcaacaggaaagtaatgagggcgacagtggggcacttgctttgattccctctttcccatgccctgtcttaatatacttctctgcagctgctttcctgcagcttaacttgctctcagattgagcactttcaagctttttgtgtatttctgtctttggcaggatttggcataggaattggtgcatggaggagaggagtgtatgataaaggatccatgcagtccttcctttattacacatatagtctggcttgctgtggaccaaattaatattctcctcccatcagactacaaaaaaattggactaccacgctacaagtgtgtctcccccattccacctccggatccctccccaaccctccagtgtttgaatactgctgtgttacttccaggccgttcaacgtcaggctcagtcccctctaccagtcatgattcacattactactaggctgtatcctttttgaggctgggaaacagtcaggctttcgtcattggaagtgattctgcagacttctgactcaccttatcaggtgactctggttaaggaaagcttttgagtggtgaactcaaagactccagttgaatcaggaggcaaaggcaaaaattagcataattatatttaaaagcctcaggaagtgggaagagaatactgcctcccagcctcaattgctgatatgttattggagacaggcttttgaaactgctccagctatttctctgtaacctttagttaaaatataagtagaaaggagacaggaggctcaggaaattttctaaattgctagtataatatctatatgtatacacacatatacacccgtggagagagaggaagagtatacagtcctgtttgaatcatttggaggatttttttgctgaataaagttctcaagaaaattttctaaaaccaaa

SEQ ID NO: 196182 - DNA, 2318 bp, Homo sapiens
  Payload ID: 18699
  Gene Name: tudor and KH domain containing
  Uniprot ID: Q9Y2W6
  ENST ID: ENST00000368827
  CDS Start-End: 171-1856
cggctgaagcgccgccggcggggctcactgtggtggtgtgagtgggaggcggcggcgctggtggctgcagctggggtgaggcgcgaggcggcgcactcgacggctgactggagcagcggtaaaggcgaggatggagaccgaaggatataagtcaaagagtacagcagaaaatgtctactgaacggacttcttggacaagcctgtccaccattcagaaaatagccctgggccttgggatcccagccagtgcaacagttgcctatatcctataccgcaggtatagggaaagcagagaagagcggctgacatttgttggggaagatgacattgagatagagatgcgggttccccaggaggctgtgaaactcatcattggccggcaaggagccaatattaaacagctgcggaaacagacaggtgctcggattgatgtggacacagaggatgtaggcgatgagcgagtgctgcttatcagtggttttcctgttcaggtgtgcaaggccaaagcagcaatccatcagatcctgacagagaataccccagtgtctgagcagctttcagttccccagagatctgtgggcagaatcatagggagaggcggcgagacaattcgttctatctgtaaggcatctggagccaaaattacctgtgacaaagaatcagaagggacattactactatcaagacttataaaaatctcaggaacacagaaggaagtggcagcagccaagcatttgatactggagaaagtttcagaagatgaagaacttcggaagagaattgctcattctgcagaaaccagggtcccacgcaaacagccaatcagtgtgagaagagaagacatgacagagccaggtggagctggagagccagcattatggaaaaacaccagttctagcatggagccgactgcacccctggtgactcctccacccaaaggaggaggcgacatggctgtggtagtgtcaaaggaaggttcctgggagaaacctagtgatgacagctttcagaagtctgaagcccaggccatcccagagatgcccatgtttgaaatccccagtcctgacttcagttttcatgctgatgagtacctagaagtctacgtttctgcttctgagcaccctaaccacttctggatccagatcgttggctcccgcagcctgcaattggataagcttgtcaatgagatgacccagcactatgagaatagtgtgcctgaagacttgactgtgcatgtaggagacattgtagcagcacctttacctacaaatggttcctggtatcgagcccgggtcctcggcaccttggagaatgggaacttggacctctattttgttgactttggagataatggagattgcccactgaaggacctcagggctctcaggagtgacttcctaagccttccatttcaagcaatagaatgtagtctggcacggattgctccctcaggtgaccagtgggaagaggaagctttggatgagtttgatagactcactcattgtgctgactggaagcctctggtagccaagatctctagctatgtccagactgggatctcaacttggccaaagatctacttatatgatactagcaatgggaagaaacttgatattgggctagaattagtacacaaaggatacgcaattgagcttcctgaagacatagaagaaaacagagctgtcccagacatgttgaaggacatggccacagaaacagatgcctctctcagcacgttgctcactgagaccaaaaagagctctggagagataacacataccctgtcctgcctcagcttatcagaagctgcttccatgtctggtgatgataaccttgaagatgactacttactctgaagtctgggcttcagtttgctcagccatctgctttgctgtatgttgcctgcaatgaactcgctgaagcatgctcagccctggaactggtgctaccagagttccgtagggaacctttactctttagaggttccctgatataaatcattcataagacttcctaccctggaaaatgagtaatgtctcattcttacctgcagtttgttactatgtataaaagtctttttctttaatatgcctttaagtcttacctgtttacagcccattctgatgggttctttgtcattctgttagtataacccagtacttttcctgctgcctggaatgccctcttctatgttacctattctgtccgttgagatcccccaacttgggccaaagccaagagatctatgtgccttctctggttttctccacatctatagcacctcaactgaaatatatggataaaaacagcctaacaaa

SEQ ID NO: 196183 - DNA, 2768 bp, Homo sapiens
  Payload ID: 18699
  Gene Name: tudor and KH domain containing
  Uniprot ID: Q9Y2W6
  ENST ID: ENST00000458431
  CDS Start-End: 129-1814
gcggggctcactgtggtggtgtgagtgggaggcggcggcgctggtggctgcagctggggtgaggcgcgaggcggcgcactcgacggctgactggagcagcggatataagtcaaagagtacagcagaaaatgtctactgaacggacttcttggacaagcctgtccaccattcagaaaatagccctgggccttgggatcccagccagtgcaacagttgcctatatcctataccgcaggtatagggaaagcagagaagagcggctgacatttgttggggaagatgacattgagatagagatgcgggttccccaggaggctgtgaaactcatcattggccggcaaggagccaatattaaacagctgcggaaacagacaggtgctcggattgatgtggacacagaggatgtaggcgatgagcgagtgctgcttatcagtggttttcctgttcaggtgtgcaaggccaaagcagcaatccatcagatcctgacagagaataccccagtgtctgagcagctttcagttccccagagatctgtgggcagaatcatagggagaggcggcgagacaattcgttctatctgtaaggcatctggagccaaaattacctgtgacaaagaatcagaagggacattactactatcaagacttataaaaatctcaggaacacagaaggaagtggcagcagccaagcatttgatactggagaaagtttcagaagatgaagaacttcggaagagaattgctcattctgcagaaaccagggtcccacgcaaacagccaatcagtgtgagaagagaagacatgacagagccaggtggagctggagagccagcattatggaaaaacaccagttctagcatggagccgactgcacccctggtgactcctccacccaaaggaggaggcgacatggctgtggtagtgtcaaaggaaggttcctgggagaaacctagtgatgacagctttcagaagtctgaagcccaggccatcccagagatgcccatgtttgaaatccccagtcctgacttcagttttcatgctgatgagtacctagaagtctacgtttctgcttctgagcaccctaaccacttctggatccagatcgttggctcccgcagcctgcaattggataagcttgtcaatgagatgacccagcactatgagaatagtgtgcctgaagacttgactgtgcatgtaggagacattgtagcagcacctttacctacaaatggttcctggtatcgagcccgggtcctcggcaccttggagaatgggaacttggacctctattttgttgactttggagataatggagattgcccactgaaggacctcagggctctcaggagtgacttcctaagccttccatttcaagcaatagaatgtagtctggcacggattgctccctcaggtgaccagtgggaagaggaagctttggatgagtttgatagactcactcattgtgctgactggaagcctctggtagccaagatctctagctatgtccagactgggatctcaacttggccaaagatctacttatatgatactagcaatgggaagaaacttgatattgggctagaattagtacacaaaggatacgcaattgagcttcctgaagacatagaagaaaacagagctgtcccagacatgttgaaggacatggccacagaaacagatgcctctctcagcacgttgctcactgagaccaaaaagagctctggagagataacacataccctgtcctgcctcagcttatcagaagctgcttccatgtctggtgatgataaccttgaagatgactacttactctgaagtctgggcttcagtttgctcagccatctgctttgctgtgtgagtgcagctatcatctatctgtagcaacaggaaagtaatgagggcgacagtggggcacttgctttgattccctctttcccatgccctgtcttaatatacttctctgcagctgctttcctgcagcttaacttgctctcagattgagcactttcaagctttttgtgtatttctgtctttggcaggatttggcataggaattggtgcatggaggagaggagtgtatgataaaggatccatgcagtccttcctttattacacatatagtctggcttgctgtggaccaaattaatattctcctcccatcagactacaaaaaaattggactaccacgctacaagtgtgtctcccccattccacctccggatccctccccaaccctccagtgtttgaatactgctgtgttacttccaggccgttcaacgtcaggctcagtcccctctaccagtcatgattcacattactactaggctgtatcctttttgaggctgggaaacagtcaggctttcgtcattggaagtgattctgcagacttctgactcaccttatcaggtgactctggttaaggaaagcttttgagtggtgaactcaaagactccagttgaatcaggaggcaaaggcaaaaattagcataattatatttaaaagcctcaggaagtgggaagagaatactgcctcccagcctcaattgctgatatgttattggagacaggcttttgaaactgctccagctatttctctgtaacctttagttaaaatataagtagaaaggagacaggaggctcaggaaattttctaaattgctagtataatatctatatgtatacacacatatacacccgtggagagagaggaagagtatacagtcctgtttgaatcatttggaggatttttttgctgaataaagttctcaag

SEQ ID NO: 196184 - DNA, 2296 bp, Homo sapiens
  Payload ID: 18699
  Gene Name: tudor and KH domain containing
  ENST ID: ENST00000440583
  CDS Start-End: 171-1988
cggctgaagcgccgccggcggggctcactgtggtggtgtgagtgggaggcggcggcgctggtggctgcagctggggtgaggcgcgaggcggcgcactcgacggctgactggagcagcggtaaaggcgaggatggagaccgaaggatataagtcaaagagtacagcagaaaatgtctactgaacggacttcttggacaagcctgtccaccattcagaaaatagccctgggccttgggatcccagccagtgcaacagttgcctatatcctataccgcaggtatagggaaagcagagaagagcggctgacatttgttggggaagatgacattgagatagagatgcgggttccccaggaggctgtgaaactcatcattggccggcaaggagccaatattaaacagctgcggaaacagacaggtgctcggattgatgtggacacagaggatgtaggcgatgagcgagtgctgcttatcagtggttttcctgttcaggtgtgcaaggccaaagcagcaatccatcagatcctgacagagaataccccagtgtctgagcagctttcagttccccagagatctgtgggcagaatcatagggagaggcggcgagacaattcgttctatctgtaaggcatctggagccaaaattacctgtgacaaagaatcagaagggacattactactatcaagacttataaaaatctcaggaacacagaaggaagtggcagcagccaagcatttgatactggagaaagtttcagaagatgaagaacttcggaagagaattgctcattctgcagaaaccagggtcccacgcaaacagccaatcagtgtgagaagagaagacatgacagagccaggtggagctggagagccagcattatggaaaaacaccagttctagcatggagccgactgcacccctggtgactcctccacccaaaggaggaggcgacatggctgtggtagtgtcaaaggaaggttcctgggagaaacctagtgatgacagctttcagaagtctgaagcccaggccatcccagagatgcccatgtttgaaatccccagtcctgacttcagttttcatgctgatgagtacctagaagtctacgtttctgcttctgagcaccctaaccacttctggatccagatcgttggctcccgcagcctgcaattggataagcttgtcaatgagatgacccagcactatgagaatagtgtgcctgaagacttgactgtgcatgtaggagacattgtagcagcacctttacctacaaatggttcctggtatcgagcccgggtcctcggcaccttggagaatgggaacttggacctctattttgttgactttggagataatggagattgcccactgaaggacctcagggctctcaggagtgacttcctaagccttccatttcaagcaatagaatgtagtctggcacggattgctccctcaggtgaccagtgggaagaggaagctttggatgagtttgatagactcactcattgtgctgactggaagcctctggtagccaagatctctagctatgtccagactgggatctcaacttggccaaagatctacttatatgatactagcaatgggaagaaacttgatattgggctagaattagtacacaaaggatacgcaattgagcttcctgaagacatagaagaaaacagagctgtcccagacatgttgaaggacatggccacagaaacagatgcctctctcagcacgttgctcactgagaccaaaaagagctctggagagataacacataccctgtcctgcctcagcttatcagaagctgcttccatgtctggtgatgataaccttgaagatgactacttactcagtctgggcttcagtttgctcagccatctgctttgctgtatgttgcctgcaatgaactcgctgaagcatgctcagccctggaactggtgctaccagagttccgtagggaacctttactctttagaggttccctgatataaatcattcataagacttcctaccctggaaaatgagtaatgtctcattcttacctgcagtttgttactatgtataaaagtctttttctttaatatgcctttaagtcttacctgtttacagcccattctgatgggttctttgtcattctgttagtataacccagtacttttcctgctgcctggaatgccctcttctatgttacctattctgtccgttgagatcccccaacttgggccaaagccaagagatctatgtgccttctctggttttctccacatctatagcacctcaactgaaatatatgg

SEQ ID NO: 196185 - DNA, 568 bp, Homo sapiens
  Payload ID: 18699
  Gene Name: tudor and KH domain containing
  ENST ID: ENST00000526378
  CDS Start-End: 176-568
attaacaattgatggcacaggatgagaagcccaaacttggaaggaccctccagggaaataagaggaaaccaagagaaagagggcacagaaaccaaggaaagagttttgtggagggagtggccaccttcctgctaccgcagagagatgggatataagtcaaagagtacagcagaaaatgtctactgaacggacttcttggacaagcctgtccaccattcagaaaatagccctgggccttgggatcccagccagtgcaacagttgcctatatcctataccgcaggtatagggaaagcagagaagagcggctgacatttgttggggaagatgacattgagatagagatgcgggttccccaggaggctgtgaaactcatcattggccggcaaggagccaatattaaacagctgcggaaacagacaggtgctcggattgatgtggacacagaggatgtaggcgatgagcgagtgctgcttatcagtggttttcctgttcaggtgtgcaaggccaaagcagcaatccatcagatcctgacagagaataccccagtgtctgagcagctttcagtt

SEQ ID NO: 196186 - DNA, 477 bp, Homo sapiens
  Payload ID: 18699
  Gene Name: tudor and KH domain containing
  ENST ID: ENST00000530202
  CDS Start-End: 82-258
ggcgcactcgacggctgactggagcagcggtaaaggcgaggatggagaccgaaggatataagtcaaagagtacagcagaaaatgtctactgaacggacttcttggacaagcctgtccaccattcagaaaatagccctgggccttgggatcccagccagtgcaacagttgcctatatcctataccgcaggtatagggaaagcagagttgttagtagaaggcacttacctcaaaggctggatctagagaataggacctagagaaatgacttatgtacctatcagtcaggagaagttctgagcctaatggacccctcagaagagcggctgacatttgttggggaagatgacattgagatagagatgcgggttccccaggaggctgtgaaactcatcattggccggcaaggagccaatattaaacagctgcggaaacagacaggtgctcggattgatgtggacacagaggatgtaggcgat

SEQ ID NO: 196187 - DNA, 1807 bp, Homo sapiens
  Payload ID: 18699
  Gene Name: tudor and KH domain containing
  ENST ID: ENST00000526413
  CDS Start-End: 54-476
gcactcgacggctgactggagcagcggatataagtcaaagagtacagcagaaaatgtctactgaacggacttcttggacaagcctgtccaccattcagaaaatagccctgggccttgggatcccagccagtgcaacagttgcctatatcctataccgcaggtatagggaaagcagagaagagcggctgacatttgttggggaagatgacattgagatagagatgcgggttccccaggaggctgtgaaactcatcattggccggcaaggagccaatattaaacagctgcggaaacagacaggtgctcggattgatgtggacacagaggatgtaggcgatgagcgagtgctgcttatcagtggttttcctgttcagggagaggcggcgagacaattcgttctatctgtaaggcatctggagccaaaattacctgtgacaaagaatcagaagggacattactactatcaagacttataaaaatctcaggaacacagaaggaagtggcagcagccaagcatttgatactggagaaagtttcagaagatgaagaacttcggaagagaattgctcattctgcagaaaccagggtcccacgcaaacagccaatcagtgtgagaagagaagacatgacagagccaggtggagctggagagccagcattatggaaaaacaccagttctagcatggagccgactgcacccctggtgactcctccacccaaaggaggaggcgacatggctgtggtagtgtcaaaggaaggttcctgggagaaacctagtgatgacagctttcagaagtctgaagcccaggccatcccagagatgcccatgtttgaaatccccagtcctgacttcagttttcatgctgatgagtacctagaagtctacgtttctgcttctgagcaccctaaccacttctggatccagatcgttggctcccgcagcctgcaattggataagcttgtcaatgagatgacccagcactatgagaatagtgtgcctgaagacttgactgtgcatgtaggagacattgtagcagcacctttacctacaaatggttcctggtatcgagcccgggtcctcggcaccttggagaatgggaacttggacctctattttgttgactttggagataatggagattgcccactgaaggacctcagggctctcaggagtgacttcctaagccttccatttcaagcaatagaatgtagtctggcacggattgctccctcaggtgaccagtgggaagaggaagctttggatgagtttgatagactcactcattgtgctgactggaagcctctggtagccaagatctctagctatgtccagactgggatctcaacttggccaaagatctacttatatgatactagcaatgggaagaaacttgatattgggctagaattagtacacaaaggatacgcaattgagcttcctgaagacatagaagaaaacagagctgtcccagacatgttgaaggacatggccacagaaacagatgcctctctcagcacgttgctcactgagaccaaaaagagctctggagagataacacataccctgtcctgcctcagcttatcagaagctgcttccatgtctggtgatgataaccttgaagatgactacttactctgaagtctgggcttcagtttgctcagccatctgctttgctgtgatttggcataggaattggtgcatggaggagaggagtgtatgataaaggatccatgcagtccttcctttattacacatatagtctggcttgctgtggaccaaattaatattctcctcccatcagactac

SEQ ID NO: 196188 - DNA, 2217 bp, Homo sapiens
  Payload ID: 18699
  Gene Name: tudor and KH domain containing
  ENST ID: ENST00000525790
  CDS Start-End: 137-559
ggtgtgagtgggaggcggcggcgctggtggctgcagctggggtgaggcgcgaggcggcgcactcgacggctgactggagcagcggtaaaggcgaggatggagaccgaaggatataagtcaaagagtacagcagaaaatgtctactgaacggacttcttggacaagcctgtccaccattcagaaaatagccctgggccttgggatcccagccagtgcaacagttgcctatatcctataccgcaggtatagggaaagcagagaagagcggctgacatttgttggggaagatgacattgagatagagatgcgggttccccaggaggctgtgaaactcatcattggccggcaaggagccaatattaaacagctgcggaaacagacaggtgctcggattgatgtggacacagaggatgtaggcgatgagcgagtgctgcttatcagtggttttcctgttcagggagaggcggcgagacaattcgttctatctgtaaggcatctggagccaaaattacctgtgacaaagaatcagaagggacattactactatcaagacttataaaaatctcaggaacacagaaggaagtggcagcagccaagcatttgatactggagaaagtttcagaagatgaagaacttcggaagagaattgctcattctgcagaaaccagggtcccacgcaaacagccaatcagtgtgagaagagaagacatgacagagccaggtggagctggagagccagcattatggaaaaacaccagttctagcatggagccgactgcacccctggtgactcctccacccaaaggaggaggcgacatggctgtggtagtgtcaaaggaaggttcctgggagaaacctagtgatgacagctttcagaagtctgaagcccaggccatcccagagatgcccatgtttgaaatccccagtcctgacttcagttttcatgctgatgagtacctagaagtctacgtttctgcttctgagcaccctaaccacttctggatccagatcgttggctcccgcagcctgcaattggataagcttgtcaatgagatgacccagcactatgagaatagtgtgcctgaagacttgactgtgcatgtaggagacattgtagcagcacctttacctacaaatggttcctggtatcgagcccgggtcctcggcaccttggagaatgggaacttggacctctattttgttgactttggagataatggagattgcccactgaaggacctcagggctctcaggagtgacttcctaagccttccatttcaagcaatagaatgtagtctggcacggattgctccctcaggtgaccagtgggaagaggaagctttggatgagtttgatagactcactcattgtgctgactggaagcctctggtagccaagatctctagctatgtccagactgggatctcaacttggccaaagatctacttatatgatactagcaatgggaagaaacttgatattgggctagaattagtacacaaaggatacgcaattgagcttcctgaagacatagaagaaaacagagctgtcccagacatgttgaaggacatggccacagaaacagatgcctctctcagcacgttgctcactgagaccaaaaagagctctggagagataacacataccctgtcctgcctcagcttatcagaagctgcttccatgtctggtgatgataaccttgaagatgactacttactctgaagtctgggcttcagtttgctcagccatctgctttgctgtgtgctccatatgtttgagatccattttgtcctgctggccacatcccttgaatggattctgtgtaatttcaccagtgctccttcagtctggcccctaacaccacctgcaggggcttcctcagagtccagttgtaacttgatggaacaagttacaacttcccaccttcgtggtaggtgggaagaaaagaatccctgaaatgcctgagggtgcatttttaaagacaggggaagagggtctcctataaaggaaaaggagttatccagctgcctcagcgcgaaaagcaaggaagaacagcagatccccacctctgtcgttccgatcattctggaagttcacaaacacagagtccacatttgtcttctcttccacgtactccagggttgcagtcaaactaggagccacagaaaaacagttaaaatgtttggccgctccctctccctctccctctccgtctcc

SEQ ID NO: 196189 - DNA, 4510 bp, Homo sapiens
  Payload ID: 18700
  Gene Name: tudor domain containing 1
  Uniprot ID: Q9BXT4
  ENST ID: ENST00000251864
  CDS Start-End: 154-3723
gctgaggccaggagggcgcactggggattggaggcgagggaagtgcagggcgcatcccaggcggcagggctcccagcatcggcagtcgccatcaccgccagaccgcagagacaggttcggatccgcggtcctcttgcctctttccaggcctcgatgagtgttaaatcgccatttaatgtgatgtcaagaaataatttggaagcacctccttgtaagatgacagagccatttaattttgagaaaaatgaaaacaagcttccaccacatgagtctttaagaagtcctggaacacttcctaaccaccctaatttcaggctgaaaagctcagagaatggaaataaaaagaacaattttttgctttgtgagcaaaccaaacaatatttggctagtcaggaagacaattcagtttcttcaaacccgaatggcatcaacggagaagtagttggctccaaaggagacaggaaaaaattgccagcaggaaactcagtgtcaccaccaagtgctgaaagtaattcaccacccaaagaagtgaatattaagcctggaaataatgtacgtcctgcaaaatcaaaaaaactaaacaagttggtcgagaattccttgtccataagtaatccagggctcttcacctccttaggacctcctcttcggtccacaacttgccatcgctgtggcctatttggatcgctgaggtgctctcagtgcaagcagacctactattgctccacagcatgtcaaagaagagactggtctgcacacagcatcgtgtgcaggcctgttcagccaaatttccacaaacttgaaaataaatcatctattgaaacaaaggatgtggaggtaaacaataagagtgactgtccacttggagttactaaggaaatagccatttgggctgagagaataatgttttctgatttgagaagtctacaactcaagaaaaccatggaaataaagggtacggttaccgaattcaaacacccaggggacttctacgtgcagttatattcttcagaagttttagaatacatgaaccaactctctgccagcttaaaagaaacatatgcaaatgtgcatgaaaaagactatattcctgttaagggggaagtttgtattgccaagtacactgttgatcagacctggaacagagcaatcatacaaaacgttgatgtgcagcaaaagaaggcacatgtcttatatattgattatggaaatgaagaaataattccattaaacagaatttaccacctcaacaggaacattgacttgtttcctccttgtgccataaagtgctttgtagccaatgttatcccagcagaagggaattggagcagtgattgtatcaaagctactaaaccactgttaatggagcagtactgctccataaagattgtcgacatcttggaagaggaagtggttacctttgctgtagaagttgagctgccaaattcaggaaaacttttagaccatgtgcttatagaaatgggatatggcttgaaacccagtggacaagattctaagaaggaaaatgcagatcaaagtgatcctgaagatgttggaaaaatgacaactgaaaacaacattgtcgtagacaaaagtgacctaatcccaaaagtgttaactttgaatgtaggtgatgagttttgtggtgtggttgcccacattcaaacaccagaagacttcttttgtcaacaactgcaaagtggccgaaagcttgctgaacttcaggcatcccttagcaagtactgtgatcagttgcctccacgctctgatttttatccagccattggtgatatatgttgtgctcagttctcagaggatgatcagtggtaccgtgcctctgttttggcttacgcttctgaagaatctgtactggtcggatatgtagattatggaaactttgaaatccttagtttgatgagactttgtcccataatcccaaagttgttggaattgccaatgcaagctataaagtgtgtactagcaggagtaaagccatcattaggaatttggactccagaagctatttgtctcatgaaaaaacttgtacagaacaaaataatcacagtgaaagtggtggacaagttggaaaacagttccctggtggagcttattgataaatccgagacgcctcatgtcagtgttagcaaagttctcctagatgcaggctttgctgtgggagaacagagtatggtgacagataaacccagtgacgtgaaagaaaccagtgttcccttgggtgtggaaggaaaagtaaatccattggagtggacatgggttgaacttggtgttgaccaaacagtagatgttgtggtctgtgtgatatatagtcctggagaattttattgccatgtgcttaaagaggatgctttaaagaaactcaatgatttgaacaagtcattagcagaacactgccagcagaagttacctaatggtttcaaggcagagataggacaaccttgttgtgctttttttgcaggtgatggtagttggtatcgtgctttagtcaaggaaatcttaccaaatggacatgttaaagtacattttgtggattatggaaacatcgaagaagttactgcagatgaactccgaatgatatcatcaacatttttaaaccttccctttcagggaatacggtgccagttagcagatatacagtctagaaacaaacattggtctgaagaagccataacaagattccagatgtgtgttgctgggataaaattgcaagccagagtggttgaagtcactgaaaatgggataggagttgaactcaccgatctctccacttgttatcccagaataattagtgatgttctgattgatgaacatctggttttaaaatctgcttcaccacataaagacttaccaaatgacagacttgttaataaacatgagcttcaagttcatgtacagggacttcaagctacctcttcagctgagcaatggaagacgatagaattgccagtggataaaactatacaagcaaatgtattagaaatcataagcccaaacttgttttatgctctaccaaaagggatgccagaaaatcaggaaaagctgtgcatgttgacagctgaattattagaatactgcaatgctccgaaaagtcgaccaccctatagaccaagaattggagacgcatgctgtgccaaatacacaagtgatgatttttggtatcgtgcagttgttctggggacatcagacactgatgtggaagtgctctatgcagactatggaaacattgaaaccctgcctctttgcagagtgcaaccaatcacctctagccacctggcgcttcctttccaaattattagatgttcacttgaaggattaatggaattgaatggaagctcttctcaattaataataatgctattaaaaaatttcatgttgaatcagaatgtaatgctttctgtgaaaggaattacaaagaatgtccatacagtgtcagttgagaaatgttctgagaatgggactgtcgatgtagctgataagctagtgacatttggtctggcaaaaaacatcacacctcaaaggcagagtgctttaaatacagaaaagatgtataggatgaattgctgctgcacagagttacagaaacaagttgaaaaacatgaacatattcttctcttcctcttaaacaattcaaccaatcaaaataaatttattgaaatgaaaaaactgttaaaaaaaacagcatctcttggaggtaaacccttatgagacaggaaacagcaaaggctagctttaggagagaaagtacagcacctggtgtttttatttatgagaaccttttctttgtccactttctctgtaatgaccttctatccctccgtttttgcctgcctgccattctcctattaggttggtggtttttattttcctctaagttccttccaccaaataaatattacgtaaaaaattcataccaaatcaatgagaatactggcaaggaatacatagggactttctgctatatatgtaactttttattacttaaaggtaccgaaggaaggccaggtgcagtggctcacgcccagcactttgggaggctgaggtgggaggatcccttgaggccaggagttcaaggttacagtgagctatgatagtgccactgcactccagcctgggtgacagattttgtcttaaaaaaaaaaaaaaaaaagttgatatgagttttattttctgtccgtttgaaatattttgtaatattccctgcattctctgtcgtctgcctcttccacataatgtcctttgctttcatgtttgttatcttctttttctgttcactcagaggtcatcaatttctttctctccgtccttaattggattatttttcttttggcctttgggcacagagtctgacctctggaccactctaactggagaaggaactttatgttccctctcctgctgtgtccacaaccttagaaatctgtagctagatttttgttgttatagatagaatttactgtttctgaaacccaaatacagttatcagtttaaggtt

SEQ ID NO: 196190 - DNA, 4062 bp, Homo sapiens
  Payload ID: 18700
  Gene Name: tudor domain containing 1
  ENST ID: ENST00000369280
  CDS Start-End: 461-3775
ggtgtgggaggattctctgagtttggaaatagcgcttccaggcatcactccttcaaatgcaaacgttcaccttctctctaagagaaacttgcatgtggattcagtgccttcgtttgactaaaaattacgatacaaacaatattaacatttactagacttttttttccctactttcctcctataggaaaggaagatgtgctagggcatttacttagatgtgggtcagctggcgctagtttgtttaaggagttcctgctgtgtgccagtagcttttccgggccctagggtccttgctataaatacgttagccctgctgggcttctgaactaagggagctaaatgcttccagcttccttagtgaggcagcacggtgctgtatgcttaaatccaaggccgtggagtctgacctgcgtttttatctaaactgtgtaaggtgctggccctgggtggtttggcctcgatgagtgttaaatcgccatttaatgtgatgtcaagaaataatttggaagcacctccttgtaagatgacagagccatttaattttgagaaaaatgaaaacaagcttccaccacatgagtctttaagaagtcctggaacacttcctaaccaccctaatttcaggctgaaaagctcagagaatggaaataaaaagaacaattttttgctttgtgagcaaaccaaacaatatttggctagtcaggaagacaattcagtttcttcaaacccgaatggcatcaacggagaagtagttggctccaaaggagacaggaaaaaattgccagcaggaaactcagtgtcaccaccaagtgctgaaagtaattcaccacccaaagaagtgaatattaagcctggaaataatgtacgtcctgcaaaatcaaaaaaactaaacaagttggtcgagaattccttgtccataagtaatccagggctcttcacctccttaggacctcctcttcggtccacaacttgccatcgctgtggcctatttggatcgctgaggtgctctcagtgcaagcagacctactattgctccacagcatgtcaaagaagagactggtctgcacacagcatcgtgtgcaggcctgttcagccaaatttccacaaacttgaaaataaatcatctattgaaacaaaggatgtggaggtaaacaataagagtgactgtccacttggagttactaaggaaatagccatttgggctgagagaataatgttttctgatttgagaagtctacaactcaagaaaaccatggaaataaagggtacggttaccgaattcaaacacccaggggacttctacgtgcagttatattcttcagaagttttagaatacatgaaccaactctctgccagcttaaaagaaacatatgcaaatgtgcatgaaaaagactatattcctgttaagggggaagtttgtattgccaagtacactgttgatcagacctggaacagagcaatcatacaaaacgttgatgtgcagcaaaagaaggcacatgtcttatatattgattatggaaatgaagaaataattccattaaacagaatttaccacctcaacaggaacattgacttgtttcctccttgtgccataaagtgctttgtagccaatgttatcccagcagaagggaattggagcagtgattgtatcaaagctactaaaccactgttaatggagcagtactgctccataaagattgtcgacatcttggaagaggaagtggttacctttgctgtagaagttgagctgccaaattcaggaaaacttttagaccatgtgcttatagaaatgggatatggcttgaaacccagtggacaagattctaagaaggaaaatgcagatcaaagtgatcctgaagatgttggaaaaatgacaactgaaaacaacattgtcgtagacaaaagtgacctaatcccaaaagtgttaactttgaatgtaggtgatgagttttgtggtgtggttgcccacattcaaacaccagaagacttcttttgtcaacaactgcaaagtggccgaaagcttgctgaacttcaggcatcccttagcaagtactgtgatcagttgcctccacgctctgatttttatccagccattggtgatatatgttgtgctcagttctcagaggatgatcagtggtaccgtgcctctgttttggcttacgcttctgaagaatctgtactggtcggatatgtagattatggaaactttgaaatccttagtttgatgagactttgtcccataatcccaaagttgttggaattgccaatgcaagctataaagtgtgtactagcaggagtaaagccatcattaggaatttggactccagaagctatttgtctcatgaaaaaacttgtacagaacaaaataatcacagtgaaagtggtggacaagttggaaaacagttccctggtggagcttattgataaatccgagacgcctcatgtcagtgttagcaaagttctcctagatgcaggctttgctgtgggagaacagagtatggtgacagataaacccagtgacgtgaaagaaaccagtgttcccttgggtgtggaaggaaaagtaaatccattggagtggacatgggttgaacttggtgttgaccaaacagtagatgttgtggtctgtgtgatatatagtcctggagaattttattgccatgtgcttaaagaggatgctttaaagaaactcaatgatttgaacaagtcattagcagaacactgccagcagaagttacctaatggtttcaaggcagagataggacaaccttgttgtgctttttttgcaggtgatggtagttggtatcgtgctttagtcaaggaaatcttaccaaatggacatgttaaagtacattttgtggattatggaaacatcgaagaagttactgcagatgaactccgaatgatatcatcaacatttttaaaccttccctttcagggaatacggtgccagttagcagatatacagtctagaaacaaacattggtctgaagaagccataacaagattccagatgtgtgttgctgggataaaattgcaagccagagtggttgaagtcactgaaaatgggataggagttgaactcaccgatctctccacttgttatcccagaataattagtgatgttctgattgatgaacatctggttttaaaatctgcttcaccacataaagacttaccaaatgacagacttgttaataaacatgagcttcaagttcatgtacagggacttcaagctacctcttcagctgagcaatggaagacgatagaattgccagtggataaaactatacaagcaaatgtattagaaatcataagcccaaacttgttttatgctctaccaaaagggatgccagaaaatcaggaaaagctgtgcatgttgacagctgaattattagaatactgcaatgctccgaaaagtcgaccaccctatagaccaagaattggagacgcatgctgtgccaaatacacaagtgatgatttttggtatcgtgcagttgttctggggacatcagacactgatgtggaagtgctctatgcagactatggaaacattgaaaccctgcctctttgcagagtgcaaccaatcacctctagccacctggcgcttcctttccaaattattagatgttcacttgaagaaaagatgtataggatgaattgctgctgcacagagttacagaaacaagttgaaaaacatgaacatattcttctcttcctcttaaacaattcaaccaatcaaaataaatttattgaaatgaaaaaactgttaaaaagttaagtaagttaaatcgtatgttttcgcctcttctgtgatcaccaataggacatcttcaggcatattggcaggatagagctaatggagtgaaacctattgtaaggctgtactttcgtgatttaatgacctgaggtttggtcataatgcttctgctgtttttgtaggtttatctgatcgttttcctttgctactgctaatggaactgaacccccaggggtattccagttgtaatagcctttccttactgttgtttggttctgtgaatgcctatgttattgatatgtggaggg

SEQ ID NO: 196191 - DNA, 3705 bp, Homo sapiens
  Payload ID: 18700
  Gene Name: tudor domain containing 1
  ENST ID: ENST00000369282
  CDS Start-End: 154-3495
gctgaggccaggagggcgcactggggattggaggcgagggaagtgcagggcgcatcccaggcggcagggctcccagcatcggcagtcgccatcaccgccagaccgcagagacaggttcggatccgcggtcctcttgcctctttccaggcctcgatgagtgttaaatcgccatttaatgtgatgtcaagaaataatttggaagcacctccttgtaagatgacagagccatttaattttgagaaaaatgaaaacaagcttccaccacatgagtctttaagaagtcctggaacacttcctaaccaccctaatttcaggctgaaaagctcagagaatggaaataaaaagaacaattttttgctttgtgagcaaaccaaacaatatttggctagtcaggaagacaattcagtttcttcaaacccgaatggcatcaacggagaagtagttggctccaaaggagacaggaaaaaattgccagcaggaaactcagtgtcaccaccaagtgctgaaagtaattcaccacccaaagaagtgaatattaagcctggaaataatgtacgtcctgcaaaatcaaaaaaactaaacaagttggtcgagaattccttgtccataagtaatccagggctcttcacctccttaggacctcctcttcggtccacaacttgccatcgctgtggcctatttggatcgctgaggtgctctcagtgcaagcagacctactattgctccacagcatgtcaaagaagagactggtctgcacacagcatcgtgtgcaggcctgttcagccaaatttccacaaacttgaaaataaatcatctattgaaacaaaggatgtggaggtaaacaataagagtgactgtccacttggagttactaaggaaatagccatttgggctgagagaataatgttttctgatttgagaagtctacaactcaagaaaaccatggaaataaagggtacggttaccgaattcaaacacccaggggacttctacgtgcagttatattcttcagaagttttagaatacatgaaccaactctctgccagcttaaaagaaacatatgcaaatgtgcatgaaaaagactatattcctgttaagggggaagtttgtattgccaagtacactgttgatcagacctggaacagagcaatcatacaaaacgttgatgtgcagcaaaagaaggcacatgtcttatatattgattatggaaatgaagaaataattccattaaacagaatttaccacctcaacaggaacattgacttgtttcctccttgtgccataaagtgctttgtagccaatgttatcccagcagaagggaattggagcagtgattgtatcaaagctactaaaccactgttaatggagcagtactgctccataaagattgtcgacatcttggaagaggaagtggttacctttgctgtagaagttgagctgccaaattcaggaaaacttttagaccatgtgcttatagaaatgggatatggcttgaaacccagtggacaagattctaagaaggaaaatgcagatcaaagtgatcctgaagatgttggaaaaatgacaactgaaaacaacattgtcgtagacaaaagtgacctaatcccaaaagtgttaactttgaatgtaggtgatgagttttgtggtgtggttgcccacattcaaacaccagaagacttcttttgtcaacaactgcaaagtggccgaaagcttgctgaacttcaggcatcccttagcaagtactgtgatcagttgcctccacgctctgatttttatccagccattggtgatatatgttgtgctcagttctcagaggatgatcagtggtaccgtgcctctgttttggcttacgcttctgaagaatctgtactggtcggatatgtagattatggaaactttgaaatccttagtttgatgagactttgtcccataatcccaaagttgttggaattgccaatgcaagctataaagtgtgtactagcaggagtaaagccatcattaggaatttggactccagaagctatttgtctcatgaaaaaacttgtacagaacaaaataatcacagtgaaagtggtggacaagttggaaaacagttccctggtggagcttattgataaatccgagacgcctcatgtcagtgttagcaaagttctcctagatgcaggctttgctgtgggagaacagagtatggtgacagataaacccagtgacgtgaaagaaaccagtgttcccttgggtgtggaaggaaaagtaaatccattggagtggacatgggttgaacttggtgttgaccaaacagtagatgttgtggtctgtgtgatatatagtcctggagaattttattgccatgtgcttaaagaggatgctttaaagaaactcaatgatttgaacaagtcattagcagaacactgccagcagaagttacctaatggtttcaaggcagagataggacaaccttgttgtgctttttttgcaggtgatggtagttggtatcgtgctttagtcaaggaaatcttaccaaatggacatgttaaagtacattttgtggattatggaaacatcgaagaagttactgcagatgaactccgaatgatatcatcaacatttttaaaccttccctttcagggaatacggtgccagttagcagatatacagtctagaaacaaacattggtctgaagaagccataacaagattccagatgtgtgttgctgggataaaattgcaagccagagtggttgaagtcactgaaaatgggataggagttgaactcaccgatctctccacttgttatcccagaataattagtgatgttctgattgatgaacatctggttttaaaatctgcttcaccacataaagacttaccaaatgacagacttgttaataaacatgagcttcaagttcatgtacagggacttcaagctacctcttcagctgagcaatggaagacgatagaattgccagtggataaaactatacaagcaaatgtattagaaatcataagcccaaacttgttttatgctctaccaaaagggatgccagaaaatcaggaaaagctgtgcatgttgacagctgaattattagaatactgcaatgctccgaaaagtcgaccaccctatagaccaagaattggagacgcatgctgtgccaaatacacaagtgatgatttttggtatcgtgcagttgttctggggacatcagacactgatgtggaagtgctctatgcagactatggaaacattgaaaccctgcctctttgcagagtgcaaccaatcacctctagccacctggcgcttcctttccaaattattagatgttcacttgaagaaaagatgtataggatgaattgctgctgcacagagttacagaaacaagttgaaaaacatgaacatattcttctcttcctcttaaacaattcaaccaatcaaaataaatttattgaaatgaaaaaactgttaaaaaaaacagcatctcttggaggtaaacccttatgagacaggaaacagcaaaggctagctttaggagagaaagtacagcacctggtgtttttatttatgagaaccttttctttgtccactttctctgtaatgaccttctatccctccgtttttgcctgcctgccattctcctattaggttggtggtttttattttcctctaagttccttccaccaaataaatattacgtaaaaaattcataccaaa

SEQ ID NO: 196192 - DNA, 1776 bp, Homo sapiens
  Payload ID: 18701
  Gene Name: tudor domain containing 10
  Uniprot ID: Q5VZ19
  ENST ID: ENST00000368480
  CDS Start-End: 86-1186
aaggcgcgaaggctgggcgtcgcgatcgcaggtgcacgcgcgtggcccgcgagacgaggagatcctgttggaaagcaactgcagcatgtcctggaacattagtcacccccaactctctgataaactgtttgggaagaatggagtgttggaggagcagaaatctccaggattcaagaaaagagagacagaggtgtatgttggcaatcttccactggatatttctaaggaggaaattctgtaccttctaaaggacttcaaccctcttgatgtccacaaaatccagaatggctgcaaatgctttgcatttgtagatctgggctccatgcagaaagtgacacttgcaatccaggagctgaatggtaaactcttccacaagcgaaaactgttcgtgaatacaagcaaaaggccccccaagaggacccctgatatgatccagcagcctcgggccccgctggtgttggagaaggcttctggtgaaggatttggcaaaaccgccgctattatacagctcgctcctaaagctcctgttgacctgtgtgagacagagaaactgagggcagccttctttgcagtcccgttggaaatgagagggtccttcctggtgctgctcctgagggaatgcttccgagacctgagctggctggcactcatccatagcgtccgtggggaggcggggctgctggtgacgagtatcgtcccgaagaccccgtttttctgggctatgcacgtcactgaggctctgcaccagaacatgcaggctctgtttagcaccctggctcaggcggaggagcagcagccctacctggagggctccaccgttatgcgcgggactcgctgtctggcagagtaccacctgggggattatggacacgcctggaacaggtgttgggtgctggacagggtggacacctgggctgtggtcatgttcattgattttggacagttggccaccatccctgtgcagtctctgcgcagcctagacagcgacgacttctggaccatcccacccctgactcagccattcatgctggagaaagacattttgagttcgtatgaggttgtccatcgaatcctcaaagggaaaatcactggtgctttgaactcggcggtaactgctcctgcatctaacttggctgttgtccctccactcctgcccttggggtgtctgcagcaggctgctgcctaggcctggacacagtatttacctggcattcttttagatcaaacgaactggttatctgaggggttgggtgaactggctcgggtgggccttccttcccaccaaggctttgtctttctcttccagttgcacatcctaaagtttgaagagtctaaataacggggcttccctcagcatgttccctctcctgtttgccacggatccagaggccacctgccctgtcttctcgtacccctttcactcttgaggcctgggaggtgaaaaaggccagactgtgcccaggattgattcaattttgcttttactcccagcttccctctcaaaagagagtgaagtctcatttgtcatgtgtcttcagttccccaacttggcatgaacatttgaaccaaacataggaaactaccattaggttgaaagcctgaggcagctgggatggtctttcttgtgtctcttctttgcaccccagagcatgatataagtggtcctaacagattctggataatggagaagccctctgctggttttcctggcattccatgtagaataggtagagaatatttaaccaatgagcaaataaatgttggcatgtttcatga

SEQ ID NO: 196193 - DNA, 2331 bp, Homo sapiens
  Payload ID: 18701
  Gene Name: tudor domain containing 10
  Uniprot ID: Q5VZ19
  ENST ID: ENST00000368482
  CDS Start-End: 839-1894
gtcttcaacgcctgcccggcccgaggacaccgtggctctcggaggcggcgggcgccgggggcttccccctgctctttcctcctgcggtgggagaggccaggcccacggaagccccctgcggcccagcccacgctcccagggaccagagaggaccgagcggaggcggcgggagtatccccggcgcagcgacagacggtggacggacggcgagcggcccatcaactccgcgcgcccctcccctccgcggctggcgcctcccagccccgccacctcctgcccagagctgggggcggcggggtgagcgccatggcagaggcgggtcgggctgcgagctctggagaaaggggcggcggccgcacgtgcggatcggccgcgccccactgagcagagagcccccttctgccgccgacagcccgcgtctgcaccgagccggtctcggccgggcgctgccttcacacgcgcccaggagtgtcacgtgcgccgctcacccccgggaaggaagcccctcgcccacccactccgctctactccactctttctgcagacgttatttttggcggtagggcagaggttgcggcccgaggtccgggcgcagggacaacggtcgccagctcctgcgctagttccgttactcttcggtggcacacggtcctgggcagcgcgaggctcttcccgccgtggccgccggggattggctgccggcaagccccgccccgtgcccccgggctcagagggggcggagcgcggagggagaaggcgcgaaggctgggcgtcgcgatcgcaggtgcacgcgcgtggcccgcgagacgaggagatcctgttggaaagcaactgcagcatgtcctggaacattagtcacccccaactctctgataaactgtttgggaagaatggagtgttggaggagcagaaatctccaggattcaagaaaagagagacagaggtgtatgttggcaatcttccactggatatttctaaggaggaaattctgtaccttctaaaggacttcaaccctcttgatgtccacaaaatccagaatggctgcaaatgctttgcatttgtagatctgggctccatgcagaaagtgacacttgcaatccaggagctgaatggtaaactcttccacaagcgaaaactgttcgtgaatacaagcaaaaggccccccaagaggacccctgatatgatccagcagcctcgggccccgctggtgttggagaaggcttctggtgaaggatttggcaaaaccgccgctattatacagctcgctcctaaagctcctgttgacctgtgtgagacagagaaactgagggcagccttctttgcagtcccgttggaaatgagagggtccttcctggtgctgctcctgagggaatgcttccgagacctgagctggctggcactcatccatagcgtccgtggggaggcggggctgctggtgacgagtatcgtcccgaagaccccgtttttctgggctatgcacgtcactgaggctctgcaccagaacatgcaggctctgtttagcaccctggctcaggcggaggagcagcagccctacctggagggctccaccgttatgcgcgggactcgctgtctggcagagtaccacctgggggattatggacacgcctggaacaggtgttgggtgctggacagggtggacacctgggctgtggtcatgttcattgattttggacagttggccaccatccctgtgcagtctctgcgcagcctagacagcgacgacttctggaccatcccacccctgactcagccattcatgctggagaaagacattttgagttcgtatgaggttgtccatcgaatcctcaaagggaaaatcactggtgctttgaactcggcgttgcacatcctaaagtttgaagagtctaaataacggggcttccctcagcatgttccctctcctgtttgccacggatccagaggccacctgccctgtcttctcgtacccctttcactcttgaggcctgggaggtgaaaaaggccagactgtgcccaggattgattcaattttgcttttactcccagcttccctctcaaaagagagtgaagtctcatttgtcatgtgtcttcagttccccaacttggcatgaacatttgaaccaaacataggaaactaccattaggttgaaagcctgaggcagctgggatggtctttcttgtgtctcttctttgcaccccagagcatgatataagtggtcctaacagattctggataatggagaagccctctgctggttttcctggcattccatgtagaataggtagagaatatttaaccaatgagcaaataaatgttggcatgtttcatga

SEQ ID NO: 196194 - DNA, 1317 bp, Homo sapiens
  Payload ID: 18702
  Gene Name: tudor domain containing 12
  Uniprot ID: Q587J7
  ENST ID: ENST00000421545
  CDS Start-End: 1-1188
atgctccagctcctggtgctgaagattgaagatccaggttgcttctgggttattataaaagggtgtagtccctttttagatcatgatgtcgattatcaaaaattaaatagtgccatgaatgacttctacaacagcacgtgtcaagatatagaaataaaacccttaacattggaagaaggacaggtgtgtgtggtctattgtgaggagctaaagtgctggtgcagggccattgtcaaatcaattacgtcttccgcagaccagtacctggcagaatgtttccttgtggactttgccaagaacattccagtcaaatctaaaaacatccgagttgtagtagaatcgtttatgcagcttccctatagagcaaaaaaattcagcctgtactgcacaaagcctgtcacattacacattgacttctgccgagacagtactgacattgtacctgccaagaagtgggacaatgcagctattcagtactttcagaaccttctgaaagcaactacccaggtggaagccagattatgtgctgtggaagaagatacatttgaggtttacctttatgtaactataaaagatgaaaaagtttgtgttaatgatgatcttgttgcaaagaactatgcttgttatatgtcacctacaaagaataaaaaccttgattatttagaaaaaccaagattgaatataaaatcagcaccctccttcaataaactcaatccagcacttacactctggccaatgtttttgcaaggaaaagatgttcaaggaatggaagattcacatggtgtaaattttccggcacaatctctgcaacatacatggtgcaagggtattgtcggtgacctcaggccaacagccacagcacaggacaaagctgtaaaatgtaatatggattcattgagagattcacctaaagacaaatctgaaaagaaacaccattgcatctctttaaaagatacaaataagcgtgttgaatcctcagtgtactggccagcaaaaagaggcataaccatatatgctgatccagatgtaccagaagcaagtgctttaagtcagaagtcaaatgagaaacctcttagattgactgagaagaaagaatatgatgagaagaatagctgtgtgaaattactgcagtttttaaatcctgatcctttgagagctgacggaatctctgatctccagcagacttgagattagaagagaaactccttagatgggggacttaacctgaagacatccttttagaaacgatcgaatggattgttgcttctgagaaattgttccttgttttttggataataaacgatcttccttttggta

SEQ ID NO: 196195 - DNA, 3934 bp, Homo sapiens
  Payload ID: 18702
  Gene Name: tudor domain containing 12
  Uniprot ID: Q587J7
  ENST ID: ENST00000444215
  CDS Start-End: 321-3854
cgacgcctcaaggcctgctcagcgtgcgcgggcatccggtgggtgcgggaggcccgaggccaggcaggcagggatcccgcagcgaggggctggttactgccaggacggagcgcattgcctcgagccgaccccggggtccgcgagggctcctggggacgaggagtgtggggcacctgccgcggggggcccaggcgctaaaggtggagggaaggaacgcactcgcggcgggggcctggccggggcggacgcagccagcctcacccgcgacggtaggggacttccagggcgagggggcccatctgccctcgggcgccaggaggatgctccagctcctggtgctgaagattgaagatccaggttgcttctgggttattataaaagggtgtagtccctttttagatcatgatgtcgattatcaaaaattaaatagtgccatgaatgacttctacaacagcacgtgtcaagatatagaaataaaacccttaacattggaagaaggacaggtgtgtgtggtctattgtgaggagctaaagtgctggtgcagggccattgtcaaatcaattacgtcttccgcagaccagtacctggcagaatgtttccttgtggactttgccaagaacattccagtcaaatctaaaaacatccgagttgtagtagaatcgtttatgcagcttccctatagagcaaaaaaattcagcctgtactgcacaaagcctgtcacattacacattgacttctgccgagacagtactgacattgtacctgccaagaagtgggacaatgcagctattcagtactttcagaaccttctgaaagcaactacccaggtggaagccagattatgtgctgtggaagaagatacatttgaggtttacctttatgtaactataaaagatgaaaaagtttgtgttaatgatgatcttgttgcaaagaactatgcttgttatatgtcacctacaaagaataaaaaccttgattatttagaaaaaccaagattgaatataaaatcagcaccctccttcaataaactcaatccagcacttacactctggccaatgtttttgcaaggaaaagatgttcaaggaatggaagattcacatggtgtaaattttccggcacaatctctgcaacatacatggtgcaagggtattgtcggtgacctcaggccaacagccacagcacaggacaaagctgtaaaatgtaatatggattcattgagagattcacctaaagacaaatctgaaaagaaacaccattgcatctctttaaaagatacaaataagcgtgttgaatcctcagtgtactggccagcaaaaagaggcataaccatatatgctgatccagatgtaccagaagcaagtgctttaagtcagaagtcaaatgagaaacctcttagattgactgagaagaaagaatatgatgagaagaatagctgtgtgaaattactgcagtttttaaatcctgatcctttgagagctgacggaatctctgatctccagcagttgcagaagctgaagggcctgcagccgcccgtggtagtgctccggaacaagatcaagccctgcttaaccattgactcgtcgccgctgtcagcagacctgaagaaggctcttcaaagaaataagtttccgggccccagccacactgaatcttactcttggcctcccatagcgcgtggctgtgatgtggttgtcatttctcactgtgaaagcaaccctttgctctacctcctaccagtgttgacagttttgcaaacaggagcctgctacaagtcattaccaagtagaaatggacctctcgcagtcatcgtgtgccctgggtggaagaaggcccaatttatttttgaattattgggagaatatagcatgtcctccaggcctcttcatcctgtgctattaacaattgggctccataaagaggaagccaaaaatacaaagcttccaaggggctgtgatgtgattgttacgaccccatacagcctgctgaggcttctcgcctgtcagagcctgctgttcctcaggctctgccacctgatcctggatgaggtagaggtgctattcttggaagccaatgaacagatgtttgctatattagataactttaaaaaaaatattgaagttgaagaaagggaatctgcaccacatcagattgttgcagttggagttcattggaacaaacatatagaacatctcatcaaagagttcatgaatgatccctacattgtgatcacagccatggaagaggctgctctctatggcaatgtccaacaggtagtacatctttgcctagaatgtgaaaaaacttcttctttactccaagctcttgattttattccaagtcaggcacaaaagaccttgatcttcacctgctctgtagctgaaacagaaatagtgtgtaaggtagtagaaagcagttcaatattttgcttgaagatgcataaagaaatgatttttaacttacaaaatgttttagaacagtggaagaagaagttaagttctggctctcaaattatattagccctcacagacgactgcgtcccactcttggccatcaccgatgccacgtgtgtgattcacttcagtttccctgcctcaccaaaagtttttggtggacgcctgtattgcatgtctgatcattttcacgctgaacagggttctcctgcagaacagggagataagaaagccaaatctgtcttgctgctgacggagaaagatgcgagccatgcggtgggcgtcctgcgctacttggagcgagcggacgccaaggtccccgcagagctgtacgagttcaccgcaggagttctggaagccaaagaagataagaaagccggaaggcctctttgtccatatctgaaggcttttggtttttgcaaagacaaaaggatctgtcctgaccgacaccgtattaatccagaaacggacttgcccaggaaactgtccagccaagccctaccttcatttggatacattaaaataatacctttttatattttgaatgcaacaaattactttggccgtatagttgataaacacatggatctttatgcaactctcaatgctgaaatgaatgagtattttaaggattctaataaaacaactgtggaaaaggtggagaagtttggattgtatggattagcagaaaaaacgctttttcacagggttcaggtgttggaagtgaaccaaaaagaagacgcctgggccctggatgacatccttgtagagttcatcgatgaaggcaggacggggctcgtcacaagggaccagctgctgcatctcccagaacatttccacacacttcccccgcaggctgtggagtttattgtctgtagggtgaaacctgctgacaacgaaatagaatggaatccgaaggttactaggtacattcatcataaaattgttggaaaattgcatgatgcaaaagtgatcctggctttgggaaatacagtttggattgatccaatggtgcacattacaaacctttccagtttaaaaacctctgtcattgattataatgttcgagctgaaattttgtccatgggcatgggcattgataatccagaacacatagaacaactgaaaaaattacgcgaagatgctaagataccagcttgtgaagaaagcctaagccagaccccgccgagggtgacagggaccagtcctgctcaagaccaggatcatccatccgaggagcagggggggcaggggacgcctccagcagaagatgctgcttgcctgcagagcccccagcctgaggacacgggtgcagaaggaggggctgagtccaagacgagctcagaaaaccagaagcctggtgggtacttggtattcaaaagatggttaagttcaaatcgttaatgtctggaaaattgctaatgtttagactttctactttgagatgaaatgtagagaagatgacataaactgatatcacctaa

SEQ ID NO: 196196 - DNA, 3176 bp, Homo sapiens
  Payload ID: 18702
  Gene Name: tudor domain containing 12
  ENST ID: ENST00000564769
  CDS Start-End: 1-338
aaaaattacgcgaagatgctaagataccagcttgtgaagaaagcctaagccagaccccgccgagggtgacagggaccagtcctgctcaagaccaggatcatccatccgaggagcagggggggcagggttcctgtagagagccaggtgttaacccctgcctctcccgtctaggacgcctccagcagaagatgctgcttgcctgcagagcccccagcctgaggacacgggtgcagaaggaggggctgagtccaagacgagctcagaaaaccagaagcctgaaactttatctggaaacactgaaggtgccttcattagcagaactgcacagccgcctctgaaaaggtacgtccactcggcatggaggagtcggcgtcccttacccagttaataagatcaatgaatgcgcaggtctttcttcttctagcttccacccacaaataaaatggttccaaaaagaagatgtcgtcatcttaaagataagaataaggaatgtaaaggactacaagtgtcagtatttaagggatagagtcgttttcagtgcttgggtgggagacaaattttacctggctgatctggagctgcggggcaacataaggaaagatgactgccaatgtgtgattagaaacgatgaacctgtaatcactctggccaaagagagaagggaggcatggtgtcacctactcagacagaggaaccccaacgtggcttttgattttgatcactgggaagactgtgaagaggacagccacttccccaaggtagtgaattctaaaaacctgccgtacacagtgacagaggtggttgaagacagtagcagcacttcagaggatgacgacagtgagagtgaaagagaaggtgaatgacgtcctcaagagcggctggaagatgttgaacaaaaatggatattgccatgtgaccgacagttaagaaaacagtcagtcataaccaaatctttttcttttcttttctttttttttttttttttttttttttgagacagagtcttgctctgtcggccaggctggagtgcagtggcatgatcttggctcactgcaacctctgcctcacaggctcaagcaattctcctgcctcagcctcccgagtagctgggattacaggcatgtgccaccatgcctgaccaatttttgtatttttagtagagacagggtttcaccatgttggacaggctggtctcgaactcctgacctcaggtaatcctcccacctcagcctcccaaagtgctgggattacaggtgtgagccaccacacccggccaaccaaatctttctttacctcaaggataaatgattactgtcaccttgtggtgctggacttgataacggtgagaaattcttcattgacttaaaaataggctgatgataagaccatcaaaggagggtggacacagagaaacagcaggtgtggtctgattccgccggcttgtctgtcctgtctggcgcctctcgccactcaccctggcagagcagacatgcatctgggtgatgaaatgcactgtctggagtcagtccattcattttttttcacctagacctttgctacattgctacaaacctgatcttacacatataaattgaggtttctaatgtacacacttagactcagcaactgttgaaccagccctttcaaccatgagatagtgggatttaacataaccatctatgtgaattgatagtgttagcattcttggatagtgatagctcctcagagtaagttgacttctgatgaagagatagtccagggatagaaattggattgctcagtaagacccaggcctttccggggtgaagctgctggttctaaacaatcccttggacctgcagagtcctgagcaaatggcacaaaggttgctttttagtggaaattcacaagggcctgtggggtgcctggaggtgatctttgaatgcctacatgtcgtgagccctgcagacattcgccaccccatctgcattgtggctgcagcactggggggggtcaccaggtttaggggaggagtgtatgtagtcatggccacacccagaggctggcttttgtgctttgggtttctttgttgactgaaaaagcgagaaaggtgagctattgggaaattaaaagtcctgtgcactctgtgtcttgtttatcagctttgcctcggaatggaaaagaatttggatagaacatgagtgttgtgtgacggccccaagatctttattatttttttgtatcagaaagcgccaatgcccaggcttatgtatgtcccagcagaagccaccgcttgaactagaggtgaactttgtcatcaagctgtcctgtgagcaggtctggatcacactctggctcagttttctcatctgtaaaatgagacatcccctcattgtgtggcctggccttgtctcagggagcgcccgccgagtgctgctgggttgggcagtttttctgcccagtggctctgatgggggctcagagccctggcctcccctgggaggacacgctgtgcagccaggacagctgccgggagtgtgcccaggtcactgctatggccttcgcagggtgactggcaggtatcaaatcagcccatgaaggaagatggtgattttccttttttgtagctaaattgggcaggctcttgggaagtagaaagttctggtgtttttgctggtgaaggttttgactgtggagctcttctaacacccatatcagtgtctgtttctctgcatgtggctgctgccctgttggtggagctctgggggcagagaccaggccgccgtccagtggcgccccgtgcgcaccagctgcctgctgtttacacccaggtgcgccgagtctctttcatacagcacagcaaatgataatagctagtgacaatgtgtttcctgtgcactcgtgaaaatgcagggaggacaactgcatgcttagatctgtttcttttttcagacattcaaatgttctaatatctgaagctaacattttgtaggatataggatgctgattatgtgaacaattagtcattggttttctgtactgctatgaatatgtctgatttcaagttttggtcaaatatctaaaatgcaaggtgaaagtgcctttgtctctatgcttctaaaatcgctcatgcttagttgtggtatggatgtcttccgcagtgtatcatcaataaaatttcactgttttcacagaaa

SEQ ID NO: 196197 - DNA, 6135 bp, Homo sapiens
  Payload ID: 18703
  Gene Name: tudor domain containing 15
  Uniprot ID: B5MCY1
  ENST ID: ENST00000405799
  CDS Start-End: 331-6135
acatgctccctggggcccctgcgggattacgagggggtgggaacagggcccgagtctcccgccatcttgggccctagcggtatttttccagctctgggaagagcggcctgacccgcagcagagattcttggtcttatttctgcattctgatctgttccagtgaattatatttccacaccagtactacaccagtaccacagtgtcttgagtgctgtaactttataattagtcttaaactcagatttagagtctgattctaaggaaaaatagtttcccaaatttcacacaattaattgagtactgatatctgaatcctgtgtatacagtaaaatggattctacatctttcttaccaacatttttagatgtggatctgacaatatcacatattaaatgtcttcccaaggatattctggtgaaatttcaaggcataaagagtaatgaatgtgagtttgactaccatgtattgcagagagaaatacaacatactccaaaagtgaaaaataatgtggaaattgatgaattttgtttggtggaagaaagagtatctggagaatggcagagaggaagagtcatggaaaagaaaaatgaactctatacagtgctcctcatagatcgcggagaagaactaagagttgctggtccacagattgcttcagcctgtggcaatttatttgagctaccgccacgggtagtatttggtatttttgcgaatatactaccagttggggaaaaatggtcccctaaagctttgaattatttcaagtcattagtaggaatacaagtgaaaggttatgtgcaagctattttacctctgcaaatgtttctttttgaagtgccaaaaattatatctcaggctctcgagttacaattaggaagacttgttgatggagattcatttcgtcttattgtggaaatgttagaagaattccctcaacaaatgccagatttattacaacataaaaggcctgaattgtcattaggtaataaagatacttcacttgatattcagcatgttctggataagttgcagccatctttgtcagtaggaagtactgaaagtgtaaaggtatcatctgcattgagcccaagtaaattttattgtcagttaattaaatggactccagagctagaaaacttgacagcacatatgactttgcattatgataccgtctgtcaagaaactagtcccacgtgtgataattttggactgctttgtgttgccagaaggcgaaatggacagtggcatagaggaattcttcagcagctcttgcccccaaatcaagtaaaaatttggtttatggattatggcagtagcgaggctataccctcaatttatgtaaagaaacttaaacaggattttattttagtaccattattttcatttccatgttctctgacatgtttgcacagtccagatagagatgcaagaatatttcaactgagtatatttaaacaggccttattaggacaagtggtatatgcacacattgattggttcaataaggatgagtgtttgtattatgtgacattacaaactcaagagtctacagttaattctaagtgtctactgaagactgtaggcacacaagtactttgtccgatgtctgattcaaaaatctccaatatcttgagtgagacaagtgtgtctgatgtaaacagctttgcagttgagagttttatgggaaatattgaatggtcaatagactctctaaataaaaaaggcattttaaaagtaggttttcccattaaaacagtacaaatggagatagaggctgcctacatagcttttatagcatatgtattaaacccatcaaatttctgggtacgcactaatgaccatcggaatgaatttcaagaaataatgaaaaacataaacaaattttatgatttgtgtgaaaacgatgaaatgattctaagaaaacctgaacctggattattttgttgtgctagatatagcaaggacagacgtttttacagagctgtcatcactgaaattaatggttataagattaatgtttattttttggattatggtaatactgattccataccattttttgatgtaaaaattttgcttccagaattttgtgagttgcctgccttagcgatgtgctgttcacttgcacatatatttcctgttgaagatttatggactaaggctgcaattgattattttaaaaaattagttttgaacaaagcaattttgcttcaggttatagcaaaaaaagatgacaagtacactgtaaatattcaaagtgttgaagcctcagaaaatattgatgttatctctcttatgttacaagctggatatgcagaatattttcaagtagaactagaatattttccaaaatctgtaagtgaatattcaatgctaaattcagaatctaaaaacaaagttaatattaaaaaagtcatatctgcccttcttgaaggacctaaatctaaaaagtaccattcaaataacctggtggaaaataacttgtctttgccaaagtccctagctgttaatatctcagaatttaaaaatcctttcaccttgtctgtgggacctgagtcatcctggccttataaagaatatatttttagaccaggaacagttcttgaagttaaatgttcctgttattatggcccaggtgacttttcatgccagctccaatgtaagtcagaagacctaaaattactaatggagcaaattcagaattactatagtattcattctgatccttatgagattgggcagactgcttgtgttgctaagtattctgggaagtggtgtagagctgctgttttgactcaagtatcaaaagaagttgacatagtgtttgttgattatggttaccaaaaaagggttttaattgaagatctttgtgcaattaacccacgttttctcttgttagaaagccaagccttcagatgttgtcttaaccattttattgagcctgttagttgtaaattattcagttggacaagaaaagcattcagagacttgtggaattttatctcttcatctagagggttattgacttgtatcatctatgccttagttattatacatccaaaccatttatataacttagtggatttacagtcctcatttactagtgcaaaagaatttcttatgaatcgtggctctgctcagtatatcacattatcagagacattcccatctttatttagtctttacagttactgttattcttcctttaatatacaaattggaagtgaagaagaagtatatatatctcacatatatagtccccaaaagttttattgccagcttggcagaaataataaagatctagagatgatagaaacaaaaatcacagagagtgttaacctccaaaattttccaaaatatgattctaataaaatgagagtgtgcatatctaagtatgtagaggatggtctctcatacagagctttagcaataccaacagattcatcatctgagtttcaagtctattttgtagactttggaaataagcaattagtaggagaaaatatgttgagggccatttcagctcagtttccagagttgttgtttacacctatgcaagctattaagtgttttttgtcagatcttagggatgtagatattccagcagaaatcagtagttggtttaaagacaatttcttgggaagatcattaaaggcgataatattgtcccaggagtcagatggacagcttggtatagaattgtatgatggatctcaatatataaatgagaaaattaaagtgttgcttcatgcttatggaaaaagacattgtgaccaagcatgctgcatggaaaagagtaataaaataaatgagaataagagatttactacttctttgaaaggcaaaacaggaaacaactatcgccataatgtgataaataaacctagtccagtaacatattccgaaagaaaaatagaccaattgatgcatcccaaaaatatacatgccaggtttttgaagccatcagtttgttataaaatggaacctgtgtcaaaaaacaaaatgaagacttctttgaatgatgggcttaaaggtataaaaattgtccctggagctgcacatattcttgagaacaggcgtgtgggccaaaaatcagtaaaggttgtatcacagtcttttatcagagcattaaatcaaacaacctcacaaaacccatatgaccttattaggccacagatcaaagaccttcctcaaccgcaaatttatttgaatgccaaagttaaagggtatgtatctaatatcagtaatccagcgaatttccatattcagcttgctgagaatgaaagtgtaattatcagacttgctgatgctctaaatgcaacagcaaggagattgagagagagaaaatcagttaaacctctagtgggagatcttgtagttgcagaatattctggtgacaatgccatttacagggcagttattaagaaaattttgccaggaaattcttttgaagtagaatttattgactatggtaactctgcaatagtaaacacatctaaaatttacgaacttcagagggaatttttaactgttcctcagctaggaatccatgcttttcttagtggagtaaaatggaatgagcctgatgaaatatgggatgacaaaactgtggattattttacttcgaaagtacataacaaaacagtttattgtgaatttttgaaaaagcatgatcagaaatgggaagtaaatatgatttgtgatgaaaaatgtgtcattaatgaactactgaaatggaaagcatgttcaaaactgcagaagtcagcattgcagatgcctcaggttctctctcaaaaggtgaggccaggtgataatgaaatgaagaaaggaaaatcaaatgagtctgaaggttctatgaattcaaaccaacagctgtttaaaattcctttggaagaattcaaacttggacaacttgaaaaagctgaaatgcttaatgtttcaaaaagtggaagattttatgtgaagttatccaaaaataaaaaaattttatcagatttaatagtattaattacgaaagaagaaaaaaaatccccttttttatcaatggaaagtattgaaaaaggtttagaatgcttggcaaaatctaaaaataccttgaaatggcatcgatcaaaagtagaagaaaagtatgttgatgataaagtacttgtttttttagtagattgtggtatctatgaaatagtacctgtatgtaataccaagctgcttagtaatgaaataagaaacattcctagacaagctgtaccttgtaaatggatttggtttgaaaattctaagaacatatcatttgagtgcttatttgctgatttggaaataaatattcttttcctgaaatatttagatgctgtttgggaagtagaaattttggtagatgacctgttacttttggaatacttaaatttgaatacagttcctgttgaagaaaacaaacttagacttgcagaaattgtttacaacattgaatctaagactcctgtatcatcatgcacaataaaatcatttacttgggttcaattccaaaatgataggcagtattctggtattgcaactgctgtttctgatccatcagacttcagtattcagttagaagatttctttgacataatgaaatacctttttatgttgctttctgatctaccagagaccttacaaacattgcctcaggagttcataattcccggttctagttgtttgttcaaatataaatcggaagatcagtggaatagagtagaaatttctgaagtctcacctcagtctttatgtcttgtgttggttgactatggattttctttttatatacgttattcagaaattataaatcttaaagttgttcctgaggaacttttgaatttgccaaggctgagttatccatgtattttatatggtatcttacctgctaaaggaaaacattggagtgaagaagccaaaatcttttttcgagatttcctaagtaaaccagacttagtttttcagtttagggaatatcattctgaaacaaaactgaaagtagatgtcattcatgagaaaaacaatttggcagatatattagttgcatctggtctcgcaacttattctaaagattcacctcatcttgatgcaattactgctactgaatctgctaaaaatccaatataa

SEQ ID NO: 196198 - DNA, 5805 bp, Homo sapiens
  Payload ID: 18703
  Gene Name: tudor domain containing 15
  Uniprot ID: B5MCY1
  ENST ID: ENST00000622654
  CDS Start-End: 1-5805
atggattctacatctttcttaccaacatttttagatgtggatctgacaatatcacatattaaatgtcttcccaaggatattctggtgaaatttcaaggcataaagagtaatgaatgtgagtttgactaccatgtattgcagagagaaatacaacatactccaaaagtgaaaaataatgtggaaattgatgaattttgtttggtggaagaaagagtatctggagaatggcagagaggaagagtcatggaaaagaaaaatgaactctatacagtgctcctcatagatcgcggagaagaactaagagttgctggtccacagattgcttcagcctgtggcaatttatttgagctaccgccacgggtagtatttggtatttttgcgaatatactaccagttggggaaaaatggtcccctaaagctttgaattatttcaagtcattagtaggaatacaagtgaaaggttatgtgcaagctattttacctctgcaaatgtttctttttgaagtgccaaaaattatatctcaggctctcgagttacaattaggaagacttgttgatggagattcatttcgtcttattgtggaaatgttagaagaattccctcaacaaatgccagatttattacaacataaaaggcctgaattgtcattaggtaataaagatacttcacttgatattcagcatgttctggataagttgcagccatctttgtcagtaggaagtactgaaagtgtaaaggtatcatctgcattgagcccaagtaaattttattgtcagttaattaaatggactccagagctagaaaacttgacagcacatatgactttgcattatgataccgtctgtcaagaaactagtcccacgtgtgataattttggactgctttgtgttgccagaaggcgaaatggacagtggcatagaggaattcttcagcagctcttgcccccaaatcaagtaaaaatttggtttatggattatggcagtagcgaggctataccctcaatttatgtaaagaaacttaaacaggattttattttagtaccattattttcatttccatgttctctgacatgtttgcacagtccagatagagatgcaagaatatttcaactgagtatatttaaacaggccttattaggacaagtggtatatgcacacattgattggttcaataaggatgagtgtttgtattatgtgacattacaaactcaagagtctacagttaattctaagtgtctactgaagactgtaggcacacaagtactttgtccgatgtctgattcaaaaatctccaatatcttgagtgagacaagtgtgtctgatgtaaacagctttgcagttgagagttttatgggaaatattgaatggtcaatagactctctaaataaaaaaggcattttaaaagtaggttttcccattaaaacagtacaaatggagatagaggctgcctacatagcttttatagcatatgtattaaacccatcaaatttctgggtacgcactaatgaccatcggaatgaatttcaagaaataatgaaaaacataaacaaattttatgatttgtgtgaaaacgatgaaatgattctaagaaaacctgaacctggattattttgttgtgctagatatagcaaggacagacgtttttacagagctgtcatcactgaaattaatggttataagattaatgtttattttttggattatggtaatactgattccataccattttttgatgtaaaaattttgcttccagaattttgtgagttgcctgccttagcgatgtgctgttcacttgcacatatatttcctgttgaagatttatggactaaggctgcaattgattattttaaaaaattagttttgaacaaagcaattttgcttcaggttatagcaaaaaaagatgacaagtacactgtaaatattcaaagtgttgaagcctcagaaaatattgatgttatctctcttatgttacaagctggatatgcagaatattttcaagtagaactagaatattttccaaaatctgtaagtgaatattcaatgctaaattcagaatctaaaaacaaagttaatattaaaaaagtcatatctgcccttcttgaaggacctaaatctaaaaagtaccattcaaataacctggtggaaaataacttgtctttgccaaagtccctagctgttaatatctcagaatttaaaaatcctttcaccttgtctgtgggacctgagtcatcctggccttataaagaatatatttttagaccaggaacagttcttgaagttaaatgttcctgttattatggcccaggtgacttttcatgccagctccaatgtaagtcagaagacctaaaattactaatggagcaaattcagaattactatagtattcattctgatccttatgagattgggcagactgcttgtgttgctaagtattctgggaagtggtgtagagctgctgttttgactcaagtatcaaaagaagttgacatagtgtttgttgattatggttaccaaaaaagggttttaattgaagatctttgtgcaattaacccacgttttctcttgttagaaagccaagccttcagatgttgtcttaaccattttattgagcctgttagttgtaaattattcagttggacaagaaaagcattcagagacttgtggaattttatctcttcatctagagggttattgacttgtatcatctatgccttagttattatacatccaaaccatttatataacttagtggatttacagtcctcatttactagtgcaaaagaatttcttatgaatcgtggctctgctcagtatatcacattatcagagacattcccatctttatttagtctttacagttactgttattcttcctttaatatacaaattggaagtgaagaagaagtatatatatctcacatatatagtccccaaaagttttattgccagcttggcagaaataataaagatctagagatgatagaaacaaaaatcacagagagtgttaacctccaaaattttccaaaatatgattctaataaaatgagagtgtgcatatctaagtatgtagaggatggtctctcatacagagctttagcaataccaacagattcatcatctgagtttcaagtctattttgtagactttggaaataagcaattagtaggagaaaatatgttgagggccatttcagctcagtttccagagttgttgtttacacctatgcaagctattaagtgttttttgtcagatcttagggatgtagatattccagcagaaatcagtagttggtttaaagacaatttcttgggaagatcattaaaggcgataatattgtcccaggagtcagatggacagcttggtatagaattgtatgatggatctcaatatataaatgagaaaattaaagtgttgcttcatgcttatggaaaaagacattgtgaccaagcatgctgcatggaaaagagtaataaaataaatgagaataagagatttactacttctttgaaaggcaaaacaggaaacaactatcgccataatgtgataaataaacctagtccagtaacatattccgaaagaaaaatagaccaattgatgcatcccaaaaatatacatgccaggtttttgaagccatcagtttgttataaaatggaacctgtgtcaaaaaacaaaatgaagacttctttgaatgatgggcttaaaggtataaaaattgtccctggagctgcacatattcttgagaacaggcgtgtgggccaaaaatcagtaaaggttgtatcacagtcttttatcagagcattaaatcaaacaacctcacaaaacccatatgaccttattaggccacagatcaaagaccttcctcaaccgcaaatttatttgaatgccaaagttaaagggtatgtatctaatatcagtaatccagcgaatttccatattcagcttgctgagaatgaaagtgtaattatcagacttgctgatgctctaaatgcaacagcaaggagattgagagagagaaaatcagttaaacctctagtgggagatcttgtagttgcagaatattctggtgacaatgccatttacagggcagttattaagaaaattttgccaggaaattcttttgaagtagaatttattgactatggtaactctgcaatagtaaacacatctaaaatttacgaacttcagagggaatttttaactgttcctcagctaggaatccatgcttttcttagtggagtaaaatggaatgagcctgatgaaatatgggatgacaaaactgtggattattttacttcgaaagtacataacaaaacagtttattgtgaatttttgaaaaagcatgatcagaaatgggaagtaaatatgatttgtgatgaaaaatgtgtcattaatgaactactgaaatggaaagcatgttcaaaactgcagaagtcagcattgcagatgcctcaggttctctctcaaaaggtgaggccaggtgataatgaaatgaagaaaggaaaatcaaatgagtctgaaggttctatgaattcaaaccaacagctgtttaaaattcctttggaagaattcaaacttggacaacttgaaaaagctgaaatgcttaatgtttcaaaaagtggaagattttatgtgaagttatccaaaaataaaaaaattttatcagatttaatagtattaattacgaaagaagaaaaaaaatccccttttttatcaatggaaagtattgaaaaaggtttagaatgcttggcaaaatctaaaaataccttgaaatggcatcgatcaaaagtagaagaaaagtatgttgatgataaagtacttgtttttttagtagattgtggtatctatgaaatagtacctgtatgtaataccaagctgcttagtaatgaaataagaaacattcctagacaagctgtaccttgtaaatggatttggtttgaaaattctaagaacatatcatttgagtgcttatttgctgatttggaaataaatattcttttcctgaaatatttagatgctgtttgggaagtagaaattttggtagatgacctgttacttttggaatacttaaatttgaatacagttcctgttgaagaaaacaaacttagacttgcagaaattgtttacaacattgaatctaagactcctgtatcatcatgcacaataaaatcatttacttgggttcaattccaaaatgataggcagtattctggtattgcaactgctgtttctgatccatcagacttcagtattcagttagaagatttctttgacataatgaaatacctttttatgttgctttctgatctaccagagaccttacaaacattgcctcaggagttcataattcccggttctagttgtttgttcaaatataaatcggaagatcagtggaatagagtagaaatttctgaagtctcacctcagtctttatgtcttgtgttggttgactatggattttctttttatatacgttattcagaaattataaatcttaaagttgttcctgaggaacttttgaatttgccaaggctgagttatccatgtattttatatggtatcttacctgctaaaggaaaacattggagtgaagaagccaaaatcttttttcgagatttcctaagtaaaccagacttagtttttcagtttagggaatatcattctgaaacaaaactgaaagtagatgtcattcatgagaaaaacaatttggcagatatattagttgcatctggtctcgcaacttattctaaagattcacctcatcttgatgcaattactgctactgaatctgctaaaaatccaatataa

SEQ ID NO: 196199 - DNA, 3019 bp, Homo sapiens
  Payload ID: 18704
  Gene Name: tudor domain containing 3
  Uniprot ID: Q9H7E2
  ENST ID: ENST00000196169
  CDS Start-End: 789-2744
acccaccctgcgccccagccctctacagcgcgggcgaagggcatcggcggggaagcggctgtggttgccagatctggcagtacagagccaaggtggcagggccgcgctaggacacggatggtcccagggggagggcaacaggaaaaacaagcactgacacaactgccccatttccccatgtcccctaaaagcaggttttcttgggctgaccagggcattttcactgtggtgtccgactggggcaactcgatctgcccgcggggactcaaaaaagcttgagctgcattttttctttgcgtccgggcggaccaaaaggcgaggtgaagggaacgagtgtttataagaaagtaaacttttgtgcagaatgggctggggacacctctgagttttgctgcccgcaacgtgacctttttagcgcggtcctggacgcgttccctcgcagccaacccgtcagtctcctcaggccttatcctgccctctctgaggtggccgcctgtgggcgctgcaaacgccacacttttgctctacgaagaacctcctcgcgactttccaaggtatctttcagatgaaggcattgaagcttgcacaagctctccagacaaagtcaatgtaaatgacatcatcctgattgctctcaatatctgagaacaattggcaagaaattcctccccagtgacatcaatagtggaaaggtagaaaagctcgaaggtccatgtgttttgcaaattcaaaaaattcgcaatgttgctgcaccaaaggataatgaagaatctcaggctgcaccaaggatgctgcgattacagatgactgatggtcatataagttgcacagcagtagaatttagttatatgtcaaaaataagcctgaacacaccacctggaactaaagttaagctctcaggcattgttgacataaaaaatggattcctgctcttgaatgactctaacaccacagttcttggtggtgaagtggaacaccttattgagaaatgggagttacagagaagcttatcaaaacacaatagaagcaatattggaactgaaggtggaccaccgccttttgtgccttttggacagaagtgtgtatctcatgtccaagtggatagcagagaacttgatcgaagaaaaacattgcaagttacaatgcctgtcaaacctacaaatgataatgatgaatttgaaaagcaaaggacggctgctattgctgaagttgcaaagagcaaggaaaccaagacatttggaggaggtggtggtggtgctagaagtaatctcaatatgaatgctgctggtaaccgaaatagggaagttttacagaaagaaaagtcaaccaaatcagagggaaaacatgaaggtgtctatagagaactggttgatgagaaagctctgaagcacataacggaaatgggcttcagtaaggaagcatcgaggcaagctcttatggataatggcaacaacttagaagcagcactgaacgtacttcttacaagcaataaacagaaacctgttatgggtcctcctctgagaggtagaggaaaaggcagggggcgaataagatctgaagatgaagaggacctgggaaatgcaaggccatcagcaccaagcacattatttgatttcttggaatctaaaatgggaactttgaatgtggaagaacctaaatcacagccacagcagcttcatcagggacaatacagatcatcaaatactgagcaaaatggagtaaaagataataatcatctgagacatcctcctcgaaatgataccaggcagccaagaaatgaaaaaccgcctcgttttcaaagagactcccaaaattcaaagtcagttttagaaggcagtggattacctagaaatagaggttctgaaagaccaagtacttcttcagtatctgaagtatgggctgaagacagaatcaaatgtgatagaccgtattctagatatgacagaactaaagatacttcatatcctttaggttctcagcatagtgatggtgcttttaaaaaaagagataactctatgcaaagcagatcaggaaaaggtccctcctttgcagaggcaaaagaaaatccacttcctcaaggatctgtagattataataatcaaaaacgtggaaaaagagaaagccaaacatctattcctgattatttttatgacaggaaatcacaaacaataaataatgaagctttcagtggtataaaaattgaaaaacattttaatgtaaatactgattatcagaatccagttcgaagtaatagtttcattggtgttccaaatggagaagtagaaatgccactgaaaggaagacgaataggacctattaagccagcaggacctgtcacagctgtaccctgtgatgataaaatattttacaatagtgggcccaaacgaagatctgggccaattaagccagaaaaaatactagaatcatctattcctatggagtatgcaaaaatgtggaaacctggagatgaatgttttgcactttattgggaagacaacaagttttaccgggcagaagttgaagccctccattcttcgggtatgacagcagttgttaaattcattgactacggaaactatgaagaggtgctactgagcaatatcaagcccattcaaacagaggcatgggaggaagaaggcacctacgatcaaactctggagttccgtaggggaggtgatggccagccaagacgatccactcggccaacccaacagttttaccaaccaccccgggctcggaactaataggaaaagtagactctttgtgaagaaacgagccagtgactgaaacaccctggtggaaacctgttgacagaccttccactttctcttcagaataagtagctgtggtggatattattatttgaagaaagaaaaaacagattttagggtggaaaaaacagtcaactcacacaaagaatggaaaaaaatactgagttaaattaagcaaataccttttacaagtgaaaggaagaatttttcttctgccgtcaataaaaccattgtgctattattgtttt

SEQ ID NO: 196200 - DNA, 2532 bp, Homo sapiens
  Payload ID: 18704
  Gene Name: tudor domain containing 3
  Uniprot ID: Q9H7E2
  ENST ID: ENST00000377881
  CDS Start-End: 311-2266
ccccccaccacccccggcctaagcagctaccatggcccaggtggccggcgcggcgttgtcccaggcgggttggtatctttcagatgaaggcattgaagcttgcacaagctctccagacaaagtcaatgtaaatgacatcatcctgattgctctcaatacagatctgagaacaattggcaagaaattcctccccagtgacatcaatagtggaaaggtagaaaagctcgaaggtccatgtgttttgcaaattcaaaaaattcgcaatgttgctgcaccaaaggataatgaagaatctcaggctgcaccaaggatgctgcgattacagatgactgatggtcatataagttgcacagcagtagaatttagttatatgtcaaaaataagcctgaacacaccacctggaactaaagttaagctctcaggcattgttgacataaaaaatggattcctgctcttgaatgactctaacaccacagttcttggtggtgaagtggaacaccttattgagaaatgggagttacagagaagcttatcaaaacacaatagaagcaatattggaactgaaggtggaccaccgccttttgtgccttttggacagaagtgtgtatctcatgtccaagtggatagcagagaacttgatcgaagaaaaacattgcaagttacaatgcctgtcaaacctacaaatgataatgatgaatttgaaaagcaaaggacggctgctattgctgaagttgcaaagagcaaggaaaccaagacatttggaggaggtggtggtggtgctagaagtaatctcaatatgaatgctgctggtaaccgaaatagggaagttttacagaaagaaaagtcaaccaaatcagagggaaaacatgaaggtgtctatagagaactggttgatgagaaagctctgaagcacataacggaaatgggcttcagtaaggaagcatcgaggcaagctcttatggataatggcaacaacttagaagcagcactgaacgtacttcttacaagcaataaacagaaacctgttatgggtcctcctctgagaggtagaggaaaaggcagggggcgaataagatctgaagatgaagaggacctgggaaatgcaaggccatcagcaccaagcacattatttgatttcttggaatctaaaatgggaactttgaatgtggaagaacctaaatcacagccacagcagcttcatcagggacaatacagatcatcaaatactgagcaaaatggagtaaaagataataatcatctgagacatcctcctcgaaatgataccaggcagccaagaaatgaaaaaccgcctcgttttcaaagagactcccaaaattcaaagtcagttttagaaggcagtggattacctagaaatagaggttctgaaagaccaagtacttcttcagtatctgaagtatgggctgaagacagaatcaaatgtgatagaccgtattctagatatgacagaactaaagatacttcatatcctttaggttctcagcatagtgatggtgcttttaaaaaaagagataactctatgcaaagcagatcaggaaaaggtccctcctttgcagaggcaaaagaaaatccacttcctcaaggatctgtagattataataatcaaaaacgtggaaaaagagaaagccaaacatctattcctgattatttttatgacaggaaatcacaaacaataaataatgaagctttcagtggtataaaaattgaaaaacattttaatgtaaatactgattatcagaatccagttcgaagtaatagtttcattggtgttccaaatggagaagtagaaatgccactgaaaggaagacgaataggacctattaagccagcaggacctgtcacagctgtaccctgtgatgataaaatattttacaatagtgggcccaaacgaagatctgggccaattaagccagaaaaaatactagaatcatctattcctatggagtatgcaaaaatgtggaaacctggagatgaatgttttgcactttattgggaagacaacaagttttaccgggcagaagttgaagccctccattcttcgggtatgacagcagttgttaaattcattgactacggaaactatgaagaggtgctactgagcaatatcaagcccattcaaacagaggcatgggaggaagaaggcacctacgatcaaactctggagttccgtaggggaggtgatggccagccaagacgatccactcggccaacccaacagttttaccaaccaccccgggctcggaactaataggaaaagactctttgtgaagaaacgagccagtgactgaaacaccctggtggaaacctgttgacagaccttccactttctcttcagaataagtagctgtggtggatattattatttgaagaaagaaaaaacagattttagggtggaaaaaacagtcaactcacacaaagaatggaaaaaaatactgagttaaattaagcaaataccttttacaagtgaaaggaagaatttttcttctgccgtcaataaaaccattgtgctattat

SEQ ID NO: 196201 - DNA, 660 bp, Homo sapiens
  Payload ID: 18704
  Gene Name: tudor domain containing 3
  ENST ID: ENST00000377882
  CDS Start-End: 272-660
tatatgccaagtgacttctgaacacgacgtgaagacagtatctttcagatgaaggcattgaagcttgcacaagctctccagacaaagtcaatgtaaatgacatcatcctgattgctctcaatatctgagaacaattggcaagaaattcctccccagtgacatcaatagtggaaaggtagaaaagctcgaaggtccatgtgttttgcaaattcaaaaaattcgcaatgttgctgcaccaaaggataatgaagaatctcaggctgcaccaaggatgctgcgattacagatgactgatggtcatataagttgcacagcagtagaatttagttatatgtcaaaaataagcctgaacacaccacctggaactaaagttaagctctcaggcattgttgacataaaaaatggattcctgctcttgaatgactctaacaccacagttcttggtggtgaagtggaacaccttattgagaaatgggagttacagagaagcttatcaaaacacaatagaagcaatattggaactgaaggtggaccaccgccttttgtgccttttggacagaagtgtgtatctcatgtccaagtggatagcagagaacttgatcgaagaaaaacattgcaagttacaatgcctgtcaaacctacaaatgataatgatgaatt

SEQ ID NO: 196202 - DNA, 2484 bp, Homo sapiens
  Payload ID: 18704
  Gene Name: tudor domain containing 3
  Uniprot ID: Q9H7E2
  ENST ID: ENST00000377894
  CDS Start-End: 258-2213
gaacctcctcgcgactttccaaggtatctttcagatgaaggcattgaagcttgcacaagctctccagacaaagtcaatgtaaatgacatcatcctgattgctctcaatatctgagaacaattggcaagaaattcctccccagtgacatcaatagtggaaaggtagaaaagctcgaaggtccatgtgttttgcaaattcaaaaaattcgcaatgttgctgcaccaaaggataatgaagaatctcaggctgcaccaaggatgctgcgattacagatgactgatggtcatataagttgcacagcagtagaatttagttatatgtcaaaaataagcctgaacacaccacctggaactaaagttaagctctcaggcattgttgacataaaaaatggattcctgctcttgaatgactctaacaccacagttcttggtggtgaagtggaacaccttattgagaaatgggagttacagagaagcttatcaaaacacaatagaagcaatattggaactgaaggtggaccaccgccttttgtgccttttggacagaagtgtgtatctcatgtccaagtggatagcagagaacttgatcgaagaaaaacattgcaagttacaatgcctgtcaaacctacaaatgataatgatgaatttgaaaagcaaaggacggctgctattgctgaagttgcaaagagcaaggaaaccaagacatttggaggaggtggtggtggtgctagaagtaatctcaatatgaatgctgctggtaaccgaaatagggaagttttacagaaagaaaagtcaaccaaatcagagggaaaacatgaaggtgtctatagagaactggttgatgagaaagctctgaagcacataacggaaatgggcttcagtaaggaagcatcgaggcaagctcttatggataatggcaacaacttagaagcagcactgaacgtacttcttacaagcaataaacagaaacctgttatgggtcctcctctgagaggtagaggaaaaggcagggggcgaataagatctgaagatgaagaggacctgggaaatgcaaggccatcagcaccaagcacattatttgatttcttggaatctaaaatgggaactttgaatgtggaagaacctaaatcacagccacagcagcttcatcagggacaatacagatcatcaaatactgagcaaaatggagtaaaagataataatcatctgagacatcctcctcgaaatgataccaggcagccaagaaatgaaaaaccgcctcgttttcaaagagactcccaaaattcaaagtcagttttagaaggcagtggattacctagaaatagaggttctgaaagaccaagtacttcttcagtatctgaagtatgggctgaagacagaatcaaatgtgatagaccgtattctagatatgacagaactaaagatacttcatatcctttaggttctcagcatagtgatggtgcttttaaaaaaagagataactctatgcaaagcagatcaggaaaaggtccctcctttgcagaggcaaaagaaaatccacttcctcaaggatctgtagattataataatcaaaaacgtggaaaaagagaaagccaaacatctattcctgattatttttatgacaggaaatcacaaacaataaataatgaagctttcagtggtataaaaattgaaaaacattttaatgtaaatactgattatcagaatccagttcgaagtaatagtttcattggtgttccaaatggagaagtagaaatgccactgaaaggaagacgaataggacctattaagccagcaggacctgtcacagctgtaccctgtgatgataaaatattttacaatagtgggcccaaacgaagatctgggccaattaagccagaaaaaatactagaatcatctattcctatggagtatgcaaaaatgtggaaacctggagatgaatgttttgcactttattgggaagacaacaagttttaccgggcagaagttgaagccctccattcttcgggtatgacagcagttgttaaattcattgactacggaaactatgaagaggtgctactgagcaatatcaagcccattcaaacagaggcatgggaggaagaaggcacctacgatcaaactctggagttccgtaggggaggtgatggccagccaagacgatccactcggccaacccaacagttttaccaaccaccccgggctcggaactaataggaaaagactctttgtgaagaaacgagccagtgactgaaacaccctggtggaaacctgttgacagaccttccactttctcttcagaataagtagctgtggtggatattattatttgaagaaagaaaaaacagattttagggtggaaaaaacagtcaactcacacaaagaatggaaaaaaatactgagttaaattaagcaaataccttttacaagtgaaaggaagaatttttcttctgccgtcaataaaaccattgtgctattattgttt

SEQ ID NO: 196203 - DNA, 1863 bp, Homo sapiens
  Payload ID: 18704
  Gene Name: tudor domain containing 3
  ENST ID: ENST00000484389
  CDS Start-End: 245-595
gaggtggccgcctgtgggcgctgcaaacgccacacttttgctctacgaagaacctcctcgcgactttccaaggtatctttcagatgaaggcattgaagcttgcacaagctctccagacaaagtcaatgtaaatgacatcatcctgattgctctcaatctcgaaggtccatgtgttttgcaaattcaaaaaattcgcaatgttgctgcaccaaaggataatgaagaatctcaggctgcaccaaggatgctgcgattacagatgactgatggtcatataagttgcacagcagtagaatttagttatatgtcaaaaataagcctgaacacaccacctggaactaaagttaagctctcaggcattgttgacataaaaaatggattcctgctcttgaatgactctaacaccacagttcttggtggtgaagtggaacaccttattgagaaatgggagttacagagaagcttatcaaaacacaatagaagcaatattggaactgaaggtggaccaccgccttttgtgccttttggacagtttggaagaagaaatagccaagataaaagaaagtgtgaagtcctatggtgtgatccatgttgatgaagtgtgtatctcatgtccaagtggatagcagagaacttgatcgaagaaaaacattgcaagttacaatgcctgtcaaacctacaaatgataatgatgaatttgaaaagcaaaggacggctgctattgctgaagttgcaaagagcaaggaaaccaagacatttggaggaggtggtggtggtgctagaagtaatctcaatatgaatgctgctggtaaccgaaatagggaagttttacagaaagaaaagtcaaccaaatcagagggaaaacatgaaggtgtctatagagaactgtgttacttgtgaggtcagagaatactcaaggcacaaccccacatatcatacagattcttccttgcctcttgtaaaaaatcagcaagagaatgttgtattagaatgacatttttacataagtatgggatgtaatttttagttaaaagacagtaagtagttaaaagtttatgccttgccttatctgtgggctatcagccagcttttctctttattccttccaggttgatgagaaagctctgaagcacataacggaaatgggcttcagtaaggaagcatcgaggcaagctcttatggataatggcaacaacttagaagcagcactgaacgtacttcttacaagcaataaacagaaacctgttatgggtcctcctctgagaggtagaggaaaaggcagggggcgaataagatctgaagatgaagaggacctgggaaatgcaaggccatcagcaccaagcacattatttgatttcttggaatctaaaatgggaactttgaatgtggaagaacctaaatcacagccacagcagcttcatcagggacaatacagatcatcaaatactgagcaaaatggagtaaaagataataatcatctgagacatcctcctcgaaatgataccaggcagccaagaaatgaaaaaccgcctcgttttcaaagagactcccaaaattcaaagtcagttttagaaggcagtggattacctagaaatagaggttctgaaagaccaagtacttcttcagtatctgaagtatgggctgaagacagaatcaaatgtgatagaccgtattctagatatgacagaactaaagatacttcatatcctttaggttctcagcatagtgatggtgcttttaaaaaaagagataactctatgcaaagcagatcaggaaaaggtccctcctttgcagaggcaaaagaaaatccacttcctcaaggatctgtagattataataatcaaaaacgtggaaaaagagaaa

SEQ ID NO: 196204 - DNA, 2579 bp, Homo sapiens
  Payload ID: 18704
  Gene Name: tudor domain containing 3
  Uniprot ID: Q9H7E2
  ENST ID: ENST00000535286
  CDS Start-End: 73-2307
ggggtctcaagtaggaggcctccccatcacccccaccccagccccccaccacccccggcctaagcagctaccatggcccaggtggccggcgcggcgttgtcccaggcgggttggtatctttcagatgaaggcattgaagcttgcacaagctctccagacaaagtcaatgtaaatgacatcatcctgattgctctcaatacagatctgagaacaattggcaagaaattcctccccagtgacatcaatagtggaaaggtagaaaagctcgaaggtccatgtgttttgcaaattcaaaaaattcgcaatgttgctgcaccaaaggataatgaagaatctcaggctgcaccaaggatgctgcgattacagatgactgatggtcatataagttgcacagcagtagaatttagttatatgtcaaaaataagcctgaacacaccacctggaactaaagttaagctctcaggcattgttgacataaaaaatggattcctgctcttgaatgactctaacaccacagttcttggtggtgaagtggaacaccttattgagaaatgggagttacagagaagcttatcaaaacacaatagaagcaatattggaactgaaggtggaccaccgccttttgtgccttttggacagaagtgtgtatctcatgtccaagtggatagcagagaacttgatcgaagaaaaacattgcaagttacaatgcctgtcaaacctacaaatgataatgatgaatttgaaaagcaaaggacggctgctattgctgaagttgcaaagagcaaggaaaccaagacatttggaggaggtggtggtggtgctagaagtaatctcaatatgaatgctgctggtaaccgaaatagggaagttttacagaaagaaaagtcaaccaaatcagagggaaaacatgaaggtgtctatagagaactggttgatgagaaagctctgaagcacataacggaaatgggcttcagtaaggaagcatcgaggcaagctcttatggataatggcaacaacttagaagcagcactgaacgtacttcttacaagcaataaacagaaacctgttatgggtcctcctctgagaggtagaggaaaaggcagggggcgaataagatctgaagatgaagaggacctgggaaatgcaaggccatcagcaccaagcacattatttgatttcttggaatctaaaatgggaactttgaatgtggaagaacctaaatcacagccacagcagcttcatcagggacaatacagatcatcaaatactgagcaaaatggagtaaaagataataatcatctgagacatcctcctcgaaatgataccaggcagccaagaaatgaaaaaccgcctcgttttcaaagagactcccaaaattcaaagtcagttttagaaggcagtggattacctagaaatagaggttctgaaagaccaagtacttcttcagtatctgaagtatgggctgaagacagaatcaaatgtgatagaccgtattctagatatgacagaactaaagatacttcatatcctttaggttctcagcatagtgatggtgcttttaaaaaaagagataactctatgcaaagcagatcaggaaaaggtccctcctttgcagaggcaaaagaaaatccacttcctcaaggatctgtagattataataatcaaaaacgtggaaaaagagaaagccaaacatctattcctgattatttttatgacaggaaatcacaaacaataaataatgaagctttcagtggtataaaaattgaaaaacattttaatgtaaatactgattatcagaatccagttcgaagtaatagtttcattggtgttccaaatggagaagtagaaatgccactgaaaggaagacgaataggacctattaagccagcaggacctgtcacagctgtaccctgtgatgataaaatattttacaatagtgggcccaaacgaagatctgggccaattaagccagaaaaaatactagaatcatctattcctatggagtatgcaaaaatgtggaaacctggagatgaatgttttgcactttattgggaagacaacaagttttaccgggcagaagttgaagccctccattcttcgggtatgacagcagttgttaaattcattgactacggaaactatgaagaggtgctactgagcaatatcaagcccattcaaacagaggcatgggaggaagaaggcacctacgatcaaactctggagttccgtaggggaggtgatggccagccaagacgatccactcggccaacccaacagttttaccaaccaccccgggctcggaactaataggaaaagactctttgtgaagaaacgagccagtgactgaaacaccctggtggaaacctgttgacagaccttccactttctcttcagaataagtagctgtggtggatattattatttgaagaaagaaaaaacagattttagggtggaaaaaacagtcaactcacacaaagaatggaaaaaaatactgagttaaattaagcaaataccttttacaagtgaaaggaagaatttttcttctgccgtcaataaaaccattgtgctattattgtttt

SEQ ID NO: 196205 - DNA, 2497 bp, Homo sapiens
  Payload ID: 18704
  Gene Name: tudor domain containing 3
  Uniprot ID: Q9H7E2
  ENST ID: ENST00000621840
  CDS Start-End: 278-2230
tttatatgccaagtgacttctgaacacgacgtgaagacagtatctttcagatgaaggcattgaagcttgcacaagctctccagacaaagtcaatgtaaatgacatcatcctgattgctctcaatacagatctgagaacaattggcaagaaattcctccccagtgacatcaatagtggaaaggtagaaaagctcgaaggtccatgtgttttgcaaattcaaaaaattcgcaatgttgctgcaccaaaggataatgaagaatctcaggctgcaccaaggatgctgcgattacagatgactgatggtcatataagttgcacagcagtagaatttagttatatgtcaaaaataagcctgaacacaccacctggaactaaagttaagctctcaggcattgttgacataaaaaatggattcctgctcttgaatgactctaacaccacagttcttggtggtgaagtggaacaccttattgagaaatgggagttacagagaagcttatcaaaacacaatagaagcaatattggaactgaaggtggaccaccgccttttgtgccttttggacagtgtgtatctcatgtccaagtggatagcagagaacttgatcgaagaaaaacattgcaagttacaatgcctgtcaaacctacaaatgataatgatgaatttgaaaagcaaaggacggctgctattgctgaagttgcaaagagcaaggaaaccaagacatttggaggaggtggtggtggtgctagaagtaatctcaatatgaatgctgctggtaaccgaaatagggaagttttacagaaagaaaagtcaaccaaatcagagggaaaacatgaaggtgtctatagagaactggttgatgagaaagctctgaagcacataacggaaatgggcttcagtaaggaagcatcgaggcaagctcttatggataatggcaacaacttagaagcagcactgaacgtacttcttacaagcaataaacagaaacctgttatgggtcctcctctgagaggtagaggaaaaggcagggggcgaataagatctgaagatgaagaggacctgggaaatgcaaggccatcagcaccaagcacattatttgatttcttggaatctaaaatgggaactttgaatgtggaagaacctaaatcacagccacagcagcttcatcagggacaatacagatcatcaaatactgagcaaaatggagtaaaagataataatcatctgagacatcctcctcgaaatgataccaggcagccaagaaatgaaaaaccgcctcgttttcaaagagactcccaaaattcaaagtcagttttagaaggcagtggattacctagaaatagaggttctgaaagaccaagtacttcttcagtatctgaagtatgggctgaagacagaatcaaatgtgatagaccgtattctagatatgacagaactaaagatacttcatatcctttaggttctcagcatagtgatggtgcttttaaaaaaagagataactctatgcaaagcagatcaggaaaaggtccctcctttgcagaggcaaaagaaaatccacttcctcaaggatctgtagattataataatcaaaaacgtggaaaaagagaaagccaaacatctattcctgattatttttatgacaggaaatcacaaacaataaataatgaagctttcagtggtataaaaattgaaaaacattttaatgtaaatactgattatcagaatccagttcgaagtaatagtttcattggtgttccaaatggagaagtagaaatgccactgaaaggaagacgaataggacctattaagccagcaggacctgtcacagctgtaccctgtgatgataaaatattttacaatagtgggcccaaacgaagatctgggccaattaagccagaaaaaatactagaatcatctattcctatggagtatgcaaaaatgtggaaacctggagatgaatgttttgcactttattgggaagacaacaagttttaccgggcagaagttgaagccctccattcttcgggtatgacagcagttgttaaattcattgactacggaaactatgaagaggtgctactgagcaatatcaagcccattcaaacagaggcatgggaggaagaaggcacctacgatcaaactctggagttccgtaggggaggtgatggccagccaagacgatccactcggccaacccaacagttttaccaaccaccccgggctcggaactaataggaaaagtagactctttgtgaagaaacgagccagtgactgaaacaccctggtggaaacctgttgacagaccttccactttctcttcagaataagtagctgtggtggatattattatttgaagaaagaaaaaacagattttagggtggaaaaaacagtcaactcacacaaagaatggaaaaaaatactgagttaaattaagcaaataccttttacaagtgaaaggaagaatttttcttctgccgtcaataaaaccattgtgctatt

SEQ ID NO: 196206 - DNA, 3525 bp, Homo sapiens
  Payload ID: 18705
  Gene Name: tudor domain containing 5
  Uniprot ID: Q8NAT2
  ENST ID: ENST00000294848
  CDS Start-End: 251-3196
aatctctactcggcccgcaccagcagcgctggcgtcagggcgcggtgggggcaagacgggtgactggcagcagggcggtgccgggccgagaagggcgcctcacctggcgcctcctgccttcctttccacctcaggttgcagagagccgccagggcaggtggaagggccacgccccgctcccgtgagggtcaccgagagacgttgggggtggggcagggaccccaaccctagaccagtcctgtagggcacaatgtctgaacaagagcgtatacaggaatgtctgcggaaggaaataaggtcacttctcatttccaccaaagatggtttgagcccacaggagttggagaaggagtaccttttgatggttggcaaccatctaccactccgaatccttgggtatcggtccactatggagctggtattggacatgcctgatgttgttcgtgtctgccccggtgcaggtggtactgtaatactgaaagccattccagatgaatctaccaaaggaatagcaagcttagttgcaaaacagaggagcagccataagcttcgaaactcaatgcataagggaagacctagtatttattctggaccgagatctcatcggcgagtaccttaccgaggaagggttgcccctattcttccagctgttgtgaagagtgagttgaaggacctgttggcgttatctcctgttcttctttctgattttgaaaaggcatttgccaaaagatttggacgatcattccaatacatgcaatatggatttctctctatgtttgaagtgcttaatgcggcttcagatgtcatttctgtagagcagaccagagcaggttctttgttgatgctaaagaagagtgtaacagaggaaaagccgagaggatgtccagcaggtaaaatttttacccagccatttagaatgaaacaagggtcatactccacaggctttccggtagcaaagccatgcttttcacaacccacttcaaacatggaaccaccgaagcaaataatgagcatggaaaagacttccaagttaaatgtagtggagacttcaagactgaatcacactgaaaaattaaaccagctggagaacacattcaaatcagttattgcacagattggacctggaggaactatcagttcagaactaaaacataagataaaatttgttgtatctaagttcccagagggtttgtttatttctaaactgcttggagagtatgaggtaatttttaaagagcaactatcaccaaaaaaattaggcttcttaaatgtgacagaacttgttggagctcttagtgacattctccatgttgagttcaggaaaggacaccaagacttactagtgtttgatgcggataagaagcctctaccacctgttcagtcagataagaaaatagaagccaaagcttgtgtctccagtccacctagaaattcattgtctactgctgctgtcaaagagactgtatggaattgcccttcaaaaaaacaaaaagagccacaacagaagatttgcaagaagcctaatctggtggtaaagcctttacagctgcaagtagaaacaaacaaatcagagctcaacttggcaatggcaaatcatgacatcccgccagacgctgtgccgaacaagaaattatgcagactcccaccattagacaccagttccctcataggggtctttgtggagtatatcatctctcctagtcaattctacatccggatctatagcagggattcgtcagagttactcgaagacatgatgattgaaatgcggcgctgttattctaatcagctggtttctgatcgatatgtcatgccagaatgttttattcagccgggacatctctgttgtgtaaggatttctgaggataagtggtggtatcgggtcattatccatcgagtccttgagaaacaggaagttgaagtgttctacccagactttggaaatattggaattgttcagaagtcctccctgaggttcctcaagtgctgctacacaaagcttccagctcaggctatcccttgttctttggcttgggtgagaccagtagaggaacactggacatcgaaagctattttgcagttccagaagttgtgcggtttgaagccattagtgggggtagtggatgaatatgtagatggaatccttaacatttttttgtgtgacacatcctcaaacgaagatgtctatttccatcatgtcttgagaacagagggccatgctattgtatgccgagaaaatatctcttctaagggtttcagtgagctcaaccctttagctttatacacgacatccagtggagggccagaggacattgtcttgacagaactgggttatccttcccagcagcactattttaatgaagaccgaaagataagtccacagtcaaaagagagtgagttacgtatcttggatgagatccccactggaatgccatgcctggagtcagtgaccataggtgatgatatttgggatgagaactggttacctctacaggctaagatgggaaaaggaggtgatgctgcctcccatctatttactgcaagccttggtggaaagaatcagtattcatcatgtaaagaaatgccacagaaggactggtgtttttctacccctaaagatacatgggatgattcttggcagccttcaggccttgtaaatggaacgaaagtagaagttcataagccagaagtactgggtgctcaggaaaaaaatactggcacaaacaggactcaaaagcaactagacataaatggttcttcagattcttccacactgcccaaattggaagaattctgtacctctcttacccagtcagagcagtcagcagacgggagccagtctgaacccaacaacagtcagactcagccaaagcaaattcagctttccacagcagcaccctgttcaacaactgcagtggatgattccgcagaaaagccctctggttctgtggaaagctcaccagagatcctaaagaatgaagatttttctagcagccgtgctattacattgtacaaagacaagcgtcaagaatctgtagaccagctgtctttgattttgtcttatgagtgccagatttctcagaagctctacattcctcgaagtacagccactgctgccttaggtgctgccgcacggttagctacatccaggagcctcctacactggtaccccagtgtgaaaaggatggaagcatgagggagggagggaggagggagaaaaacagaatccagccgcttaggctttgatgaactcccaggccaaaatgaggagttattgaagcaaaatagtatcttgatcattgatacttttgtctttctgtgactatatgttagctttattatgctaacagtctactttgatgtgtaagtaagtattgatatttactgttaatcttgatttttcttgattttattctgtgtcattttgttcacctttgtttttaatgtagtttaaaggaatttgtttttttgtgtttgtttttcttgtacattatcatgactgataaatgaaaattgaaaaactaa

SEQ ID NO: 196207 - DNA, 3632 bp, Homo sapiens
  Payload ID: 18705
  Gene Name: tudor domain containing 5
  Uniprot ID: Q8NAT2
  ENST ID: ENST00000367614
  CDS Start-End: 360-3305
acctcgcgtcttcccaccgcgtcggaggacgtaggcgcctgggatcctggaaggcttcggatgggaagtttgcgttggagtccaacacccgacaggaaccccagttaacgcctccgcatggccaggggcagagttcttgacacctgtagcttaatcaacgcaggtggagattcagggcttgaatcgcccggccacgcgcaagccgcagggcaccctcatactactacttctgccttattacccttaaaactggagtctcagttatttgtatcccactattggtttttttttaaatcttttttcgtgggtttgcccccttttcctcagctgcgtttctgtcttcagtcctgtagggcacaatgtctgaacaagagcgtatacaggaatgtctgcggaaggaaataaggtcacttctcatttccaccaaagatggtttgagcccacaggagttggagaaggagtaccttttgatggttggcaaccatctaccactccgaatccttgggtatcggtccactatggagctggtattggacatgcctgatgttgttcgtgtctgccccggtgcaggtggtactgtaatactgaaagccattccagatgaatctaccaaaggaatagcaagcttagttgcaaaacagaggagcagccataagcttcgaaactcaatgcataagggaagacctagtatttattctggaccgagatctcatcggcgagtaccttaccgaggaagggttgcccctattcttccagctgttgtgaagagtgagttgaaggacctgttggcgttatctcctgttcttctttctgattttgaaaaggcatttgccaaaagatttggacgatcattccaatacatgcaatatggatttctctctatgtttgaagtgcttaatgcggcttcagatgtcatttctgtagagcagaccagagcaggttctttgttgatgctaaagaagagtgtaacagaggaaaagccgagaggatgtccagcaggtaaaatttttacccagccatttagaatgaaacaagggtcatactccacaggctttccggtagcaaagccatgcttttcacaacccacttcaaacatggaaccaccgaagcaaataatgagcatggaaaagacttccaagttaaatgtagtggagacttcaagactgaatcacactgaaaaattaaaccagctggagaacacattcaaatcagttattgcacagattggacctggaggaactatcagttcagaactaaaacataagataaaatttgttgtatctaagttcccagagggtttgtttatttctaaactgcttggagagtatgaggtaatttttaaagagcaactatcaccaaaaaaattaggcttcttaaatgtgacagaacttgttggagctcttagtgacattctccatgttgagttcaggaaaggacaccaagacttactagtgtttgatgcggataagaagcctctaccacctgttcagtcagataagaaaatagaagccaaagcttgtgtctccagtccacctagaaattcattgtctactgctgctgtcaaagagactgtatggaattgcccttcaaaaaaacaaaaagagccacaacagaagatttgcaagaagcctaatctggtggtaaagcctttacagctgcaagtagaaacaaacaaatcagagctcaacttggcaatggcaaatcatgacatcccgccagacgctgtgccgaacaagaaattatgcagactcccaccattagacaccagttccctcataggggtctttgtggagtatatcatctctcctagtcaattctacatccggatctatagcagggattcgtcagagttactcgaagacatgatgattgaaatgcggcgctgttattctaatcagctggtttctgatcgatatgtcatgccagaatgttttattcagccgggacatctctgttgtgtaaggatttctgaggataagtggtggtatcgggtcattatccatcgagtccttgagaaacaggaagttgaagtgttctacccagactttggaaatattggaattgttcagaagtcctccctgaggttcctcaagtgctgctacacaaagcttccagctcaggctatcccttgttctttggcttgggtgagaccagtagaggaacactggacatcgaaagctattttgcagttccagaagttgtgcggtttgaagccattagtgggggtagtggatgaatatgtagatggaatccttaacatttttttgtgtgacacatcctcaaacgaagatgtctatttccatcatgtcttgagaacagagggccatgctattgtatgccgagaaaatatctcttctaagggtttcagtgagctcaaccctttagctttatacacgacatccagtggagggccagaggacattgtcttgacagaactgggttatccttcccagcagcactattttaatgaagaccgaaagataagtccacagtcaaaagagagtgagttacgtatcttggatgagatccccactggaatgccatgcctggagtcagtgaccataggtgatgatatttgggatgagaactggttacctctacaggctaagatgggaaaaggaggtgatgctgcctcccatctatttactgcaagccttggtggaaagaatcagtattcatcatgtaaagaaatgccacagaaggactggtgtttttctacccctaaagatacatgggatgattcttggcagccttcaggccttgtaaatggaacgaaagtagaagttcataagccagaagtactgggtgctcaggaaaaaaatactggcacaaacaggactcaaaagcaactagacataaatggttcttcagattcttccacactgcccaaattggaagaattctgtacctctcttacccagtcagagcagtcagcagacgggagccagtctgaacccaacaacagtcagactcagccaaagcaaattcagctttccacagcagcaccctgttcaacaactgcagtggatgattccgcagaaaagccctctggttctgtggaaagctcaccagagatcctaaagaatgaagatttttctagcagccgtgctattacattgtacaaagacaagcgtcaagaatctgtagaccagctgtctttgattttgtcttatgagtgccagatttctcagaagctctacattcctcgaagtacagccactgctgccttaggtgctgccgcacggttagctacatccaggagcctcctacactggtaccccagtgtgaaaaggatggaagcatgagggagggagggaggagggagaaaaacagaatccagccgcttaggctttgatgaactcccaggccaaaatgaggagttattgaagcaaaatagtatcttgatcattgatacttttgtctttctgtgactatatgttagctttattatgctaacagtctactttgatgtgtaagtaagtattgatatttactgttaatcttgatttttcttgattttattctgtgtcattttgttcacctttgtttttaatgtagtttaaaggaatttgtttttttgtgtttgtttttcttgtacattatcatgactgataaatgaaaattgaaaaact

SEQ ID NO: 196208 - DNA, 3946 bp, Homo sapiens
  Payload ID: 18705
  Gene Name: tudor domain containing 5
  Uniprot ID: Q8NAT2
  ENST ID: ENST00000444136
  CDS Start-End: 519-3626
cttcccaccgcgtcggaggacgtaggcgcctgggatcctggaaggcggccagcctctgcagccgggcccagcggctcctgagactggggcggacctcacacctgaccccggagcggctaatcctgcccaaccgtcccacctgccacgtgccctcggggctggaacgcggcgccccgggagaggcctgctggtcagggggcgctggtgcgcaggcgcgcggggccgccgtcgcagctaccttcctgcgccgattcggagagggccccctaatctctactcggcccgcaccagcagcgctggcgtcagggcgcggtgggggcaagacgggtgactggcagcagggcggtgccgggccgagaagggcgcctcacctggcgcctcctgccttcctttccacctcaggttgcagagagccgccagggcaggtggaagggccacgccccgctcccgtgagggtcaccgagagacgttgggggtggggcagggaccccaaccctagaccagtcctgtagggcacaatgtctgaacaagagcgtatacaggaatgtctgcggaaggaaataaggtcacttctcatttccaccaaagatggtttgagcccacaggagttggagaaggagtaccttttgatggttggcaaccatctaccactccgaatccttgggtatcggtccactatggagctggtattggacatgcctgatgttgttcgtgtctgccccggtgcaggtggtactgtaatactgaaagccattccagatgaatctaccaaaggaatagcaagcttagttgcaaaacagaggagcagccataagcttcgaaactcaatgcataagggaagacctagtatttattctggaccgagatctcatcggcgagtaccttaccgaggaagggttgcccctattcttccagctgttgtgaagagtgagttgaaggacctgttggcgttatctcctgttcttctttctgattttgaaaaggcatttgccaaaagatttggacgatcattccaatacatgcaatatggatttctctctatgtttgaagtgcttaatgcggcttcagatgtcatttctgtagagcagaccagagcaggttctttgttgatgctaaagaagagtgtaacagaggaaaagccgagaggatgtccagcaggtaaaatttttacccagccatttagaatgaaacaagggtcatactccacaggctttccggtagcaaagccatgcttttcacaacccacttcaaacatggaaccaccgaagcaaataatgagcatggaaaagacttccaagttaaatgtagtggagacttcaagactgaatcacactgaaaaattaaaccagctggagaacacattcaaatcagttattgcacagattggacctggaggaactatcagttcagaactaaaacataagataaaatttgttgtatctaagttcccagagggtttgtttatttctaaactgcttggagagtatgaggtaatttttaaagagcaactatcaccaaaaaaattaggcttcttaaatgtgacagaacttgttggagctcttagtgacattctccatgttgagttcaggaaaggacaccaagacttactagtgtttgatgcggataagaagcctctaccacctgttcagtcagataagaaaatagaagccaaagcttgtgtctccagtccacctagaaattcattgtctactgctgctgtcaaagagactgtatggaattgcccttcaaaaaaacaaaaagagccacaacagaagatttgcaagaagcctaatctggtggtaaagcctttacagctgcaagtagaaacaaacaaatcagagctcaacttggcaatggcaaatcatgacatcccgccagacgctgtgccgaacaagaaattatgcagactcccaccattagacaccagttccctcataggggtctttgtggagtatatcatctctcctagtcaattctacatccggatctatagcagggattcgtcagagttactcgaagacatgatgattgaaatgcggcgctgttattctaatcagctggtttctgatcgatatgtcatgccagaatgttttattcagccgggacatctctgttgtgtaaggatttctgaggataagtggtggtatcgggtcattatccatcgagtccttgagaaacaggaagttgaagtgttctacccagactttggaaatattggaattgttcagaagtcctccctgaggttcctcaagtgctgctacacaaagcttccagctcaggctatcccttgttctttggcttgggtgagaccagtagaggaacactggacatcgaaagctattttgcagttccagaagttgtgcggtttgaagccattagtgggggtagtggatgaatatgtagatggaatccttaacatttttttgtgtgacacatcctcaaacgaagatgtctatttccatcatgtcttgagaacagagggccatgctattgtatgccgagaaaatatctcttctaagggtttcagtgagctcaaccctttagctttatacacgacatccagtggagggccagaggacattgtcttgacagaactgggttatccttcccagcagcactattttaatgaagaccgaaagataagtccacagtcaaaagagagtgagttacgtatcttgcaagatattaatgatgaaaagtctttaagtcatcttaaatctgagtcaaaggagccattaaaggattctgaatttgagtctttgaaaacctgtaataagagctttgaagaagatccaaagtggtccaacccagaaccaaacgatctgaaggaagaaaatgaggatgagatccccactggaatgccatgcctggagtcagtgaccataggtgatgatatttgggatgagaactggttacctctacaggctaagatgggaaaaggaggtgatgctgcctcccatctatttactgcaagccttggtggaaagaatcagtattcatcatgtaaagaaatgccacagaaggactggtgtttttctacccctaaagatacatgggatgattcttggcagccttcaggccttgtaaatggaacgaaagtagaagttcataagccagaagtactgggtgctcaggaaaaaaatactggcacaaacaggactcaaaagcaactagacataaatggttcttcagattcttccacactgcccaaattggaagaattctgtacctctcttacccagtcagagcagtcagcagacgggagccagtctgaacccaacaacagtcagactcagccaaagcaaattcagctttccacagcagcaccctgttcaacaactgcagtggatgattccgcagaaaagccctctggttctgtggaaagctcaccagagatcctaaagaatgaagatttttctagcagccgtgctattacattgtacaaagacaagcgtcaagaatctgtagaccagctgtctttgattttgtcttatgagtgccagatttctcagaagctctacattcctcgaagtacagccactgctgccttaggtgctgccgcacggttagctacatccaggagcctcctacactggtaccccagtgtgaaaaggatggaagcatgagggagggagggaggagggagaaaaacagaatccagccgcttaggctttgatgaactcccaggccaaaatgaggagttattgaagcaaaatagtatcttgatcattgatacttttgtctttctgtgactatatgttagctttattatgctaacagtctactttgatgtgtaagtaagtattgatatttactgttaatcttgatttttcttgattttattctgtgtcattttgttcacctttgtttttaatgtagtttaaaggaatttgtttttttgtgtttgtttttcttgtacattatcatgactgataaatgaaaattg

SEQ ID NO: 196209 - DNA, 1805 bp, Homo sapiens
  Payload ID: 18705
  Gene Name: tudor domain containing 5
  ENST ID: ENST00000417329
  CDS Start-End: 1-1476
gtcattatccatcgagtccttgagaaacaggaagttgaagtgttctacccagactttggaaatattggaattgttcagaagtcctccctgaggttcctcaagtgctgctacacaaagcttccagctcaggctatcccttgttctttggcttgggtgagaccagtagaggaacactggacatcgaaagctattttgcagttccagaagttgtgcggtttgaagccattagtgggggtagtggatgaatatgtagatggaatccttaacatttttttgtgtgacacatcctcaaacgaagatgtctatttccatcatgtcttgagaacagagggccatgctattgtatgccgagaaaatatctcttctaagggtttcagtgagctcaaccctttagctttatacacgacatccagtggagggccagaggacattgtcttgacagaactgggttatccttcccagcagcactattttaatgaagaccgaaagataagtccacagtcaaaagagagtgagttacgtatcttgcaagatattaatgatgaaaagtctttaagtcatcttaaatctgagtcaaaggagccattaaaggattctgaatttgagtctttgaaaacctgtaataagagctttgaagaagatccaaagtggtccaacccagaaccaaacgatctgaaggaagaaaatgaggatgagatccccactggaatgccatgcctggagtcagtgaccataggtgatgatatttgggatgagaactggttacctctacaggctaagatgggaaaaggaggtgatgctgcctcccatctatttactgcaagccttggtggaaagaatcagtattcatcatgtaaagaaatgccacagaaggactggtgtttttctacccctaaagatacatgggatgattcttggcagccttcaggccttgtaaatggaacgaaagtagaagttcataagccagaagtactgggtgctcaggaaaaaaatactggcacaaacaggactcaaaagcaactagacataaatggttcttcagattcttccacactgcccaaattggaagaattctgtacctctcttacccagtcagagcagtcagcagacgggagccagtctgaacccaacaacagtcagactcagccaaagcaaattcagctttccacagcagcaccctgttcaacaactgcagtggatgattccgcagaaaagccctctggttctgtggaaagctcaccagagatcctaaagaatgaagatttttctagcagccgtgctattacattgtacaaagacaagcgtcaagaatctgtagaccagctgtctttgattttgtcttatgagtgccagatttctcagaagctctacattcctcgaagtacagccactgctgccttaggtgctgccgcacggttagctacatccaggagcctcctacactggtaccccagtgtgaaaaggatggaagcatgagggagggagggaggagggagaaaaacagaatccagccgcttaggctttgatgaactcccaggccaaaatgaggagttattgaagcaaaatagtatcttgatcattgatacttttgtctttctgtgactatatgttagctttattatgctaacagtctactttgatgtgtaagtaagtattgatatttactgttaatcttgatttttcttgattttattctgtgtcattttgttcacctttgtttttaatgtagtttaaaggaatttgtttttttgtgtttgtttttcttgtacattatcatgactgataaatgaaaattgaaaaactaa

SEQ ID NO: 196210 - DNA, 6817 bp, Homo sapiens
  Payload ID: 18706
  Gene Name: tudor domain containing 6
  Uniprot ID: O60522
  ENST ID: ENST00000316081
  CDS Start-End: 1-6291
atgtgctcgacgcccggaatgccggcgccgggggcctcgctggccctgcgggtgtccttcgtggacgtgcatcccgatgtgatcccggtgcagctgtgggggctggtgggcgagcggcggggcgagtacctgcggctgagccgggaaatccaggaagcggcggccacgcgcggccagtgggcgctgggcagcgcctcggcctcgcccggcgagctgtgcctggtgcaggtcgggcttttgtggcaccgctgccgcgtggtcagccggcaggcacaggagagccgtgtcttcctgctggacgagggccgcaccatcacggccggagcaggctcgctggcgcctgggcgcagagagttcttcaatttgccctcggaagtgctgggctgcgtgctagcgggcctggtgccggcaggctgcggcgcgggctcaggcgagccgccgcagcactggcccgccgacgccgtggacttccttagcaaccttcagggcaaggaggtgcacgggtgcgtcctggacgtgctgctgctccatcgcctggtcctcctggaggtgcctgatgtgttccaacagatgcgggagctgggcctggctcggcgggtgcccgacagcctcttccgttcgctgctggagcgctatctcacagcggccactgctagcgtgggctccggggtcccggttctctcgcgagtcccgctcaagcaaaagcagcctggtctggattacttctatccccagctgcagctgggcgtgacggaggccgtggtcataacccaagtgtgccatccccaccgcattcactgccagctccgcagcgtctcgcaggagatccaccgcctctccgagagcatggcccaggtataccggggttccacggggacaggggatgagaactctaccagtgccacctgggaggagagggaggagagcccagataagccgggctctccgtgtgcatcctgtggcctggatggacattggtacagagcactgttgcttgagacttttcggccccagcgctgtgcccaggtgcttcatgtggactatggaaggaaggagttagtgagttgcagcagccttcggtacttgctgcctgaatattttcgaatgccggtggtgacctacccttgtgctttgtatggactctgggacggtgggagaggctggtctcggtcacaggtcggtgacctgaagacactgatactaggcaaggcagtgaatgcaaagattgaattttattgctcctttgagcatgtgtattatgtcagcctgtatggagaagatgggattaatctgaaccgtgtgtttggagtacagtcgtgttgcttggctgaccgagtccttcagagccaggcaacagaggaggaggaaccagaaacatctcagtctcagtctcctgctgaagaagtagatgaagagatttcactcccagccttaagatctatcaggttaaagatgaatgccttctacgatgcgcaggtagagtttgttaaaaatccttctgagttttggattaggttgaggaaacacaatgtcaccttcagtaagctgatgaggagaatgtgtggtttctattcctctgccagtaagctggatggtgtagttttgaaacctgaacctgatgacctttgctgtgtcaagtggaaagaaaatggttattatagggccatagtcaccaaattggatgacaagagtgtggatgtattcttagttgaccgaggcaattcggaaaatgtggactggtatgacgtaaggatgctgcttcctcagtttaggcagctaccaatattggctgtgaagtgcaccctggctgatatttggcctttgggaaaaacttggagccaggaggcagtttccttttttaaaaagactgtgctccacaaagaattagtcatccatattcttgataaacaggatcatcaatatgttattgagattcttgacgaatcaagaacaggggaagaaaacattagtaaggtaattgcccaagctggatatgccaagtatcaggaatttgaaacaaaggaaaatatcctggtaaatgcccactccccagggcatgtttcaaaccactttactacggagagtaacaaaataccttttgccaagactggagaaggagagcagaaagccaagagagagaataaaaccacatctgtttcaaaagctttgagtgacacaacagttgtaacaaatggttcaactgaactagttgtgcaggaaaaagtgaaaagagcatctgtttattttcctcttatgcagaattgcttggaaattaagccaggctcctctagtaaaggagagctggaagttggaagtacagtagaagtcagagtgtcttatgttgaaaaccctggctatttctggtgtcagctgaccaggaacatacaaggacttaaaactctaatgtctgatattcagtactattgcaaaaatacagctgctcctcaccagagaaacacccttgcttgtttggctaagcgaacagtaaacagacagtggtccagagcacttattagtgggatacagtctgtggagcatgtcaatgtaacatttgtagattatggagacagagaaatggtatctgtgaagaatatttattcaattagtgaagaatttctgaaggttaaggcacaggcttttaggtgcagtctttataatttaattcaaccagttggccagaatccctttgtttgggatgtaaaggcaatacaagctttcaatgaatttatagataatgcatggcaaaaaaatctagaattaaaatgtacaatatttgctctggcttcaattaatgaagaactgtttaacattgtggatttgctaaccccctttcagagtgcatgccatttcttggtagaaaagagacttgcaagaccagtaaaacttcagaagcctttggagtcctctgttcagctacattcctacttctattctacacatgatatgaaaattggaagtgaagaattagtttatataacgcatattgatgacccttggacattttattgccagctggcaagaaatgcaaatattttagaacagttgtcatgtagtattacacaattaagtaaagttttgctgaatttaaaaacatctcccttgaaccctggaaccttgtgccttgccaagtatactgatggaaactggtataggggcatagtaatagagaaagagccaaagaaagtcttctttgttgattttgggaatatttatgtagtaacaagtgatgatctgcttccaatacctagtgatgcatatgatgtcttacttttgcccatgcaagctgtcagatgttcattatctgatattcctgatcatataccagaagaagtggtggtgtggtttcaggagactattttagataagtcattgaaggctttagttgtagcaaaagatccagatggaacactgattatagaactatatggtgacaatattcaaattagtgctagtattaataagaagttggggctacttagttacaaagatagaataagaaaaaaagaaagtgaagtcctctgttctacaactgaaactcttgaagaaaaaaatgagaatatgaagttgccatgtacagagtatttaagtaaatcagtagggtacaagttacctaataaagaaattttggaagagtcatataaacctcagatcaactcatcatacaaggaactcaaacttttacaaagtttaacaaaaacaaacttagtcactcaatatcaagactctgtgggaaataaaaatagtcaagtgtttccattaacaacagaaaagaaagaagaaatttctgctgagacacccttgaaaacagcaagagtagaagctactctttcagagagaaaaataggagattcatgtgacaaagatttgcctctgaaattttgtgagttcccacagaagactataatgcctggatttaaaacaactgtatatgtttctcatataaatgacctttcagacttttatgttcaactaatagaagatgaagctgaaattagtcatctttcagagagattaaacagtgttaaaacaaggcccgaatattatgtaggtccacctttgcaaagaggagatatgatatgtgctgttttcccagaagataatttatggtatcgtgctgtgatcaaggagcaacaacccaatgaccttctctctgtgcagtttatagattatggcaatgtttctgtggttcatactaacaaaataggtaggcttgaccttgttaatgcaatattgccggggttgtgcattcattgctccttgcagggatttgaggttcctgacaataaaaattctaagaaaatgatgcattacttttcccaacggaccagcgaggctgcaataagatgtgaatttgttaaatttcaagacagatgggaagttattcttgctgatgaacatgggatcatagcagatgatatgattagcaggtatgctctcagtgaaaaatctcaagtagaactttctacccaagtaattaaaagtgccagttcaaagtctgttaacaaatcagacattgacacttcagtatttcttaactggtataatccagaaaaaaaaatgataagagcttatgccactgtgatagatggacctgagtacttttggtgtcagtttgctgatacggagaaacttcagtgtttagaagtagaagtacagactgctggagaacaggtagcagacaggagaaattgtatcccatgtccttatattggagatccttgtatagtaagatacagagaagatggacattattatagggcacttatcactaatatttgtgaagattatcttgtatctgtcaggcttgtggactttggaaacattgaagactgtgtggacccaaaagcactctgggccattccttctgaacttctgtcggttcccatgcaagcctttccatgttgcctctcagggtttaacatttcagaaggattatgttctcaagagggaaatgactatttctatgaaataataacagaagatgtgttggaaataacaatactagaaatcagaagggatgtttgtgatatccctttagcaattgttgacttgaaaagcaaaggtaaaagtattaatgagaaaatggagaaatattctaagactggtattaaaagtgctcttccctatgaaaatattgactcagagataaagcagactcttgggtcctacaatcttgatgtaggacttaagaaattaagtaataaagctgtacaaaataaaatatatatggaacaacagacagatgagcttgctgaaataactgaaaaagatgtaaacattattggaaccaaaccaagtaacttccgtgaccctaaaactgataacatttgtgaagggtttgaaaacccctgcaaagataaaattgatactgaggaactggaaggtgaattagagtgccatctggttgacaaagcagagtttgatgataaatacctgattacaggatttaacacattactaccacatgctaatgaaacaaaggagatactagaactgaattcacttgaggtgccgctttctcctgatgatgaatcaaaagaattcttagaactggaatctattgagttacagaattctctggtggtggatgaagaaaaaggggagctaagcccggtgccaccgaatgtgccactctcccaagagtgtgtcacaaaaggcgccatggagctatttacactgcagcttcctctcagctgtgaagctgagaaacagccagaactagaactacctacagcccagctgcctttagatgacaagatggatcctttgtctttaggagttagtcagaaagcacaggaatccatgtgtactgaggacatgagaaagtcaagttgtgtagaatcttttgatgaccagcgcaggatgtcattgcatctacatggagcagattgtgatcctaaaacacagaatgaaatgaatatatgtgaagaagaatttgtagagtataaaaacagggatgccatttcggcattgatgcctttgttctctgaggaagaaagcagtgatggaagcaagcacaataatggtttaccagatcatatctcagctcaactacagaacacctacactctgaaagcctttactgttggatctaaatgtgttgtgtggtcaagtctaagaaacacatggtctaaatgtgagattttagaaacagctgaagaaggaacaagggttttgaacctttcaaatggtatggaggagatagtgaaccctgagaatgtctggaatggcatacccaaattggataagagtccacctgagaaaaggggtttggaggtgatggagatttaaccgtggatctatagctgtggccaatcagtcagaagctgcccttgaacaagtggcatcttacgcagaccaacagagtatttgagaaaattgaaaacatgtaaccacaagaagttgtcattttcaaaaacttctatataggtggaaaacaaattaggtctcaggttgatggtggggtgtgtttatagtgatcctgttatatatacagatctgggatctttcgtctttattgtcttacgtttctaattagttgggaggatttattttgctaaacagtttactaacacattacatttcaaaaactattttggtacctttcaaatacagtgtttaaattaaaatagaaaaataagggctcatgacaagtacattatttgattctacttaggatagctttttagcaggatctccttcagaatttttgtcttgactttgaatctttgcctgtttgtctaaacatttgactaacattctgtttgaatttggaagtattctaatacaagatttgaataaagtttatccttaaata

SEQ ID NO: 196211 - DNA, 583 bp, Homo sapiens
  Payload ID: 18706
  Gene Name: tudor domain containing 6
  ENST ID: ENST00000450697
  CDS Start-End: 1-526
ttttgatgaccagcgcaggatgtcattgcatctacatggagcagattgtgatcctaaaacacagaatgaaatgaatatatgtgaagaagaatttgtagagtataaaaacagggatgccatttcggcattgatgcctttgttctctgaggaagaaagcagtgatggaagcaagcacaataatggtttaccagatcatatctcagctcaactacagaacacctacactctgaaagcctttactgttggatctaaatgtgttgtgtggtcaagtctaagaaacacatggtctaaatgtgagattttagaaacagctgaagaaggaacaagggttttgaacctttcaaatggtatggaggagatagtgaaccctgagaatgtctggaatggcatacccaaattggataagagtccacctgaggctgtatcccaaagagtagggaaagatctttacttcatgtcagtgggtgataccactattaaagaaaaggggtttggaggtgatggagatttaaccgtggatctatagctgtggccaatcagtcagaagctgcccttgaacaagtggcatcttacgcagaccaac

SEQ ID NO: 196212 - DNA, 8887 bp, Homo sapiens
  Payload ID: 18706
  Gene Name: tudor domain containing 6
  Uniprot ID: O60522
  ENST ID: ENST00000544460
  CDS Start-End: 255-6455
aggtaaatgcgtgcccggaagcgcgacctcgggcggttggaggggctaccgggtcttaccagtccgtggcgggagtcccggaggaccctcgacgggggagttgccgagaaaaggcctcgccggcattcttcccctccactgggtcctttgaacctagtttggctgggactcgccttcaggcggcgcggaggatttcgaggccctgaggcgcggcccttaatttccggaagtgggggccgcgccgcgccgtcaagatgtgctcgacgcccggaatgccggcgccgggggcctcgctggccctgcgggtgtccttcgtggacgtgcatcccgatgtgatcccggtgcagctgtgggggctggtgggcgagcggcggggcgagtacctgcggctgagccgggaaatccaggaagcggcggccacgcgcggccagtgggcgctgggcagcgcctcggcctcgcccggcgagctgtgcctggtgcaggtcgggcttttgtggcaccgctgccgcgtggtcagccggcaggcacaggagagccgtgtcttcctgctggacgagggccgcaccatcacggccggagcaggctcgctggcgcctgggcgcagagagttcttcaatttgccctcggaagtgctgggctgcgtgctagcgggcctggtgccggcaggctgcggcgcgggctcaggcgagccgccgcagcactggcccgccgacgccgtggacttccttagcaaccttcagggcaaggaggtgcacgggtgcgtcctggacgtgctgctgctccatcgcctggtcctcctggaggtgcctgatgtgttccaacagatgcgggagctgggcctggctcggcgggtgcccgacagcctcttccgttcgctgctggagcgctatctcacagcggccactgctagcgtgggctccggggtcccggttctctcgcgagtcccgctcaagcaaaagcagcctggtctggattacttctatccccagctgcagctgggcgtgacggaggccgtggtcataacccaagtgtgccatccccaccgcattcactgccagctccgcagcgtctcgcaggagatccaccgcctctccgagagcatggcccaggtataccggggttccacggggacaggggatgagaactctaccagtgccacctgggaggagagggaggagagcccagataagccgggctctccgtgtgcatcctgtggcctggatggacattggtacagagcactgttgcttgagacttttcggccccagcgctgtgcccaggtgcttcatgtggactatggaaggaaggagttagtgagttgcagcagccttcggtacttgctgcctgaatattttcgaatgccggtggtgacctacccttgtgctttgtatggactctgggacggtgggagaggctggtctcggtcacaggtcggtgacctgaagacactgatactaggcaaggcagtgaatgcaaagattgaattttattgctcctttgagcatgtgtattatgtcagcctgtatggagaagatgggattaatctgaaccgtgtgtttggagtacagtcgtgttgcttggctgaccgagtccttcagagccaggcaacagaggaggaggaaccagaaacatctcagtctcagtctcctgctgaagaagtagatgaagagatttcactcccagccttaagatctatcaggttaaagatgaatgccttctacgatgcgcaggtagagtttgttaaaaatccttctgagttttggattaggttgaggaaacacaatgtcaccttcagtaagctgatgaggagaatgtgtggtttctattcctctgccagtaagctggatggtgtagttttgaaacctgaacctgatgacctttgctgtgtcaagtggaaagaaaatggttattatagggccatagtcaccaaattggatgacaagagtgtggatgtattcttagttgaccgaggcaattcggaaaatgtggactggtatgacgtaaggatgctgcttcctcagtttaggcagctaccaatattggctgtgaagtgcaccctggctgatatttggcctttgggaaaaacttggagccaggaggcagtttccttttttaaaaagactgtgctccacaaagaattagtcatccatattcttgataaacaggatcatcaatatgttattgagattcttgacgaatcaagaacaggggaagaaaacattagtaaggtaattgcccaagctggatatgccaagtatcaggaatttgaaacaaaggaaaatatcctggtaaatgcccactccccagggcatgtttcaaaccactttactacggagagtaacaaaataccttttgccaagactggagaaggagagcagaaagccaagagagagaataaaaccacatctgtttcaaaagctttgagtgacacaacagttgtaacaaatggttcaactgaactagttgtgcaggaaaaagtgaaaagagcatctgtttattttcctcttatgcagaattgcttggaaattaagccaggctcctctagtaaaggagagctggaagttggaagtacagtagaagtcagagtgtcttatgttgaaaaccctggctatttctggtgtcagctgaccaggaacatacaaggacttaaaactctaatgtctgatattcagtactattgcaaaaatacagctgctcctcaccagagaaacacccttgcttgtttggctaagcgaacagtaaacagacagtggtccagagcacttattagtgggatacagtctgtggagcatgtcaatgtaacatttgtagattatggagacagagaaatggtatctgtgaagaatatttattcaattagtgaagaatttctgaaggttaaggcacaggcttttaggtgcagtctttataatttaattcaaccagttggccagaatccctttgtttgggatgtaaaggcaatacaagctttcaatgaatttatagataatgcatggcaaaaaaatctagaattaaaatgtacaatatttgctctggcttcaattaatgaagaactgtttaacattgtggatttgctaaccccctttcagagtgcatgccatttcttggtagaaaagagacttgcaagaccagtaaaacttcagaagcctttggagtcctctgttcagctacattcctacttctattctacacatgatatgaaaattggaagtgaagaattagtttatataacgcatattgatgacccttggacattttattgccagctggcaagaaatgcaaatattttagaacagttgtcatgtagtattacacaattaagtaaagttttgctgaatttaaaaacatctcccttgaaccctggaaccttgtgccttgccaagtatactgatggaaactggtataggggcatagtaatagagaaagagccaaagaaagtcttctttgttgattttgggaatatttatgtagtaacaagtgatgatctgcttccaatacctagtgatgcatatgatgtcttacttttgcccatgcaagctgtcagatgttcattatctgatattcctgatcatataccagaagaagtggtggtgtggtttcaggagactattttagataagtcattgaaggctttagttgtagcaaaagatccagatggaacactgattatagaactatatggtgacaatattcaaattagtgctagtattaataagaagttggggctacttagttacaaagatagaataagaaaaaaagaaagtgaagtcctctgttctacaactgaaactcttgaagaaaaaaatgagaatatgaagttgccatgtacagagtatttaagtaaatcagtagggtacaagttacctaataaagaaattttggaagagtcatataaacctcagatcaactcatcatacaaggaactcaaacttttacaaagtttaacaaaaacaaacttagtcactcaatatcaagactctgtgggaaataaaaatagtcaagtgtttccattaacaacagaaaagaaagaagaaatttctgctgagacacccttgaaaacagcaagagtagaagctactctttcagagagaaaaataggagattcatgtgacaaagatttgcctctgaaattttgtgagttcccacagaagactataatgcctggatttaaaacaactgtatatgtttctcatataaatgacctttcagacttttatgttcaactaatagaagatgaagctgaaattagtcatctttcagagagattaaacagtgttaaaacaaggcccgaatattatgtaggtccacctttgcaaagaggagatatgatatgtgctgttttcccagaagataatttatggtatcgtgctgtgatcaaggagcaacaacccaatgaccttctctctgtgcagtttatagattatggcaatgtttctgtggttcatactaacaaaataggtaggcttgaccttgttaatgcaatattgccggggttgtgcattcattgctccttgcagggatttgaggttcctgacaataaaaattctaagaaaatgatgcattacttttcccaacggaccagcgaggctgcaataagatgtgaatttgttaaatttcaagacagatgggaagttattcttgctgatgaacatgggatcatagcagatgatatgattagcaggtatgctctcagtgaaaaatctcaagtagaactttctacccaagtaattaaaagtgccagttcaaagtctgttaacaaatcagacattgacacttcagtatttcttaactggtataatccagaaaaaaaaatgataagagcttatgccactgtgatagatggacctgagtacttttggtgtcagtttgctgatacggagaaacttcagtgtttagaagtagaagtacagactgctggagaacaggtagcagacaggagaaattgtatcccatgtccttatattggagatccttgtatagtaagatacagagaagatggacattattatagggcacttatcactaatatttgtgaagattatcttgtatctgtcaggcttgtggactttggaaacattgaagactgtgtggacccaaaagcactctgggccattccttctgaacttctgtcggttcccatgcaagcctttccatgttgcctctcagggtttaacatttcagaaggattatgttctcaagagggaaatgactatttctatgaaataataacagaagatgtgttggaaataacaatactagaaatcagaagggatgtttgtgatatccctttagcaattgttgacttgaaaagcaaaggtaaaagtattaatgagaaaatggagaaatattctaagactggtattaaaagtgctcttccctatgaaaatattgactcagagataaagcagactcttgggtcctacaatcttgatgtaggacttaagaaattaagtaataaagctgtacaaaataaaatatatatggaacaacagacagatgagcttgctgaaataactgaaaaagatgtaaacattattggaaccaaaccaagtaacttccgtgaccctaaaactgataacatttgtgaagggtttgaaaacccctgcaaagataaaattgatactgaggaactggaaggtgaattagagtgccatctggttgacaaagcagagtttgatgataaatacctgattacaggatttaacacattactaccacatgctaatgaaacaaaggagatactagaactgaattcacttgaggtgccgctttctcctgatgatgaatcaaaagaattcttagaactggaatctattgagttacagaattctctggtggtggatgaagaaaaaggggagctaagcccggtgccaccgaatgtgccactctcccaagagtgtgtcacaaaaggcgccatggagctatttacactgcagcttcctctcagctgtgaagctgagaaacagccagaactagaactacctacagcccagctgcctttagatgacaagatggatcctttgtctttaggagttagtcagaaagcacaggaatccatgtgtactgaggacatgagaaagtcaagttgtgtagaatcttttgatgaccagcgcaggatgtcattgcatctacatggagcagattgtgatcctaaaacacagaatgaaatgaatatatgtgaagaagaatttgtagagtataaaaacagggatgccatttcggcattgatgcctttgttctctgaggaagaaagcagtgatggaagcaagcacaataatggtttaccagatcatatctcagctcaactacagaacacctacactctgaaagcctttactgttggatctaaatgtgttgtgtggtcaagtctaagaaacacatggtctaaatgtgagattttagaaacagctgaagaaggaacaaggaaaaggggtttggaggtgatggagatttaaccgtggatctatagctgtggccaatcagtcagaagctgcccttgaacaagtggcatcttacgcagaccaacagagtatttgagaaaattgaaaacatgtaaccacaagaagttgtcattttcaaaaacttctatataggtggaaaacaaattaggtctcaggttgatggtggggtgtgtttatagtgatcctgttatatatacagatctgggatctttcgtctttattgtcttacgtttctaattagttgggaggatttattttgctaaacagtttactaacacattacatttcaaaaactattttggtacctttcaaatacagtgtttaaattaaaatagaaaaataagggctcatgacaagtacattatttgattctacttaggatagctttttagcaggatctccttcagaatttttgtcttgactttgaatctttgcctgtttgtctaaacatttgactaacattctgtttgaatttggaagtattctaatacaagatttgaataaagtttatccttaaataaagtttatccttaatatgatggtctcattttattaaaaaggaaatagaactcttaaatatacttggttccatctctcctctgtaatggaggattggggaaagcatagtaatattaaatgttagctcttatgtattagtcacttagcttatactttaaatgcattttttcactttattcatcaactttgaagtgcatatcaatattatccatattttataggtgagaaaattgaagcttcataaagaggttaaataacttgcctaaggtcagatagctgatgagtctcagaggcttgatcaaacccagacctacctaactttgaagcccatgactttttaaacatgattttgcaaagcatagatcttagcttttagaaacagatctgagctatatgctgcttaacagatatgtgacatgggcaaattatgtaatattttgaactttgatcttcatctgtaaagtggtgataataaaacctttcttgcagtgtttttttaagatgagaaataattgatataaagtccctgaaaaggagtaggcatttgataaatgtgtctttctttaccctgaaaaatactcagtgtgcactatgttaggttatttctttttaaccttaacttattagatattttcaatagttattttctcctttcagcatcagcatgcgccaccaacaaaagactgtaaaaaacaaacaaacaaaaaagtgttgaatgggacatccatacagttggaatgcttatttctaaaatgaatagggaaaaggtttgctaaatgagactggggtaaaggtgtatctctgtgaagcattatcagactctgaagcctaatggaaatagaattatgaaccttaaaaacccattataatttccgtaagtagaagggagagaggtttgcattaaaagtaattgaggtagatgagtatattacttattcctggaataatgaatagacaagtttggcttactcatatagataatataatgtgaattgccagaagcaaagctcagagaagatgcattaggatcagattataggaagccttcaatttcaagctgagtttaactccctattttaaaaaatttaatctgaatggctacagaagtaaaatttctcagaatgagtgactttgcacctgacaccactaagataggactagggtaccaaatgagtggtataaatttttatgtcccctgggaaataaaatcattttccatgattcccatatttataagtataaattcttaagctatatttttacctccatttaatcgtgttattctgttttactactacatatagaattgaaaacattaaataaaattaactggaatatgaagaagctaaatgtaattctgaatgttttattatccttcacagcctttgtgtgagtaactaatgtattctaactggaatccctgctatatgctgtaatacctgtggaacctttctttagcaagtagaatgccttaaagaattaaagaaagtgtcaaaaaattaccaatttaatccactgcctttgcctcatctctaatattcttaacccttctctactccttttagtcatcatttgaaattgtgtagtaccaccaatcctgtgctgaaacaatggcttttgcttgttctaatttttcttaccgtgaccaaaagtcaaagagaagagctgccaaattctacctagaatatcatgttgctataattaaactccactgcccatagtagataataaaaggcaagaaattgttttttactctatgtttagggagtcttgtatcattgcaacaggttttcactgggattttgcctgttttaatctacttgtctgtcaaagtaatgtaaaaacagtttttaacttcgacactgaaaaggaatcatctttaaaattaaaatttaggctgatatgaa

SEQ ID NO: 196213 - DNA, 3834 bp, Homo sapiens
  Payload ID: 18707
  Gene Name: tudor domain containing 7
  Uniprot ID: Q8NHU6
  ENST ID: ENST00000355295
  CDS Start-End: 296-3592
ggcgacggtttcccttcccacgcgcggacgccggcgtgggccgacgcggccggagcgcccgcgcgtgcgcagagccgaggccaggctgccctcgaagcggggcggggcgaagcggggcggggccgagcagggcggggcgggggcttgaggtgattcccaagccgcggggcggctccggtggtgcggggaaaccgaaagtgggcggcggccgcggcggggcccctggcggagacggcggcaggagctgggcccagagacgcggggacgggccgtgggcccccggaacgaggcaaagatgctggaaggagatctggtttcaaagatgctacgagctgttctgcagtctcataagaatggagtagcattaccccggctccaaggagagtacagatccttgactggagactggatccccttcaaacagctaggtttccctacactagaagcctatctgagaagtgtgccagcagtggtcaggatagagactagtagatctggagagattacctgctatgccatggcctgcacagaaactgcaagaattgctcagcttgtggctcgtcaaaggagttctaaaaggaaaaccgggcgtcaagttaattgtcagatgagagtgaagaaaaccatgccattttttctagaaggaaaaccaaaagcaaccctcagacaaccaggatttgcttcaaatttttctgttggcaaaaaacctaatccagcaccgttaagagacaaaggaaactctgttggagttaagcctgatgctgaaatgtctccttatatgctacacacaactcttggaaatgaagcattcaaagacattccagtgcaaaggcatgtgaccatgtccaccaacaacaggtttagcccaaaggcgtcccttcaaccacctttgcagatgcatctctcaagaacctctactaaggaaatgagtgataatttaaatcagactgttgaaaaacccaatgtcaagcctcctgcctcttacacttataaaatggatgaggttcaaaatcgcataaaggaaatactaaacaagcataacaatggcatttggatatctaagcttccacatttttacaaagagttatataaagaagaccttaatcaaggaattttacaacagtttgaacactggcctcatatttgcacggtggagaaaccttgcagtggtggccaagatttacttctttatccagctaagagaaagcagcttttgagaagtgaactggatactgagaaagtacctctatccccactacctggtcccaaacaaacaccaccgttgaaagggtgtccaacagttatggcaggagactttaaagaaaaagtggcagacctgctggtgaaatacacaagtggcctttgggccagtgcacttccgaaagcatttgaggaaatgtacaaagtgaaattccctgaggatgccttaaaaaatcttgcctcactttctgatgtatgcagcatagactacatttctggaaatccccagaaggccattctctatgctaaacttccattgcccactgacaaaatccaaaaggatgcagggcaagcacatggtgataatgatatcaaggctatggttgaacaagagtatttgcaggtagaagaaagcattgctgaaagtgctaatacctttatggaggacataacagttcctcctttaatgattccaactgaagcatcaccatctgtattggtggttgaactgagcaacacaaatgaagtggttatcaggtatgtgggcaaagactattctgctgctcaggaattaatggaagatgagatgaaggaatattacagtaagaatcctaagatcacaccagtccaggctgtgaatgttgggcagttgctggccgtaaatgccgaggaggacgcctggttacgggcacaggtcatctcaacagaagagaacaaaataaaggtatgctatgttgactatggttttagtgaaaatgttgaaaaaagcaaagcatacaaattaaacccgaagttttgttcactctcatttcaagctacaaaatgtaagcttgcaggcttggaagtcctaagcgatgaccctgatctagtgaaggtggttgaatctttaacttgtggaaagatctttgcagtggaaatacttgacaaagctgacattccacttgttgttctgtacgatacctcaggagaagatgatatcaatatcaatgccacctgcttgaaggctatatgtgacaagtcactagaggttcacctgcaggttgacgccatgtacacaaatgtcaaagtaactaatatttgctctgatgggacactctactgccaggtgccttgtaagggtctgaacaagctcagtgaccttctacgtaagatagaggactacttccattgcaagcacatgacctctgagtgctttgtttcattacccttctgtgggaaaatctgcctcttccattgcaaaggaaaatggttacgagtagagatcacaaatgttcacagcagccgggctcttgatgttcagttcctggactctggcactgtgacatctgtaaaagtgtcagagctcagggaaattccacctcggtttctacaagaaatgattgcaataccacctcaggccattaagtgctgtttagcagatcttccacaatctattggcatgtggacaccagatgcagtgctgtggttaagagattctgttttgaattgctcggactgtagcattaaggttacaaaagtggatgaaaccagagggatcgcacatgtttatttatttacccctaagaacttccctgaccctcatcgcagtattaatcgccagattacaaatgcagacttgtggaagcatcagaaggatgtgtttttgagtgccatatccagtggagctgactctcccaacagcaaaaatggcaacatgcccatgtcgggcaacactggagagaatttcagaaagaacctcacagatgtcatcaaaaagtccatggtggaccatacgagcgctttctccacagaggaactgccacctcctgtccacttatcaaagccaggggaacacatggatgtgtatgtgcctgtggcctgtcacccaggctacttcgtcatccagccttggcaggagatacataagttggaagttctgatggaagagatgattctatattacagcgtgtctgaagagcgccacatagcagtggagaaagaccaagtgtatgctgcaaaagtggaaaataagtggcacagggtgcttttaaaaggaatcctgaccaatggactggtatctgtgtatgagctggattatggcaaacacgaattagtcaacataagaaaagtacagcccctagtggacatgttccgaaagctgcccttccaagcagtcacagctcaacttgcaggagtgaagtgcaaccagtggtctgaggaggcttctatggtgtttcgaaatcatgtggagaagaaacctctggtggcactggtgcagacagtcattgaaaatgctaacccttgggaccggaaagtagtggtctacttagtggacacatcgttgccagacaccgatacctggattcatgattttatgtcagagtatctgatagagctttcaaaagttaattaatgactgcctctgaaaccttgacaactaattcagattttttagcaataacaaaatgtagtaggcttaaaaaaaatcttaactctgctacatggctctgactgctgtgggggattgaaaagaatatgcttatgtttgatgaaagatatttaacaagttttgttttaacagagttgacttttcaaagaaaattgtacttgaattattactataatattagaataaaaatgtttatcaatataaaa

SEQ ID NO: 196214 - DNA, 3447 bp, Homo sapiens
  Payload ID: 18708
  Gene Name: tudor domain containing 9
  ENST ID: ENST00000339063
  CDS Start-End: 25-2658
tcacgttttgtgaaggtggtcctgatgtcggctaccatcagctgtaaagagtttgcagactactttgctgttcctgttcaaaacaagatgaatcctgcatatatttttgaagtggaaggcaagccccattcagttgaagagtattatcttaatgatttggagcacattcatcatagcaagctctctcctcatctcctggaggaaccggtgataactaaggatatatatgaagttgctgtctctctcattcagatgtttgatgacttggatatgaaggagagtgggaacaaggcttggtcgggggcccagtttgtgttggagcgaagcagtgtgttggtgtttttgccaggtctgggtgaaataaattatatgcatgaacttctcacaagcctggttcataaaaggttgcaggtctatccactccattcaagtgtggctttagaagaacagaataatgtctttttaagtccagtccctgggtacagaaagattattctgtccaccaatattgcagagagttctgtcacagttccagatgtcaaatatgttatagatttttgtttgactagaactttggtctgtgatgaagatacaaattatcagagtctgcgattgagttgggcttctaaaaccagctgtaatcagagaaaaggccgtgctggacgagtgtctagagggtactgttaccggctggtacacaaggatttctgggacaactccatccctgatcatgttgttcctgagatgttgcgttgtccattaggaagcacgatcttgaaagtgaaattacttgacatgggtgagccgagagctctgctggccactgccctttccccgcctggtctgagtgacattgagcgcaccatccttctactaaaggaggttggagcacttgcagtgagtgggcagagagaagatgaaaacccccatgatggtgaattgaccttcttaggaagagttttagcccaacttcctgtaaatcagcaacttggtaaactcatagtccttggacatgtatttggatgtctagatgaatgtcttattatagcggcagctctttctttgaagaatttttttgcaatgcctttccggcagcatctcgatggatataggaacaaagtgaatttctctggcagtagcaagagtgactgtattgcacttgttgaggcatttaaaacatggaaggcttgcagacagacaggggagctgcggtacccgaaggatgaacttaattggggacggttaaattacattcaaatcaagagaattagagaggtggctgaattatatgaagaattgaagactagaatctcacagttcaacatgcatgttgattctcggcgacctgtcatggaccaagagtatatatataagcagcgattcatcctacaggttgtattggcaggtgctttctatccaaattactttacttttggacagccggatgaggagatggcggtgagggagctggctggcaaggaccccaagacaactgtcgtgttgaaacacattcctccctatggatttctttactataaacaactacagtctctctttagacagtgtggtcaagtcaaatccattgtatttgatggtgcaaaagcctttgtggaattctcacgaaatccaacagagagatttaaaacccttcctgcagtatatatggcaattaagatgtctcaactaaaagtttcacttgaactcagcgttcattctgcagaggaaattgaagggaaggtgcaaggcatgaacgtctcaaagctcaggaacacaagggtgaatgtggacttccagaagcagacggtagatcctatgcaagtctcctttaacacatcagacaggtcccagacagttacagatctccttctaactattgatgtcacagaggtggttgaagtgggacacttttggggatacaggattgatgaaaacaactcagagattctgaaaaagcttactgctgaaatcaaccaactgacgctggtgcccttgcccactcacccacatccagacttggtctgtctggcaccttttgctgattttgataaacaacgctactttagagctcaagtcctttatgtttctggaaattctgctgaggtattctttgtagattatggcaataagtctcatgtagatctacatcttttgatggagattccctgtcaatttcttgaacttcctttccaggctttggaatttaagatttgcaaaatgagaccatcagcaaagtctcttgtttgtggcaagcactggagtgacggggccagccagtggttcgcctctctggtgagcggctgcaccctccttgtgaaggtcttctctgtggtgcacagcgtcctgcacgtggatgtgtaccagtactcaggggtccaggatgccatcaacataagagacgtcctcatccagcagggctatgccgagctcacggaggagtcctacgagtccaagcaaagccatgaagttctcaagggcctcttttccaagtcagtagaaaacatgacagatggctctgtgccctttcccatgaaagacgacgagaaatatctcatccggattttgttagagagcttttctaccaataaactgggtactccaaactgtaaggcagaacttcacgggccttttaacccttatgaactaagtgccatagtttgaccagaatatccaaattcaggtgtgtttggattgagaaggagagcatcaactctgtcattatcagtgacgcccctgaagaccttcaccagagaatgctggttgcagcttccctttccatcaatgcgactggatctacgatgctgctgagagaaacctctctgatgcctcatatccctggcctcccggctctcctcagcatgttattcgcaccggtgatagagttaaggattgatcagaatggcaagtactatactggagtcctttgtggtttggggtggaatccagctacaggggcttccatactgcccgagcacgacatggagcttgcgtttgacgttcaattcagcgtggaggatgtcgtcgaggttaatattctcagggctgctattaacaagctagtctgtgatggaccaaatggatgcaagtgtcttgggccagagagagttgcgcagcttcaagacattgcccgtcagaagcttttaggtttgttctgtcagtcaaaaccaagggagaagattgttcccaagtggcatgaaaagccctacgagtggaatcaggttgatccaaagctggtcatggagcaggccgaccgtgagagcagcagagggaagaacacctttctctaccagctccacaaactggttgtgctcggcacctgagcatgtccacaggtggcctccagcacacccctcaggaagctgtggaggctggattccaggctccctccgcagactgactttcctctgtgtctgggtgttacagtctgtgcccactgcatcctaaaggcct

SEQ ID NO: 196215 - DNA, 4782 bp, Homo sapiens
  Payload ID: 18708
  Gene Name: tudor domain containing 9
  Uniprot ID: Q8NDG6
  ENST ID: ENST00000409874
  CDS Start-End: 49-4197
gccgcggagacccggcagttgggggatgccgacgcctgggccttgaggatgctgcggaagctcaccatcgagcagatcaacgactggttcaccatcggcaagacggtgaccaatgtggagctgctgggcgcgccgcccgccttcccggcaggggcggccagggaggaggtgcagcgccaggacgtggcccccggcgctggtcccgcggcccaggctccggctctggcccaagctccggcccggccggccgctgcgttcgaaaggtcactcagccaaaggagctcagaagtagagtatattaacaaatacagacagctcgaagcacaagagcttgatgtgtgtcgcagtgtccaaccaaccagtgggccaggtccaaggccatctttggctaaattaagcagtgtgacatgcatcccagggacaacttataaatatcctgatttgcctataagtcgatacaaggaagaggttgtgtctttgatagaaagtaattccgtggtgattatccatggggccacgggaagcggtaaaagcactcagctcccgcagtatatcttggaccactacgttcagcgctccgcctactgcagcattgtggtcacccagccccggaagataggggcaagcagcatcgccaggtggatcagtaaagagcgtgcctggaccctgggaggtgtggtgggctaccaggtagggctagagaaaatagcaacagaggacaccaggctaatttatatgacaactggagtcctgcttcagaaaatagttagtgccaagagtttgatggaattcacacatatcatcattgatgaagtacacgaacgaacagaagaaatggatttcctgctattggtagtccgcaaactcttaagaacaaattcacgttttgtgaaggtggtcctgatgtcggctaccatcagctgtaaagagtttgcagactactttgctgttcctgttcaaaacaagatgaatcctgcatatatttttgaagtggaaggcaagccccattcagttgaagagtattatcttaatgatttggagcacattcatcatagcaagctctctcctcatctcctggaggaaccggtgataactaaggatatatatgaagttgctgtctctctcattcagatgtttgatgacttggatatgaaggagagtgggaacaaggcttggtcgggggcccagtttgtgttggagcgaagcagtgtgttggtgtttttgccaggtctgggtgaaataaattatatgcatgaacttctcacaagcctggttcataaaaggttgcaggtctatccactccattcaagtgtggctttagaagaacagaataatgtctttttaagtccagtccctgggtacagaaagattattctgtccaccaatattgcagagagttctgtcacagttccagatgtcaaatatgttatagatttttgtttgactagaactttggtctgtgatgaagatacaaattatcagagtctgcgattgagttgggcttctaaaaccagctgtaatcagagaaaaggccgtgctggacgagtgtctagagggtactgttaccggctggtacacaaggatttctgggacaactccatccctgatcatgttgttcctgagatgttgcgttgtccattaggaagcacgatcttgaaagtgaaattacttgacatgggtgagccgagagctctgctggccactgccctttccccgcctggtctgagtgacattgagcgcaccatccttctactaaaggaggttggagcacttgcagtgagtgggcagagagaagatgaaaacccccatgatggtgaattgaccttcttaggaagagttttagcccaacttcctgtaaatcagcaacttggtaaactcatagtccttggacatgtatttggatgtctagatgaatgtcttattatagcggcagctctttctttgaagaatttttttgcaatgcctttccggcagcatctcgatggatataggaacaaagtgaatttctctggcagtagcaagagtgactgtattgcacttgttgaggcatttaaaacatggaaggcttgcagacagacaggggagctgcggtacccgaaggatgaacttaattggggacggttaaattacattcaaatcaagagaattagagaggtggctgaattatatgaagaattgaagactagaatctcacagttcaacatgcatgttgattctcggcgacctgtcatggaccaagagtatatatataagcagcgattcatcctacaggttgtattggcaggtgctttctatccaaattactttacttttggacagccggatgaggagatggcggtgagggagctggctggcaaggaccccaagacaactgtcgtgttgaaacacattcctccctatggatttctttactataaacaactacagtctctctttagacagtgtggtcaagtcaaatccattgtatttgatggtgcaaaagcctttgtggaattctcacgaaatccaacagagagatttaaaacccttcctgcagtatatatggcaattaagatgtctcaactaaaagtttcacttgaactcagcgttcattctgcagaggaaattgaagggaaggtgcaaggcatgaacgtctcaaagctcaggaacacaagggtgaatgtggacttccagaagcagacggtagatcctatgcaagtctcctttaacacatcagacaggtcccagacagttacagatctccttctaactattgatgtcacagaggtggttgaagtgggacacttttggggatacaggattgatgaaaacaactcagagattctgaaaaagcttactgctgaaatcaaccaactgacgctggtgcccttgcccactcacccacatccagacttggtctgtctggcaccttttgctgattttgataaacaacgctactttagagctcaagtcctttatgtttctggaaattctgctgaggtattctttgtagattatggcaataagtctcatgtagatctacatcttttgatggagattccctgtcaatttcttgaacttcctttccaggctttggaatttaagatttgcaaaatgagaccatcagcaaagtctcttgtttgtggcaagcactggagtgacggggccagccagtggttcgcctctctggtgagcggctgcaccctccttgtgaaggtcttctctgtggtgcacagcgtcctgcacgtggatgtgtaccagtactcaggggtccaggatgccatcaacataagagacgtcctcatccagcagggctatgccgagctcacggaggagtcctacgagtccaagcaaagccatgaagttctcaagggcctcttttccaagtcagtagaaaacatgacagatggctctgtgccctttcccatgaaagacgacgagaaatatctcatccggattttgttagagagcttttctaccaataaactgggtactccaaactgtaaggcagaacttcacgggccttttaacccttatgaactaaagtgccatagtttgaccagaatatccaaattcaggtgtgtttggattgagaaggagagcatcaactctgtcattatcagtgacgcccctgaagaccttcaccagagaatgctggttgcagcttccctttccatcaatgcgactggatctacgatgctgctgagagaaacctctctgatgcctcatatccctggcctcccggctctcctcagcatgttattcgcaccggtgatagagttaaggattgatcagaatggcaagtactatactggagtcctttgtggtttggggtggaatccagctacaggggcttccatactgcccgagcacgacatggagcttgcgtttgacgttcaattcagcgtggaggatgtcgtcgaggttaatattctcagggctgctattaacaagctagtctgtgatggaccaaatggatgcaagtgtcttgggccagagagagttgcgcagcttcaagacattgcccgtcagaagcttttaggtttgttctgtcagtcaaaaccaagggagaagattgttcccaagtggcatgaaaagccctacgagtggaatcaggttgatccaaagctggtcatggagcaggccgaccgtgagagcagcagagggaagaacacctttctctaccagctccacaaactggttgtgctcggcacctgagcatgtccacaggtggcctccagcacacccctcaggaagctgtggaggctggattccaggctccctccgcagactgactttcctctgtgtctgggtgttacagtctgtgcccactgcatcctaaaggccttttctttcttcttttctctttgggtgatagtcagagagtggtgtttttgttcaggtgggaaggattggaaactctagtcttttctagaaacagaaaatcactgtattaaatattttggaaagattgttctgaaagaagtctgtttggataaagagctgtattttgctttaaatttattaaggtaaatataagtagttaatcttagatgtaaggttccagaatgtgcttacatattctgttctgttacagtgatttaaaccagtagtataggaaaaaacttaaaaaaacaaaaaaaccatgtagtattttctgatttttttttccatgagggaaaatatctaatttttataagactaagttgagttatacttcttggttcacattttggaaatcagagattacagattacatggccatagcttatctgtgttaaaacaataaaagcattaaatgaa

SEQ ID NO: 196216 - DNA, 3338 bp, Homo sapiens
  Payload ID: 18708
  Gene Name: tudor domain containing 9
  ENST ID: ENST00000557332
  CDS Start-End: 1-2755
aagaacaaattcacgttttgtgaaggtggtcctgatgtcggctaccatcagctgtaaagagtttgcagactactttgctgttcctgttcaaaacaagatgaatcctgcatatatttttgaagtggaaggcaagccccattcagttgaagagtattatcttaatgatttggagcacattcatcatagcaagctctctcctcatctcctggaggaaccggtgataactaaggatatatatgaagttgctgtctctctcattcagatgtttgatgacttggatatgaaggagagtgggaacaaggcttggtcgggggcccagtttgtgttggagcgaagcagtgtgttggtgtttttgccaggtctgggtgaaataaattatatgcatgaacttctcacaagcctggttcataaaaggttgcaggtctatccactccattcaagtgtggctttagaagaacagaataatgtctttttaagtccagtccctgggtacagaaagattattctgtccaccaatattgcagagagttctgtcacagttccagatgtcaaatatgttatagatttttgtttgactagaactttggtctgtgatgaagatacaaattatcagagtctgcgattgagttgggcttctaaaaccagctgtaatcagagaaaaggccgtgctggacgagtgtctagagggtactgttaccggctggtacacaaggatttctgggacaactccatccctgatcatgttgttcctgagatgttgcgttgtccattaggaagcacgatcttgaaagtgaaattacttgacatgggtgagccgagagctctgctggccactgccctttccccgcctggtctgagtgacattgagcgcaccatccttctactaaaggaggttggagcacttgcagtgagtgggcagagagaagatgaaaacccccatgatggtgaattgaccttcttaggaagagttttagcccaacttcctgtaaatcagcaacttggtaaactcatagtccttggacatgtatttggatgtctagatgaatgtcttattatagcggcagctctttctttgaagaatttttttgcaatgcctttccggcagcatctcgatggatataggaacaaagtgaatttctctggcagtagcaagagtgactgtattgcacttgttgaggcatttaaaacatggaaggcttgcagacagacaggggagctgcggtacccgaaggatgaacttaattggggacggttaaattacattcaaatcaagagaattagagaggtggctgaattatatgaagaattgaagactagaatctcacagttcaacatgcatgttgattctcggcgacctgtcatggaccaagagtatatatataagcagcgattcatcctacaggttgtattggcaggtgctttctatccaaattactttacttttggacagccggatgaggagatggcggtgagggagctggctggcaaggaccccaagacaactgtcgtgttgaaacacattcctccctatggatttctttactataaacaactacagtctctctttagacagtgtggtcaagtcaaatccattgtatttgatggtgcaaaagcctttgtggaattctcacgaaatccaacagagagatttaaaacccttcctgcagtatatatggcaattaagatgtctcaactaaaagtttcacttgaactcagcgttcattctgcagaggaaattgaagggaaggtgcaaggcatgaacgtctcaaagctcaggaacacaagggtgaatgtggacttccagaagcagacggtagatcctatgcaagtctcctttaacacatcagacaggtcccagacagttacagatctccttctaactattgatgtcacagaggtggttgaagtgggacacttttggggatacaggattgatgaaaacaactcagagattctgaaaaagcttactgctgaaatcaaccaactgacgctggtgcccttgcccactcacccacatccagacttggtctgtctggcaccttttgctgattttgataaacaacgctactttagagctcaagtcctttatgtttctggaaattctgctgaggtattctttgtagattatggcaataagtctcatgtagatctacatcttttgatggagattccctgtcaatttcttgaacttcctttccaggctttggaatttaagatttgcaaaatgagaccatcagcaaagtctcttgtttgtggcaagcactggagtgacggggccagccagtggttcgcctctctggtgagcggctgcaccctccttgtgaaggtcttctctgtggtgcacagcgtcctgcacgtggatgtgtaccagtactcaggggtccaggatgccatcaacataagagacgtcctcatccagcagggctatgccgagctcacggaggagtcctacgagtccaaggttaatattctcagggctgctattaacaagctagtctgtgatggaccaaatggatgcaagtgtcttgggccagagagagttgcgcagcttcaagacattgcccgtcagaagcttttaggtttgttctgtcagtcaaaaccaagggagaagattgttcccaagtggcatgaaaagccctacgagtggaatcaggttgatccaaagctggtcatggagcaggccgaccgtgagagcagcagagggaagaacacctttctctaccagctccacaaactggttgtgctcggcacctgagcatgtccacaggtggcctccagcacacccctcaggaagctgtggaggctggattccaggctccctccgcagactgactttcctctgtgtctgggtgttacagtctgtgcccactgcatcctaaaggccttttctttcttcttttctctttgggtgatagtcagagagtggtgtttttgttcaggtgggaaggattggaaactctagtcttttctagaaacagaaaatcactgtattaaatattttggaaagattgttctgaaagaagtctgtttggataaagagctgtattttgctttaaatttattaaggtaaatataagtagttaatcttagatgtaaggttccagaatgtgcttacatattctgttctgttacagtgatttaaaccagtagtataggaaaaaacttaaaaaaacaaaaaaaccatgtagtattttctgatttttttttccatgagggaaaatatctaatttttataagactaagttgagttatacttcttggttcacattttggaaatcagagattacagattacatggccatagcttatctgtgttaaaacaataaaagcattaaatg

SEQ ID NO: 196217 - DNA, 2107 bp, Homo sapiens
  Payload ID: 18709
  Gene Name: tuftelin 1
  ENST ID: ENST00000353024
  CDS Start-End: 45-644
agcggggtggacaagtggcgtgtgtgctgcgaccccgagggaagatgaacgggacgcggaactggtgtaccctggtggacgtgcacccagaggaccaggcggcggcgggcaggaagacctatgccatggtgtccagccactcagctggtcattctctggcttcagaactggtggagtcccatgatggacatgaggagatcattaaggtgtacttgaaggggaggtctggagacaagatgattcacgagaagaatattaaccagctgaagagtgaggtccagtacatccaggaggccaggaactgcctacagaagctccgggaggatataagtagcaagcttgacaggaacctaggagattctctccatcgacaggagatacaggtggtgctagaaaagccaaatggctttagtcagagtcccacagccctgtacagcagcccacctgaggtggacacctgtataaatgaggatgttgagagcttgaggaagacggtgcaggacttgctggccaagcttcaggaggccaagcggcaacaccagtcagactgtgtggcttttgaggtcacactcagccggtaccagagggaagcagaacaaagtaatgtggcccttcagagagaggaggacagatgtccagagtgattggagaatgtcctgggggaatgaagttccttccacaaacacagctcagttcttagcaacaaactgtttgtttttctacttgctccatctgcagcctacgctgccctggcctcctgcagacagatagtggggttacctggcaaggcctggtgagagccagtgaacctaagctttgactgggtggccttgtctttctggggaggagggaatgtacattcagggagtagccttttgcggaaaaattctctagggctacagacagtcatgtgtgacttctctctgctgtgaaaactcccagagtctctttagggattttccctaaggtgtaccaccaggcacacctcagtcttcttgacccagagcctgaaaactgttttcactgggttccaccagtcccagcaaaatcctctttgtatttattttgctaagttattggtggttttgcttacatctcatgattgatataataccaaagttctatagccttctcttgcagtatttggatttgcttgaaaccgggaaaactgttcccattaggcttgttaatgtcagagtgacactattatgaatctttctctccctttcctctgcctgtttcttctctctttctccttcaaacttgctctgcagctaaggaaggtgagtctactttccctgaggctttggggtcagagtatatgttgtttggagaaagagggcaatcaggactcttctgggacccagatgagttcttcactagcccttctgaaccccttgctccataattggtcttttatcctggctctgaatgaccctgcaggtcatcatggttttctttttttattgtttttttttttttctgagacagagtctcactctgtcacccaggctggagtgcagtggcgcgatctcagctcactgcaacctctgcctcccggatttaagcgattcttctgcctcagcctcccgagtagctgggactacaggtgtgccaccacgcctggctgatttttgtatttttagtagagatggggtttcaccatactggctaggctggtctcgaattcctgacctcaggtgatccacccacctcggcttcccaaagtgctaggattataggcttgagctactgcgcccggcccatggtgtttttctttagggctcttcctacaaccttgagaagtagataggcatcagagtatggtactataggaatcagaaaaattcaaaacaaatgtggattaagtgtttaggctctatgtggctcacgcagccagaatccttaagtctgtgtgtttctgtgtctcaagactgggctcacattctggctttgtccataacaatgctctgggatttcagggagttccctcatttgtaaaatgagggggtcagagcaggtgatatccatgtttcttccctttctgatattgttgtctgtggcatattctttgtatggcgaatttaataaattatattaatgtgtc

SEQ ID NO: 196218 - DNA, 3033 bp, Homo sapiens
  Payload ID: 18709
  Gene Name: tuftelin 1
  Uniprot ID: Q9NNX1
  ENST ID: ENST00000368848
  CDS Start-End: 60-1157
cagttggagccagacagcggggtggacaagtggcgtgtgtgctgcgaccccgagggaagatgaacgggacgcggaactggtgtaccctggtggacgtgcacccagaggaccaggcggcggcgggcaggaagacctatgccatggtgtccagccactcagctggtcattctctggcttcagaactggtggagtcccatgatggacatgaggagatcattaaggtgtacttgaaggggaggtctggagacaagatgattcacgagaagaatattaaccagctgaagagtgaggtccagtacatccaggaggccaggaactgcctacagaagctccgggaggatataagtagcaagcttgacaggaacctaggagattctctccatcgacaggagatacaggtggtgctagaaaagccaaatggctttagtcagagtcccacagccctgtacagcagcccacctgaggtggacacctgtataaatgaggatgttgagagcttgaggaagacggtgcaggacttgctggccaagcttcaggaggccaagcggcaacaccagtcagactgtgtggcttttgaggtcacactcagccggtaccagagggaagcagaacaaagtaatgtggcccttcagagagaggaggacagagtggagcagaaagaggcagaagtcggagagctgcagaggcgcttgctagggatggagacggagcatcaggccttactggcgaaagtgagggaaggggaggtggccctagaggaacttcggagcaacaatgctgactgccaagcagaacgagaaaaggctgctaccctggaaaaggaagtggccgggttgcgggagaagatccaccacttggatgacatgctcaagagccagcagcggaaagtccggcaaatgatagagcagctccagaattcaaaagctgtgatccagtcaaaggacgccaccatccaggagctcaaggagaaaatcgcctatctggaggcagagaatttagagatgcatgaccggatggaacacctgatagaaaaacaaatcagtcatggcaacttcagcacccaggcccgggccaagacagagaacccgggcagtattaggatatccaagccgcctagcccgaagcccatgcctgtcatccgagtggtggaaacctgagctgcctggagatggttgctgccattgctgctgcctctgcctcggagaagcccactgcccctgttggctgttaacactgcctttgacttcctgactgtcccctggctgcacccaggacttcgggctcctgtgtctcaccattcccaagcccctggccactctaagctgggcagacggagcacgagcacctattcaaggcactgcagccctttggaagacattgtcctgcaagcaggagccagggcaatatctatattcctacagtgactatttttctctgtagagagcctcccttctgttgtagactggactctggctgtgccataagccaggccttcatcagattgggagaggtgacaagatttgcctcagccctaaaagctggagacacagatgtccagagtgattggagaatgtcctgggggaatgaagttccttccacaaacacagctcagttcttagcaacaaactgtttgtttttctacttgctccatctgcagcctacgctgccctggcctcctgcagacagatagtggggttacctggcaaggcctggtgagagccagtgaacctaagctttgactgggtggccttgtctttctggggaggagggaatgtacattcagggagtagccttttgcggaaaaattctctagggctacagacagtcatgtgtgacttctctctgctgtgaaaactcccagagtctctttagggattttccctaaggtgtaccaccaggcacacctcagtcttcttgacccagagcctgaaaactgttttcactgggttccaccagtcccagcaaaatcctctttgtatttattttgctaagttattggtggttttgcttacatctcatgattgatataataccaaagttctatagccttctcttgcagtatttggatttgcttgaaaccgggaaaactgttcccattaggcttgttaatgtcagagtgacactattatgaatctttctctccctttcctctgcctgtttcttctctctttctccttcaaacttgctctgcagctaaggaaggtgagtctactttccctgaggctttggggtcagagtatatgttgtttggagaaagagggcaatcaggactcttctgggacccagatgagttcttcactagcccttctgaaccccttgctccataattggtcttttatcctggctctgaatgaccctgcaggtcatcatggttttctttttttattgtttttttttttttctgagacagagtctcactctgtcacccaggctggagtgcagtggcgcgatctcagctcactgcaacctctgcctcccggatttaagcgattcttctgcctcagcctcccgagtagctgggactacaggtgtgccaccacgcctggctgatttttgtatttttagtagagatggggtttcaccatactggctaggctggtctcgaattcctgacctcaggtgatccacccacctcggcttcccaaagtgctaggattataggcttgagctactgcgcccggcccatggtgtttttctttagggctcttcctacaaccttgagaagtagataggcatcagagtatggtactataggaatcagaaaaattcaaaacaaatgtggattaagtgtttaggctctatgtggctcacgcagccagaatccttaagtctgtgtgtttctgtgtctcaagactgggctcacattctggctttgtccataacaatgctctgggatttcagggagttccctcatttgtaaaatgagggggtcagagcaggtgatatccatgtttcttccctttctgatattgttgtctgtggcatattctttgtatggcgaatttaataaattatattaatgtgtctctttga

SEQ ID NO: 196219 - DNA, 3111 bp, Homo sapiens
  Payload ID: 18709
  Gene Name: tuftelin 1
  Uniprot ID: Q9NNX1
  ENST ID: ENST00000368849
  CDS Start-End: 63-1235
gcccagttggagccagacagcggggtggacaagtggcgtgtgtgctgcgaccccgagggaagatgaacgggacgcggaactggtgtaccctggtggacgtgcacccagaggaccaggcggcgggcagcgtggacattctcaggctgactctccagggtgaactgacaggagatgaacttgaacacatagcccagaaggcgggcaggaagacctatgccatggtgtccagccactcagctggtcattctctggcttcagaactggtggagtcccatgatggacatgaggagatcattaaggtgtacttgaaggggaggtctggagacaagatgattcacgagaagaatattaaccagctgaagagtgaggtccagtacatccaggaggccaggaactgcctacagaagctccgggaggatataagtagcaagcttgacaggaacctaggagattctctccatcgacaggagatacaggtggtgctagaaaagccaaatggctttagtcagagtcccacagccctgtacagcagcccacctgaggtggacacctgtataaatgaggatgttgagagcttgaggaagacggtgcaggacttgctggccaagcttcaggaggccaagcggcaacaccagtcagactgtgtggcttttgaggtcacactcagccggtaccagagggaagcagaacaaagtaatgtggcccttcagagagaggaggacagagtggagcagaaagaggcagaagtcggagagctgcagaggcgcttgctagggatggagacggagcatcaggccttactggcgaaagtgagggaaggggaggtggccctagaggaacttcggagcaacaatgctgactgccaagcagaacgagaaaaggctgctaccctggaaaaggaagtggccgggttgcgggagaagatccaccacttggatgacatgctcaagagccagcagcggaaagtccggcaaatgatagagcagctccagaattcaaaagctgtgatccagtcaaaggacgccaccatccaggagctcaaggagaaaatcgcctatctggaggcagagaatttagagatgcatgaccggatggaacacctgatagaaaaacaaatcagtcatggcaacttcagcacccaggcccgggccaagacagagaacccgggcagtattaggatatccaagccgcctagcccgaagcccatgcctgtcatccgagtggtggaaacctgagctgcctggagatggttgctgccattgctgctgcctctgcctcggagaagcccactgcccctgttggctgttaacactgcctttgacttcctgactgtcccctggctgcacccaggacttcgggctcctgtgtctcaccattcccaagcccctggccactctaagctgggcagacggagcacgagcacctattcaaggcactgcagccctttggaagacattgtcctgcaagcaggagccagggcaatatctatattcctacagtgactatttttctctgtagagagcctcccttctgttgtagactggactctggctgtgccataagccaggccttcatcagattgggagaggtgacaagatttgcctcagccctaaaagctggagacacagatgtccagagtgattggagaatgtcctgggggaatgaagttccttccacaaacacagctcagttcttagcaacaaactgtttgtttttctacttgctccatctgcagcctacgctgccctggcctcctgcagacagatagtggggttacctggcaaggcctggtgagagccagtgaacctaagctttgactgggtggccttgtctttctggggaggagggaatgtacattcagggagtagccttttgcggaaaaattctctagggctacagacagtcatgtgtgacttctctctgctgtgaaaactcccagagtctctttagggattttccctaaggtgtaccaccaggcacacctcagtcttcttgacccagagcctgaaaactgttttcactgggttccaccagtcccagcaaaatcctctttgtatttattttgctaagttattggtggttttgcttacatctcatgattgatataataccaaagttctatagccttctcttgcagtatttggatttgcttgaaaccgggaaaactgttcccattaggcttgttaatgtcagagtgacactattatgaatctttctctccctttcctctgcctgtttcttctctctttctccttcaaacttgctctgcagctaaggaaggtgagtctactttccctgaggctttggggtcagagtatatgttgtttggagaaagagggcaatcaggactcttctgggacccagatgagttcttcactagcccttctgaaccccttgctccataattggtcttttatcctggctctgaatgaccctgcaggtcatcatggttttctttttttattgtttttttttttttctgagacagagtctcactctgtcacccaggctggagtgcagtggcgcgatctcagctcactgcaacctctgcctcccggatttaagcgattcttctgcctcagcctcccgagtagctgggactacaggtgtgccaccacgcctggctgatttttgtatttttagtagagatggggtttcaccatactggctaggctggtctcgaattcctgacctcaggtgatccacccacctcggcttcccaaagtgctaggattataggcttgagctactgcgcccggcccatggtgtttttctttagggctcttcctacaaccttgagaagtagataggcatcagagtatggtactataggaatcagaaaaattcaaaacaaatgtggattaagtgtttaggctctatgtggctcacgcagccagaatccttaagtctgtgtgtttctgtgtctcaagactgggctcacattctggctttgtccataacaatgctctgggatttcagggagttccctcatttgtaaaatgagggggtcagagcaggtgatatccatgtttcttccctttctgatattgttgtctgtggcatattctttgtatggcgaatttaataaattatattaatgtgtctctttga

SEQ ID NO: 196220 - DNA, 2946 bp, Homo sapiens
  Payload ID: 18709
  Gene Name: tuftelin 1
  ENST ID: ENST00000392712
  CDS Start-End: 63-1070
gcccagttggagccagacagcggggtggacaagtggcgtgtgtgctgcgaccccgagggaagatgaacgggacgcggaactggtgtaccctggtggacgtgcacccagaggaccaggcggcggcgggcaggaagacctatgccatggtgtccagccactcagctggtcattctctggcttcagaactggtggagtcccatgatggacatgaggagatcattaaggtgtacttgaaggggaggtctggagacaagatgattcacgagaagaatattaaccagctgaagagtgaggtccagtacatccaggaggtggtgctagaaaagccaaatggctttagtcagagtcccacagccctgtacagcagcccacctgaggtggacacctgtataaatgaggatgttgagagcttgaggaagacggtgcaggacttgctggccaagcttcaggaggccaagcggcaacaccagtcagactgtgtggcttttgaggtcacactcagccggtaccagagggaagcagaacaaagtaatgtggcccttcagagagaggaggacagagtggagcagaaagaggcagaagtcggagagctgcagaggcgcttgctagggatggagacggagcatcaggccttactggcgaaagtgagggaaggggaggtggccctagaggaacttcggagcaacaatgctgactgccaagcagaacgagaaaaggctgctaccctggaaaaggaagtggccgggttgcgggagaagatccaccacttggatgacatgctcaagagccagcagcggaaagtccggcaaatgatagagcagctccagaattcaaaagctgtgatccagtcaaaggacgccaccatccaggagctcaaggagaaaatcgcctatctggaggcagagaatttagagatgcatgaccggatggaacacctgatagaaaaacaaatcagtcatggcaacttcagcacccaggcccgggccaagacagagaacccgggcagtattaggatatccaagccgcctagcccgaagcccatgcctgtcatccgagtggtggaaacctgagctgcctggagatggttgctgccattgctgctgcctctgcctcggagaagcccactgcccctgttggctgttaacactgcctttgacttcctgactgtcccctggctgcacccaggacttcgggctcctgtgtctcaccattcccaagcccctggccactctaagctgggcagacggagcacgagcacctattcaaggcactgcagccctttggaagacattgtcctgcaagcaggagccagggcaatatctatattcctacagtgactatttttctctgtagagagcctcccttctgttgtagactggactctggctgtgccataagccaggccttcatcagattgggagaggtgacaagatttgcctcagccctaaaagctggagacacagatgtccagagtgattggagaatgtcctgggggaatgaagttccttccacaaacacagctcagttcttagcaacaaactgtttgtttttctacttgctccatctgcagcctacgctgccctggcctcctgcagacagatagtggggttacctggcaaggcctggtgagagccagtgaacctaagctttgactgggtggccttgtctttctggggaggagggaatgtacattcagggagtagccttttgcggaaaaattctctagggctacagacagtcatgtgtgacttctctctgctgtgaaaactcccagagtctctttagggattttccctaaggtgtaccaccaggcacacctcagtcttcttgacccagagcctgaaaactgttttcactgggttccaccagtcccagcaaaatcctctttgtatttattttgctaagttattggtggttttgcttacatctcatgattgatataataccaaagttctatagccttctcttgcagtatttggatttgcttgaaaccgggaaaactgttcccattaggcttgttaatgtcagagtgacactattatgaatctttctctccctttcctctgcctgtttcttctctctttctccttcaaacttgctctgcagctaaggaaggtgagtctactttccctgaggctttggggtcagagtatatgttgtttggagaaagagggcaatcaggactcttctgggacccagatgagttcttcactagcccttctgaaccccttgctccataattggtcttttatcctggctctgaatgaccctgcaggtcatcatggttttctttttttattgtttttttttttttctgagacagagtctcactctgtcacccaggctggagtgcagtggcgcgatctcagctcactgcaacctctgcctcccggatttaagcgattcttctgcctcagcctcccgagtagctgggactacaggtgtgccaccacgcctggctgatttttgtatttttagtagagatggggtttcaccatactggctaggctggtctcgaattcctgacctcaggtgatccacccacctcggcttcccaaagtgctaggattataggcttgagctactgcgcccggcccatggtgtttttctttagggctcttcctacaaccttgagaagtagataggcatcagagtatggtactataggaatcagaaaaattcaaaacaaatgtggattaagtgtttaggctctatgtggctcacgcagccagaatccttaagtctgtgtgtttctgtgtctcaagactgggctcacattctggctttgtccataacaatgctctgggatttcagggagttccctcatttgtaaaatgagggggtcagagcaggtgatatccatgtttcttccctttctgatattgttgtctgtggcatattctttgtatggcgaatttaataaattatattaatgtgtctctttga

SEQ ID NO: 196221 - DNA, 2974 bp, Homo sapiens
  Payload ID: 18710
  Gene Name: tuftelin interacting protein 11
  Uniprot ID: Q9UBB9
  ENST ID: ENST00000407431
  CDS Start-End: 375-2888
acaaggggactcagcgccagtgagagtagggacgaaggctcagggaaggcgagcttcggtccaagccgttggggtgtggggaggggaatccatttcgtagacagctctgccgaggcacggagaggggcggtgctgcttggggtcaactgggatttagggcttggattcatttaagaacctgagcttccttcaccaaacctagacagcaagagagagacaagcccgaggcctgacttctagcactcctgagtttgagccctatgagcagtggaacctagggaccaccaaggatccagatataattctttcctcagtaatagaaaaaagaatctgggatctaagaagatacctactcattttctaagtgactggccatgtcattgtcccacttataccgggatggggaaggccgcattgatgatgatgatgacgagcgggagaactttgagatcactgactgggatctccagaatgagttcaaccccaaccgacagcgccactggcagaccaaggaagaagccacctacggggtgtgggcagagcgagactcggatgatgagaggcccagctttggaggcaaacgggcccgtgactactctgcgccagtcaacttcatcagcgcagggctcaagaaaggggcagcggaggaggcagagttggaagattctgatgacgaagagaaacctgttaagcaggacgactttcctaaggattttggaccaaggaagctaaaaacgggtggcaattttaagcccagccagaaaggttttgcaggaggaaccaaatctttcatggacttcggcagctgggaaagacacacaaaaggaattggacagaagcttcttcagaagatgggctacgtccctggacggggcctcgggaagaatgcacaaggtatcattaacccaattgaagccaagcagagaaagggaaaaggtgctgtgggggcttatggatccgagcgcaccactcagtccatgcaagacttccctgtggttgactcagaggaagaagctgaagaggagtttcagaaggagctgagccagtggaggaaagacccaagtggaagcaagaagaagcccaaatactcttacaagaccgtggaagagttgaaggccaagggcaggattagcaagaagctcactgctccccagaaggaactttctcaagtcaaggtcatagacatgacaggccgggagcagaaggtctactacagctacagtcagatcagccacaagcacaacgttcccgatgatgggctgccgctacagtcccaacagctgccacagtctggcaaagaggccaaggcccccggcttcgcgctgcccgagctggagcacaacctgcagctgctcatcgacctcacggagcaggagatcatccagaatgaccggcagctacagtatgagcgggacatggtggtcaacctcttccacgagctggagaagatgaccgaggtcctggaccacgaggagcgggtcatctcgaacctcagcaaggtcctggagatggtggaggagtgcgagcggcggatgcagcccgactgcagcaaccccctcaccctggacgagtgtgcccgcatcttcgaaaccctgcaggacaagtactatgaggagtacaggatgtccgaccgtgtggaccttgctgtggccatcgtctatccactcatgaaggagtacttcaaggagtgggatcccctcaaagactgcacttatggcaccgagatcatctctaagtggaaaagcctcctagagaatgaccagctcttgtcccatggcggacaggacctctcagcagatgcctttcacaggttgatatgggaagtctggatgccttttgttcgaaatattgtcacccagtggcagccaaggaactgtgacccgatggtggactttttggatagttgggtgcacattattcctgtgtggatcttagataacatactggaccaactcatcttccccaagctgcaaaaggaggtggaaaactggaacccgctcacagacactgttcccatccactcttggatccacccatggctgccccttatgcaggcacggctggagccactctattcccccatccgtagtaagctgtccagcgccctgcagaagtggcaccccagcgactcctctgccaagctcatcctccagccctggaaggatgtcttcactcctggctcctgggaagcattcatggtcaaaaacatagtgcccaagctggggatgtgtcttggtgagctagtcattaacccccaccagcagcacatggatgcattctattgggtgattgactgggaagggatgatctctgtctctagcctggtgggacttcttgaaaagcacttcttccccaagtggcttcaggtgctgtgctcttggctcagtaacagcccaaattatgaggagatcaccaagtggtacctgggttggaagtcgatgttctcagaccaagtgctggcacatccatctgtcaaggacaaatttaatgaggcacttgatatcatgaaccgggcggtgtcctccaacgttggtgcctacatgcagccaggagcacgggagaacattgcctatctcacccacacggagcggaggaaggacttccagtacgaggccatgcaggagaggcgggaggctgagaacatggctcagaggggcattggcgtggccgctagctctgtgcccatgaactttaaggacctcattgagaccaaggctgaggagcacaacattgtcttcatgcccgtcattgggaagcgacacgaagggaagcagctctacacctttggccgcattgtgatctacatcgaccggggagtggtctttgtccagggcgagaagacgtgggtgcccacctcactgcagagcctgatcgacatggccaagtgaactgtggcaggtccagaaccagtcagagacttgcccctaagagggatgtactgtaaataaacagtatttttagatcaccttcaaaa

SEQ ID NO: 196222 - DNA, 2896 bp, Homo sapiens
  Payload ID: 18710
  Gene Name: tuftelin interacting protein 11
  Uniprot ID: Q9UBB9
  ENST ID: ENST00000405938
  CDS Start-End: 356-2869
gtcatttccggcgcgccggccacggtgcttccgggttctggtgtaggagcggcgtcttctcgcgcggatggtgaagctgaatttggtacgctggaccctcggacagacagcaagagagagacaagcccgaggcctgacttctagcactcctgagtttgagccctatgagcagtggaacctaggttcttcagctttggaacttgactggctctccttgctcctcagcctgcagacagcctattgtgggaccttttgatcgtgaccaccaaggatccagatataattctttcctcagtaatagaaaaaagaatctgggatctaagaagatacctactcattttctaagtgactggccatgtcattgtcccacttataccgggatggggaaggccgcattgatgatgatgatgacgagcgggagaactttgagatcactgactgggatctccagaatgagttcaaccccaaccgacagcgccactggcagaccaaggaagaagccacctacggggtgtgggcagagcgagactcggatgatgagaggcccagctttggaggcaaacgggcccgtgactactctgcgccagtcaacttcatcagcgcagggctcaagaaaggggcagcggaggaggcagagttggaagattctgatgacgaagagaaacctgttaagcaggacgactttcctaaggattttggaccaaggaagctaaaaacgggtggcaattttaagcccagccagaaaggttttgcaggaggaaccaaatctttcatggacttcggcagctgggaaagacacacaaaaggaattggacagaagcttcttcagaagatgggctacgtccctggacggggcctcgggaagaatgcacaaggtatcattaacccaattgaagccaagcagagaaagggaaaaggtgctgtgggggcttatggatccgagcgcaccactcagtccatgcaagacttccctgtggttgactcagaggaagaagctgaagaggagtttcagaaggagctgagccagtggaggaaagacccaagtggaagcaagaagaagcccaaatactcttacaagaccgtggaagagttgaaggccaagggcaggattagcaagaagctcactgctccccagaaggaactttctcaagtcaaggtcatagacatgacaggccgggagcagaaggtctactacagctacagtcagatcagccacaagcacaacgttcccgatgatgggctgccgctacagtcccaacagctgccacagtctggcaaagaggccaaggcccccggcttcgcgctgcccgagctggagcacaacctgcagctgctcatcgacctcacggagcaggagatcatccagaatgaccggcagctacagtatgagcgggacatggtggtcaacctcttccacgagctggagaagatgaccgaggtcctggaccacgaggagcgggtcatctcgaacctcagcaaggtcctggagatggtggaggagtgcgagcggcggatgcagcccgactgcagcaaccccctcaccctggacgagtgtgcccgcatcttcgaaaccctgcaggacaagtactatgaggagtacaggatgtccgaccgtgtggaccttgctgtggccatcgtctatccactcatgaaggagtacttcaaggagtgggatcccctcaaagactgcacttatggcaccgagatcatctctaagtggaaaagcctcctagagaatgaccagctcttgtcccatggcggacaggacctctcagcagatgcctttcacaggttgatatgggaagtctggatgccttttgttcgaaatattgtcacccagtggcagccaaggaactgtgacccgatggtggactttttggatagttgggtgcacattattcctgtgtggatcttagataacatactggaccaactcatcttccccaagctgcaaaaggaggtggaaaactggaacccgctcacagacactgttcccatccactcttggatccacccatggctgccccttatgcaggcacggctggagccactctattcccccatccgtagtaagctgtccagcgccctgcagaagtggcaccccagcgactcctctgccaagctcatcctccagccctggaaggatgtcttcactcctggctcctgggaagcattcatggtcaaaaacatagtgcccaagctggggatgtgtcttggtgagctagtcattaacccccaccagcagcacatggatgcattctattgggtgattgactgggaagggatgatctctgtctctagcctggtgggacttcttgaaaagcacttcttccccaagtggcttcaggtgctgtgctcttggctcagtaacagcccaaattatgaggagatcaccaagtggtacctgggttggaagtcgatgttctcagaccaagtgctggcacatccatctgtcaaggacaaatttaatgaggcacttgatatcatgaaccgggcggtgtcctccaacgttggtgcctacatgcagccaggagcacgggagaacattgcctatctcacccacacggagcggaggaaggacttccagtacgaggccatgcaggagaggcgggaggctgagaacatggctcagaggggcattggcgtggccgctagctctgtgcccatgaactttaaggacctcattgagaccaaggctgaggagcacaacattgtcttcatgcccgtcattgggaagcgacacgaagggaagcagctctacacctttggccgcattgtgatctacatcgaccggggagtggtctttgtccagggcgagaagacgtgggtgcccacctcactgcagagcctgatcgacatggccaagtgaactgtggcaggtccagaaccagtcaga

SEQ ID NO: 196223 - DNA, 3586 bp, Homo sapiens
  Payload ID: 18710
  Gene Name: tuftelin interacting protein 11
  Uniprot ID: Q9UBB9
  ENST ID: ENST00000407690
  CDS Start-End: 285-2798
actaacgtcatttccggcgcgccggccacggtgcttccgggttctggtgtaggagcggcgtcttctcgcgcggatggtgaagctgaatttggtacgctggaccctcggacagacagcaagagagagacaagcccgaggcctgacttctagcactcctgagtttgagccctatgagcagtggaacctagggaccaccaaggatccagatataattctttcctcagtaatagaaaaaagaatctgggatctaagaagatacctactcattttctaagtgactggccatgtcattgtcccacttataccgggatggggaaggccgcattgatgatgatgatgacgagcgggagaactttgagatcactgactgggatctccagaatgagttcaaccccaaccgacagcgccactggcagaccaaggaagaagccacctacggggtgtgggcagagcgagactcggatgatgagaggcccagctttggaggcaaacgggcccgtgactactctgcgccagtcaacttcatcagcgcagggctcaagaaaggggcagcggaggaggcagagttggaagattctgatgacgaagagaaacctgttaagcaggacgactttcctaaggattttggaccaaggaagctaaaaacgggtggcaattttaagcccagccagaaaggttttgcaggaggaaccaaatctttcatggacttcggcagctgggaaagacacacaaaaggaattggacagaagcttcttcagaagatgggctacgtccctggacggggcctcgggaagaatgcacaaggtatcattaacccaattgaagccaagcagagaaagggaaaaggtgctgtgggggcttatggatccgagcgcaccactcagtccatgcaagacttccctgtggttgactcagaggaagaagctgaagaggagtttcagaaggagctgagccagtggaggaaagacccaagtggaagcaagaagaagcccaaatactcttacaagaccgtggaagagttgaaggccaagggcaggattagcaagaagctcactgctccccagaaggaactttctcaagtcaaggtcatagacatgacaggccgggagcagaaggtctactacagctacagtcagatcagccacaagcacaacgttcccgatgatgggctgccgctacagtcccaacagctgccacagtctggcaaagaggccaaggcccccggcttcgcgctgcccgagctggagcacaacctgcagctgctcatcgacctcacggagcaggagatcatccagaatgaccggcagctacagtatgagcgggacatggtggtcaacctcttccacgagctggagaagatgaccgaggtcctggaccacgaggagcgggtcatctcgaacctcagcaaggtcctggagatggtggaggagtgcgagcggcggatgcagcccgactgcagcaaccccctcaccctggacgagtgtgcccgcatcttcgaaaccctgcaggacaagtactatgaggagtacaggatgtccgaccgtgtggaccttgctgtggccatcgtctatccactcatgaaggagtacttcaaggagtgggatcccctcaaagactgcacttatggcaccgagatcatctctaagtggaaaagcctcctagagaatgaccagctcttgtcccatggcggacaggacctctcagcagatgcctttcacaggttgatatgggaagtctggatgccttttgttcgaaatattgtcacccagtggcagccaaggaactgtgacccgatggtggactttttggatagttgggtgcacattattcctgtgtggatcttagataacatactggaccaactcatcttccccaagctgcaaaaggaggtggaaaactggaacccgctcacagacactgttcccatccactcttggatccacccatggctgccccttatgcaggcacggctggagccactctattcccccatccgtagtaagctgtccagcgccctgcagaagtggcaccccagcgactcctctgccaagctcatcctccagccctggaaggatgtcttcactcctggctcctgggaagcattcatggtcaaaaacatagtgcccaagctggggatgtgtcttggtgagctagtcattaacccccaccagcagcacatggatgcattctattgggtgattgactgggaagggatgatctctgtctctagcctggtgggacttcttgaaaagcacttcttccccaagtggcttcaggtgctgtgctcttggctcagtaacagcccaaattatgaggagatcaccaagtggtacctgggttggaagtcgatgttctcagaccaagtgctggcacatccatctgtcaaggacaaatttaatgaggcacttgatatcatgaaccgggcggtgtcctccaacgttggtgcctacatgcagccaggagcacgggagaacattgcctatctcacccacacggagcggaggaaggacttccagtacgaggccatgcaggagaggcgggaggctgagaacatggctcagaggggcattggcgtggccgctagctctgtgcccatgaactttaaggacctcattgagaccaaggctgaggagcacaacattgtcttcatgcccgtcattgggaagcgacacgaagggaagcagctctacacctttggccgcattgtgatctacatcgaccggggagtggtctttgtccagggcgagaagacgtgggtgcccacctcactgcagagcctgatcgacatggccaagtgaactgtggcaggtccagaaccagtcagagacttgcccctaagagggatgtactgtaaataaacagtatttttagatcaccttcaaaagggtaacttctttactcaggagctactccacatcaggccaggtcatgagggaaggatgtaaaatgggacaatgccacgtagggcaggaatctttataccaagtcctcatgtggggtatcgtcctcaaaacaggacagccaagttgatgttctttcctggcaaaggagttctctgtagttcctccatagcagccttccctttagtctctggtggcagcttctacctcagccaacactgagtacctcacaacgagttcagtcagtagcagaaggatcttctctcttgttcctgatgatttcaaggtcctcacagtcctgataatctggttcttcccgaaactcccaaatatctatggagagctgttctagcttttgcacagggaaccagtggacagaggtatcattaaatatgtccatgtattgtgaagtctgaggaaactcaagctcctccagtccttttaaaatctgagcagaaaaattcaagtataaaaacttcagatagtcacagtaatccccactcttctgggataaatttccactttacttgtcatccccactttactttttaaaaaaataacaaatagggtattttgatttaaatgcttttgcacaatgaattgggcgccccaaggacagtggatatcatggactgtgatactaagaataaaggaaataaggaaaaaactaagagatgcattaaaga

SEQ ID NO: 196224 - DNA, 2789 bp, Homo sapiens
  Payload ID: 18710
  Gene Name: tuftelin interacting protein 11
  Uniprot ID: Q9UBB9
  ENST ID: ENST00000407148
  CDS Start-End: 190-2703
atttccggcgcgccggccacggtgcttccgggttctggtgtaggagcggcgtcttctcgcgcggatggtgaagctgaatttggtacgctggaccctcggacagacagcaagagagagacaagcccgaggcctgacttctagcactcctgagtttgagccctatgagcagtggaacctaggtgactggccatgtcattgtcccacttataccgggatggggaaggccgcattgatgatgatgatgacgagcgggagaactttgagatcactgactgggatctccagaatgagttcaaccccaaccgacagcgccactggcagaccaaggaagaagccacctacggggtgtgggcagagcgagactcggatgatgagaggcccagctttggaggcaaacgggcccgtgactactctgcgccagtcaacttcatcagcgcagggctcaagaaaggggcagcggaggaggcagagttggaagattctgatgacgaagagaaacctgttaagcaggacgactttcctaaggattttggaccaaggaagctaaaaacgggtggcaattttaagcccagccagaaaggttttgcaggaggaaccaaatctttcatggacttcggcagctgggaaagacacacaaaaggaattggacagaagcttcttcagaagatgggctacgtccctggacggggcctcgggaagaatgcacaaggtatcattaacccaattgaagccaagcagagaaagggaaaaggtgctgtgggggcttatggatccgagcgcaccactcagtccatgcaagacttccctgtggttgactcagaggaagaagctgaagaggagtttcagaaggagctgagccagtggaggaaagacccaagtggaagcaagaagaagcccaaatactcttacaagaccgtggaagagttgaaggccaagggcaggattagcaagaagctcactgctccccagaaggaactttctcaagtcaaggtcatagacatgacaggccgggagcagaaggtctactacagctacagtcagatcagccacaagcacaacgttcccgatgatgggctgccgctacagtcccaacagctgccacagtctggcaaagaggccaaggcccccggcttcgcgctgcccgagctggagcacaacctgcagctgctcatcgacctcacggagcaggagatcatccagaatgaccggcagctacagtatgagcgggacatggtggtcaacctcttccacgagctggagaagatgaccgaggtcctggaccacgaggagcgggtcatctcgaacctcagcaaggtcctggagatggtggaggagtgcgagcggcggatgcagcccgactgcagcaaccccctcaccctggacgagtgtgcccgcatcttcgaaaccctgcaggacaagtactatgaggagtacaggatgtccgaccgtgtggaccttgctgtggccatcgtctatccactcatgaaggagtacttcaaggagtgggatcccctcaaagactgcacttatggcaccgagatcatctctaagtggaaaagcctcctagagaatgaccagctcttgtcccatggcggacaggacctctcagcagatgcctttcacaggttgatatgggaagtctggatgccttttgttcgaaatattgtcacccagtggcagccaaggaactgtgacccgatggtggactttttggatagttgggtgcacattattcctgtgtggatcttagataacatactggaccaactcatcttccccaagctgcaaaaggaggtggaaaactggaacccgctcacagacactgttcccatccactcttggatccacccatggctgccccttatgcaggcacggctggagccactctattcccccatccgtagtaagctgtccagcgccctgcagaagtggcaccccagcgactcctctgccaagctcatcctccagccctggaaggatgtcttcactcctggctcctgggaagcattcatggtcaaaaacatagtgcccaagctggggatgtgtcttggtgagctagtcattaacccccaccagcagcacatggatgcattctattgggtgattgactgggaagggatgatctctgtctctagcctggtgggacttcttgaaaagcacttcttccccaagtggcttcaggtgctgtgctcttggctcagtaacagcccaaattatgaggagatcaccaagtggtacctgggttggaagtcgatgttctcagaccaagtgctggcacatccatctgtcaaggacaaatttaatgaggcacttgatatcatgaaccgggcggtgtcctccaacgttggtgcctacatgcagccaggagcacgggagaacattgcctatctcacccacacggagcggaggaaggacttccagtacgaggccatgcaggagaggcgggaggctgagaacatggctcagaggggcattggcgtggccgctagctctgtgcccatgaactttaaggacctcattgagaccaaggctgaggagcacaacattgtcttcatgcccgtcattgggaagcgacacgaagggaagcagctctacacctttggccgcattgtgatctacatcgaccggggagtggtctttgtccagggcgagaagacgtgggtgcccacctcactgcagagcctgatcgacatggccaagtgaactgtggcaggtccagaaccagtcagagacttgcccctaagagggatgtactgtaaataaacagtatttttagatcaccttcaaaa

SEQ ID NO: 196225 - DNA, 571 bp, Homo sapiens
  Payload ID: 18710
  Gene Name: tuftelin interacting protein 11
  ENST ID: ENST00000450493
  CDS Start-End: 1-571
ctggacggggcctcgggaagaatgcacaaggtatcattaacccaattgaagccaagcagagaaagggaaaaggtgctgtgggggcttatggatccgagcgcaccactcagtccatgcaagacttccctgtggttgactcagaggaagaagctgaagagtggttgttccttgctgcatctgactgtattcttctggttcaggagtttcagaaggagctgagccagtggaggaaagacccaagtggaagcaagaagaagcccaaatactcttacaagaccgtggaagagttgaaggccaagggcaggattagcaagaagctcactgctccccagaaggaactttctcaagtcaaggtcatagacatgacaggccgggagcagaaggtctactacagctacagtcagatcagccacaagcacaacgttcccgatgatgggctgccgctacagtcccaacagctgccacagtctggcaaagaggccaaggcccccggcttcgcgctgcccgagctggagcacaacctgcagctgctcatcgacctcacggagcaggagatcatccagaatgaccg

SEQ ID NO: 196226 - DNA, 525 bp, Homo sapiens
  Payload ID: 18710
  Gene Name: tuftelin interacting protein 11
  ENST ID: ENST00000420242
  CDS Start-End: 266-525
atttccggcgcgccggccacggtgcttccgggttctggtgtaggagcggcgtcttctcgcgcggatggtgaagctgaatttggtacgctggaccctcggacagacagcaagagagagacaagcccgaggcctgacttctagcactcctgagtttgagccctatgagcagtggaacctagggatccagatataattctttcctcagtaatagaaaaaagaatctgggatctaagaagatacctactcattttctaagtgactggccatgtcattgtcccacttataccgggatggggaaggccgcattgatgatgatgatgacgagcgggagaactttgagatcactgactgggatctccagaatgagttcaaccccaaccgacagcgccactggcagaccaaggaagaagccacctacggggtgtgggcagagcgagactcggatgatgagaggcccagctttggaggcaaacgggcccgtgactactctgcgccagtcaacttcatcagcgcagggctcaagaa

SEQ ID NO: 196227 - DNA, 638 bp, Homo sapiens
  Payload ID: 18710
  Gene Name: tuftelin interacting protein 11
  ENST ID: ENST00000455080
  CDS Start-End: 275-638
ggtgtaggagcggcgtcttctcgcgcggatggtgaagctgaatttggtacgctggaccctcggacagacagcaagagagagacaagcccgaggcctgacttctagcactcctgagtttgagccctatgagcagtggaacctaggcctgcagacagcctattgtgggaccttttgatcgtgaccaccaaggatccagatataattctttcctcagtaatagaaaaaagaatctgggatctaagaagatacctactcattttctaagtgactggccatgtcattgtcccacttataccgggatggggaaggccgcattgatgatgatgatgacgagcgggagaactttgagatcactgactgggatctccagaatgagttcaaccccaaccgacagcgccactggcagaccaaggaagaagccacctacggggtgtgggcagagcgagactcggatgatgagaggcccagctttggaggcaaacgggcccgtgactactctgcgccagtcaacttcatcagcgcagggctcaagaaaggggcagcggaggaggcagagttggaagattctgatgacgaagagaaacctgttaagcaggacgactttcctaaggattttggaccaaggaagctaaaaacgg

SEQ ID NO: 196228 - DNA, 563 bp, Homo sapiens
  Payload ID: 18710
  Gene Name: tuftelin interacting protein 11
  ENST ID: ENST00000418876
  CDS Start-End: 300-563
acggtgcttccgggttctggtgtaggagcggcgtcttctcgcgcggatggtgaagctgaatttggtacgctggaccctcggacagacagcaagagagagacaagcccgaggcctgacttctagcactcctgagtttgagccctatgagcagtggaacctaggttcttcagctttggaacttgactggctctccttgctcctcagcctgcagacagcctattgtgggaccttttgatcgttaatagaaaaaagaatctgggatctaagaagatacctactcattttctaagtgactggccatgtcattgtcccacttataccgggatggggaaggccgcattgatgatgatgatgacgagcgggagaactttgagatcactgactgggatctccagaatgagttcaaccccaaccgacagcgccactggcagaccaaggaagaagccacctacggggtgtgggcagagcgagactcggatgatgagaggcccagctttggaggcaaacgggcccgtgactactctgcgccagtcaacttcatcagcgcagggctcaagaaaggg

SEQ ID NO: 196229 - DNA, 595 bp, Homo sapiens
  Payload ID: 18710
  Gene Name: tuftelin interacting protein 11
  ENST ID: ENST00000440258
  CDS Start-End: 468-595
gcgcgccggccacggtgcttccgggttctggtgtaggagcggcgtcttctcgcgcggatggtgaagctgaatttggtacgctggaccctcggacagacagcaagagagagacaagcccgaggcctgacttctagcactcctgagtttgagccctatgagcagtggaacctaggctgccagcacggcaagaatataagcaggcagaaaaatgtgaaaagagagactggcctagcctcccagcctatatctttctcctgtgctggatgcttcctgccctcgaacattggacttcaagttcttcagctttggaacttgactggctctccttgctcctcagcctgcagacagcctattgtgggaccttttgatcgtgaccaccaaggatccagatataattctttcctcagtaatagaaaaaagaatctgggatctaagaagatacctactcattttctaagtgactggccatgtcattgtcccacttataccgggatggggaaggccgcattgatgatgatgatgacgagcgggagaactttgagatcactgactgggatctccagaatgagttcaaccccaaccgacagcgccactg

SEQ ID NO: 196230 - DNA, 3402 bp, Homo sapiens
  Payload ID: 18710
  Gene Name: tuftelin interacting protein 11
  Uniprot ID: Q9UBB9
  ENST ID: ENST00000619735
  CDS Start-End: 101-2614
cctaggaccaccaaggatccagatataattctttcctcagtaatagaaaaaagaatctgggatctaagaagatacctactcattttctaagtgactggccatgtcattgtcccacttataccgggatggggaaggccgcattgatgatgatgatgacgagcgggagaactttgagatcactgactgggatctccagaatgagttcaaccccaaccgacagcgccactggcagaccaaggaagaagccacctacggggtgtgggcagagcgagactcggatgatgagaggcccagctttggaggcaaacgggcccgtgactactctgcgccagtcaacttcatcagcgcagggctcaagaaaggggcagcggaggaggcagagttggaagattctgatgacgaagagaaacctgttaagcaggacgactttcctaaggattttggaccaaggaagctaaaaacgggtggcaattttaagcccagccagaaaggttttgcaggaggaaccaaatctttcatggacttcggcagctgggaaagacacacaaaaggaattggacagaagcttcttcagaagatgggctacgtccctggacggggcctcgggaagaatgcacaaggtatcattaacccaattgaagccaagcagagaaagggaaaaggtgctgtgggggcttatggatccgagcgcaccactcagtccatgcaagacttccctgtggttgactcagaggaagaagctgaagaggagtttcagaaggagctgagccagtggaggaaagacccaagtggaagcaagaagaagcccaaatactcttacaagaccgtggaagagttgaaggccaagggcaggattagcaagaagctcactgctccccagaaggaactttctcaagtcaaggtcatagacatgacaggccgggagcagaaggtctactacagctacagtcagatcagccacaagcacaacgttcccgatgatgggctgccgctacagtcccaacagctgccacagtctggcaaagaggccaaggcccccggcttcgcgctgcccgagctggagcacaacctgcagctgctcatcgacctcacggagcaggagatcatccagaatgaccggcagctacagtatgagcgggacatggtggtcaacctcttccacgagctggagaagatgaccgaggtcctggaccacgaggagcgggtcatctcgaacctcagcaaggtcctggagatggtggaggagtgcgagcggcggatgcagcccgactgcagcaaccccctcaccctggacgagtgtgcccgcatcttcgaaaccctgcaggacaagtactatgaggagtacaggatgtccgaccgtgtggaccttgctgtggccatcgtctatccactcatgaaggagtacttcaaggagtgggatcccctcaaagactgcacttatggcaccgagatcatctctaagtggaaaagcctcctagagaatgaccagctcttgtcccatggcggacaggacctctcagcagatgcctttcacaggttgatatgggaagtctggatgccttttgttcgaaatattgtcacccagtggcagccaaggaactgtgacccgatggtggactttttggatagttgggtgcacattattcctgtgtggatcttagataacatactggaccaactcatcttccccaagctgcaaaaggaggtggaaaactggaacccgctcacagacactgttcccatccactcttggatccacccatggctgccccttatgcaggcacggctggagccactctattcccccatccgtagtaagctgtccagcgccctgcagaagtggcaccccagcgactcctctgccaagctcatcctccagccctggaaggatgtcttcactcctggctcctgggaagcattcatggtcaaaaacatagtgcccaagctggggatgtgtcttggtgagctagtcattaacccccaccagcagcacatggatgcattctattgggtgattgactgggaagggatgatctctgtctctagcctggtgggacttcttgaaaagcacttcttccccaagtggcttcaggtgctgtgctcttggctcagtaacagcccaaattatgaggagatcaccaagtggtacctgggttggaagtcgatgttctcagaccaagtgctggcacatccatctgtcaaggacaaatttaatgaggcacttgatatcatgaaccgggcggtgtcctccaacgttggtgcctacatgcagccaggagcacgggagaacattgcctatctcacccacacggagcggaggaaggacttccagtacgaggccatgcaggagaggcgggaggctgagaacatggctcagaggggcattggcgtggccgctagctctgtgcccatgaactttaaggacctcattgagaccaaggctgaggagcacaacattgtcttcatgcccgtcattgggaagcgacacgaagggaagcagctctacacctttggccgcattgtgatctacatcgaccggggagtggtctttgtccagggcgagaagacgtgggtgcccacctcactgcagagcctgatcgacatggccaagtgaactgtggcaggtccagaaccagtcagagacttgcccctaagagggatgtactgtaaataaacagtatttttagatcaccttcaaaagggtaacttctttactcaggagctactccacatcaggccaggtcatgagggaaggatgtaaaatgggacaatgccacgtagggcaggaatctttataccaagtcctcatgtggggtatcgtcctcaaaacaggacagccaagttgatgttctttcctggcaaaggagttctctgtagttcctccatagcagccttccctttagtctctggtggcagcttctacctcagccaacactgagtacctcacaacgagttcagtcagtagcagaaggatcttctctcttgttcctgatgatttcaaggtcctcacagtcctgataatctggttcttcccgaaactcccaaatatctatggagagctgttctagcttttgcacagggaaccagtggacagaggtatcattaaatatgtccatgtattgtgaagtctgaggaaactcaagctcctccagtccttttaaaatctgagcagaaaaattcaagtataaaaacttcagatagtcacagtaatccccactcttctgggataaatttccactttacttgtcatccccactttactttttaaaaaaataacaaatagggtattttgatttaaatgcttttgcacaatgaattgggcgccccaaggacagtggatatcatggactgtgatactaagaataaaggaaataaggaaaaaactaagagatgcattaaaga

SEQ ID NO: 196231 - DNA, 1676 bp, Homo sapiens
  Payload ID: 18711
  Gene Name: tumor necrosis factor
  Uniprot ID: P01375
  ENST ID: ENST00000376122
  CDS Start-End: 176-877
cagacgctccctcagcaaggacagcagaggaccagctaagagggagagaagcaactacagaccccccctgaaaacaaccctcagacgccacatcccctgacaagctgccaggcaggttctcttcctctcacatactgacccacggctccaccctctctcccctggaaaggacaccatgagcactgaaagcatgatccgggacgtggagctggccgaggaggcgctccccaagaagacaggggggccccagggctccaggcggtgcttgttcctcagcctcttctccttcctgatcgtggcaggcgccaccacgctcttctgcctgctgcactttggagtgatcggcccccagagggaagagttccccagggacctctctctaatcagccctctggcccaggcagtcagatcatcttctcgaaccccgagtgacaagcctgtagcccatgttgtagcaaaccctcaagctgaggggcagctccagtggctgaaccgccgggccaatgccctcctggccaatggcgtggagctgagagataaccagctggtggtgccatcagagggcctgtacctcatctactcccaggtcctcttcaagggccaaggctgcccctccacccatgtgctcctcacccacaccatcagccgcatcgccgtctcctaccagaccaaggtcaacctcctctctgccatcaagagcccctgccagagggagaccccagagggggctgaggccaagccctggtatgagcccatctatctgggaggggtcttccagctggagaagggtgaccgactcagcgctgagatcaatcggcccgactatctcgactttgccgagtctgggcaggtctactttgggatcattgccctgtgaggaggacgaacatccaaccttcccaaacgcctcccctgccccaatccctttattaccccctccttcagacaccctcaacctcttctggctcaaaaagagaattgggggcttagggtcggaacccaagcttagaactttaagcaacaagaccaccacttcgaaacctgggattcaggaatgtgtggcctgcacagtgaagtgctggcaaccactaagaattcaaactggggcctccagaactcactggggcctacagctttgatccctgacatctggaatctggagaccagggagcctttggttctggccagaatgctgcaggacttgagaagacctcacctagaaattgacacaagtggaccttaggccttcctctctccagatgtttccagacttccttgagacacggagcccagccctccccatggagccagctccctctatttatgtttgcacttgtgattatttattatttatttattatttatttatttacagatgaatgtatttatttgggagaccggggtatcctgggggacccaatgtaggagctgccttggctcagacatgttttccgtgaaaacggagctgaacaataggctgttcccatgtagccccctggcctctgtgccttcttttgattatgttttttaaaatatttatctgattaagttgtctaaacaatgctgatttggtgaccaactgtcactcattgctgagcctctgctccccaggggagttgtgtctgtaatcgccctactattcagtggcgagaaataaagtttgcttagaaaagaaa

SEQ ID NO: 196232 - DNA, 1676 bp, Homo sapiens; identical to SEQ ID NO: 196231
  Payload ID: 18711
  Gene Name: tumor necrosis factor
  Uniprot ID: P01375
  ENST ID: ENST00000383496
  CDS Start-End: 176-877

SEQ ID NO: 196233 - DNA, 1315 bp, Homo sapiens
  Payload ID: 18711
  Gene Name: tumor necrosis factor
  ENST ID: ENST00000445232
  CDS Start-End: 1-516
ttccccagggacctctctctaatcagccctctggcccaggcagtcagatcatcttctcgaaccccgagtgacaagcctgtagcccatgttgtagcaaaccctcaagctgaggggcagctccagtggctgaaccgccgggccaatgccctcctggccaatggcgtggagctgagagataaccagctggtggtgccatcagagggcctgtacctcatctactcccaggtcctcttcaagggccaaggctgcccctccacccatgtgctcctcacccacaccatcagccgcatcgccgtctcctaccagaccaaggtcaacctcctctctgccatcaagagcccctgccagagggagaccccagagggggctgaggccaagccctggtatgagcccatctatctgggaggggtcttccagctggagaagggtgaccgactcagcgctgagatcaatcggcccgactatctcgactttgccgagtctgggcaggtctactttgggatcattgccctgtgaggaggacgaacatccaaccttcccaaacgcctcccctgccccaatccctttattaccccctccttcagacaccctcaacctcttctggctcaaaaagagaattgggggcttagggtcggaacccaagcttagaactttaagcaacaagaccaccacttcgaaacctgggattcaggaatgtgtggcctgcacagtgaagtgctggcaaccactaagaattcaaactggggcctccagaactcactggggcctacagctttgatccctgacatctggaatctggagaccagggagcctttggttctggccagaatgctgcaggacttgagaagacctcacctagaaattgacacaagtggaccttaggccttcctctctccagatgtttccagacttccttgagacacggagcccagccctccccatggagccagctccctctatttatgtttgcacttgtgattatttattatttatttattatttatttatttacagatgaatgtatttatttgggagaccggggtatcctgggggacccaatgtaggagctgccttggctcagacatgttttccgtgaaaacggagctgaacaataggctgttcccatgtagccccctggcctctgtgccttcttttgattatgttttttaaaatatttatctgattaagttgtctaaacaatgctgatttggtgaccaactgtcactcattgctgagcctctgctccccaggggagttgtgtctgtaatcgccctactattcagtggcgagaaataaagtttgcttagaaaagaaa

SEQ ID NO: 196234 - DNA, 1676 bp, Homo sapiens; identical to SEQ ID NO: 196231
  Payload ID: 18711
  Gene Name: tumor necrosis factor
  Uniprot ID: P01375
  ENST ID: ENST00000448781
  CDS Start-End: 176-877

SEQ ID NO: 196235 - DNA, 1676 bp, Homo sapiens; identical to SEQ ID NO: 196231
  Payload ID: 18711
  Gene Name: tumor necrosis factor
  Uniprot ID: P01375
  ENST ID: ENST00000443707
  CDS Start-End: 176-877

SEQ ID NO: 196236 - DNA, 1676 bp, Homo sapiens; identical to SEQ ID NO: 196231
  Payload ID: 18711
  Gene Name: tumor necrosis factor
  Uniprot ID: P01375
  ENST ID: ENST00000412275
  CDS Start-End: 176-877

SEQ ID NO: 196237 - DNA, 1676 bp, Homo sapiens; identical to SEQ ID NO: 196231
  Payload ID: 18711
  Gene Name: tumor necrosis factor
  Uniprot ID: P01375
  ENST ID: ENST00000449264
  CDS Start-End: 176-877

SEQ ID NO: 196238 - DNA, 1676 bp, Homo sapiens; identical to SEQ ID NO: 196231
  Payload ID: 18711
  Gene Name: tumor necrosis factor
  Uniprot ID: P01375
  ENST ID: ENST00000420425
  CDS Start-End: 176-877

SEQ ID NO: 196239 - DNA, 1953 bp, Homo sapiens
  Payload ID: 18712
  Gene Name: tumor necrosis factor (ligand) superfamily, member 10
  Uniprot ID: P50591
  ENST ID: ENST00000241261
  CDS Start-End: 124-969
acagaacccagaaaaacaactcattcgctttcatttcctcactgactataaaagaatagagaaggaagggcttcagtgaccggctgcctggctgacttacagcagtcagactctgacaggatcatggctatgatggaggtccaggggggacccagcctgggacagacctgcgtgctgatcgtgatcttcacagtgctcctgcagtctctctgtgtggctgtaacttacgtgtactttaccaacgagctgaagcagatgcaggacaagtactccaaaagtggcattgcttgtttcttaaaagaagatgacagttattgggaccccaatgacgaagagagtatgaacagcccctgctggcaagtcaagtggcaactccgtcagctcgttagaaagatgattttgagaacctctgaggaaaccatttctacagttcaagaaaagcaacaaaatatttctcccctagtgagagaaagaggtcctcagagagtagcagctcacataactgggaccagaggaagaagcaacacattgtcttctccaaactccaagaatgaaaaggctctgggccgcaaaataaactcctgggaatcatcaaggagtgggcattcattcctgagcaacttgcacttgaggaatggtgaactggtcatccatgaaaaagggttttactacatctattcccaaacatactttcgatttcaggaggaaataaaagaaaacacaaagaacgacaaacaaatggtccaatatatttacaaatacacaagttatcctgaccctatattgttgatgaaaagtgctagaaatagttgttggtctaaagatgcagaatatggactctattccatctatcaagggggaatatttgagcttaaggaaaatgacagaatttttgtttctgtaacaaatgagcacttgatagacatggaccatgaagccagtttttttggggcctttttagttggctaactgacctggaaagaaaaagcaataacctcaaagtgactattcagttttcaggatgatacactatgaagatgtttcaaaaaatctgaccaaaacaaacaaacagaaaacagaaaacaaaaaaacctctatgcaatctgagtagagcagccacaaccaaaaaattctacaacacacactgttctgaaagtgactcacttatcccaagagaatgaaattgctgaaagatctttcaggactctacctcatatcagtttgctagcagaaatctagaagactgtcagcttccaaacattaatgcaatggttaacatcttctgtctttataatctactccttgtaaagactgtagaagaaagagcaacaatccatctctcaagtagtgtatcacagtagtagcctccaggtttccttaagggacaacatccttaagtcaaaagagagaagaggcaccactaaaagatcgcagtttgcctggtgcagtggctcacacctgtaatcccaacattttgggaacccaaggtgggtagatcacgagatcaagagatcaagaccatagtgaccaacatagtgaaaccccatctctactgaaagtacaaaaattagctgggtgtgttggcacatgcctgtagtcccagctacttgagaggctgaggcaagagaattgtttgaacccgggaggcagaggttgcagtgtggtgagatcatgccactacactccagcctggcgacagagcgagacttggtttcaaaaaaaaaaaaaaaaaaaacttcagtaagtacgtgttatttttttcaataaaattctattacagtatgtcatgtttgctgtagtgctcatatttattgttgtttttgttttagtactcacttgtttcataatatcaagattactaaaaatgggggaaaagacttctaatctttttttcataatatctttgacacatattacagaagaaataaatttcttacttttaatttaatatga

SEQ ID NO: 196240 - DNA, 1619 bp, Homo sapiens
  Payload ID: 18712
  Gene Name: tumor necrosis factor (ligand) superfamily, member 10
  Uniprot ID: P50591
  ENST ID: ENST00000420541
  CDS Start-End: 92-397
atttcctcactgactataaaagaatagagaaggaagggcttcagtgaccggctgcctggctgacttacagcagtcagactctgacaggatcatggctatgatggaggtccaggggggacccagcctgggacagacctgcgtgctgatcgtgatcttcacagtgctcctgcagtctctctgtgtggctgtaacttacgtgtactttaccaacgagctgaagcagatgcaggacaagtactccaaaagtggcattgcttgtttcttaaaagaagatgacagttattgggaccccaatgacgaagagagtatgaacagcccctgctggcaagtcaagtggcaactccgtcagctcgttagaaagactccaagaatgaaaaggctctgggccgcaaaataaactcctgggaatcatcaaggagtgggcattcattcctgagcaacttgcacttgaggaatggtgaactggtcatccatgaaaaagggttttactacatctattcccaaacatactttcgatttcaggaggaaataaaagaaaacacaaagaacgacaaacaaatggtccaatatatttacaaatacacaagttatcctgaccctatattgttgatgaaaagtgctagaaatagttgttggtctaaagatgcagaatatggactctattccatctatcaagggggaatatttgagcttaaggaaaatgacagaatttttgtttctgtaacaaatgagcacttgatagacatggaccatgaagccagtttttttggggcctttttagttggctaactgacctggaaagaaaaagcaataacctcaaagtgactattcagttttcaggatgatacactatgaagatgtttcaaaaaatctgaccaaaacaaacaaacagaaaacagaaaacaaaaaaacctctatgcaatctgagtagagcagccacaaccaaaaaattctacaacacacactgttctgaaagtgactcacttatcccaagagaatgaaattgctgaaagatctttcaggactctacctcatatcagtttgctagcagaaatctagaagactgtcagcttccaaacattaatgcaatggttaacatcttctgtctttataatctactccttgtaaagactgtagaagaaagagcaacaatccatctctcaagtagtgtatcacagtagtagcctccaggtttccttaagggacaacatccttaagtcaaaagagagaagaggcaccactaaaagatcgcagtttgcctggtgcagtggctcacacctgtaatcccaacattttgggaacccaaggtgggtagatcacgagatcaagagatcaagaccatagtgaccaacatagtgaaaccccatctctactgaaagtacaaaaattagctgggtgtgttggcacatgcctgtagtcccagctacttgagaggctgaggcaagagaattgtttgaacccgggaggcagaggttgcagtgtggtgagatcatgccactacactccagcctggcgacagagcgagacttggtttcaaaaaaaaaaaaaaaaaaaacttcagtaagtacgtgttatttttttcaataaaattctattacagtatgtcatgtttgctgtag

SEQ ID NO: 196241 - DNA, 467 bp, Homo sapiens
  Payload ID: 18712
  Gene Name: tumor necrosis factor (ligand) superfamily, member 10
  ENST ID: ENST00000430881
  CDS Start-End: 1-223
cctgcagtctctctgtgtggctgtaacttacgtgtactttaccaacgagctgaagcagatgcaggacaagtactccaaaagtggcattgcttgtttcttaaaagaagatgacagttattgggaccccaatgacgaagagagtatgaacagcccctgctggcaagtcaagtggcaactccgtcagctcgttagaaagaaaagcaacaaaatatttctcccctagtgagagaaagaggtcctcagagagtagcagctcacataactgggaccagaggaagaagcaacacattgtcttctccaaagacgccatctgcttggatgtgcctttgactctggagagctgagaaagatcaaggggggacccaaagagtccaaaaggaatggcaagaacttctgagatttaggcctaaagaaatagatacgtttatttcggtttccttctggattgtccacttaagttcaccagc

SEQ ID NO: 196242 - DNA, 911 bp, Homo sapiens
  Payload ID: 18713
  Gene Name: tumor necrosis factor (ligand) superfamily, member 11
  Uniprot ID: O14788
  ENST ID: ENST00000239849
  CDS Start-End: 99-911
atgcgccgcgccagcagagactacaccaagtacctgcgtggctcggaggagatgggcggcggccccggagccccgcacgagggccccctgcacgctccatgttcgtggccctcctggggctggggctgggccaggttgtctgcagcgtcgccctgttcttctatttcagagcgcagatggatcctaatagaatatcagaagatggcactcactgcatttatagaattttgagactccatgaaaatgcagattttcaagacacaactctggagagtcaagatacaaaattaatacctgattcatgtaggagaattaaacaggcctttcaaggagctgtgcaaaaggaattacaacatatcgttggatcacagcacatcagagcagagaaagcgatggtggatggctcatggttagatctggccaagaggagcaagcttgaagctcagccttttgctcatctcactattaatgccaccgacatcccatctggttcccataaagtgagtctgtcctcttggtaccatgatcggggttgggccaagatctccaacatgacttttagcaatggaaaactaatagttaatcaggatggcttttattacctgtatgccaacatttgctttcgacatcatgaaacttcaggagacctagctacagagtatcttcaactaatggtgtacgtcactaaaaccagcatcaaaatcccaagttctcataccctgatgaaaggaggaagcaccaagtattggtcagggaattctgaattccatttttattccataaacgttggtggattttttaagttacggtctggagaggaaatcagcatcgaggtctccaacccctccttactggatccggatcaggatgcaacatactttggggcttttaaagttcgagatatagattga

SEQ ID NO: 196243 - DNA, 1520 bp, Homo sapiens
  Payload ID: 18713
  Gene Name: tumor necrosis factor (ligand) superfamily, member 11
  Uniprot ID: O14788
  ENST ID: ENST00000358545
  CDS Start-End: 530-1264
ctgaaagcaaatggtgtggccgaagctgcctctctggtggcatagctaagaccaagctgcacgcagtgaaaacacagtttgttttcactgacaacaaggcagaatgtgtaccagggatgtgacgtggggaaccaggaagaggacagtctgaggatcattattaaagggactccatccaagaaggtttccagccagaggcaagctgtagccagaagaaaagaatgagagatcacctgaataatagaacagaaactgctgaaatattgaacacagatctagatcaaatgaaggaacatattcaggatgaagcataaataaaggccaggcgtggtggctcatgcctggaatctcagctctttgggaggccgaggctattctccatctcctgggctccagtgatcctcacgcctcggccacccaaagtgctgggattatagaagtgaaccactgcgcctggcctattgaaggtttttaatcttcagagtttcgactttatcaacaacacttagaagccaccaaagaattgcagatggatcctaatagaatatcagaagatggcactcactgcatttatagaattttgagactccatgaaaatgcagattttcaagacacaactctggagagtcaagatacaaaattaatacctgattcatgtaggagaattaaacaggcctttcaaggagctgtgcaaaaggaattacaacatatcgttggatcacagcacatcagagcagagaaagcgatggtggatggctcatggttagatctggccaagaggagcaagcttgaagctcagccttttgctcatctcactattaatgccaccgacatcccatctggttcccataaagtgagtctgtcctcttggtaccatgatcggggttgggccaagatctccaacatgacttttagcaatggaaaactaatagttaatcaggatggcttttattacctgtatgccaacatttgctttcgacatcatgaaacttcaggagacctagctacagagtatcttcaactaatggtgtacgtcactaaaaccagcatcaaaatcccaagttctcataccctgatgaaaggaggaagcaccaagtattggtcagggaattctgaattccatttttattccataaacgttggtggattttttaagttacggtctggagaggaaatcagcatcgaggtctccaacccctccttactggatccggatcaggatgcaacatactttggggcttttaaagttcgagatatagattgagccccagtttttggagtgttatgtatttcctggatgtttggaaacattttttaaaacaagccaagaaagatgtatataggtgtgtgagactactaagaggcatggccccaacggtacacgactcagtatccatgctcttgaccttgtagagaacacgcgtatttacagccagtgggagatgttagactcatggtgtgttacacaatggtttttaaattttgtaatgaattcctagaattaaaccagattggagcaa

SEQ ID NO: 196244 - DNA, 2199 bp, Homo sapiens
  Payload ID: 18713
  Gene Name: tumor necrosis factor (ligand) superfamily, member 11
  Uniprot ID: O14788
  ENST ID: ENST00000398795
  CDS Start-End: 152-1105
cccgctcgcccgcgcgccccaggacccaaagccgggctccaagtcggcgccccacgtcgaggctccgccgcagcctccggagttggccgcagacaagaaggggagggagcgggagagggaggagagctccgaagcgagagggccgagcgccatgcgccgcgccagcagagactacaccaagtacctgcgtggctcggaggagatgggcggcggccccggagccccgcacgagggccccctgcacgccccgccgccgcctgcgccgcaccagccccctgccgcctcccgctccatgttcgtggccctcctggggctggggctgggccaggttgtctgcagcgtcgccctgttcttctatttcagagcgcagatggatcctaatagaatatcagaagatggcactcactgcatttatagaattttgagactccatgaaaatgcagattttcaagacacaactctggagagtcaagatacaaaattaatacctgattcatgtaggagaattaaacaggcctttcaaggagctgtgcaaaaggaattacaacatatcgttggatcacagcacatcagagcagagaaagcgatggtggatggctcatggttagatctggccaagaggagcaagcttgaagctcagccttttgctcatctcactattaatgccaccgacatcccatctggttcccataaagtgagtctgtcctcttggtaccatgatcggggttgggccaagatctccaacatgacttttagcaatggaaaactaatagttaatcaggatggcttttattacctgtatgccaacatttgctttcgacatcatgaaacttcaggagacctagctacagagtatcttcaactaatggtgtacgtcactaaaaccagcatcaaaatcccaagttctcataccctgatgaaaggaggaagcaccaagtattggtcagggaattctgaattccatttttattccataaacgttggtggattttttaagttacggtctggagaggaaatcagcatcgaggtctccaacccctccttactggatccggatcaggatgcaacatactttggggcttttaaagttcgagatatagattgagccccagtttttggagtgttatgtatttcctggatgtttggaaacattttttaaaacaagccaagaaagatgtatataggtgtgtgagactactaagaggcatggccccaacggtacacgactcagtatccatgctcttgaccttgtagagaacacgcgtatttacagccagtgggagatgttagactcatggtgtgttacacaatggtttttaaattttgtaatgaattcctagaattaaaccagattggagcaattacggggtgaccttatgagaaactgcatgtgggctatgggaggggttggtccctggtcatgtgccccttcgcagctgaagtggagagggtgtcatctagcgcaattgaaggatcatctgaaggggcaaattcttttgaattgttacatcatgctggaacctgcaaaaaatactttttctaatgaggagagaaaatatatgtatttttatataatatctaaagttatatttcagatgtaatgttttctttgcaaagtattgtaaattatatttgtgctatagtatttgattcaaaatatttaaaaatgtcttgctgttgacatatttaatgttttaaatgtacagacatatttaactggtgcactttgtaaattccctggggaaaacttgcagctaaggaggggaaaaaaatgttgtttcctaatatcaaatgcagtatatttcttcgttctttttaagttaatagattttttcagacttgtcaagcctgtgcaaaaaaattaaaatggatgccttgaataataagcaggatgttggccaccaggtgcctttcaaatttagaaactaattgactttagaaagctgacattgccaaaaaggatacataatgggccactgaaatctgtcaagagtagttatataattgttgaacaggtgtttttccacaagtgccgcaaattgtaccttttttgttttttcaaaatagaaaagttattagtggtttatcagcaaaaaagtccaattttaatttagtaaatgttatcttatactgtacaataaaaacattgcctttgaatgttaattttttggtacaaaaataaatttatatgaaaacctg

SEQ ID NO: 196245 - DNA, 2135 bp, Homo sapiens
  Payload ID: 18713
  Gene Name: tumor necrosis factor (ligand) superfamily, member 11
  Uniprot ID: O14788
  ENST ID: ENST00000405262
  CDS Start-End: 306-1040
acagatcacctgaataatagaacagaaactgctgaaatattgaacacagatctagatcaaatgaaggaacatattcaggatgaagcataaataaaggccaggcgtggtggctcatgcctggaatctcagctctttgggaggccgaggctattctccatctcctgggctccagtgatcctcacgcctcggccacccaaagtgctgggattatagaagtgaaccactgcgcctggcctattgaaggtttttaatcttcagagtttcgactttatcaacaacacttagaagccaccaaagaattgcagatggatcctaatagaatatcagaagatggcactcactgcatttatagaattttgagactccatgaaaatgcagattttcaagacacaactctggagagtcaagatacaaaattaatacctgattcatgtaggagaattaaacaggcctttcaaggagctgtgcaaaaggaattacaacatatcgttggatcacagcacatcagagcagagaaagcgatggtggatggctcatggttagatctggccaagaggagcaagcttgaagctcagccttttgctcatctcactattaatgccaccgacatcccatctggttcccataaagtgagtctgtcctcttggtaccatgatcggggttgggccaagatctccaacatgacttttagcaatggaaaactaatagttaatcaggatggcttttattacctgtatgccaacatttgctttcgacatcatgaaacttcaggagacctagctacagagtatcttcaactaatggtgtacgtcactaaaaccagcatcaaaatcccaagttctcataccctgatgaaaggaggaagcaccaagtattggtcagggaattctgaattccatttttattccataaacgttggtggattttttaagttacggtctggagaggaaatcagcatcgaggtctccaacccctccttactggatccggatcaggatgcaacatactttggggcttttaaagttcgagatatagattgagccccagtttttggagtgttatgtatttcctggatgtttggaaacattttttaaaacaagccaagaaagatgtatataggtgtgtgagactactaagaggcatggccccaacggtacacgactcagtatccatgctcttgaccttgtagagaacacgcgtatttacagccagtgggagatgttagactcatggtgtgttacacaatggtttttaaattttgtaatgaattcctagaattaaaccagattggagcaattacggggtgaccttatgagaaactgcatgtgggctatgggaggggttggtccctggtcatgtgccccttcgcagctgaagtggagagggtgtcatctagcgcaattgaaggatcatctgaaggggcaaattcttttgaattgttacatcatgctggaacctgcaaaaaatactttttctaatgaggagagaaaatatatgtatttttatataatatctaaagttatatttcagatgtaatgttttctttgcaaagtattgtaaattatatttgtgctatagtatttgattcaaaatatttaaaaatgtcttgctgttgacatatttaatgttttaaatgtacagacatatttaactggtgcactttgtaaattccctggggaaaacttgcagctaaggaggggaaaaaaatgttgtttcctaatatcaaatgcagtatatttcttcgttctttttaagttaatagattttttcagacttgtcaagcctgtgcaaaaaaattaaaatggatgccttgaataataagcaggatgttggccaccaggtgcctttcaaatttagaaactaattgactttagaaagctgacattgccaaaaaggatacataatgggccactgaaatctgtcaagagtagttatataattgttgaacaggtgtttttccacaagtgccgcaaattgtaccttttttgttttttcaaaatagaaaagttattagtggtttatcagcaaaaaagtccaattttaatttagtaaatgttatcttatactgtacaataaaaacattgcctttgaatgttaattttttggtacaaaaataaatttatatgaaaacctgc

SEQ ID NO: 196246 - DNA, 818 bp, Homo sapiens
  Payload ID: 18713
  Gene Name: tumor necrosis factor (ligand) superfamily, member 11
  Uniprot ID: O14788
  ENST ID: ENST00000544862
  CDS Start-End: 84-818
agcctccggagttggccgcagacaagaaggggctgggccaggttgtctgcagcgtcgccctgttcttctatttcagagcgcagatggatcctaatagaatatcagaagatggcactcactgcatttatagaattttgagactccatgaaaatgcagattttcaagacacaactctggagagtcaagatacaaaattaatacctgattcatgtaggagaattaaacaggcctttcaaggagctgtgcaaaaggaattacaacatatcgttggatcacagcacatcagagcagagaaagcgatggtggatggctcatggttagatctggccaagaggagcaagcttgaagctcagccttttgctcatctcactattaatgccaccgacatcccatctggttcccataaagtgagtctgtcctcttggtaccatgatcggggttgggccaagatctccaacatgacttttagcaatggaaaactaatagttaatcaggatggcttttattacctgtatgccaacatttgctttcgacatcatgaaacttcaggagacctagctacagagtatcttcaactaatggtgtacgtcactaaaaccagcatcaaaatcccaagttctcataccctgatgaaaggaggaagcaccaagtattggtcagggaattctgaattccatttttattccataaacgttggtggattttttaagttacggtctggagaggaaatcagcatcgaggtctccaacccctccttactggatccggatcaggatgcaacatactttggggcttttaaagttcgagatatagattga

SEQ ID NO: 196247 - DNA, 1553 bp, Homo sapiens
  Payload ID: 18714
  Gene Name: tumor necrosis factor (ligand) superfamily, member 12
  Uniprot ID: O43508
  ENST ID: ENST00000293825
  CDS Start-End: 264-1013
cctcgccctggtggtgcacgcccgggctgggcgctcagaggtcgggtgggcgcccactccgttcgctgcgcgcacagcgcccggcgagaggctcggagtttgatcacacacagcgtccggcttcctgtccccagcgccccctcccgccccgtttcccttgcccctccctctccccggcccgatccgcccgccggctccccctcccccgatccctcgggtcccgggatgggggggcggtgaggcaggcacagccccccgcccccatggccgcccgtcggagccagaggcggagggggcgccggggggagccgggcaccgccctgctggtcccgctcgcgctgggcctgggcctggcgctggcctgcctcggcctcctgctggccgtggtcagtttggggagccgggcatcgctgtccgcccaggagcctgcccaggaggagctggtggcagaggaggaccaggacccgtcggaactgaatccccagacagaagaaagccaggatcctgcgcctttcctgaaccgactagttcggcctcgcagaagtgcacctaaaggccggaaaacacgggctcgaagagcgatcgcagcccattatgaagttcatccacgacctggacaggacggagcgcaggcaggtgtggacgggacagtgagtggctgggaggaagccagaatcaacagctccagccctctgcgctacaaccgccagatcggggagtttatagtcacccgggctgggctctactacctgtactgtcaggtgcactttgatgaggggaaggctgtctacctgaagctggacttgctggtggatggtgtgctggccctgcgctgcctggaggaattctcagccactgcggcgagttccctcgggccccagctccgcctctgccaggtgtctgggctgttggccctgcggccagggtcctccctgcggatccgcaccctcccctgggcccatctcaaggctgcccccttcctcacctacttcggactcttccaggttcactgaggggccctggtctccccgcagtcgtcccaggctgccggctcccctcgacagctctctgggcacccggtcccctctgccccaccctcagccgctctttgctccagacctgcccctccctctagaggctgcctgggcctgttcacgtgttttccatcccacataaatacagtattcccactcttatcttacaactcccccaccgcccactctccacctcactagctccccaatccctgaccctttgaggcccccagtgatctcgactcccccctggccacagacccccagggcattgtgttcactgtactctgtgggcaaggatgggtccagaagaccccacttcaggcactaagaggggctggacctggcggcaggaagccaaagagactgggcctaggccaggagttcccaaatgtgaggggcgagaaacaagacaagctcctcccttgagaattccctgtggatttttaaaacagatattatttttattattattgtgacaaaatgttgataaatggatattaaatagaataagtcata

SEQ ID NO: 196248 - DNA, 1625 bp, Homo sapiens
  Payload ID: 18714
  Gene Name: tumor necrosis factor (ligand) superfamily, member 12
  ENST ID: ENST00000322272
  CDS Start-End: 97-501
ctctccccggcccgatccgcccgccggctccccctcccccgatccctcgggtcccgggatgggggggcggtgaggcaggcacagccccccgcccccatggccgcccgtcggagccagaggcggagggggcgccggggggagccgggcaccgccctgctggtcccgctcgcgctgggcctgggcctggcgctggcctgcctcggcctcctgctggccgtggtcagtttggggagccgggcatcgctgtccgcccaggagcctgcccaggaggagctggtggcagaggaggaccaggacccgtcggaactgaatccccagacagaagaaagccaggatcctgcgcctttcctgaaccgactagttcggcctcgcagaagtgcacctaaaggccggaaaacacgggctcgaagagcgatcgcagcccattatgaagttcatccacgacctggacaggacggagcgcaggcagatggaggttacacaacttgtctgaggccatgagatactaagtggtggagccaagatttgaacccagctagaatgtgcctgtgtactggacatggtctgcatgaaaggcgaggtggctggtgcaggggtgaggggtccatgcaggggccacatccaaaaaggggagagggaagtttccagaaagaagagaggacacatctcccaccattaccagagggtcaaaggagaacaagagaccaggtgtggacgggacagtgagtggctgggaggaagccagaatcaacagctccagccctctgcgctacaaccgccagatcggggagtttatagtcacccgggctgggctctactacctgtactgtcaggtgcactttgatgaggggaaggctgtctacctgaagctggacttgctggtggatggtgtgctggccctgcgctgcctggaggaattctcagccactgcggcgagttccctcgggccccagctccgcctctgccaggtgtctgggctgttggccctgcggccagggtcctccctgcggatccgcaccctcccctgggcccatctcaaggctgcccccttcctcacctacttcggactcttccaggttcactgaggggccctggtctccccgcagtcgtcccaggctgccggctcccctcgacagctctctgggcacccggtcccctctgccccaccctcagccgctctttgctccagacctgcccctccctctagaggctgcctgggcctgttcacgtgttttccatcccacataaatacagtattcccactcttatcttacaactcccccaccgcccactctccacctcactagctccccaatccctgaccctttgaggcccccagtgatctcgactcccccctggccacagacccccagggcattgtgttcactgtactctgtgggcaaggatgggtccagaagaccccacttcaggcactaagaggggctggacctggcggcaggaagccaaagagactgggcctaggccaggagttcccaaatgtgaggggcgagaaacaagacaagctcctcccttgagaattccctgtggatttttaaaacagatattatttttattattattgtgacaaaatgttgataaatggatattaaatagaataagtcata

SEQ ID NO: 196249 - DNA, 2036 bp, Homo sapiens
  Payload ID: 18715
  Gene Name: tumor necrosis factor (ligand) superfamily, member 13
  Uniprot ID: O75888
  ENST ID: ENST00000349228
  CDS Start-End: 565-1269
agaactcagccagtttcttgcttccgtgcccctggttctcctccccatcgagcccacccctcctttcccaccttcagtcacccctagtgaactgccccagcgatctctgctgtgcttgaccccgagggtcttccaccctcgccctgaccctggacactgcccagcttggccccccatcctgctcctggcacaatgccctctagccagccaaccttccctcccccaaccctggggccgccccagggttcctgcgcactgcctgttcctcctgggtgtcactggcagccctgtccttcctagagggactggaacctaattctcctgaggctgagggagggtggagggtctcaaggcaacgctggccccacgacggagtgccaggagcactaacagtacccttagcttgctttcctcctccctcctttttattttcaagttcctttttatttctccttgcgtaacaaccttcttcccttctgcaccactgcccgtacccttacccgccccgccacctccttgctaccccactcttgaaaccacagctgttggcagggtccccagctcatgccagcctcatctcctttcttgctagcccccaaagggcctccaggcaacatggggggcccagtcagagagccggcactctcagttgccctctggttgagttggggggcagctctgggggccgtggcttgtgccatggctctgctgacccaacaaacagagctgcagagcctcaggagagaggtgagccggctgcaggggacaggaggcccctcccagaatggggaagggtatccctggcagagtctcccggagcagagttccgatgccctggaagcctgggagaatggggagagatcccggaaaaggagagcagtgctcacccaaaaacagaagaatgactccgatgtgacagaggtgatgtggcaaccagctcttaggcgtgggagaggcctacaggcccaaggatatggtgtccgaatccaggatgctggagtttatctgctgtatagccaggtcctgtttcaagacgtgactttcaccatgggtcaggtggtgtctcgagaaggccaaggaaggcaggagactctattccgatgtataagaagtatgccctcccacccggaccgggcctacaacagctgctatagcgcaggtgtcttccatttacaccaaggggatattctgagtgtcataattccccgggcaagggcgaaacttaacctctctccacatggaaccttcctggggtttgtgaaactgtgattgtgttataaaaagtggctcccagcttggaagaccagggtgggtacatactggagacagccaagagctgagtatataaaggagagggaatgtgcaggaacagaggcgtcttcctgggtttggctccccgttcctcacttttcccttttcattcccaccccctagactttgattttacggatatcttgcttctgttccccatggagctccgaattcttgcgtgtgtgtagatgaggggcgggggacgggcgccaggcattgtccagacctggtcggggcccactggaagcatccagaacagcaccaccatctagcggccgctcgagggaagcacccgccggttggccgaagtccacgaagccgccctctgctagggaaaacccctggttctccatgccacacctctctccaggtgccctctgcctcttcaccccacaagaagccttatcctacgtccttctctccatctatcggaccccagtttccatcactatctccagagatgtagctattatgcgcccgtctacagggggtgcccgacgatgacggtgccttcgcagtcaaattactcttcgggtcccaaggtttggctttcacgcgctccattgccccggcgtggcaggccattccaagcccttccgggctggaactggtgtcggaggagcctcgggtgtatcgtacgccctggtgttggtgttgcctcactcctctgagctcttctttctgatcaagccctgcttaaagttaaataaaatagaatgaatgat

SEQ ID NO: 196250 - DNA, 1971 bp, Homo sapiens
  Payload ID: 18715
  Gene Name: tumor necrosis factor (ligand) superfamily, member 13
  Uniprot ID: O75888
  ENST ID: ENST00000338784
  CDS Start-End: 444-1196
ccgagggtcttccaccctcgccctgaccctggacactgcccagcttggccccccatcctgctcctggcacaatgccctctagccagccaaccttccctcccccaaccctggggccgccccagggttcctgcgcactgcctgttcctcctgggtgtcactggcagccctgtccttcctagagggactggaacctaattctcctgaggctgagggagggtggagggtctcaaggcaacgctggccccacgacggagtgccaggagcactaacagtacccttagcttgctttcctcctccctcctttttattttcaagttcctttttatttctccttgcgtaacaaccttcttcccttctgcaccactgcccgtacccttacccgccccgccacctccttgctaccccactcttgaaaccacagctgttggcagggtccccagctcatgccagcctcatctcctttcttgctagcccccaaagggcctccaggcaacatggggggcccagtcagagagccggcactctcagttgccctctggttgagttggggggcagctctgggggccgtggcttgtgccatggctctgctgacccaacaaacagagctgcagagcctcaggagagaggtgagccggctgcaggggacaggaggcccctcccagaatggggaagggtatccctggcagagtctcccggagcagagttccgatgccctggaagcctgggagaatggggagagatcccggaaaaggagagcagtgctcacccaaaaacagaagaagcagcactctgtcctgcacctggttcccattaacgccacctccaaggatgactccgatgtgacagaggtgatgtggcaaccagctcttaggcgtgggagaggcctacaggcccaaggatatggtgtccgaatccaggatgctggagtttatctgctgtatagccaggtcctgtttcaagacgtgactttcaccatgggtcaggtggtgtctcgagaaggccaaggaaggcaggagactctattccgatgtataagaagtatgccctcccacccggaccgggcctacaacagctgctatagcgcaggtgtcttccatttacaccaaggggatattctgagtgtcataattccccgggcaagggcgaaacttaacctctctccacatggaaccttcctggggtttgtgaaactgtgattgtgttataaaaagtggctcccagcttggaagaccagggtgggtacatactggagacagccaagagctgagtatataaaggagagggaatgtgcaggaacagaggcgtcttcctgggtttggctccccgttcctcacttttcccttttcattcccaccccctagactttgattttacggatatcttgcttctgttccccatggagctccgaattcttgcgtgtgtgtagatgaggggcgggggacgggcgccaggcattgtccagacctggtcggggcccactggaagcatccagaacagcaccaccatctagcggccgctcgagggaagcacccgccggttggccgaagtccacgaagccgccctctgctagggaaaacccctggttctccatgccacacctctctccaggtgccctctgcctcttcaccccacaagaagccttatcctacgtccttctctccatctatcggaccccagtttccatcactatctccagagatgtagctattatgcgcccgtctacagggggtgcccgacgatgacggtgccttcgcagtcaaattactcttcgggtcccaaggtttggctttcacgcgctccattgccccggcgtggcaggccattccaagcccttccgggctggaactggtgtcggaggagcctcgggtgtatcgtacgccctggtgttggtgttgcctcactcctctgagctcttctttctgatcaagccctgcttaaagttaaataaaatagaatgaatgataccccggc

SEQ ID NO: 196251 - DNA, 2195 bp, Homo sapiens
  Payload ID: 18715
  Gene Name: tumor necrosis factor (ligand) superfamily, member 13
  ENST ID: ENST00000380535
  CDS Start-End: 749-1420
ccggaaccctgtgtgctggggaggaatcccgcagtggccggggggcttgaggccgctgctttgtctcttcgtccagagccttatgtaagagcttttctcgggaaacaggaagtcctgcttgccaatttcagcacagggagtagtgcaggccttattccaacacacccggcccagccttaaccccagaactcagccagtttcttgcttccgtgcccctggttctcctccccatcgagcccacccctcctttcccaccttcagtcacccctagtgaactgccccagcgatctctgctgtgcttgaccccgagggtcttccaccctcgccctgaccctggacactgcccagcttggccccccatcctgctcctggcacaatgccctctagccagccaaccttccctcccccaaccctggggccgccccagggttcctgcgcactgcctgttcctcctgggtgtcactggcagccctgtccttcctagagggactggaacctaattctcctgaggctgagggagggtggagggtctcaaggcaacgctggccccacgacggagtgccaggagcactaacagtacccttagcttgctttcctcctccctcctttttattttcaagttcctttttatttctccttgcgtaacaaccttcttcccttctgcaccactgcccgtacccttacccgccccgccacctccttgctaccccactcttgaaaccacagctgttggcagggtccccagctcatgccagcctcatctcctttcttgctagcccccaaagggcctccaggcaacatggggggcccagtcagagagccggcactctcagttgccctctggttgagttggggggcagctctgggggccgtggcttgtgccatggctctgctgacccaacaaacagagctgcagagcctcaggagagaggtgagccggctgcaggggacaggaggcccctcccagaatggggaagggtatccctggcagagtctcccggagcagcagcactctgtcctgcacctggttcccattaacgccacctccaaggatgactccgatgtgacagaggtgatgtggcaaccagctcttaggcgtgggagaggcctacaggcccaaggatatggtgtccgaatccaggatgctggagtttatctgctgtatagccaggtcctgtttcaagacgtgactttcaccatgggtcaggtggtgtctcgagaaggccaaggaaggcaggagactctattccgatgtataagaagtatgccctcccacccggaccgggcctacaacagctgctatagcgcaggtgtcttccatttacaccaaggggatattctgagtgtcataattccccgggcaagggcgaaacttaacctctctccacatggaaccttcctggggtttgtgaaactgtgattgtgttataaaaagtggctcccagcttggaagaccagggtgggtacatactggagacagccaagagctgagtatataaaggagagggaatgtgcaggaacagaggcgtcttcctgggtttggctccccgttcctcacttttcccttttcattcccaccccctagactttgattttacggatatcttgcttctgttccccatggagctccgaattcttgcgtgtgtgtagatgaggggcgggggacgggcgccaggcattgtccagacctggtcggggcccactggaagcatccagaacagcaccaccatctagcggccgctcgagggaagcacccgccggttggccgaagtccacgaagccgccctctgctagggaaaacccctggttctccatgccacacctctctccaggtgccctctgcctcttcaccccacaagaagccttatcctacgtccttctctccatctatcggaccccagtttccatcactatctccagagatgtagctattatgcgcccgtctacagggggtgcccgacgatgacggtgccttcgcagtcaaattactcttcgggtcccaaggtttggctttcacgcgctccattgccccggcgtggcaggccattccaagcccttccgggctggaactggtgtcggaggagcctcgggtgtatcgtacgccctggtgttggtgttgcctcactcctctgagctcttctttctgatcaagccctgcttaaagttaaataaaatagaatgaatgataccccggc

SEQ ID NO: 196252 - DNA, 726 bp, Homo sapiens
  Payload ID: 18715
  Gene Name: tumor necrosis factor (ligand) superfamily, member 13
  Uniprot ID: O75888
  ENST ID: ENST00000396542
  CDS Start-End: 107-724
cggaaccctgtgtgctggggaggaatcccgcagtggccggggggcttgaggccgctgctttgtctcttcgtccagagccttatcccccaaagggcctccaggcaacatggggggcccagtcagagagccggcactctcagttgccctctggttgagttggggggcagctctgggggccgtggcttgtgccatggctctgctgacccaacaaacagagctgcagagcctcaggagagaggtgagccggctgcaggggacaggaggcccctcccagaatggggaagggtatccctggcagagtctcccggagcagcactctgtcctgcacctggttcccattaacgccacctccaaggatgactccgatgtgacagaggtgatgtggcaaccagctcttaggcgtgggagaggcctacaggcccaaggatatggtgtccgaatccaggatgctggagtttatctgctgtatagccaggtcctgtttcaagacgtgactttcaccatgggtcaggtggtgtctcgagaaggccaaggaaggcaggagactctattccgatgtataagaagtatgccctcccacccggaccgggcctacaacagctgctatagcgcaggtgtcttccatttacaccaaggggatattctgagtgtcataattccccgggcaagggcgaaacttaacctctctccacatggaaccttcctggggtttgtgaaactgtgatt

SEQ ID NO: 196253 - DNA, 1593 bp, Homo sapiens
  Payload ID: 18715
  Gene Name: tumor necrosis factor (ligand) superfamily, member 13
  Uniprot ID: O75888
  ENST ID: ENST00000396545
  CDS Start-End: 254-997
cctaattctcctgaggctgagggagggtggagggtctcaaggcaacgctggccccacgacggagtgccaggagcactaacagtacccttagcttgctttcctcctccctcctttttattttcaagttcctttttatttctccttgcgtaacaaccttcttcccttctgcaccactgcccgtacccttacccgccccgccacctccttgctaccccactcttgaaaccacagctgttggcagggtccccagctcatgccagcctcatctcctttcttgctagcccccaaagggcctccaggcaacatggggggcccagtcagagagccggcactctcagttgccctctggttgagttggggggcagctctgggggccgtggcttgtgccatggctctgctgacccaacaaacagagctgcagagcctcaggagagaggtgagccggctgcaggggacaggaggcccctcccagaatggggaagggtatccctggcagagtctcccggagcagagttccgatgccctggaagcctgggagaatggggagagatcccggaaaaggagagcagtgctcacccaaaaacagaagaagcagcactctgtcctgcacctggttcccattaacgccacctccaaggatgactccgatgtgacagaggtgatgtggcaaccagctcttaggcgtgggagaggcctacaggcccaaggatatggtgtccgaatccaggatgctggagtttatctgctgtatagccaggtcctgtttcaagacgtgactttcaccatgggtcaggtggtgtctcgagaaggccaaggaaggcaggagactctattccgatgtataagaagtatgccctcccacccggaccgggcctacaacagctgctatagcgcaggtgtcttccatttacaccaaggggatattctgagtgtcataattccccgggcaagggcgaaacttaacctctctccacatggaaccttcctgggactttgattttacggatatcttgcttctgttccccatggagctccgaattcttgcgtgtgtgtagatgaggggcgggggacgggcgccaggcattgtccagacctggtcggggcccactggaagcatccagaacagcaccaccatctagcggccgctcgagggaagcacccgccggttggccgaagtccacgaagccgccctctgctagggaaaacccctggttctccatgccacacctctctccaggtgccctctgcctcttcaccccacaagaagccttatcctacgtccttctctccatctatcggaccccagtttccatcactatctccagagatgtagctattatgcgcccgtctacagggggtgcccgacgatgacggtgccttcgcagtcaaattactcttcgggtcccaaggtttggctttcacgcgctccattgccccggcgtggcaggccattccaagcccttccgggctggaactggtgtcggaggagcctcgggtgtatcgtacgccctggtgttggtgttgcctcactcctctgagctcttctttctgatcaagccctgcttaaagttaaataaaatagaatgaatgata

SEQ ID NO: 196254 - DNA, 549 bp, Homo sapiens
  Payload ID: 18715
  Gene Name: tumor necrosis factor (ligand) superfamily, member 13
  ENST ID: ENST00000438470
  CDS Start-End: 100-549
ctgtgtgctggggaggaatcccgcagtggccggggggcttgaggccgctgctttgtctcttcgtccagagccttatcccccaaagggcctccaggcaacatggggggcccagtcagagagccggcactctcagttgccctctggttgagttggggggcagctctgggggccgtggcttgtgccatggctctgctgacccaacaaacagagctgcagagcctcaggagagaggtgagccggctgcaggggacaggaggcccctcccagaatggggaagggtatccctggcagagtctcccggagcagagttccgatgccctggaagcctgggagaatggggagagatcccggaaaaggagagcagtgctcacccaaaaacagaagaatgactccgatgtgacagaggtgatgtggcaaccagctcttaggcgtgggagaggcctacaggcccaaggatatggtgtccgaatccaggatgctggagtttatctgctgtatagccaggtcctgtttcaagacgtgactttcaccatgggtcaggtggtgtct

SEQ ID NO: 196255 - DNA, 573 bp, Homo sapiens
  Payload ID: 18715
  Gene Name: tumor necrosis factor (ligand) superfamily, member 13
  ENST ID: ENST00000436057
  CDS Start-End: 98-573
gtgtgctggggaggaatcccgcagtggccggggggcttgaggccgctgctttgtctcttcgtccagagccttatcccccaaagggcctccaggcaacatggggggcccagtcagagagccggcactctcagttgccctctggttgagttggggggcagctctgggggccgtggcttgtgccatggctctgctgacccaacaaacagagctgcagagcctcaggagagaggtgagccggctgcaggggacaggaggcccctcccagaatggggaagggtatccctggcagagtctcccggagcagagttccgatgccctggaagcctgggagaatggggagagatcccggaaaaggagagcagtgctcacccaaaaacagaagaagcagcactctgtcctgcacctggttcccattaacgccacctccaaggatgactccgatgtgacagaggtgatgtggcaaccagctcttaggcgtgggagaggcctacaggcccaaggatatggtgtccgaatccaggatgctggagtttatctgctgtatagccaggtcctgtttcaagacgtgacttt

SEQ ID NO: 196256 - DNA, 959 bp, Homo sapiens
  Payload ID: 18715
  Gene Name: tumor necrosis factor (ligand) superfamily, member 13
  ENST ID: ENST00000483039
  CDS Start-End: 156-500
ccggaaccctgtgtgctggggaggaatcccgcagtggccggggggcttgaggccgctgctttgtctcttcgtccagagccttatagcagcactctgtcctgcacctggttcccattaacgccacctccaaggatgactccgatgtgacagaggtgatgtggcaaccagctcttaggcgtgggagaggcctacaggcccaaggatatggtgtccgaatccaggatgctggagtttatctgctgtatagccaggtcctgtttcaagacgtgactttcaccatgggtcaggtggtgtctcgagaaggccaaggaaggcaggagactctattccgatgtataagaagtatgccctcccacccggaccgggcctacaacagctgctatagcgcaggtgtcttccatttacaccaaggggatattctgagtgtcataattccccgggcaagggcgaaacttaacctctctccacatggaaccttcctggggtttgtgaaactgtgattgtgttataaaaagtggctcccagcttggaagaccagggtgggtacatactggagacagccaagagctgagtatataaaggagagggaatgtgcaggaacagaggcgtcttcctgggtttggctccccgttcctcacttttcccttttcattcccaccccctagactttgattttacggatatcttgcttctgttccccatggagctccgaattcttgcgtgtgtgtagatgaggggcgggggacgggcgccaggcattgtccagacctggtcggggcccactggaagcatccagaacagcaccaccatctagcggccgctcgagggaagcacccgccggttggccgaagtccacgaagccgccctctgctagggaaaacccctggttctccatgccacacctctctccaggtgccctctgcctcttcaccccacaagaagccttatcctacgtcctt

SEQ ID NO: 196257 - DNA, 955 bp, Homo sapiens
  Payload ID: 18715
  Gene Name: tumor necrosis factor (ligand) superfamily, member 13
  Uniprot ID: O75888
  ENST ID: ENST00000625791
  CDS Start-End: 282-950
agccctgtccttcctagagggactggaacctaattctcctgaggctgagggagggtggagggtctcaaggcaacgctggccccacgacggagtgccaggagcactaacagtacccttagcttgctttcctcctccctcctttttattttcaagttcctttttatttctccttgcgtaacaaccttcttcccttctgcaccactgcccgtacccttacccgccccgccacctccttgctaccccactcttgaaaccacagctgttggcagggtccccagctcatgccagcctcatctcctttcttgctagcccccaaagggcctccaggcaacatggggggcccagtcagagagccggcactctcagttgccctctggttgagttggggggcagctctgggggccgtggcttgtgccatggctctgctgacccaacaaacagagctgcagagcctcaggagagaggtgagccggctgcaggggacaggaggcccctcccagaatggggaagggtatccctggcagagtctcccggagcagcactctgtcctgcacctggttcccattaacgccacctccaaggatgactccgatgtgacagaggtgatgtggcaaccagctcttaggcgtgggagaggcctacaggcccaaggatatggtgtccgaatccaggatgctggagtttatctgctgtatagccaggtcctgtttcaagacgtgactttcaccatgggtcaggtggtgtctcgagaaggccaaggaaggcaggagactctattccgatgtataagaagtatgccctcccacccggaccgggcctacaacagctgctatagcgcaggtgtcttccatttacaccaaggggatattctgagtgtcataattccccgggcaagggcgaaacttaacctctctccacatggaaccttcctggggtttgtgaaactgtgattgtg

SEQ ID NO: 196258 - DNA, 2582 bp, Homo sapiens
  Payload ID: 18716
  Gene Name: tumor necrosis factor (ligand) superfamily, member 13b
  Uniprot ID: Q9Y275
  ENST ID: ENST00000375887
  CDS Start-End: 179-1036
aggggtagagatgcagaaaggcagaaaggagaaaattcaggataactctcctgaggggtgagccaagccctgccatgtagtgcacgcaggacatcaacaaacacagataacaggaaatgatccattccctgtggtcacttattctaaaggccccaaccttcaaagttcaagtagtgatatggatgactccacagaaagggagcagtcacgccttacttcttgccttaagaaaagagaagaaatgaaactgaaggagtgtgtttccatcctcccacggaaggaaagcccctctgtccgatcctccaaagacggaaagctgctggctgcaaccttgctgctggcactgctgtcttgctgcctcacggtggtgtctttctaccaggtggccgccctgcaaggggacctggccagcctccgggcagagctgcagggccaccacgcggagaagctgccagcaggagcaggagcccccaaggccggcctggaggaagctccagctgtcaccgcgggactgaaaatctttgaaccaccagctccaggagaaggcaactccagtcagaacagcagaaataagcgtgccgttcagggtccagaagaaacagtcactcaagactgcttgcaactgattgcagacagtgaaacaccaactatacaaaaaggatcttacacatttgttccatggcttctcagctttaaaaggggaagtgccctagaagaaaaagagaataaaatattggtcaaagaaactggttacttttttatatatggtcaggttttatatactgataagacctacgccatgggacatctaattcagaggaagaaggtccatgtctttggggatgaattgagtctggtgactttgtttcgatgtattcaaaatatgcctgaaacactacccaataattcctgctattcagctggcattgcaaaactggaagaaggagatgaactccaacttgcaataccaagagaaaatgcacaaatatcactggatggagatgtcacattttttggtgcattgaaactgctgtgacctacttacaccatgtctgtagctattttcctccctttctctgtacctctaagaagaaagaatctaactgaaaataccaaaaaaaaaaaaaaaaaaaaaaaaaaaaaaagtagttaccattgccttttctgtgagctatttgttttggtttgctgaaactagtccaaaacaggaaatttaacagacagccacagccaaagagtgtcatgtgaattacaagaaatagagcccatttagggaaagatagaactagaaaggcttttcattataattccatgttgaacaattgagtcatagcttcttatcttggaggaaggacacaattcaaaggggcagtaaggattttgtaaaacgtggcatccataatttactatggagcaagtgcccacatctctaggacattaagacatttatgagaaatctcaggattcatcttctgtttttatgttaaatgcactccctccttttcagttaacattataaaaagtaaaaaatgaaaattttagaaatcttgcattagacacatgaaaaaataactaaaagtttaaatttaaatatgaaacaattttgctgaaaatagtatccatatactatttaagtcttttatggttatttcaagtatacaatttctatctgtaatgtaatatattacccacacatttttttcacaggagagagagaatatcctcatttgtttatgctcatgtgtattttctatagtgaatttcagaaacttttaatatcaggtaatttcaatttatgcctataaagcattgattgaaaaataactagaattgtgcatatataacacataatctccaacagaagttactgaatacattcatactaatgtaatgtaatttccctttatttcttgctcttctgtttcaaactgctgctattgtagtttacatatcccaacctttaaaaatattcctcttattagctttatattcactttatagaagttgagttttaattaaaattcttggcatcctgaagtatgtcacatagcatgtgctccttataaatatgttgatatctcagaagacagcatcccggttttcattttataaagtaccatacttaagaatgctgtaatacttatcttttataacatgtttccttcgctttgcttgtcttttatgtcatcagttttaactgtttacttcatttaacagtttacatcattcaacagtttacttcattaaacagtaggtggaaaaatagatgccagtctatgaaaatcttcccatctatatcaaaatacttttcaaggatatacttttcaaaacaaacgatttaaattttatgtttaaaatataaactttagatttaaactttatttaaatatctggttcctatgattttgacttcagtaagttcaaataaaatatattttgcaattcatttttacattataatttaaaaagaagaagcgataagtggagtcagtttcaatgctaggtggggtggttaatgatttttctggtgttgctgctaatgtggattaacaaataaaaacattcattgccttttgcctcat

SEQ ID NO: 196259 - DNA, 2614 bp, Homo sapiens
  Payload ID: 18716
  Gene Name: tumor necrosis factor (ligand) superfamily, member 13b
  Uniprot ID: Q9Y275
  ENST ID: ENST00000430559
  CDS Start-End: 268-1068
gaaattcttacaaaaactgaaagtgaaatgaggaagacagattgagcaatccaatcggagggtaaatgccagcaaacctactgtacagtaggggtagagatgcagaaaggcagaaaggagaaaattcaggataactctcctgaggggtgagccaagccctgccatgtagtgcacgcaggacatcaacaaacacagataacaggaaatgatccattccctgtggtcacttattctaaaggccccaaccttcaaagttcaagtagtgatatggatgactccacagaaagggagcagtcacgccttacttcttgccttaagaaaagagaagaaatgaaactgaaggagtgtgtttccatcctcccacggaaggaaagcccctctgtccgatcctccaaagacggaaagctgctggctgcaaccttgctgctggcactgctgtcttgctgcctcacggtggtgtctttctaccaggtggccgccctgcaaggggacctggccagcctccgggcagagctgcagggccaccacgcggagaagctgccagcaggagcaggagcccccaaggccggcctggaggaagctccagctgtcaccgcgggactgaaaatctttgaaccaccagctccaggagaaggcaactccagtcagaacagcagaaataagcgtgccgttcagggtccagaagaaacaggatcttacacatttgttccatggcttctcagctttaaaaggggaagtgccctagaagaaaaagagaataaaatattggtcaaagaaactggttacttttttatatatggtcaggttttatatactgataagacctacgccatgggacatctaattcagaggaagaaggtccatgtctttggggatgaattgagtctggtgactttgtttcgatgtattcaaaatatgcctgaaacactacccaataattcctgctattcagctggcattgcaaaactggaagaaggagatgaactccaacttgcaataccaagagaaaatgcacaaatatcactggatggagatgtcacattttttggtgcattgaaactgctgtgacctacttacaccatgtctgtagctattttcctccctttctctgtacctctaagaagaaagaatctaactgaaaataccaaaaaaaaaaaaaaaaaaaaaaaaaaaaaaagtagttaccattgccttttctgtgagctatttgttttggtttgctgaaactagtccaaaacaggaaatttaacagacagccacagccaaagagtgtcatgtgaattacaagaaatagagcccatttagggaaagatagaactagaaaggcttttcattataattccatgttgaacaattgagtcatagcttcttatcttggaggaaggacacaattcaaaggggcagtaaggattttgtaaaacgtggcatccataatttactatggagcaagtgcccacatctctaggacattaagacatttatgagaaatctcaggattcatcttctgtttttatgttaaatgcactccctccttttcagttaacattataaaaagtaaaaaatgaaaattttagaaatcttgcattagacacatgaaaaaataactaaaagtttaaatttaaatatgaaacaattttgctgaaaatagtatccatatactatttaagtcttttatggttatttcaagtatacaatttctatctgtaatgtaatatattacccacacatttttttcacaggagagagagaatatcctcatttgtttatgctcatgtgtattttctatagtgaatttcagaaacttttaatatcaggtaatttcaatttatgcctataaagcattgattgaaaaataactagaattgtgcatatataacacataatctccaacagaagttactgaatacattcatactaatgtaatgtaatttccctttatttcttgctcttctgtttcaaactgctgctattgtagtttacatatcccaacctttaaaaatattcctcttattagctttatattcactttatagaagttgagttttaattaaaattcttggcatcctgaagtatgtcacatagcatgtgctccttataaatatgttgatatctcagaagacagcatcccggttttcattttataaagtaccatacttaagaatgctgtaatacttatcttttataacatgtttccttcgctttgcttgtcttttatgtcatcagttttaactgtttacttcatttaacagtttacatcattcaacagtttacttcattaaacagtaggtggaaaaatagatgccagtctatgaaaatcttcccatctatatcaaaatacttttcaaggatatacttttcaaaacaaacgatttaaattttatgtttaaaatataaactttagatttaaactttatttaaatatctggttcctatgattttgacttcagtaagttcaaataaaatatattttgcaattcatttttacattataatttaaaaagaagaagcgataagtggagtcagtttcaatgctaggtggggtggttaatgatttttctggtgttgctgctaatgtggattaacaaataaaaacattcattgccttttgcctcat

SEQ ID NO: 196260 - DNA, 495 bp, Homo sapiens
  Payload ID: 18716
  Gene Name: tumor necrosis factor (ligand) superfamily, member 13b
  Uniprot ID: Q9Y275
  ENST ID: ENST00000542136
  CDS Start-End: 1-495
atggatgactccacagaaagggagcagtcacgccttacttcttgccttaagaaaagagaagaaatgaaactgaaggagtgtgtttccatcctcccacggaaggaaagcccctctgtccgatcctccaaagacggaaagctgctggctgcaaccttgctgctggcactgctgtcttgctgcctcacggtggtgtctttctaccaggtggccgccctgcaaggggacctggccagcctccgggcagagctgcagggccaccacgcggagaagctgccagcaggagcaggagcccccaaggccggcctggaggaagctccagctgtcaccgcgggactgaaaatctttgaaccaccagctccaggagaaggcaactccagtcagaacagcagaaataagcgtgccgttcagggtccagaagaaacagtcactcaagactgcttgcaactgattgcagacagtgaaacaccaactatacaaaaaggttttatatactga

SEQ ID NO: 196261 - DNA, 4336 bp, Homo sapiens
  Payload ID: 18717
  Gene Name: tumor necrosis factor (ligand) superfamily, member 14
  Uniprot ID: O43557
  ENST ID: ENST00000245912
  CDS Start-End: 49-663
gaggttgaaggacccaggcgtgtcagccctgctccagacaccttgggcatggaggagagtgtcgtacggccctcagtgtttgtggtggatggacagaccgacatcccattcacgaggctgggacgaagccaccggagacagtcgtgcagtgtggcccgggacggacctgcaggctcctgggagcagctgatacaagagcgaaggtctcacgaggtcaacccagcagcgcatctcacaggggccaactccagcttgaccggcagcggggggccgctgttatgggagactcagctgggcctggccttcctgaggggcctcagctaccacgatggggcccttgtggtcaccaaagctggctactactacatctactccaaggtgcagctgggcggtgtgggctgcccgctgggcctggccagcaccatcacccacggcctctacaagcgcacaccccgctaccccgaggagctggagctgttggtcagccagcagtcaccctgcggacgggccaccagcagctcccgggtctggtgggacagcagcttcctgggtggtgtggtacacctggaggctggggagaaggtggtcgtccgtgtgctggatgaacgcctggttcgactgcgtgatggtacccggtcttacttcggggctttcatggtgtgaaggaaggagcgtggtgcattggacatgggtctgacacgtggagaactcagagggtgcctcaggggaaagaaaactcacgaagcagaggctgggcgtggtggctctcgcctgtaatcccagcactttgggaggccaaggcaggcggatcacctgaggtcaggagttcgagaccagcctggctaacatggcaaaaccccatctctactaaaaatacaaaaattagccggacgtggtggtgcctgcctgtaatccagctactcaggaggctgaggcaggataattttgcttaaacccgggaggcggaggttgcagtgagccgagatcacaccactgcactccaacctgggaaacgcagtgagactgtgcctcaaaaaaaagaaaggaagaaaaaagaaaactcaggaaacagatcttgggggacactccagggaacccaaaactcaaaggcggagagctcagtgggcaccaccaaggcgagatgaagccccagcaggcaccttcagaagacccacgtagactgcagaccctgccacggacaatactaaggacaaaaacccagagacttggggtctgtgggcccccaaacatggggtaaagttgatttgcctgatattcaggaagaaggggtgaggggtgggtatttatgcttttgattcagaagaaagtggggcttgggattccagggacttggctgggggtgggaaacttcatccacttccctactctcatcatgagtacggacagggtgggcgggagactgatcatcgggactcatcatgaagagcccagccccaccccacatactcagatcccacccacagactggtggccacacctcagcctggtcacaaagagttacactcagatacatgagcacggcagcgtgctcataactgtttaacaaccagctgtcctgggagggggacagctttgtaatgtttgccaatttccatggtgtaaatgctaccaccatggctgatttcatcactgccaagcatagacatccctaataggacaccacggatctgtccccggcatccggcccagggcctggcacaaagcatgctctagggaaatgcttgctgattgaaaggaaggaagaatgactctacagtcacacctatggcatcccacaaaatctgtcacatggctgcataatctcagccactctttcacaactatagactcatacacgcgaagtgccagattcatgcacaaccacacaatcacatggaagtcacagacggcatcacagacagtcacagcactgtgtgtatgttataacacaagcacacaaaactcagacagcatcccagctacacagccactcccagaggtgtcaccgtcacacttggtaattaatactcattacattagacacagacagaccaagttatagtcagacctggttacacacatacacacacacaatatcaccatgacaaatacacattacacacacacaacatcacaatgacaaacacacattacacacacaacatcacgatgacaaacacacattacacacacaacatcacgatgacaaacacacattacacacacatcacaatgacaaacacaacattacacacacacaacatcacaatgacacacacatcacacacacatcacaatgacaaacacacaacattacacacatatacacacagcctgagggccctccccagcccagactaacacatctcggggtgaggaccagaccttgttcataaccctgggcctcttaaccactgatctttgaaataaatggcaaatagttgtacctggatctgtctagttcttaggggaacaaactgaagaagggtggagaggaattgtcaggcctaaagagccccacagggaaagggaggagtcggatggggggcaaccatcagcaacaagtggtggctcctagaggcagagggatggaggtaatgacccatggaggtcattctacagatgaggaacctggacccagttggctcaagtccatgcaggaaatgtgggggaaaccagagacctcacgtctggatctggcttcctctccaatccacaattcctgaggaagtagaggctacatcccgcaagacgcccttattagacacatccaggacagaatgacaatccgccaagccagctggaagcataaaacacagggagctggtgggttgggtgggggcagataatgatatgcatacaaattagagggtctatgcaaatgagcattgctgcagtgtggctggagggaatccttagttcctaggattctaggatatgggtttcgaccccagaggtgaatgtattgttattattgttttgttgttgttgtgaatgacaagtcaaaatttgtgggttattgttgttatcgccaatagtattcttgtcattgttgcacagtacagagatgaaggaaacagattttgcaatcagatgatcctgggttctgagtccactctgccactcaccagctatatgacctccagcaatttccatcacctctcaatgcttcagtttccccatcggcaagatggttgtggggggagaggaacaacagtacagattcaccatcccaaattcaaaatgctccaaaatctaggccgggcgtggtggctcatacctgtaatcccagcactttgggaggtcaaagtggacggataacctgaggtcaggagctccagaccagcctggccaacatggcgaaaccccatctctactaaaaatacaaaaaattacctgggtgtggtggggggcacctgtaaccccagctactcgggaggctgaggcaggaaccctggaggttgaggttgcagtgagctgagatcacaccactgcactccagcctgggtgacagagcaaggctcccatctcaaaaaacaaaaaaacatgctccaaaatctgaaactctttgagccccagtgtgatgccacaagtgggaaattccacaactcatcacatgtgatagattgcagtggaaatgcaggcacacaccacgaagtttactcagcatcctcaaaggaaatccccgtcagtagctatatatcattttctcacatgccagataggtatctctcatcttttactgttaggtacttctgtgttgaataggtggaggaaaatgattgctggttagtagtatataaattcagagtcaggaaggatggtgatgtcggctgggtgcagtggctcatgcctgtaattccaatgtgataccctaccttgtgtttaacgtgattgactctcccttagctgagagggccaggcagactctattttggcttcttcgcttgcagtctctcacccaccccccttcctcaaggacttaagctgactcccagcacatccaagaatgcgattactgataagatactgtgacaagctatatccacaattcccaggaattcgtccggttgatagcacccaaagcccccgcgtctatcaccttgtgatagatttaaagcccctgcacctggaactgtttgtttttctgttaccatttatctttttcactttcttgcctgttttgcttctgtaaaattgcttcagctcggctccctcttccccttctaaaccaaggtataaaaagaaacctagccccttctttggggtggagagaattttgagcgctagccgtctctcagtcgccggctaataaaggactcctgaattagtctaa

SEQ ID NO: 196262 - DNA, 1476 bp, Homo sapiens
  Payload ID: 18717
  Gene Name: tumor necrosis factor (ligand) superfamily, member 14
  Uniprot ID: O43557
  ENST ID: ENST00000599359
  CDS Start-End: 383-1105
cgagactccatctcaaaaacaaaacaaataaacgaacaaaaaaacccacaacgtattattttcttgtttacgaggtttcttgtctctctggctccaccagaagaggagcagggacccttcttgctgttgttcattgctgcatcccccacaccgagagcagagcctggcatgggcagaaagtcctcagtcgatatttggtggccccaagcgaatgaagcatccaagaagggaaagctgggggctccccactgcacttgccacctgagtcacattttcagaagcctctggaaagtcgtgcacagcccaggagtgttgagcaatttcggtttcctctgaggttgaaggacccaggcgtgtcagccctgctccagacaccttgggcatggaggagagtgtcgtacggccctcagtgtttgtggtggatggacagaccgacatcccattcacgaggctgggacgaagccaccggagacagtcgtgcagtgtggcccgggtgggtctgggtctcttgctgttgctgatgggggccgggctggccgtccaaggctggttcctcctgcagctgcactggcgtctaggagagatggtcacccgcctgcctgacggacctgcaggctcctgggagcagctgatacaagagcgaaggtctcacgaggtcaacccagcagcgcatctcacaggggccaactccagcttgaccggcagcggggggccgctgttatgggagactcagctgggcctggccttcctgaggggcctcagctaccacgatggggcccttgtggtcaccaaagctggctactactacatctactccaaggtgcagctgggcggtgtgggctgcccgctgggcctggccagcaccatcacccacggcctctacaagcgcacaccccgctaccccgaggagctggagctgttggtcagccagcagtcaccctgcggacgggccaccagcagctcccgggtctggtgggacagcagcttcctgggtggtgtggtacacctggaggctggggagaaggtggtcgtccgtgtgctggatgaacgcctggttcgactgcgtgatggtacccggtcttacttcggggctttcatggtgtgaaggaaggagcgtggtgcattggacatgggtctgacacgtggagaactcagagggtgcctcaggggaaagaaaactcacgaagcagaggctgggcgtggtggctctcgcctgtaatcccagcactttgggaggccaaggcaggcggatcacctgaggtcaggagttcgagaccagcctggctaacatggcaaaaccccatctctactaaaaatacaaaaattagccggacgtggtggtgcctgcctgtaatccagctactcaggaggctgaggcaggataattttgcttaaacccgggaggcggaggttgcagtgagccgagatcacaccactgcactccaacctgggaaacgcagtgagactgtgcctcaa

SEQ ID NO: 196263 - DNA, 2789 bp, Homo sapiens
  Payload ID: 18718
  Gene Name: tumor necrosis factor (ligand) superfamily, member 15
  ENST ID: ENST00000374044
  CDS Start-End: 1133-1657
agtgcaggtatctcatggagggttttttggatgtcttcttccctgtgggggggttccaaaggcccatgtctcttgggcattttctttcagattctatcagccctctctctttctctcctgtctctctctttcattcatacactgagtcattcagaaatggcttctctccaactcggagctgcaagtaattctggatctggtcacaaacaaaaagtccccagagttgccaatttatctagttcatctgtgccctgttcaagatgatgtaactaaacatttaccttcagggaggtgtttccaaagaattttcatcgatatatagaaatcaagagaaattccatactatcaccaaatcaagagaaattccatactatcaccagttggccaactttccaagtctagtgcagaaatccaaggcacctcacacctagagttcctatacctctgagactccagaggaaagaacaagacagtgcagaaggatatgttagaacccactgaaaacctagaaggttaaaaaggaagcataccctcctgacctataagaaaattttcagtctgcagggggatatccttgtggcccaagacattggtgttatcatttgactaagaggaaattatttgtggtgagctctgagtgaggattaggaccagggagatgccaagtttctatcacttacctcatgcctgtaagacaagtgttttgttccaattgatgaatggggataaaacagttcagccaatcacttatggggcaaagaatgggaatttgaagggtctggtgcctggccttgtcatacgtaaacaagagaggcatcgatgagttttatctgagtcatttgggaaaggataattcttgcagcaagccattttcctaaacacagaagaatagggggattccttaaccttcattgttctccaggatcataggtctcaggtaaaattaaaaattttcaggtcagaccactcagtctcagaaaggcaaagtaatttgccccaggtcactagtccaagatgttattctctttgaacaaatgtgtatgtccagtcacatattcttcattcattcctccccaaagcagtttttagctgttaggtatattcgatcactttagtctattttgaaaatgatatgagacactttttaagcaaagtctacagtttcccaatgagaaaattaatcctctttcttgtctttccagttgtgagacaaactcccacacagcactttaaaaatcagttcccagctctgcactgggaacatgaactaggcctggccttcaccaagaaccgaatgaactataccaacaaattcctgctgatcccagagtcgggagactacttcatttactcccaggtcacattccgtgggatgacctctgagtgcagtgaaatcagacaagcaggccgaccaaacaagccagactccatcactgtggtcatcaccaaggtaacagacagctaccctgagccaacccagctcctcatggggaccaagtctgtatgcgaagtaggtagcaactggttccagcccatctacctcggagccatgttctccttgcaagaaggggacaagctaatggtgaacgtcagtgacatctctttggtggattacacaaaagaagataaaaccttctttggagccttcttactataggaggagagcaaatatcattatatgaaagtcctctgccaccgagttcctaattttctttgttcaaatgtaattataaccaggggttttcttggggccgggagtagggggcattccacagggacaacggtttagctatgaaatttggggcccaaaatttcacacttcatgtgccttactgatgagagtactaactggaaaaaggctgaagagagcaaatatattattaagatgggttggaggattggcgagtttctaaatattaagacactgatcactaaatgaatggatgatctactcgggtcaggattgaaagagaaatatttcaacaccttcctgctatacaatggtcaccagtggtccagttattgttcaatttgatcataaatttgcttcaattcaggagctttgaaggaagtccaaggaaagctctagaaaacagtataaactttcagaggcaaaatccttcaccaatttttccacatactttcatgccttgcctaaaaaaaatgaaaagagagttggtatgtctcatgaatgttcacacagaaggagttggttttcatgtcatctacagcatatgagaaaagctacctttcttttgattatgtacacagatatctaaataaggaagtatgagtttcacatgtatatcaaaaatacaacagttgcttgtattcagtagagttttcttgcccacctattttgtgctgggttctaccttaacccagaagacactatgaaaaacaagacagactccactcaaaatttatatgaacaccactagatacttcctgatcaaacatcagtcaacatactctaaagaataactccaagtcttggccaggcgcagtggctcacacctgtaatcccaacactttgggaggccaaggtgggtggatcatctaaggccgggagttcaagaccagcctgaccaacgtggagaaaccccatctctactaaaaatacaaaattagccgggcgtggtagcgcatggctgtaatcctggctactcaggaggccgaggcagaagaattgcttgaactggggaggcagaggttgcggtgagcccagatcgcgccattgcactccagcctgggtaacaagagcaaaactctgtccaaaaaaaaaaaaa

SEQ ID NO: 196264 - DNA, 6687 bp, Homo sapiens
  Payload ID: 18718
  Gene Name: tumor necrosis factor (ligand) superfamily, member 15
  Uniprot ID: O95150
  ENST ID: ENST00000374045
  CDS Start-End: 115-870
aaaagggaaggaggagactgagtgattaagtcacccactgtgagagctggtcttctatttaatgggggctctctctgcccaggagtcagaggtgcctccaggagcagcaggagcatggccgaggatctgggactgagctttggggaaacagccagtgtggaaatgctgccagagcacggcagctgcaggcccaaggccaggagcagcagcgcacgctgggctctcacctgctgcctggtgttgctccccttccttgcaggactcaccacatacctgcttgtcagccagctccgggcccagggagaggcctgtgtgcagttccaggctctaaaaggacaggagtttgcaccttcacatcagcaagtttatgcacctcttagagcagacggagataagccaagggcacacctgacagttgtgagacaaactcccacacagcactttaaaaatcagttcccagctctgcactgggaacatgaactaggcctggccttcaccaagaaccgaatgaactataccaacaaattcctgctgatcccagagtcgggagactacttcatttactcccaggtcacattccgtgggatgacctctgagtgcagtgaaatcagacaagcaggccgaccaaacaagccagactccatcactgtggtcatcaccaaggtaacagacagctaccctgagccaacccagctcctcatggggaccaagtctgtatgcgaagtaggtagcaactggttccagcccatctacctcggagccatgttctccttgcaagaaggggacaagctaatggtgaacgtcagtgacatctctttggtggattacacaaaagaagataaaaccttctttggagccttcttactataggaggagagcaaatatcattatatgaaagtcctctgccaccgagttcctaattttctttgttcaaatgtaattataaccaggggttttcttggggccgggagtagggggcattccacagggacaacggtttagctatgaaatttggggcccaaaatttcacacttcatgtgccttactgatgagagtactaactggaaaaaggctgaagagagcaaatatattattaagatgggttggaggattggcgagtttctaaatattaagacactgatcactaaatgaatggatgatctactcgggtcaggattgaaagagaaatatttcaacaccttcctgctatacaatggtcaccagtggtccagttattgttcaatttgatcataaatttgcttcaattcaggagctttgaaggaagtccaaggaaagctctagaaaacagtataaactttcagaggcaaaatccttcaccaatttttccacatactttcatgccttgcctaaaaaaaatgaaaagagagttggtatgtctcatgaatgttcacacagaaggagttggttttcatgtcatctacagcatatgagaaaagctacctttcttttgattatgtacacagatatctaaataaggaagtatgagtttcacatgtatatcaaaaatacaacagttgcttgtattcagtagagttttcttgcccacctattttgtgctgggttctaccttaacccagaagacactatgaaaaacaagacagactccactcaaaatttatatgaacaccactagatacttcctgatcaaacatcagtcaacatactctaaagaataactccaagtcttggccaggcgcagtggctcacacctgtaatcccaacactttgggaggccaaggtgggtggatcatctaaggccgggagttcaagaccagcctgaccaacgtggagaaaccccatctctactaaaaatacaaaattagccgggcgtggtagcgcatggctgtaatcctggctactcaggaggccgaggcagaagaattgcttgaactggggaggcagaggttgcggtgagcccagatcgcgccattgcactccagcctgggtaacaagagcaaaactctgtccaaaaaaaaaaaaataaaataataactccaagcctttaaaaaatatcatctgaaactgttacatcagatttctggcactctactgactgtggaagatagccagctgactggaagatagccagctgattagttccctgaagaaacctgaagacagatacctggttaactagatcaactacactgccaacttgtttgatgctgagagacaatggacttattccatgggggaagggaaaaaagaagtcaatcaccaaatctgaagaagttaacctagatctttgaggtttgatttgcaactttatatgcagagtattatgtgggtattttcccttaaaatattcaaagggatttacatatgggattagctaatgagcctagccaagaccttccctggaggacaggctggtcattgcggaggtcccttctgtgcttcagtgggttcatatcctctagtccgtatgattttcctacgctaatatgtcaagggcaggagaggcagctctgttctcctagcctttgttgacttgtctgcaaagcaggaatctgcccatttgtttccaaggagcaaatgagctcatgagaatgaaagatgttaacttcatgcattctgtgccatctgagcatttcggtattatatgactggtgacccttggcccgtattataaatgcttcctatcctgggagacctcatggatgagtctgagaggaaatttggcaccaaaatcactctcactctggtttccagtagactatagaggcagagaggcatttgagaggctcctgagcaaagtgtccagtgtagcaggagcacttcattaatatttattgagttataattaaataaaaattaatttctgatttctcagtttggaggttaaggctctaaatatattttctaacctctgctaggctaacttaagccaggcctttttcttgccttccctttctcaaaacagtcagcacagactcagtgggagcacagaggagtgtggtcacctccacctggctcaccagagtcttcatagaggaagtgaagcctggaagaaactgggcgggccccagatgaccacagggaaagggcatctcagatggaggaattacccttgacttaaagcagaaaagaaagatttctcagtaactccaaaacttgcttgataggagaatattccctcaaccaattcctaggacaatatttattggtagatcaagaatgtttcctcaataactctagtctagctccatgatcagaactaacacccattaaaaacataaaatgttctttctgaaccggtcttcatggtgcgtgagagcaccaagcagctttggtatgcaggaggagttttgcacagaagagtggcctgctcaaacctgcccactgttctgtaggtgatctggtggatctggaaatttatcccaagacaggaatttcctaatattcgaagacatttgaggctttgggaaattctctgctgtgcatttatttggctcctgtcataagcttgttttttaaagaatgtatcatagctcaagtttttactgctgattttgttaaattctgtatagtatattttttacggaaaggcacagtcagacattcctaatagggctcatgtcagaacttctgttcccaaggcattatctccatagcaaaaattagtgcactgttttcaaaagtgaggtgggaaaatgcttttaagatcatgtgatgttcccctaaaaggggttaatggggtgtattcagggtttgggagggaggaagaagcatgctttagaaaacagtaaatttagggagaaaatgctttgttggttaaatgtcactcaaaaggctgaattcaaatcaattccacaaacatttactgagtacctactgcccctggggacacagagataaattatttagtctcagacacactcattctaacttcccagcacctctactgtctgcagattctttaatttattttggttgtattagctaattaattcgtaaactttaggcacatggatctattctcattatgaaaatggatgccatttgattaaggctgatgactaacaaaatgatttgtgtttactcgaagtgtttttttaaaaatagctactcaaggatagttttccataaatcaagaaggtaaaaaagttcccattttttattgtagaatccattatttaaactacatgtagagacaggttattatttgctatattcaagtttggtcatcaatacccttaaaaatattagaattttatggatgacccagaaatgctttgaaaatctgtgttcctcagcaaatacagagaccatgatcaaaatgcacagaatcactaacattttgatgctagcatggtttcagtctatttggcagaacagaattgattatgctactaaaatttctttttctttttttttttttttttttttgagacagagtcttgctttgtcacccaggctgaagtgcagtggcaggatctcagttcactgcaacctctgcctcccaggttcacgccattctcctgcttcagcctcccgagtagctgggactacaggctcccaccaccatgcccggctaattttttgcatttttagtagagacggggtttcaccgtgttagccaggatggtctcgatctcctgacctcgtgatccgcccgcctcagccttccaaagtgctgggattacaggcgtgagccactgtgcccggactctgattttttttttactaaggtacagtaagaaaagggaaaagtgtacgttttcacttcctgaaatatgtcaggttgaatcaataatagagcacaccagaactcttggctccatttcaacctaaactattcagttctcatcaccccagaggaaattccgcctctgtgctggtcagtaatccccctggattataaaagtttaactaactcactgtgcacaaggcacggccattgccaacattctcttgcaaggtattttcccaagcccttacccaattctgtttccatgattgtgacattggggattaattctgcaagacagaactgtttatattctgtaccttaaaaacacatgcaaacatctcttgccttaagatttctggctttcctatggcccagagtcctagaagtgttttgatatttgtagcagaattttcaagtgtacatccttatcctggatattaacatttttgcatcatattggcagctggacctacagagaatttagtagactgttaacctaataagccttgaatccttttgcaccagtggtgagagaatgtggatcagagccatcacctccatgccccgtcaccctctaacaaccacatttacaacttccccagctctgagacacacttgcctccaccccttccatcaccccattttaagatgaaaataccacaccagcctggaaggaagaagttacttgcccagggccacatagtgagttaagggctgatctagagctaggaagctgtcttcctgaaccataatcctggactcttctaacctctctactcatcgcaaatagagttcattttagtgatttgaaggaagatgggacaagtattttcaaacacctgtaggacaacatggaagtgggaggagacttctactgtagctccccagagaagagagctagggctacagagttgcagttacaaggttgccctctctggcttgatccccaaaggaattttctactccaaaatagaatttttctaggatgctatttctcagtccctggagatactcaaacaaagggcttgtcacaagggtttttgtagaagctattcttcacagaggttgggggagagattaagccaaaggatctctgaggtctttttcaaatctataattatgtggccttttgttcattgacttccatgtgttctagttgatcattacaaacctggcaggccttctcaagggttcagtaattagctgtcatttcccatttgtccagagagtgtccaacacaaaatacccctaagatcttggccaatagagaaatgtcatggaattttagaaatgacagtatctgcggagtttattccaagttatatcatttcaaagatgaagaaacccaggctcagagggagccatcacatccacaccctgtcacccttcgtggccagtgccagacagtagctagttggatgctaaaagtagaatttagatatcttaacaataagcccagcagtctttcaacttcattcgtaaatcatttttgttttgagcatctgtcacgtggcagcacttgcctggatactggagagctgagaaggaatgcgacaggcaagtcctactctcacagtgtatacattcaggaggaacaagacacacagtgccaagtaaataaagtagctgaacttcatcaaatgattttattcttaaagtcattaaagcatgtaatgttcccctttttttgtttcaggggtgtacagattgaagaagtgtaggtgtttatgtggttttagtgacaaaccccatgtgctttcattgattttatgttttatgttaaaacatcaaccgcaaggtaaaatgcatattgtatgttgttggatacgtacttaactggtatgcatcccatgtctttgggtactagtgtatgaattctaatctctgtaaatgaaatgttgtatgtgttaatatatttaatagatgtaacttaataaactggcattgaagactgaagaattttcacactgtca

SEQ ID NO: 196265 - DNA, 2008 bp, Homo sapiens
  Payload ID: 18719
  Gene Name: tumor necrosis factor (ligand) superfamily, member 18
  Uniprot ID: Q9UNG2
  ENST ID: ENST00000404377
  CDS Start-End: 2-601
catgacattgcatccttcacccatcacttgtgaatttttgttttccacagctctcatttctccaaaaatgtgtttgagccacttggaaaatatgcctttaagccattcaagaactcaaggagctcagagatcatcctggaagctgtggctcttttgctcaatagttatgttgctatttctttgctccttcagttggctaatctttatttttctccaattagagactgctaaggagccctgtatggctaagtttggaccattaccctcaaaatggcaaatggcatcttctgaacctccttgcgtgaataaggtgtctgactggaagctggagatacttcagaatggcttatatttaatttatggccaagtggctcccaatgcaaactacaatgatgtagctccttttgaggtgcggctgtataaaaacaaagacatgatacaaactctaacaaacaaatctaaaatccaaaatgtaggagggacttatgaattgcatgttggggacaccatagacttgatattcaactctgagcatcaggttctaaaaaataatacatactggggtatcattttactagcaaatccccaattcatctcctagagacttgatttgatctcctcattcccttcagcacatgtagaggtgccagtgggtggattggagggagaagatattcaatttctagagtttgtctgtctacaaaaatcaacacaaacagaactcctctgcacgtgaattttcatctatcatgcctatctgaaagagactcaggggaagagccaaagacttttggttggatctgcagagatacttcattaatccatgataaaacaaatatggatgacagaggacatgtgcttttcaaagaatctttatctaattcttgaattcatgagtggaaaaatggagttctattcccatggaagatttacctggtatgcaaaaaggatctggggcagtagcctggctttgttctcatattcttgggctgctgtaattcattcttctcatactcccatcttctgagaccctcccaataaaaagtagactgataggatggccacagatatgcctaccataccctactttagatatggtggtgttagaagataaagaacaatctgagaactattggaatagaggtacaagtggcataaaatggaatgtacgctatctggaaatttctcttggttttatcttcctcaggatgcagggtgctttaaaaagccttatcaaaggagtcattccgaaccctcacgtagagctttgtgagaccttactgttggtgtgtgtgtctaaacattgctaattgtaaagaaagagtaaccattagtaatcattaggtttaaccccagaatggtattatcattactggattatgtcatgtaatgatttagtatttttagctagctttccacagtttgcaaagtgctttcgtaaaacagttagcaattctatgaagttaattgggcaggcatttgggggaaaattttagtgatgagaatgtgatagcatagcatagccaactttcctcaactcataggacaagtgactacaagaggcaatgggtagtcccctgcattgcactgtctcagctttagaattgttatttctgctatcgtgttataagactctaaaacttagcgaattcacttttcaggaagcatattcccctttagcccaaggtgagcagagtgaagctacaacagatctttcctttaccagcacactttttttttttttcctgcctgaatcagggagatccaggatgctgttcaggccttatcccaaccaaattcccctcttcactttgcagggcccatcttagtcaaatgtgctaacttctaaaataataaatagcactaattcaaaatttttggactcttaaattagctacttgcaggttcttgttgaaaggtatataatattacattgtaaacaaatttaaaatatttatggatatttgtgaaaagctgcattatgttaaataatattacatgtaaagct

SEQ ID NO: 196266 - DNA, 3470 bp, Homo sapiens
  Payload ID: 18720
  Gene Name: tumor necrosis factor (ligand) superfamily, member 4
  Uniprot ID: P23510
  ENST ID: ENST00000281834
  CDS Start-End: 138-689
ggccctgggacctttgcctattttctgattgataggctttgttttgtctttacctccttctttctggggaaaacttcagttttatcgcacgttccccttttccatatcttcatcttccctctacccagattgtgaagatggaaagggtccaacccctggaagagaatgtgggaaatgcagccaggccaagattcgagaggaacaagctattgctggtggcctctgtaattcagggactggggctgctcctgtgcttcacctacatctgcctgcacttctctgctcttcaggtatcacatcggtatcctcgaattcaaagtatcaaagtacaatttaccgaatataagaaggagaaaggtttcatcctcacttcccaaaaggaggatgaaatcatgaaggtgcagaacaactcagtcatcatcaactgtgatgggttttatctcatctccctgaagggctacttctcccaggaagtcaacattagccttcattaccagaaggatgaggagcccctcttccaactgaagaaggtcaggtctgtcaactccttgatggtggcctctctgacttacaaagacaaagtctacttgaatgtgaccactgacaatacctccctggatgacttccatgtgaatggcggagaactgattcttatccatcaaaatcctggtgaattctgtgtcctttgaggggctgatggcaatatctaaaaccaggcaccagcatgaacaccaagctgggggtggacagggcatggattcttcattgcaagtgaaggagcctcccagctcagccacgtgggatgtgacaagaagcagatcctggccctcccgcccccacccctcagggatatttaaaacttattttatataccagttaatcttatttatccttatattttctaaattgcctagccgtcacaccccaagattgccttgagcctactaggcacctttgtgagaaagaaaaaatagatgcctcttcttcaagatgcattgtttctattggtcaggcaattgtcataataaacttatgtcattgaaaacggtacctgactaccatttgctggaaatttgacatgtgtgtggcattatcaaaatgaagaggagcaaggagtgaaggagtggggttatgaatctgccaaaggtggtatgaaccaacccctggaagccaaagcggcctctccaaggttaaattgattgcagtttgcatattgcctaaatttaaactttctcatttggtgggggttcaaaagaagaatcagcttgtgaaaaatcaggacttgaagagagccgtctaagaaataccacgtgctttttttctttaccattttgctttcccagcctccaaacatagttaatagaaatttcccttcaaagaactgtctggggatgtgatgctttgaaaaatctaatcagtgacttaagagagattttcttgtatacagggagagtgagataacttattgtgaagggttagctttactgtacaggatagcagggaactggacatctcagggtaaaagtcagtacggattttaatagcctggggaggaaaacacattctttgccacagacaggcaaagcaacacatgctcatcctcctgcctatgctgagatacgcactcagctccatgtcttgtacacacagaaacattgctggtttcaagaaatgaggtgatcctattatcaaattcaatctgatgtcaaatagcactaagaagttattgtgccttatgaaaaataatgatctctgtctagaaataccatagaccatatatagtctcacattgataattgaaactagaagggtctataatcagcctatgccagggcttcaatggaatagtatccccttatgtttagttgaaatgtccccttaacttgatataatgtgttatgcttatggcgctgtggacaatctgatttttcatgtcaactttccagatgatttgtaacttctctgtgccaaaccttttataaacataaatttttgagatatgtattttaaaattgtagcacatgtttccctgacattttcaatagaggatacaacatcacagaatctttctggatgattctgtgttatcaaggaattgtactgtgctacaattatctctagaatctccagaaaggtggagggctgttcgcccttacactaaatggtctcagttggatttttttttcctgttttctatttcctcttaagtacaccttcaactatattcccatccctctattttaatctgttatgaaggaaggtaaataaaaatgctaaatagaagaaattgtaggtaaggtaagaggaatcaagttctgagtggctgccaaggcactcacagaatcataatcatggctaaatatttatggagggcctactgtggaccaggcactgggctaaatacttacatttacaagaatcattctgagacagatattcaatgatatctggcttcactactcagaagattgtgtgtgtgtttgtgtgtgtgtgtgtgtgtgtatttcactttttgttattgaccatgttctgcaaaattgcagttactcagtgagtgatatccgaaaaagtaaacgtttatgactataggtaatatttaagaaaatgcatggttcatttttaagtttggaatttttatctatatttctcacagatgtgcagtgcacatgcaggcctaagtatatgttgtgtgtgttgtttgtctttgatgtcatggtcccctctcttaggtgctcactcgctttgggtgcacctggcctgctcttcccatgttggcctctgcaaccacacagggatatttctgctatgcaccagcctcactccaccttccttccatcaaaaatatgtgtgtgtgtctcagtccctgtaagtcatgtccttcacagggagaattaacccttcgatatacatggcagagttttgtgggaaaagaattgaatgaaaagtcaggagatcagaattttaaatttgacttagccactaactagccatgtaaccttgggaaagtcatttcccatttctgggtcttgcttttctttctgttaaatgagaggaatgttaaatatctaacagtttagaatcttatgcttacagtgttatctgtgaatgcacatattaaatgtctatgttcttgttgctatgagtcaaggagtgtaaccttctcctttactatgttgaatgtatttttttctggacaagcttacatcttcctcagccatctttgtgagtccttcaagagcagttatcaattgttagttagatattttctatttagagaatgcttaagggattccaatcccgatccaaatcataatttgttcttaagtatactgggcaggtcccctattttaagtcataattttgtatttagtgctttcctggctctcagagagtattaatattgatattaataatatagttaatagtaatattgctatttacatggaaacaaataaaagatctcagaattc

SEQ ID NO: 196267 - DNA, 3429 bp, Homo sapiens
  Payload ID: 18720
  Gene Name: tumor necrosis factor (ligand) superfamily, member 4
  Uniprot ID: P23510
  ENST ID: ENST00000367718
  CDS Start-End: 246-647
aaaacacaggacacatggctccattcaaggctaactgattgcacaacggctctgagcaggagagagcaaaaggtgaaccacagttgtacagcttgctggtggttggggtcacattggactatcaatatccaggagatgttgagaaaaagaggggatcctttccaacaagtcatccagcaactctgggacagaaggaaagctgtgggaagaaaagcagggtgctggtttctaggacactaaacctcatggtatcacatcggtatcctcgaattcaaagtatcaaagtacaatttaccgaatataagaaggagaaaggtttcatcctcacttcccaaaaggaggatgaaatcatgaaggtgcagaacaactcagtcatcatcaactgtgatgggttttatctcatctccctgaagggctacttctcccaggaagtcaacattagccttcattaccagaaggatgaggagcccctcttccaactgaagaaggtcaggtctgtcaactccttgatggtggcctctctgacttacaaagacaaagtctacttgaatgtgaccactgacaatacctccctggatgacttccatgtgaatggcggagaactgattcttatccatcaaaatcctggtgaattctgtgtcctttgaggggctgatggcaatatctaaaaccaggcaccagcatgaacaccaagctgggggtggacagggcatggattcttcattgcaagtgaaggagcctcccagctcagccacgtgggatgtgacaagaagcagatcctggccctcccgcccccacccctcagggatatttaaaacttattttatataccagttaatcttatttatccttatattttctaaattgcctagccgtcacaccccaagattgccttgagcctactaggcacctttgtgagaaagaaaaaatagatgcctcttcttcaagatgcattgtttctattggtcaggcaattgtcataataaacttatgtcattgaaaacggtacctgactaccatttgctggaaatttgacatgtgtgtggcattatcaaaatgaagaggagcaaggagtgaaggagtggggttatgaatctgccaaaggtggtatgaaccaacccctggaagccaaagcggcctctccaaggttaaattgattgcagtttgcatattgcctaaatttaaactttctcatttggtgggggttcaaaagaagaatcagcttgtgaaaaatcaggacttgaagagagccgtctaagaaataccacgtgctttttttctttaccattttgctttcccagcctccaaacatagttaatagaaatttcccttcaaagaactgtctggggatgtgatgctttgaaaaatctaatcagtgacttaagagagattttcttgtatacagggagagtgagataacttattgtgaagggttagctttactgtacaggatagcagggaactggacatctcagggtaaaagtcagtacggattttaatagcctggggaggaaaacacattctttgccacagacaggcaaagcaacacatgctcatcctcctgcctatgctgagatacgcactcagctccatgtcttgtacacacagaaacattgctggtttcaagaaatgaggtgatcctattatcaaattcaatctgatgtcaaatagcactaagaagttattgtgccttatgaaaaataatgatctctgtctagaaataccatagaccatatatagtctcacattgataattgaaactagaagggtctataatcagcctatgccagggcttcaatggaatagtatccccttatgtttagttgaaatgtccccttaacttgatataatgtgttatgcttatggcgctgtggacaatctgatttttcatgtcaactttccagatgatttgtaacttctctgtgccaaaccttttataaacataaatttttgagatatgtattttaaaattgtagcacatgtttccctgacattttcaatagaggatacaacatcacagaatctttctggatgattctgtgttatcaaggaattgtactgtgctacaattatctctagaatctccagaaaggtggagggctgttcgcccttacactaaatggtctcagttggatttttttttcctgttttctatttcctcttaagtacaccttcaactatattcccatccctctattttaatctgttatgaaggaaggtaaataaaaatgctaaatagaagaaattgtaggtaaggtaagaggaatcaagttctgagtggctgccaaggcactcacagaatcataatcatggctaaatatttatggagggcctactgtggaccaggcactgggctaaatacttacatttacaagaatcattctgagacagatattcaatgatatctggcttcactactcagaagattgtgtgtgtgtttgtgtgtgtgtgtgtgtgtgtatttcactttttgttattgaccatgttctgcaaaattgcagttactcagtgagtgatatccgaaaaagtaaacgtttatgactataggtaatatttaagaaaatgcatggttcatttttaagtttggaatttttatctatatttctcacagatgtgcagtgcacatgcaggcctaagtatatgttgtgtgtgttgtttgtctttgatgtcatggtcccctctcttaggtgctcactcgctttgggtgcacctggcctgctcttcccatgttggcctctgcaaccacacagggatatttctgctatgcaccagcctcactccaccttccttccatcaaaaatatgtgtgtgtgtctcagtccctgtaagtcatgtccttcacagggagaattaacccttcgatatacatggcagagttttgtgggaaaagaattgaatgaaaagtcaggagatcagaattttaaatttgacttagccactaactagccatgtaaccttgggaaagtcatttcccatttctgggtcttgcttttctttctgttaaatgagaggaatgttaaatatctaacagtttagaatcttatgcttacagtgttatctgtgaatgcacatattaaatgtctatgttcttgttgctatgagtcaaggagtgtaaccttctcctttactatgttgaatgtatttttttctggacaagcttacatcttcctcagccatctttgtgagtccttcaagagcagttatcaattgttagttagatattttctatttagagaatgcttaagggattccaatcccgatccaaatcataatttgttcttaagtatactgggcaggtcccctattttaagtcataattttgtatttagtgctttcctggctctcagagagtattaatattgatattaataatatagttaatagtaatattgctatttacatggaaacaaataaaagatctcagaattca

SEQ ID NO: 196268 - DNA, 1906 bp, Homo sapiens
  Payload ID: 18721
  Gene Name: tumor necrosis factor (ligand) superfamily, member 8
  Uniprot ID: P32971
  ENST ID: ENST00000223795
  CDS Start-End: 115-819
ccaagtcacatgattcaggattcagggggagaatccttcttggaacagagatgggcccagaactgaatcagatgaagagagataaggtgtgatgtggggaagactatataaagaatggacccagggctgcagcaagcactcaacggaatggcccctcctggagacacagccatgcatgtgccggcgggctccgtggccagccacctggggaccacgagccgcagctatttctatttgaccacagccactctggctctgtgccttgtcttcacggtggccactattatggtgttggtcgttcagaggacggactccattcccaactcacctgacaacgtccccctcaaaggaggaaattgctcagaagacctcttatgtatcctgaaaagggctccattcaagaagtcatgggcctacctccaagtggcaaagcatctaaacaaaaccaagttgtcttggaacaaagatggcattctccatggagtcagatatcaggatgggaatctggtgatccaattccctggtttgtacttcatcatttgccaactgcagtttcttgtacaatgcccaaataattctgtcgatctgaagttggagcttctcatcaacaagcatatcaaaaaacaggccctggtgacagtgtgtgagtctggaatgcaaacgaaacacgtataccagaatctctctcaattcttgctggattacctgcaggtcaacaccaccatatcagtcaatgtggatacattccagtacatagatacaagcacctttcctcttgagaatgtgttgtccatcttcttatacagtaattcagactgaacagtttctcttggccttcaggaagaaagcgcctctctaccatacagtatttcatccctccaaacacttgggcaaaaagaaaactttagaccaagacaaactacacagggtattaaatagtatacttctccttctgtctcttggaaagatacagctccagggttaaaaagagagtttttagtgaagtatctttcagatagcaggcagggaagcaatgtagtgtggtgggcagagccccacacagaatcagaagggatgaatggatgtcccagcccaacctctaattcactgtatggtcttgatctatttcttctgttttgagagcctccagttaaaatggggctccagtaccagagcagctagcaactctgccctaatgggaaatgaaggggagctgggtgtgagtgtttacactgtgcccttcacgggatacttcttttatctgcagatggcctaatacttagttgtccaagtcgcgatcaaggactctctcacacaggaaacttccctatactggcagatacacttgtgactgaaccatgcccagtttatgcctgtctgactgtcactctggcactaggaggctgatcttgtactccatatgaccccacccctaggaacccccagggaaaaccaggctgggacagccccctgttcctgagatggaaagcacaaatttaatacaccaccacaatggaaaacaagttcaaagacttttacttacagatcctggacagaaagggcataatgagtctgaagggcagtcctccttctctaggttacatgaggcaggaataagaagtcagacagagacagcaagacagttaacaatgtaggtaaagaaatagggtgtggtcactctcaattcactggcaaatgcctgaatggtctgtctgaaggaagcaacagagaagtggggaatccagtctgctaggcaggaaagatgcctctaagttcttgtctctggccagaggtgtggtatagaaccagaaacccatatcaagggtgactaagcccggcttctggtatgagaaattaaacttgtatacaaaatggttgccaaggcaacataaaattataagaattc

SEQ ID NO: 196269 - DNA, 1523 bp, Homo sapiens
  Payload ID: 18721
  Gene Name: tumor necrosis factor (ligand) superfamily, member 8
  ENST ID: ENST00000618336
  CDS Start-End: 293-787
aaccgtcattttcctacgcgccctctgacatcagccaccttctctgtagctagtttctctgcacacaacttaatccctggcaatgaaaaatgaacctctcccccacccttgctgccgcctctcgcctcacgcccccagagaagagtttctccaccaggcagcaggtgaaggtttttttccaagtcacatgattcaggattcagggggagaatccttcttggaacagagatgggcccagaactgaatcagatgaagagagataaggtgtgatgtggggaagactatataaagaatggacccagggctgcagcaagcactcaacggaatggcccctcctggagacacagccatgcatgtgccggcgggctccgtggccagccacctggggaccacgagccgcagctatttctatttgaccacagccactctggctctgtgccttgtcttcacggtggccactattatggtgttggtcgttcagaggacggactccattcccaactcacctgacaacgtccccctcaaaggaggaaattgctcagaagacctcttatgtatcctgaaaagggctccattcaagaagtcatgggcctacctccaagtggcaaagcatctaaacaaaaccaagttgtcttggaacaaagatggcattctccatggagtcagatatcaggatgggaatctggtgatccaattccctgattactgtggcatgatcctccaccattcacactctaccctggactctgggaagggacactgctgccttgaaactctacaaccctgaaccttgatgctggttgctgcagacaagaactgcttctaccctgggtcactgtcactgctaagtggaaagtcatgaacttgatggtaccagtcactctgggcctaaaccgacatagccaggaaacggttcaccccccacaaacagaatcatctagacctgtccatgatttggaatcgtggcccaatacttcctggccccagagagagaaaaaagtctgaccaccccctactcaaagtgccaactcatttccttcccagaattaatcacttcccaaaatgtatgactgtgtgaacatcaattcccttcaggggaaaaccccactcccacctctcaggctgtcatcttaccctatgaccccaacctgacaatcatgcaacagcccattattggtaccttttccaatgtttaggtgactcattcttatctacaatcactttgttgttctaggaaagtttttgacacagcaggcatttgatatatatttcttgattaaatgaaagattaaatgaataccatcttagatgtctgcatagtgctttaaagtttacaccactattctttcaaatagtacaagagagaactaagctgtgtactcaactgggaagaagcagaactgagagtgggagcacctggtattctgatttcttgtctagaactatactatattctgagatcactaaactacaacctcaggcgactctgcctacttttgtaaataaagttttattggaacaca

SEQ ID NO: 196270 - DNA, 1665 bp, Homo sapiens
  Payload ID: 18722
  Gene Name: tumor necrosis factor (ligand) superfamily, member 9
  Uniprot ID: P41273
  ENST ID: ENST00000245817
  CDS Start-End: 39-803
aaaaagcggcgcgctgtgtcttcccgcagtctctcgtcatggaatacgcctctgacgcttcactggaccccgaagccccgtggcctcccgcgccccgcgctcgcgcctgccgcgtactgccttgggccctggtcgcggggctgctgctgctgctgctgctcgctgccgcctgcgccgtcttcctcgcctgcccctgggccgtgtccggggctcgcgcctcgcccggctccgcggccagcccgagactccgcgagggtcccgagctttcgcccgacgatcccgccggcctcttggacctgcggcagggcatgtttgcgcagctggtggcccaaaatgttctgctgatcgatgggcccctgagctggtacagtgacccaggcctggcaggcgtgtccctgacggggggcctgagctacaaagaggacacgaaggagctggtggtggccaaggctggagtctactatgtcttctttcaactagagctgcggcgcgtggtggccggcgagggctcaggctccgtttcacttgcgctgcacctgcagccactgcgctctgctgctggggccgccgccctggctttgaccgtggacctgccacccgcctcctccgaggctcggaactcggccttcggtttccagggccgcttgctgcacctgagtgccggccagcgcctgggcgtccatcttcacactgaggccagggcacgccatgcctggcagcttacccagggcgccacagtcttgggactcttccgggtgacccccgaaatcccagccggactcccttcaccgaggtcggaataacgtccagcctgggtgcagcccacctggacagagtccgaatcctactccatccttcatggagacccctggtgctgggtccctgctgctttctctacctcaaggggcttggcaggggtccctgctgctgacctccccttgaggaccctcctcacccactccttccccaagttggaccttgatatttattctgagcctgagctcagataatatattatatatattatatatatatatatatttctatttaaagaggatcctgagtttgtgaatggacttttttagaggagttgttttgggggggggggggtcttcgacattgccgaggctggtcttgaactcctggacttagacgatcctcctgcctcagcctcccaagcaactgggattcatcctttctattaattcattgtacttatttgcttatttgtgtgtattgagcatctgtaatgtgccagcattgtgcccaggctagggggctatagaaacatctagaaatagactgaaagaaaatctgagttatggtaatacgtgaggaatttaaagactcatccccagcctccacctcctgtgtgatacttgggggctagcttttttctttctttcttttttttgagatggtcttgttctgtcaaccaggctagaatgcagcggtgcaatcatgagtcaatgcagcctccagcctcgacctcccgaggctcaggtgatcctcccatctcagcctctcgagtagctgggaccacagttgtgtgccaccacacttggctaactttttaatttttttgcggagacggtattgctatgttgccaaggttgtttacatgccagtacaatttataataaacactcatttttcctccctctg

SEQ ID NO: 196271 - DNA, 2714 bp, Homo sapiens
  Payload ID: 18723
  Gene Name: tumor necrosis factor receptor superfamily, member 10a
  Uniprot ID: O00220
  ENST ID: ENST00000221132
  CDS Start-End: 66-1472
actccgaatgcgaagttctgtcttgtcatagccaagcacgctgcttcttggattgacctggcaggatggcgccaccaccagctagagtacatctaggtgcgttcctggcagtgactccgaatcccgggagcgcagcgagtgggacagaggcagccgcggccacacccagcaaagtgtggggctcttccgcggggaggattgaaccacgaggcgggggccgaggagcgctccctacctccatgggacagcacggacccagtgcccgggcccgggcagggcgcgccccaggacccaggccggcgcgggaagccagccctcggctccgggtccacaagaccttcaagtttgtcgtcgtcggggtcctgctgcaggtcgtacctagctcagctgcaaccatcaaacttcatgatcaatcaattggcacacagcaatgggaacatagccctttgggagagttgtgtccaccaggatctcatagatcagaacatcctggagcctgtaaccggtgcacagagggtgtgggttacaccaatgcttccaacaatttgtttgcttgcctcccatgtacagcttgtaaatcagatgaagaagagagaagtccctgcaccacgaccaggaacacagcatgtcagtgcaaaccaggaactttccggaatgacaattctgctgagatgtgccggaagtgcagcagagggtgccccagagggatggtcaaggtcaaggattgtacgccctggagtgacatcgagtgtgtccacaaagaatcaggcaatggacataatatatgggtgattttggttgtgactttggttgttccgttgctgttggtggctgtgctgattgtctgttgttgcatcggctcaggttgtggaggggaccccaagtgcatggacagggtgtgtttctggcgcttgggtctcctacgagggcctggggctgaggacaatgctcacaacgagattctgagcaacgcagactcgctgtccactttcgtctctgagcagcaaatggaaagccaggagccggcagatttgacaggtgtcactgtacagtccccaggggaggcacagtgtctgctgggaccggcagaagctgaagggtctcagaggaggaggctgctggttccagcaaatggtgctgaccccactgagactctgatgctgttctttgacaagtttgcaaacatcgtgccctttgactcctgggaccagctcatgaggcagctggacctcacgaaaaatgagatcgatgtggtcagagctggtacagcaggcccaggggatgccttgtatgcaatgctgatgaaatgggtcaacaaaactggacggaacgcctcgatccacaccctgctggatgccttggagaggatggaagagagacatgcaagagagaagattcaggacctcttggtggactctggaaagttcatctacttagaagatggcacaggctctgccgtgtccttggagtgaaagactctttttaccagaggtttcctcttaggtgttaggagttaatacatattaggttttttttttttttaacatgtatacaaagtaaattcttagccaggtgtagtggctcatgcctgtaatcccagcactttgggaggctgaggcgggtggatcacttgaggtcagaagttcaagaccagcctgaccaacatcgtgaaatgccgtctttacaaaaaaatacaaaaattaactggatgtgatggtgtgtgcatatattctcggctactcgggaggctgaggcaggagaatcacttgaacccacgaggcagtgagctgagattgcaccactgcactccagcctgggacacagagcaagactctgtctcaagataaaataaaataaacttgaaagaattattgcccgactgaggctcacatgccaaaggaaaatctggttctcccctgagctggcctccgtgtgtttccttatcatggtggtcaattggaggtgttaatttgaatggattaaggaacacctagaacactggtaaggcattatttctgggacattatttctgggcatgtcttcgagggtgtttccagaggggattggcatgcgatcgggtggactgagtggaaaagacctacccttaatttgggggggcaccgtccgacagactggggagcaagatagaagaaaacaaaaaaaaaaggaaaagcaaatccatctgatctcctggagctgggacactcttctgcctgtggacatcagagtctaggatttctagcccttggactccagggcatacaccagtggcctcccgaaggatctaaggattttggccttgaactaagaattacaccatcggcttccctgggtcttaggtttttgggctggattaagtcctgcttccagcatttcagggtctctgctgtgcagatggcctgttgtggaacttctcaacctccattatcagatgcattaattcctccaataagtcccatttcatatatagtcatttaccccacaacatttcagtcaagggaacagcatataagatggtggccgtccagtaagctaaggttaatttattaattatttaatttatttaccttgagttcaagtcacaattaaagtacatatacctttggaaatttggacttttgtatataaaagtacttttttttggcgggggcagtgggcagctctcatcctaaacaaatgtgttatttggtacctatgcaaagatttggttaaaa

SEQ ID NO: 196272 - DNA, 693 bp, Homo sapiens
  Payload ID: 18723
  Gene Name: tumor necrosis factor receptor superfamily, member 10a
  ENST ID: ENST00000524158
  CDS Start-End: 469-693
cggggtccccggggccaggcaggagcgacccgggcctggaggcagcagagccccctcccgcaggaggctgggcccggggactccaccccgttggctgctgcctggcgcgtctccctcctgcccacacctcacgatgtatcgggaagtttcggaatcgatagagctcaagtcgtacctagctcagctgcaaccatcaaacttcatgatcaatcaattggcacacagcaatgggaacatagccctttgggagagttgtgtccaccaggatctcatagatcagaacatcctggagcctgtaaccggtgcacagagggtgtgggttacaccaatgcttccaacaatttgtttgcttgcctcccatgtacagcttgtaaatcagatgaagaagagagaagtccctgcaccacgaccaggaacacagcatgtcagtgcaaaccaggaactttccggaatgacaattctgctgagatgtgccggaagtgcagcagagggtgccccagagggatggtcaaggtcaaggattgtacgccctggagtgacatcgagtgtgtccacaaagaatcaggcaatggacataatatatgggtgattttggttgtgactttggttgttccgttgctgttggtggctgtgctgattgtctgttgttgcatcggctcaggttgtggaggggaccccaagtgcatggacagg

SEQ ID NO: 196273 - DNA, 978 bp, Homo sapiens
  Payload ID: 18723
  Gene Name: tumor necrosis factor receptor superfamily, member 10a
  ENST ID: ENST00000613472
  CDS Start-End: 1-933
atggcgccaccaccagctagagtacatctagcttgtaaatcagatgaagaagagagaagtccctgcaccacgaccaggaacacagcatgtcagtgcaaaccaggaactttccggaatgacaattctgctgagatgtgccggaagtgcagcagagggtgccccagagggatggtcaaggtcaaggattgtacgccctggagtgacatcgagtgtgtccacaaagaatcaggcaatggacataatatatgggtgattttggttgtgactttggttgttccgttgctgttggtggctgtgctgattgtctgttgttgcatcggctcaggttgtggaggggaccccaagtgcatggacagggtgtgtttctggcgcttgggtctcctacgagggcctggggctgaggacaatgctcacaacgagattctgagcaacgcagactcgctgtccactttcgtctctgagcagcaaatggaaagccaggagccggcagatttgacaggtgtcactgtacagtccccaggggaggcacagtgtctgctgggaccggcagaagctgaagggtctcagaggaggaggctgctggttccagcaaatggtgctgaccccactgagactctgatgctgttctttgacaagtttgcaaacatcgtgccctttgactcctgggaccagctcatgaggcagctggacctcacgaaaaatgagatcgatgtggtcagagctggtacagcaggcccaggggatgccttgtatgcaatgctgatgaaatgggtcaacaaaactggacggaacgcctcgatccacaccctgctggatgccttggagaggatggaagagagacatgcaagagagaagattcaggacctcttggtggactctggaaagttcatctacttagaagatggcacaggctctgccgtgtccttggagtgaaagactctttttaccagaggtttcctcttaggtgttaggagttaa

SEQ ID NO: 196274 - DNA, 4146 bp, Homo sapiens
  Payload ID: 18724
  Gene Name: tumor necrosis factor receptor superfamily, member 10b
  Uniprot ID: O14763
  ENST ID: ENST00000276431
  CDS Start-End: 286-1608
gcgcttgcggaggattgcgttgacgagactcttatttattgtcaccaacctgtggtggaatttgcagttgcacattggatctgattcgccccgccccgaatgacgcctgcccggaggcagtgaaagtacagccgcgccgccccaagtcagcctggacacataaatcagcacgcggccggagaaccccgcaatctctgcgcccacaaaatacaccgacgatgcccgatctactttaagggctgaaacccacgggcctgagagactataagagcgttccctaccgccatggaacaacggggacagaacgccccggccgcttcgggggcccggaaaaggcacggcccaggacccagggaggcgcggggagccaggcctgggccccgggtccccaagacccttgtgctcgttgtcgccgcggtcctgctgttggtctcagctgagtctgctctgatcacccaacaagacctagctccccagcagagagcggccccacaacaaaagaggtccagcccctcagagggattgtgtccacctggacaccatatctcagaagacggtagagattgcatctcctgcaaatatggacaggactatagcactcactggaatgacctccttttctgcttgcgctgcaccaggtgtgattcaggtgaagtggagctaagtccctgcaccacgaccagaaacacagtgtgtcagtgcgaagaaggcaccttccgggaagaagattctcctgagatgtgccggaagtgccgcacagggtgtcccagagggatggtcaaggtcggtgattgtacaccctggagtgacatcgaatgtgtccacaaagaatcaggtacaaagcacagtggggaagtcccagctgtggaggagacggtgacctccagcccagggactcctgcctctccctgttctctctcaggcatcatcataggagtcacagttgcagccgtagtcttgattgtggctgtgtttgtttgcaagtctttactgtggaagaaagtccttccttacctgaaaggcatctgctcaggtggtggtggggaccctgagcgtgtggacagaagctcacaacgacctggggctgaggacaatgtcctcaatgagatcgtgagtatcttgcagcccacccaggtccctgagcaggaaatggaagtccaggagccagcagagccaacaggtgtcaacatgttgtcccccggggagtcagagcatctgctggaaccggcagaagctgaaaggtctcagaggaggaggctgctggttccagcaaatgaaggtgatcccactgagactctgagacagtgcttcgatgactttgcagacttggtgccctttgactcctgggagccgctcatgaggaagttgggcctcatggacaatgagataaaggtggctaaagctgaggcagcgggccacagggacaccttgtacacgatgctgataaagtgggtcaacaaaaccgggcgagatgcctctgtccacaccctgctggatgccttggagacgctgggagagagacttgccaagcagaagattgaggaccacttgttgagctctggaaagttcatgtatctagaaggtaatgcagactctgccatgtcctaagtgtgattctcttcaggaagtcagaccttccctggtttaccttttttctggaaaaagcccaactggactccagtcagtaggaaagtgccacaattgtcacatgaccggtactggaagaaactctcccatccaacatcacccagtggatggaacatcctgtaacttttcactgcacttggcattatttttataagctgaatgtgataataaggacactatggaaatgtctggatcattccgtttgtgcgtactttgagatttggtttgggatgtcattgttttcacagcacttttttatcctaatgtaaatgctttatttatttatttgggctacattgtaagatccatctacacagtcgttgtccgacttcacttgatactatatgatatgaaccttttttgggtggggggtgcggggcagttcactctgtctcccaggctggagtgcaatggtgcaatcttggctcactatagccttgacctctcaggctcaagcgattctcccacctcagccatccaaatagctgggaccacaggtgtgcaccaccacgcccggctaattttttgtattttgtctagatataggggctctctatgttgctcagggtggtctcgaattcctggactcaagcagtctgcccacctcagactcccaaagcggtggaattagaggcgtgagcccccatgcttggccttacctttctacttttataattctgtatgttattattttatgaacatgaagaaactttagtaaatgtacttgtttacatagttatgtgaatagattagataaacataaaaggaggagacatacaatgggggaagaagaagaagtcccctgtaagatgtcactgtctgggttccagccctccctcagatgtactttggcttcaatgattggcaacttctacaggggccagtcttttgaactggacaaccttacaagtatatgagtattatttataggtagttgtttacatatgagtcgggaccaaagagaactggatccacgtgaagtcctgtgtgtggctggtccctacctgggcagtctcatttgcacccatagcccccatctatggacaggctgggacagaggcagatgggttagatcacacataacaatagggtctatgtcatatcccaagtgaacttgagccctgtttgggctcaggagatagaagacaaaatctgtctcccacgtctgccatggcatcaagggggaagagtagatggtgcttgagaatggtgtgaaatggttgccatctcaggagtagatggcccggctcacttctggttatctgtcaccctgagcccatgagctgccttttagggtacagattgcctacttgaggaccttggccgctctgtaagcatctgactcatctcagaaatgtcaattcttaaacactgtggcaacaggacctagaatggctgacgcattaaggttttcttcttgtgtcctgttctattattgttttaagacctcagtaaccatttcagcctctttccagcaaacccttctccatagtatttcagtcatggaaggatcatttatgcaggtagtcattccaggagtttttggtcttttctgtctcaaggcattgtgtgttttgttccgggactggtttgggtgggacaaagttagaattgcctgaagatcacacattcagactgttgtgtctgtggagttttaggagtggggggtgacctttctggtctttgcacttccatcctctcccacttccatctggcatcccacgcgttgtcccctgcacttctggaaggcacagggtgctgctgcctcctggtctttgcctttgctgggccttctgtgcaggacgctcagcctcagggctcagaaggtgccagtccggtcccaggtcccttgtcccttccacagaggccttcctagaagatgcatctagagtgtcagccttatcagtgtttaagatttttcttttatttttaatttttttgagacagaatctcactctctcgcccaggctggagtgcaacggtacgatcttggctcagtgcaacctccgcctcctgggttcaagcgattctcgtgcctcagcctccggagtagctgggattgcaggcacccgccaccacgcctggctaatttttgtatttttagtagagacggggtttcaccatgttggtcaggctggtctcgaactcctgacctcaggtgatccaccttggcctccgaaagtgctgggattacaggcgtgagccaccagccaggccaagctattcttttaaagtaagcttcctgacgacatgaaataattgggggttttgttgtttagttacattaggctttgctatatccccaggccaaatagcatgtgacacaggacagccatagtatagtgtgtcactcgtggttggtgtcctttcatgcttctgccctgtcaaaggtccctatttgaaatgtgttataatacaaacaaggaagcacattgtgtacaaaatacttatgtatttatgaatccatgaccaaattaaatatgaaaccttatataaaaa

SEQ ID NO: 196275 - DNA, 1723 bp, Homo sapiens
  Payload ID: 18724
  Gene Name: tumor necrosis factor receptor superfamily, member 10b
  Uniprot ID: O14763
  ENST ID: ENST00000347739
  CDS Start-End: 128-1363
cataaatcagcacgcggccggagaaccccgcaatctctgcgcccacaaaatacaccgacgatgcccgatctactttaagggctgaaacccacgggcctgagagactataagagcgttccctaccgccatggaacaacggggacagaacgccccggccgcttcgggggcccggaaaaggcacggcccaggacccagggaggcgcggggagccaggcctgggccccgggtccccaagacccttgtgctcgttgtcgccgcggtcctgctgttggtctcagctgagtctgctctgatcacccaacaagacctagctccccagcagagagcggccccacaacaaaagaggtccagcccctcagagggattgtgtccacctggacaccatatctcagaagacggtagagattgcatctcctgcaaatatggacaggactatagcactcactggaatgacctccttttctgcttgcgctgcaccaggtgtgattcaggtgaagtggagctaagtccctgcaccacgaccagaaacacagtgtgtcagtgcgaagaaggcaccttccgggaagaagattctcctgagatgtgccggaagtgccgcacagggtgtcccagagggatggtcaaggtcggtgattgtacaccctggagtgacatcgaatgtgtccacaaagaatcaggcatcatcataggagtcacagttgcagccgtagtcttgattgtggctgtgtttgtttgcaagtctttactgtggaagaaagtccttccttacctgaaaggcatctgctcaggtggtggtggggaccctgagcgtgtggacagaagctcacaacgacctggggctgaggacaatgtcctcaatgagatcgtgagtatcttgcagcccacccaggtccctgagcaggaaatggaagtccaggagccagcagagccaacaggtgtcaacatgttgtcccccggggagtcagagcatctgctggaaccggcagaagctgaaaggtctcagaggaggaggctgctggttccagcaaatgaaggtgatcccactgagactctgagacagtgcttcgatgactttgcagacttggtgccctttgactcctgggagccgctcatgaggaagttgggcctcatggacaatgagataaaggtggctaaagctgaggcagcgggccacagggacaccttgtacacgatgctgataaagtgggtcaacaaaaccgggcgagatgcctctgtccacaccctgctggatgccttggagacgctgggagagagacttgccaagcagaagattgaggaccacttgttgagctctggaaagttcatgtatctagaaggtaatgcagactctgccatgtcctaagtgtgattctcttcaggaagtcagaccttccctggtttaccttttttctggaaaaagcccaactggactccagtcagtaggaaagtgccacaattgtcacatgaccggtactggaagaaactctcccatccaacatcacccagtggatggaacatcctgtaacttttcactgcacttggcattatttttataagctgaatgtgataataaggacactatggaaatgtctggatcattccgtttgtgcgtactttgagatttggtttgggatgtcattgttttcacagcacttttttatcctaatgtaaatgctttatttatttatttgggctacattgtaagatccatctacacagtcgt

SEQ ID NO: 196276 - DNA, 1464 bp, Homo sapiens
  Payload ID: 18724
  Gene Name: tumor necrosis factor receptor superfamily, member 10b
  ENST ID: ENST00000523504
  CDS Start-End: 138-410
agcctggacacataaatcagcacgcggccggagaaccccgcaatctctgcgcccacaaaatacaccgacgatgcccgatctactttaagggctgaaacccacgggcctgagagactataagagcgttccctaccgccatggaacaacggggacagaacgccccggccgcttcgggggcccggaaaaggcacggcccaggacccagggaggcgcggggagccaggcctgggccccgggtccccaagacccttgtgctcgttgtcgccgcggtcctgctgttggacaccatatctcagaagacggtagagattgcatctcctgcaaatatggacaggactatagcactcactggaatgacctccttttctgcttgcgctgcaccaggtgtgattcaggtgaagtggagctaagtccctgcaccacgaccagaaacacagtgtgtcagtgcgaagaaggcaccttccgggaagaagattctcctgagatgtgccggaagtgccgcacagggtgtcccagagggatggtcaaggtcggtgattgtacaccctggagtgacatcgaatgtgtccacaaagaatcaggcatcatcataggagtcacagttgcagccgtagtcttgattgtggctgtgtttgtttgcaagtctttactgtggaagaaagtccttccttacctgaaaggcatctgctcaggtggtggtggggaccctgagcgtgtggacagaagctcacaacgacctggggctgaggacaatgtcctcaatgagatcgtgagtatcttgcagcccacccaggtccctgagcaggaaatggaagtccaggagccagcagagccaacaggtgtcaacatgttgtcccccggggagtcagagcatctgctggaaccggcagaagctgaaaggtctcagaggaggaggctgctggttccagcaaatgaaggtgatcccactgagactctgagacagtgcttcgatgactttgcagacttggtgccctttgactcctgggagccgctcatgaggaagttgggcctcatggacaatgagataaaggtggctaaagctgaggcagcgggccacagggacaccttgtacacgatgctgataaagtgggtcaacaaaaccgggcgagatgcctctgtccacaccctgctggatgccttggagacgctgggagagagacttgccaagcagaagattgaggaccacttgttgagctctggaaagttcatgtatctagaaggtaatgcagactctgccatgtcctaagtgtgattctcttcaggaagtcagaccttccctggtttaccttttttctggaaaaagcccaactggactccagtcagtaggaaagtgccacaattgtcacatgaccggtactggaagaaactctcccatccaacatcacccagtggatggaacatcctgtaacttttcactgcacttggcattatttttataagctg

SEQ ID NO: 196277 - DNA, 1718 bp, Homo sapiens
  Payload ID: 18725
  Gene Name: tumor necrosis factor receptor superfamily, member 10c, decoy without an intracellular domain
  Uniprot ID: O14798
  ENST ID: ENST00000356864
  CDS Start-End: 533-1312
ggagcaggctcaggatgggcctccagtgcctcctctggagctcactacccagactacagcagcgcagtgggcagcgcctcagctccttccccttctgctgcctacagcctggacaggacccggaatcaaaccgcaggccctgggtcaccgctgccggaaagagccagttcctgtccgtccatgcacccaccaccaaaacccaggccttcctggaggtgctaggggaggccatgccccttttctgagtgcttggaagtgactgctgcaagtgacaagtgaccacgccttttcccccgcgggtataaattcagaggcgctgcgctccgattctggcagtgcagctgtgggaacctctccacgcgcacgaactcagccaacgatttctgatagatttttgggagtttgaccagagatgcaaggggtgaaggagcgcttcctaccgttagggaactctggggacagagcgccccggccgcctgatggccgaggcagggtgcgacccaggacccaggacggcgtcgggaaccataccatggcccggatccccaagaccctaaagttcgtcgtcgtcatcgtcgcggtcctgctgccagtcctagcttactctgccaccactgcccggcaggaggaagttccccagcagacagtggccccacagcaacagaggcacagcttcaagggggaggagtgtccagcaggatctcatagatcagaacatactggagcctgtaacccgtgcacagagggtgtggattacaccaacgcttccaacaatgaaccttcttgcttcccatgtacagtttgtaaatcagatcaaaaacataaaagttcctgcaccatgaccagagacacagtgtgtcagtgtaaagaaggcaccttccggaatgaaaactccccagagatgtgccggaagtgtagcaggtgccctagtggggaagtccaagtcagtaattgtacgtcctgggatgatatccagtgtgttgaagaatttggtgccaatgccactgtggaaaccccagctgctgaagagacaatgaacaccagcccggggactcctgccccagctgctgaagagacaatgaacaccagcccggggactcctgccccagctgctgaagagacaatgaccaccagcccggggactcctgccccagctgctgaagagacaatgaccaccagcccggggactcctgccccagctgctgaagagacaatgatcaccagcccggggactcctgcctcttctcattacctctcatgcaccatcgtagggatcatagttctaattgtgcttctgattgtgtttgtttgaaagacttcactgtggaagaaattccttccttacctgaaaggttcaggtaggcgctggctgagggcggggggcgctggacactctctgccctgcctccctctgctgtgttcccacagacagaaacgcctgcccctgccccaagtcctggtgtctccagcctggctctatcttcctccttgtgatcgtcccatccccacatcccgtgcaccccccaggaccctggtctcatcagtccctctcctggagctgggggtccacacatctcccagccaagtccaagagggcagggccagttcctcccatcttcaggcccagccaggcagggggcagtcggctcctcaactgggtgacaagggtgaggatgagaagtggtcacgggatttattcagccttggtcagagcagaa

SEQ ID NO: 196278 - DNA, 1242 bp, Homo sapiens
  Payload ID: 18725
  Gene Name: tumor necrosis factor receptor superfamily, member 10c, decoy without an intracellular domain
  ENST ID: ENST00000397703
  CDS Start-End: 686-1153
gccagccgccctggaggacgtggaggggaggcagccacagtcctggagaggcctgagcctgaacaacatggcttcccccagcgtgagactcgcttgtcctcccaccgcctgctctctcctgatgaccaggttccaggagttatcaaagaacagcctctgagctgcgtggagaaagccatggagacagccagaagaaaacggcaggattagattaacctgtgattcctggctggccacgaggtcacccatggcatggagctgcccacaacgcccttctcagcatgaagcatcctgaaagatccagggccaggttccccaggattggggagttggaagctcattggcactgtcaaatttgaagaagaggcgtgctctgactgcctggacaggacccggaatcaaaccgcaggccctgggtcaccgctgccggaaagagccagttcctgtccgtccatgcacccaccaccaaaacccaggccttcctggaggtgctaggggaggccatgccccttttctgagtgcttggaagtgactgctgcaagtgacaagtgaccacgccttttcccccgcgggtataaattcagaggcgctgcgctccgattctggcagtgcagctgtgggaacctctccacgcgcacgaactcagccaacgatttctgatagatttttgggagtttgaccagagatgcaaggggtgaaggagcgcttcctaccgttagggaactctggggacagagcgccccggccgcctgatggccgaggcagggtgcgacccaggacccaggacggcgtcgggaaccataccatggcccggatccccaagaccctaaagttcgtcgtcgtcatcgtcgcggtcctgctgccagtgagtcccggccgcggtccctggctggggaagagcgcacctggcgccgggagggggcagggagacggggacacggcagggatgcctggccctggtcacctgcggccgggcatgtccgggcaggacgaactcgccgtcggagtcaggggaagaactgggtccccgggctgggcaggagggacccggccgcgagggagcagagaggcggtccccctggctgccccgagcccgcgaagggagggaagttccagaatcgagagagggagggagtcaaggtggaacccatagagtgagcctcctgaagacacagagcggttgcctctctcattaattaattaattagttaataaaattaaccccatgtttacattcttaaa

SEQ ID NO: 196279 - DNA, 894 bp, Homo sapiens
  Payload ID: 18725
  Gene Name: tumor necrosis factor receptor superfamily, member 10c, decoy without an intracellular domain
  ENST ID: ENST00000517558
  CDS Start-End: 202-405
ggcagtgcagctgtgggaacctctccacgcgcacgaactcagccaacgatttctgatagatttttgggagtttgaccagagatgcaaggggtgaaggagcgcttcctaccgttagggaactctggggacagagcgccccggccgcctgatggccgaggcagggtgcgacccaggacccaggacggcgtcgggaaccataccatggcccggatccccaagaccctaaagttcgtcgtcgtcatcgtcgcggtcctgctgccagatctcatagatcagaacatactggagcctgtaacccgtgcacagagggtgtggattacaccaacgcttccaacaatgaaccttcttgcttcccatgtacagtttgtaaatcagatcaaaaacataaaagttcctgcaccatgaccagagacacagtgtgtcagtgtaaagaaggcaccttccggaatgaaaactccccagagatgtgccggaagtgtagcaggtgccctagtggggaagtccaagtcagtaattgtacgtcctgggatgatatccagtgtgttgaagaatttggtgccaatgccactgtggaaaccccagctgctgaagagacaatgaacaccagcccggggactcctgccccagctgctgaagagacaatgaacaccagcccggggactcctgccccagctgctgaagagacaatgaccaccagcccggggactcctgccccagctgctgaagagacaatgaccaccagcccggggactcctgccccagctgctgaagagacaatgatcaccagcccggggactcctgcctcttctcattacctctcatgcaccatcgtagggatcatagttctaattgtgcttctgattgtgtttgtttgaaagacttcactgtggaaga

SEQ ID NO: 196280 - DNA, 3538 bp, Homo sapiens
  Payload ID: 18726
  Gene Name: tumor necrosis factor receptor superfamily, member 10d, decoy with truncated death domain
  Uniprot ID: Q9UBN6
  ENST ID: ENST00000312584
  CDS Start-End: 96-1256
ggcagtgtagctgcgagaacctttgcacgcgcacaaactacggggacgatttctgattgatttttggcgctttcgatccaccctcctcccttctcatgggactttggggacaaagcgtcccgaccgcctcgagcgctcgagcagggcgctatccaggagccaggacagcgtcgggaaccagaccatggctcctggaccccaagatccttaagttcgtcgtcttcatcgtcgcggttctgctgccggtccgggttgactctgccaccatcccccggcaggacgaagttccccagcagacagtggccccacagcaacagaggcgcagcctcaaggaggaggagtgtccagcaggatctcatagatcagaatatactggagcctgtaacccgtgcacagagggtgtggattacaccattgcttccaacaatttgccttcttgcctgctatgtacagtttgtaaatcaggtcaaacaaataaaagttcctgtaccacgaccagagacaccgtgtgtcagtgtgaaaaaggaagcttccaggataaaaactcccctgagatgtgccggacgtgtagaacagggtgtcccagagggatggtcaaggtcagtaattgtacgccccggagtgacatcaagtgcaaaaatgaatcagctgccagttccactgggaaaaccccagcagcggaggagacagtgaccaccatcctggggatgcttgcctctccctatcactaccttatcatcatagtggttttagtcatcattttagctgtggttgtggttggcttttcatgtcggaagaaattcatttcttacctcaaaggcatctgctcaggtggtggaggaggtcccgaacgtgtgcacagagtccttttccggcggcgttcatgtccttcacgagttcctggggcggaggacaatgcccgcaacgagaccctgagtaacagatacttgcagcccacccaggtctctgagcaggaaatccaaggtcaggagctggcagagctaacaggtgtgactgtagagttgccagaggagccacagcgtctgctggaacaggcagaagctgaagggtgtcagaggaggaggctgctggttccagtgaatgacgctgactccgctgacatcagcaccttgctggatgcctcggcaacactggaagaaggacatgcaaaggaaacaattcaggaccaactggtgggctccgaaaagctcttttatgaagaagatgaggcaggctctgctacgtcctgcctgtgaaagaatctcttcaggaaaccagagcttccctcatttaccttttctcctacaaagggaagcagcctggaagaaacagtccagtacttgacccatgccccaacaaactctactatccaatatggggcagcttaccaatggtcctagaactttgttaacgcacttggagtaatttttatgaaatactgcgtgtgataagcaaacgggagaaatttatatcagattcttggctgcatagttatacgattgtgtattaagggtcgttttaggccacatgcggtggctcatgcctgtaatcccagcactttgataggctgaggcaggtggattgcttgagctcgggagtttgagaccagcctcatcaacacagtgaaactccatctcaatttaaaaagaaaaaaagtggttttaggatgtcattctttgcagttcttcatcatgagacaagtctttttttctgcttcttatattgcaagctccatctctactggtgtgtgcatttaatgacatctaactacagatgccgcacagccacaatgctttgccttatagttttttaactttagaacgggattatcttgttattacctgtattttcagtttcggatatttttgacttaatgatgagattatcaagacgtagccctatgctaagtcatgagcatatggacttacgagggttcgacttagagttttgagctttaagataggattattggggcttacccccaccttaattagagaaacatttatattgcttactactgtaggctgtacatctcttttccgatttttgtataatgatgtaaacatggaaaaactttaggaaatgcacttattaggctgtttacatgggttgcctggatacaaatcagcagtcaaaaatgactaaaaatataactagtgacggagggagaaatcctccctctgtgggaggcacttactgcattccagttctccctcctgcgccctgagactggaccagggtttgatggctggcagcttctcaaggggcagcttgtcttacttgttaattttagaggtatatagccatatttatttataaataaatatttatttatttatttataagtagatgtttacatatgcccaggattttgaagagcctggtatctttgggaagccatgtgtctggtttgtcgtgctgggacagtcatgggactgcatcttccgacttgtccacagcagatgaggacagtgagaattaagttagatccgagactgcgaagagcttctctttcaagcgccattacagttgaacgttagtgaatcttgagcctcatttgggctcagggcagagcaggtgtttatctgccccggcatctgccatggcatcaagagggaagagtggacggtgcttgggaatggtgtgaaatggttgccgactcaggcatggatgggcccctctcgcttctggtggtctgtgaactgagtccctgggatgccttttagggcagagattcctgagctgcgttttagggtacagattccctgtttgaggagcttggcccctctgtaagcatctgactcatctcagagatatcaattcttaaacactgtgacaacaggatctaaaatggctgacacatttgtccttgtgtcacgttccattattttatttaaaaacctcagtaatcgttttagcttctttccagcaaactcttctccacagtagcccagtcgtggtaggataaattacggatatagtcattctaggggtttcagtcttttccatctcaaggcattgtgtgttttgttccgggactggtttggctgggacaaagttagaactgcctgaagttcgcacattcagattgttgtgtccatggagttttaggaggggatggcctttccggtcttcgcacttccatcctctcccacttccatctggcgtcccacaccttgtcccctgcacttctggatgacacagggtgctgctgcctcctagtctttgcctttgctgggccttctgtgcaggagacttggtctcaaagctcagagagagccagtccggtcccagctcctttgtcccttcctcagaggccttccttgaagatgcatctagactaccagccttatcagtgtttaagcttattcctttaacataagcttcctgacaacatgaaattgttggggttttttggcgttggttgatttgtttaggttttgctttatacccgggccaaatagcacataacacctggttatatatgaaatactcatatgtttatgaccaaaataaatatgaaacctcatattaaaaa

SEQ ID NO: 196281 - DNA, 3591 bp, Homo sapiens
  Payload ID: 18727
  Gene Name: tumor necrosis factor receptor superfamily, member 11a, NFKB activator
  Uniprot ID: Q9Y6Q6
  ENST ID: ENST00000269485
  CDS Start-End: 67-966
ggcagccgcgcccgctgggccacagaggccgctgaggccgcggcgcccgccagcctgtcccgcgccatggccccgcgcgcccggcggcgccgcccgctgttcgcgctgctgctgctctgcgcgctgctcgcccggctgcaggtggctttgcagatcgctcctccatgtaccagtgagaagcattatgagcatctgggacggtgctgtaacaaatgtgaaccaggaaagtacatgtcttctaaatgcactactacctctgacagtgtatgtctgccctgtggcccggatgaatacttggatagctggaatgaagaagataaatgcttgctgcataaagtttgtgatacaggcaaggccctggtggccgtggtcgccggcaacagcacgaccccccggcgctgcgcgtgcacggctgggtaccactggagccaggactgcgagtgctgccgccgcaacaccgagtgcgcgccgggcctgggcgcccagcacccgttgcagctcaacaaggacacagtgtgcaaaccttgccttgcaggctacttctctgatgccttttcctccacggacaaatgcagaccctggaccaactgtaccttccttggaaagagagtagaacatcatgggacagagaaatccgatgcggtttgcagttcttctctgccagctagaaaaccaccaaatggaaatgtgactggaaacagtaactccacgttcatctccagcgggcaggtgatgaacttcaagggcgacatcatcgtggtctacgtcagccagacctcgcaggagggcgcggcggcggctgcggagcccatgggccgcccggtgcaggaggagaccctggcgcgccgagactccttcgcggggaacggcccgcgcttcccggacccgtgcggcggccccgaggggctgcgggagccggagaaggcctcgaggccggtgcaggagcaaggcggggccaaggcttgagcgccccccatggctgggagcccgaagctcggagccagggctcgcgagggcagcaccgcagcctctgccccagccccggccacccagggatcgatcggtacagtcgaggaagaccacccggcattctctgcccactttgccttccaggaaatgggcttttcaggaagtgaattgatgaggactgtccccatgcccacggatgctcagcagcccgccgcactggggcagatgtctcccctgccactcctcaaactcgcagcagtaatttgtggcactatgacagctatttttatgactatcctgttctgtgggggggggggtctgttttccccccatatttgtattccttttcataacttttcttgatatctttcctccctcttttttaatgtaaaggttttctcaaaaattctcctaaaggtgagggtctctttcttttctcttttccttttttttttctttttttggcaacctggctctggcccaggctagagtgcagtggtgcgattatagcccggtgcagcctctaactcctgggctcaagcaatccaagtgatcctcccacctcaaccttcggagtagctgggatcacagctgcaggccacgcccagcttcctccccccgactccccccccagagacacggtcccaccatgttacccagcctggtctcaaactccccagctaaagcagtcctccagcctcggcctcccaaagtactgggattacaggcgtgagcccccacgctggcctgctttacgtattttcttttgtgcccctgctcacagtgttttagagatggctttcccagtgtgtgttcattgtaaacacttttgggaaagggctaaacatgtgaggcctggagatagttgctaagttgctaggaacatgtggtgggactttcatattctgaaaaatgttctatattctcatttttctaaaagaaagaaaaaaggaaacccgatttatttctcctgaatctttttaagtttgtgtcgttccttaagcagaactaagctcagtatgtgaccttacccgctaggtggttaatttatccatgctggcagaggcactcaggtacttggtaagcaaatttctaaaactccaagttgctgcagcttggcattcttcttattctagaggtctctctggaaaagatggagaaaatgaacaggacatggggctcctggaaagaaagggcccgggaagttcaaggaagaataaagttgaaattttaatttgcattttttttgtctagataagaatagcgtgaatagatcctcttttattcgtaaataatcgtgcatctgtgggttagccttgtagaagtggaaaacattccattttccaatgcatttaaatgtaaagccaaatctgcatgttgtgaatttaagaaaacttattatcctaaaggtgcctttctcttggcatcatcccgcttgtgagaagcctagaggacgctccaggtggaaggaaatcccctgggtggttttatcttttgttacccagtgagcactggttccccgcaaatactggggaaaagcaaaaatacacaagcaagttaaaattaattttgcacatctgggaggttataaaagaaagcactaatagtagtcactgcccagactttactggccacaaatgcccagctgaagagcatgactgtggatcactggtttttccctcctgctggaaatgctggggtggtagcggtcgattaggattttcagtggagaagcacaggacagttctgtaatttatgggactccttagccaacataaagaactgcaggaaataactgcacagccaggaggatccgttggtgggaatttaccgtcattcctgcccttttatttaacatcatccacagagagatgttatacaaatggaggaaaccattataccttttgatatggaatatattacagagttacagttcacaaagtagaatgctgagctgaaaacccgagtttctgctgtgactgtcatctcactgagcacttcgcttttctttgcttttattttttccttctataaaaaggcaataatgataatttataatagtttccctacccagagatattagaagtatgctacagtgaatgttaaagtaccttgagatccttaaatcaaaggtgctatatacataagtaagactctactttcagaaaaaggtaatattatttcctgcactgatccctactaattctatattgatccaaaggcaactcaatgctaaaaaatgtatagaaaatataagtctgtgtctgtgtactgtagagatgtatgtgacaagtgtaaacaaaatgaactgaagcagtaatgaacagttattagggggaacatgataaagagattatattaagcttatgtttcaccataaaatcctttttatggcttactaaaaccgagctcactgtaaaatcatgatccaacttattgctaatctttatgatatgcttattcctaatctttatggtatggtgtcaaccgttcatttgtatcttattgctcattccctggaccacagactagggacagaaaatacttgctttaataatatatatgctgttgatttcacaaaaatttattaaaatacagcctgggtacccagtgaaagagctg

SEQ ID NO: 196282 - DNA, 8147 bp, Homo sapiens
  Payload ID: 18727
  Gene Name: tumor necrosis factor receptor superfamily, member 11a, NFKB activator
  Uniprot ID: Q9Y6Q6
  ENST ID: ENST00000586569
  CDS Start-End: 39-1889
ccgctgaggccgcggcgcccgccagcctgtcccgcgccatggccccgcgcgcccggcggcgccgcccgctgttcgcgctgctgctgctctgcgcgctgctcgcccggctgcaggtggctttgcagatcgctcctccatgtaccagtgagaagcattatgagcatctgggacggtgctgtaacaaatgtgaaccaggaaagtacatgtcttctaaatgcactactacctctgacagtgtatgtctgccctgtggcccggatgaatacttggatagctggaatgaagaagataaatgcttgctgcataaagtttgtgatacaggcaaggccctggtggccgtggtcgccggcaacagcacgaccccccggcgctgcgcgtgcacggctgggtaccactggagccaggactgcgagtgctgccgccgcaacaccgagtgcgcgccgggcctgggcgcccagcacccgttgcagctcaacaaggacacagtgtgcaaaccttgccttgcaggctacttctctgatgccttttcctccacggacaaatgcagaccctggaccaactgtaccttccttggaaagagagtagaacatcatgggacagagaaatccgatgcggtttgcagttcttctctgccagctagaaaaccaccaaatgaaccccatgtttacttgcccggtttaataattctgcttctcttcgcgtctgtggccctggtggctgccatcatctttggcgtttgctataggaaaaaagggaaagcactcacagctaatttgtggcactggatcaatgaggcttgtggccgcctaagtggagataaggagtcctcaggtgacagttgtgtcagtacacacacggcaaactttggtcagcagggagcatgtgaaggtgtcttactgctgactctggaggagaagacatttccagaagatatgtgctacccagatcaaggtggtgtctgtcagggcacatgtgtaggaggtggtccctacgcacaaggcgaagatgccaggatgctctcattggtcagcaagaccgagatagaggaagacagcttcagacagatgcccacagaagatgaatacatggacaggccctcccagcccacagaccagttactgttcctcactgagcctggaagcaaatccacacctcctttctctgaacccctggaggtgggggagaatgacagtttaagccagtgcttcacggggacacagagcacagtgggttcagaaagctgcaactgcactgagcccctgtgcaggactgattggactcccatgtcctctgaaaactacttgcaaaaagaggtggacagtggccattgcccgcactgggcagccagccccagccccaactgggcagatgtctgcacaggctgccggaaccctcctggggaggactgtgaacccctcgtgggttccccaaaacgtggacccttgccccagtgcgcctatggcatgggccttccccctgaagaagaagccagcaggacggaggccagagaccagcccgaggatggggctgatgggaggctcccaagctcagcgagggcaggtgccgggtctggaagctcccctggtggccagtcccctgcatctggaaatgtgactggaaacagtaactccacgttcatctccagcgggcaggtgatgaacttcaagggcgacatcatcgtggtctacgtcagccagacctcgcaggagggcgcggcggcggctgcggagcccatgggccgcccggtgcaggaggagaccctggcgcgccgagactccttcgcggggaacggcccgcgcttcccggacccgtgcggcggccccgaggggctgcgggagccggagaaggcctcgaggccggtgcaggagcaaggcggggccaaggcttgagcgccccccatggctgggagcccgaagctcggagccagggctcgcgagggcagcaccgcagcctctgccccagccccggccacccagggatcgatcggtacagtcgaggaagaccacccggcattctctgcccactttgccttccaggaaatgggcttttcaggaagtgaattgatgaggactgtccccatgcccacggatgctcagcagcccgccgcactggggcagatgtctcccctgccactcctcaaactcgcagcagtaatttgtggcactatgacagctatttttatgactatcctgttctgtgggggggggggtctgttttccccccatatttgtattccttttcataacttttcttgatatctttcctccctcttttttaatgtaaaggttttctcaaaaattctcctaaaggtgagggtctctttcttttctcttttccttttttttttctttttttggcaacctggctctggcccaggctagagtgcagtggtgcgattatagcccggtgcagcctctaactcctgggctcaagcaatccaagtgatcctcccacctcaaccttcggagtagctgggatcacagctgcaggccacgcccagcttcctccccccgactccccccccagagacacggtcccaccatgttacccagcctggtctcaaactccccagctaaagcagtcctccagcctcggcctcccaaagtactgggattacaggcgtgagcccccacgctggcctgctttacgtattttcttttgtgcccctgctcacagtgttttagagatggctttcccagtgtgtgttcattgtaaacacttttgggaaagggctaaacatgtgaggcctggagatagttgctaagttgctaggaacatgtggtgggactttcatattctgaaaaatgttctatattctcatttttctaaaagaaagaaaaaaggaaacccgatttatttctcctgaatctttttaagtttgtgtcgttccttaagcagaactaagctcagtatgtgaccttacccgctaggtggttaatttatccatgctggcagaggcactcaggtacttggtaagcaaatttctaaaactccaagttgctgcagcttggcattcttcttattctagaggtctctctggaaaagatggagaaaatgaacaggacatggggctcctggaaagaaagggcccgggaagttcaaggaagaataaagttgaaattttaatttgcattttttttgtctagataagaatagcgtgaatagatcctcttttattcgtaaataatcgtgcatctgtgggttagccttgtagaagtggaaaacattccattttccaatgcatttaaatgtaaagccaaatctgcatgttgtgaatttaagaaaacttattatcctaaaggtgcctttctcttggcatcatcccgcttgtgagaagcctagaggacgctccaggtggaaggaaatcccctgggtggttttatcttttgttacccagtgagcactggttccccgcaaatactggggaaaagcaaaaatacacaagcaagttaaaattaattttgcacatctgggaggttataaaagaaagcactaatagtagtcactgcccagactttactggccacaaatgcccagctgaagagcatgactgtggatcactggtttttccctcctgctggaaatgctggggtggtagcggtcgattaggattttcagtggagaagcacaggacagttctgtaatttatgggactccttagccaacataaagaactgcaggaaataactgcacagccaggaggatccgttggtgggaatttaccgtcattcctgcccttttatttaacatcatccacagagagatgttatacaaatggaggaaaccattataccttttgatatggaatatattacagagttacagttcacaaagtagaatgctgagctgaaaacccgagtttctgctgtgactgtcatctcactgagcacttcgcttttctttgcttttattttttccttctataaaaaggcaataatgataatttataatagtttccctacccagagatattagaagtatgctacagtgaatgttaaagtaccttgagatccttaaatcaaaggtgctatatacataagtaagactctactttcagaaaaaggtaatattatttcctgcactgatccctactaattctatattgatccaaaggcaactcaatgctaaaaaatgtatagaaaatataagtctgtgtctgtgtactgtagagatgtatgtgacaagtgtaaacaaaatgaactgaagcagtaatgaacagttattagggggaacatgataaagagattatattaagcttatgtttcaccataaaatcctttttatggcttactaaaaccgagctcactgtaaaatcatgatccaacttattgctaatctttatgatatgcttattcctaatctttatggtatggtgtcaaccgttcatttgtatcttattgctcattccctggaccacagactagggacagaaaatacttgctttaataatatatatgctgttgatttcacaaaaatttattaaaatacagcctgggtacccagtgaaagagctgaaatggaaatggagtatcatgtttcctactcacattttactcagctgtcggaaggaagaatgaatttctcaagagcagtttgaatgtgttagatcagaaccttcatgtggtggggaaaatgggattatttcagtgtaacaaaccacccaaagacttagtggcttaaaatagtcaccattggccaggcacagcggttcatgcctcccagtgctttgggaggccaaggcaggaggatcacttgaggacagtagttagagatcaaactgggcaatggagtgagacctcgtctctacaaaaaatacaaaacttatctgggcacggtggtgtgcacctgcagtcctggctactcaggaggctgaggcaggaggatgcttgagtccaggagttcaaggttactgtgagctttgattgggtcagtgcactccagtgtaaaaaaacaaaaataaaaaccaccacttatttagctcccaattctatgggttggatcagcttgggtggttcttcaggcctggtccctcctggcctggtttgcttacccatttacaatgacccggctagttggccgggccaggctgtgtgctctccacctgtctcccatccttccagccacctagctgggcatgctctcatggtggtgtcgagcctgagaacaagcagaaacctgccaggcttcttgaggcctaggctctaactggcatgctgtcacttctgccacattctgtgggccaaagcaggtcacaaaggcagcccagatccaagggatgggggagcagcatatccccccatgggaagagttgcggaatgagagggtagggggtggacacacagaggggaagatggcccccttgccatctgtccaccacagggcactgcgtggagtaaaatgctgcagagaagagtgcattctgggaaaaaaagaggaacatatcccagcccctaaccagtgagtagctccttctctggtgattgaattcccttaatgcacagcactatagattcccacaatgaaagggacacccacgttcatatttaagtgctgtgtcaaaattctttccagagccaaatataggtgatttgggaattgagcctactgtactgcttccacattcctttggcacagaaaactgaaaagtcacaacttctaaaatcaagaaaactggtgagataccttggggtagagaaacctgcatataaacagataaaagatcgagtgttcacccttcacctcagctcaacaaacaaactcttgttacgattatacaagggtgagcttgagcaaaggtgctgtctttggtggaagaaacgtagttttgagttgtttgctctttgacagtctctgatggcatgtgagtctggtgcattgctgtgggctgcgctgggcacaagttgcataacccgcttttggaagaggagacaaagcattcaaagccctaaacactctgttggtgaatcatcatgtttattgagtgtgcttttagtggcagggccctgagcacctgggaaaggagatgaggagcgctggagggttcggagcagagaagacgagacaatgctctgctccaagcgccagaggaggcttctgggaaggggctgtctgtggaatttctgacccccagagccctgctggtgaagtcttgcaaccactaaagctttgccagagaagaggagggacctgacactgggcagtggcggtgccagcagtgagcacaggcggggtctaggtgggatcactgaagccaagccaagtggtgcagggggagccgccctggaccaacacccccatggctgccccactgcggaactgcctactgcggcaaaacaatcctatgtcccccaaggtttcaacaaagaggaggaccgaataaatgtcccagtgggcaggcacacccacaagacttgctgctcctcctgacccacccgcatggctctgcacagctgtgagtccagttttctctcttcctacctccctcttacccagttatcctgaccccagggtgaggttgaaactcatgctaggctaacatctctttccttcatcccattcataaaactggcatacaggaatgttttaaaaaaatctttaagattaccaggagtataaaagttaaaatgacaaaattacaggcctgttaccagatcttcgtactaaccaaggagctggtgacactaccctcttccctgtgtgatagaaaatgcagacgttttgcaggcagacctggttcatgactcagcgctgtgacttgtggacttatcttgtgcagctacatcacttcttagccttgttttcaacatgcgtaagcagaaggtactaatattagtctttagggctggtttgaggatgacgtgagatgagagacaaccaagcactcactggcagttcctagaagattccagtagtagagatctgactgtcctacactactttccctccctgtctctgacacttgttcattcctgggctcaggagccatctcagtcatcatgtcggaccacgtaactataaccaagctctgctgcccacctgggacaccttcccactctttgcaactaggtcggagggacgcaccttctccacagttgacaggactgttatggttgacccaaaagttgtcatcttctgacatgacacactgagggaagtagacttacccaatataacttcacattatactgtcttaaaagactatgattaaaatgggcatcagtgtaggcaacatgtagggcgcaaagaatagccagatgtgaaggttgaaaggctatgtgggctagtttgtcatggtattcctggtgcctctccccgtttgggaagaataacacattgaccaccggctcagaggaggtggcattataggtccaggccccttcaggagggcactggagtcaatgaaagcttttgctctcacccaggctcttggtttctcacgggcaggggtagcccaggaaacaaaggctgtatagactttaagtcgtgagaaaaacgacattcttatggtgaggctcttagagactgtctccatttaagcagcagcagtaaaacatcttaccctaaaatgaagaagcaaatccatttttattggcttttatagcctctctctttcaatgacaaagaaaccattaaaatgaatgtttaaagttcttagaagagctttctctaaatatttactctgtcagtggaaaaataaacattttttacatcgggtctattgagtttgttatatacagtaaaattcaccctttttagatatatagttttatgagttttaacaaaaatacatagttgtgtaaccaccaccatcacaatcaagatatagaatatttcaacatcccaaagttcccatttcccttttcagtcaatcccttccccactacccctagcccctggcaaccattatctgttctctcttcccatagtttcaccttttccaatttgtcgtgtagagttacacagctcatagccatttgagtctggcttctttccacataatgtccttgagatccatcggtgggtacaccagtagttccattttttttctgagtagtagtccattgtatggatgtactgcggtttattcaccaacatatgggttctttcctgtttggggagattacaaataaagctactataaaaactcg

SEQ ID NO: 196283 - DNA, 3809 bp, Homo sapiens
  Payload ID: 18727
  Gene Name: tumor necrosis factor receptor superfamily, member 11a, NFKB activator
  Uniprot ID: Q9Y6Q6
  ENST ID: ENST00000616710
  CDS Start-End: 67-858
ggcagccgcgcccgctgggccacagaggccgctgaggccgcggcgcccgccagcctgtcccgcgccatggccccgcgcgcccggcggcgccgcccgctgttcgcgctgctgctgctctgcgcgctgctcgcccggctgcaggtggctttgcagatcgctcctccatgtaccagtgagaagcattatgagcatctgggacggtgctgtaacaaatgtgaaccaggaaagtacatgtcttctaaatgcactactacctctgacagtgtatgtctgccctgtggcccggatgaatacttggatagctggaatgaagaagataaatgcttgctgcataaagtttgtgatacaggcaaggccctggtggccgtggtcgccggcaacagcacgaccccccggcgctgcgcgtgcacggctgggtaccactggagccaggactgcgagtgctgccgccgcaacaccgagtgcgcgccgggcctgggcgcccagcacccgttgcagctcaacaaggacacagtgtgcaaaccttgccttgcaggctacttctctgatgccttttcctccacggacaaatgcagaccctggaccaactgtaccttccttggaaagagagtagaacatcatgggacagagaaatccgatgcggtttgcagttcttctctgccagctagaaaaccaccaaatgaaccccatgtttacttgcccggtttaataattctgcttctcttcgcgtctgtggccctggtggctgccatcatctttggcgtttgctataggaaaaaagggaaagcactcacagctaatttgtggcactggatcaatgaggcttgtggccgcctaagtggagataaggaaatgtgactggaaacagtaactccacgttcatctccagcgggcaggtgatgaacttcaagggcgacatcatcgtggtctacgtcagccagacctcgcaggagggcgcggcggcggctgcggagcccatgggccgcccggtgcaggaggagaccctggcgcgccgagactccttcgcggggaacggcccgcgcttcccggacccgtgcggcggccccgaggggctgcgggagccggagaaggcctcgaggccggtgcaggagcaaggcggggccaaggcttgagcgccccccatggctgggagcccgaagctcggagccagggctcgcgagggcagcaccgcagcctctgccccagccccggccacccagggatcgatcggtacagtcgaggaagaccacccggcattctctgcccactttgccttccaggaaatgggcttttcaggaagtgaattgatgaggactgtccccatgcccacggatgctcagcagcccgccgcactggggcagatgtctcccctgccactcctcaaactcgcagcagtaatttgtggcactatgacagctatttttatgactatcctgttctgtgggggggggggtctgttttccccccatatttgtattccttttcataacttttcttgatatctttcctccctcttttttaatgtaaaggttttctcaaaaattctcctaaaggtgagggtctctttcttttctcttttccttttttttttctttttttggcaacctggctctggcccaggctagagtgcagtggtgcgattatagcccggtgcagcctctaactcctgggctcaagcaatccaagtgatcctcccacctcaaccttcggagtagctgggatcacagctgcaggccacgcccagcttcctccccccgactccccccccagagacacggtcccaccatgttacccagcctggtctcaaactccccagctaaagcagtcctccagcctcggcctcccaaagtactgggattacaggcgtgagcccccacgctggcctgctttacgtattttcttttgtgcccctgctcacagtgttttagagatggctttcccagtgtgtgttcattgtaaacacttttgggaaagggctaaacatgtgaggcctggagatagttgctaagttgctaggaacatgtggtgggactttcatattctgaaaaatgttctatattctcatttttctaaaagaaagaaaaaaggaaacccgatttatttctcctgaatctttttaagtttgtgtcgttccttaagcagaactaagctcagtatgtgaccttacccgctaggtggttaatttatccatgctggcagaggcactcaggtacttggtaagcaaatttctaaaactccaagttgctgcagcttggcattcttcttattctagaggtctctctggaaaagatggagaaaatgaacaggacatggggctcctggaaagaaagggcccgggaagttcaaggaagaataaagttgaaattttaatttgcattttttttgtctagataagaatagcgtgaatagatcctcttttattcgtaaataatcgtgcatctgtgggttagccttgtagaagtggaaaacattccattttccaatgcatttaaatgtaaagccaaatctgcatgttgtgaatttaagaaaacttattatcctaaaggtgcctttctcttggcatcatcccgcttgtgagaagcctagaggacgctccaggtggaaggaaatcccctgggtggttttatcttttgttacccagtgagcactggttccccgcaaatactggggaaaagcaaaaatacacaagcaagttaaaattaattttgcacatctgggaggttataaaagaaagcactaatagtagtcactgcccagactttactggccacaaatgcccagctgaagagcatgactgtggatcactggtttttccctcctgctggaaatgctggggtggtagcggtcgattaggattttcagtggagaagcacaggacagttctgtaatttatgggactccttagccaacataaagaactgcaggaaataactgcacagccaggaggatccgttggtgggaatttaccgtcattcctgcccttttatttaacatcatccacagagagatgttatacaaatggaggaaaccattataccttttgatatggaatatattacagagttacagttcacaaagtagaatgctgagctgaaaacccgagtttctgctgtgactgtcatctcactgagcacttcgcttttctttgcttttattttttccttctataaaaaggcaataatgataatttataatagtttccctacccagagatattagaagtatgctacagtgaatgttaaagtaccttgagatccttaaatcaaaggtgctatatacataagtaagactctactttcagaaaaaggtaatattatttcctgcactgatccctactaattctatattgatccaaaggcaactcaatgctaaaaaatgtatagaaaatataagtctgtgtctgtgtactgtagagatgtatgtgacaagtgtaaacaaaatgaactgaagcagtaatgaacagttattagggggaacatgataaagagattatattaagcttatgtttcaccataaaatcctttttatggcttactaaaaccgagctcactgtaaaatcatgatccaacttattgctaatctttatgatatgcttattcctaatctttatggtatggtgtcaaccgttcatttgtatcttattgctcattccctggaccacagactagggacagaaaatacttgctttaataatatatatgctgttgatttcacaaaaatttattaaaatacagcctgggtacccagtgaaagagctgaaatggaaatggagtatcatgtttcctactcacattttactcagctgtcgg

SEQ ID NO: 196284 - DNA, 3756 bp, Homo sapiens
  Payload ID: 18727
  Gene Name: tumor necrosis factor receptor superfamily, member 11a, NFKB activator
  Uniprot ID: Q9Y6Q6
  ENST ID: ENST00000617039
  CDS Start-End: 67-1080
ggcagccgcgcccgctgggccacagaggccgctgaggccgcggcgcccgccagcctgtcccgcgccatggccccgcgcgcccggcggcgccgcccgctgttcgcgctgctgctgctctgcgcgctgctcgcccggctgcaggtggctttgcagatcgctcctccatgtaccagtgagaagcattatgagcatctgggacggtgctgtaacaaatgtgaaccaggaaagtacatgtcttctaaatgcactactacctctgacagtgtatgtctgccctgtggcccggatgaatacttggatagctggaatgaagaagataaatgcttgctgcataaagtttgtgatacaggcaaggccctggtggccgtggtcgccggcaacagcacgaccccccggcgctgcgcgtgcacggctgggtaccactggagccaggactgcgagtgctgccgccgcaacaccgagtgcgcgccgggcctgggcgcccagcacccgttgcagctcaacaaggacacagtgtgcaaaccttgccttgcaggctacttctctgatgccttttcctccacggacaaatgcagaccctggaccaactgtaccttccttggaaagagagtagaacatcatgggacagagaaatccgatgcggtttgcagttcttctctgccagctagaaaaccaccaaatgaaccccatgtttacttgcccggtttaataattctgcttctcttcgcgtctgtggccctggtggctgccatcatctttggcgtttgctataggaaaaaagggaaagcactcacaggaaatgtgactggaaacagtaactccacgttcatctccagcgggcaggtgatgaacttcaagggcgacatcatcgtggtctacgtcagccagacctcgcaggagggcgcggcggcggctgcggagcccatgggccgcccggtgcaggaggagaccctggcgcgccgagactccttcgcggggaacggcccgcgcttcccggacccgtgcggcggccccgaggggctgcgggagccggagaaggcctcgaggccggtgcaggagcaaggcggggccaaggcttgagcgccccccatggctgggagcccgaagctcggagccagggctcgcgagggcagcaccgcagcctctgccccagccccggccacccagggatcgatcggtacagtcgaggaagaccacccggcattctctgcccactttgccttccaggaaatgggcttttcaggaagtgaattgatgaggactgtccccatgcccacggatgctcagcagcccgccgcactggggcagatgtctcccctgccactcctcaaactcgcagcagtaatttgtggcactatgacagctatttttatgactatcctgttctgtgggggggggggtctgttttccccccatatttgtattccttttcataacttttcttgatatctttcctccctcttttttaatgtaaaggttttctcaaaaattctcctaaaggtgagggtctctttcttttctcttttccttttttttttctttttttggcaacctggctctggcccaggctagagtgcagtggtgcgattatagcccggtgcagcctctaactcctgggctcaagcaatccaagtgatcctcccacctcaaccttcggagtagctgggatcacagctgcaggccacgcccagcttcctccccccgactccccccccagagacacggtcccaccatgttacccagcctggtctcaaactccccagctaaagcagtcctccagcctcggcctcccaaagtactgggattacaggcgtgagcccccacgctggcctgctttacgtattttcttttgtgcccctgctcacagtgttttagagatggctttcccagtgtgtgttcattgtaaacacttttgggaaagggctaaacatgtgaggcctggagatagttgctaagttgctaggaacatgtggtgggactttcatattctgaaaaatgttctatattctcatttttctaaaagaaagaaaaaaggaaacccgatttatttctcctgaatctttttaagtttgtgtcgttccttaagcagaactaagctcagtatgtgaccttacccgctaggtggttaatttatccatgctggcagaggcactcaggtacttggtaagcaaatttctaaaactccaagttgctgcagcttggcattcttcttattctagaggtctctctggaaaagatggagaaaatgaacaggacatggggctcctggaaagaaagggcccgggaagttcaaggaagaataaagttgaaattttaatttgcattttttttgtctagataagaatagcgtgaatagatcctcttttattcgtaaataatcgtgcatctgtgggttagccttgtagaagtggaaaacattccattttccaatgcatttaaatgtaaagccaaatctgcatgttgtgaatttaagaaaacttattatcctaaaggtgcctttctcttggcatcatcccgcttgtgagaagcctagaggacgctccaggtggaaggaaatcccctgggtggttttatcttttgttacccagtgagcactggttccccgcaaatactggggaaaagcaaaaatacacaagcaagttaaaattaattttgcacatctgggaggttataaaagaaagcactaatagtagtcactgcccagactttactggccacaaatgcccagctgaagagcatgactgtggatcactggtttttccctcctgctggaaatgctggggtggtagcggtcgattaggattttcagtggagaagcacaggacagttctgtaatttatgggactccttagccaacataaagaactgcaggaaataactgcacagccaggaggatccgttggtgggaatttaccgtcattcctgcccttttatttaacatcatccacagagagatgttatacaaatggaggaaaccattataccttttgatatggaatatattacagagttacagttcacaaagtagaatgctgagctgaaaacccgagtttctgctgtgactgtcatctcactgagcacttcgcttttctttgcttttattttttccttctataaaaaggcaataatgataatttataatagtttccctacccagagatattagaagtatgctacagtgaatgttaaagtaccttgagatccttaaatcaaaggtgctatatacataagtaagactctactttcagaaaaaggtaatattatttcctgcactgatccctactaattctatattgatccaaaggcaactcaatgctaaaaaatgtatagaaaatataagtctgtgtctgtgtactgtagagatgtatgtgacaagtgtaaacaaaatgaactgaagcagtaatgaacagttattagggggaacatgataaagagattatattaagcttatgtttcaccataaaatcctttttatggcttactaaaaccgagctcactgtaaaatcatgatccaacttattgctaatctttatgatatgcttattcctaatctttatggtatggtgtcaaccgttcatttgtatcttattgctcattccctggaccacagactagggacagaaaatacttgctttaataatatatatgctgttgatttcacaaaaatttattaaaatacagcctgggtacccagtgaaagagctgaaatggaaatggagtatcatgtttcctactcacattttactcagctgtcgg

SEQ ID NO: 196285 - DNA, 2402 bp, Homo sapiens
  Payload ID: 18728
  Gene Name: tumor necrosis factor receptor superfamily, member 11b
  Uniprot ID: O00300
  ENST ID: ENST00000297350
  CDS Start-End: 380-1585
ggaaacctcagagccccgcggagacagcagccgccttgttcctcagcccggtggcttttttttcccctgctctcccaggggccagacaccaccgccccacccctcacgccccacctccctgggggatcctttccgccccagccctgaaagcgttaaccctggagctttctgcacaccccccgaccgctcccgcccaagcttcctaaaaaagaaaggtgcaaagtttggtccaggatagaaaaatgactgatcaaaggcaggcgatacttcctgttgccgggacgctatatataacgtgatgagcgcacgggctgcggagacgcaccggagcgctcgcccagccgccgcctccaagcccctgaggtttccggggaccacaatgaacaacttgctgtgctgcgcgctcgtgtttctggacatctccattaagtggaccacccaggaaacgtttcctccaaagtaccttcattatgacgaagaaacctctcatcagctgttgtgtgacaaatgtcctcctggtacctacctaaaacaacactgtacagcaaagtggaagaccgtgtgcgccccttgccctgaccactactacacagacagctggcacaccagtgacgagtgtctatactgcagccccgtgtgcaaggagctgcagtacgtcaagcaggagtgcaatcgcacccacaaccgcgtgtgcgaatgcaaggaagggcgctaccttgagatagagttctgcttgaaacataggagctgccctcctggatttggagtggtgcaagctggaaccccagagcgaaatacagtttgcaaaagatgtccagatgggttcttctcaaatgagacgtcatctaaagcaccctgtagaaaacacacaaattgcagtgtctttggtctcctgctaactcagaaaggaaatgcaacacacgacaacatatgttccggaaacagtgaatcaactcaaaaatgtggaatagatgttaccctgtgtgaggaggcattcttcaggtttgctgttcctacaaagtttacgcctaactggcttagtgtcttggtagacaatttgcctggcaccaaagtaaacgcagagagtgtagagaggataaaacggcaacacagctcacaagaacagactttccagctgctgaagttatggaaacatcaaaacaaagaccaagatatagtcaagaagatcatccaagatattgacctctgtgaaaacagcgtgcagcggcacattggacatgctaacctcaccttcgagcagcttcgtagcttgatggaaagcttaccgggaaagaaagtgggagcagaagacattgaaaaaacaataaaggcatgcaaacccagtgaccagatcctgaagctgctcagtttgtggcgaataaaaaatggcgaccaagacaccttgaagggcctaatgcacgcactaaagcactcaaagacgtaccactttcccaaaactgtcactcagagtctaaagaagaccatcaggttccttcacagcttcacaatgtacaaattgtatcagaagttatttttagaaatgataggtaaccaggtccaatcagtaaaaataagctgcttataactggaaatggccattgagctgtttcctcacaattggcgagatcccatggatgagtaaactgtttctcaggcacttgaggctttcagtgatatctttctcattaccagtgactaattttgccacagggtactaaaagaaactatgatgtggagaaaggactaacatctcctccaataaaccccaaatggttaatccaactgtcagatctggatcgttatctactgactatattttcccttattactgcttgcagtaattcaactggaaattaaaaaaaaaaaactagactccattgtgccttactaaatatgggaatgtctaacttaaatagctttgagatttcagctatgctagaggcttttattagaaagccatatttttttctgtaaaagttactaatatatctgtaacactattacagtattgctatttatattcattcagatataagatttgtacatattatcatcctataaagaaacggtatgacttaattttagaaagaaaattatattctgtttattatgacaaatgaaagagaaaatatatatttttaatggaaagtttgtagcatttttctaataggtactgccatatttttctgtgtggagtatttttataattttatctgtataagctgtaatatcattttatagaaaatgcattatttagtcaattgtttaatgttggaaaacatatgaaatataaattatctgaatattagatgctctgagaaattgaatgtaccttatttaaaagattttatggttttataactatataaatgacattattaaagttttcaaattatttttta

SEQ ID NO: 196286 - DNA, 1144 bp, Homo sapiens
  Payload ID: 18728
  Gene Name: tumor necrosis factor receptor superfamily, member 11b
  ENST ID: ENST00000517352
  CDS Start-End: 63-500
agacgcaccggagcgctcgcccagccgccgcctccaagcccctgaggtttccggggaccacaatgaacaacttgctgtgctgcgcgctcgtgtttctggacatctccattaagtggaccacccaggaaacgtttcctccaaagtaccttcattatgacgaagaaacctctcatcagctgttgtgtgacaaatgtcctcctggtacctacctaaaacaacactgtacagcaaagtggaagaccgtgtgcgccccttgccctgaccactactacacagacagctggcacaccagtgacgagtgtctatactgcagccccgtgtgcaaggagctgcagtacgtcaagcaggagtgcaatcgcacccacaaccgcgtgtgcgaatgcaaggaagggcgctaccttgagatagagttctgcttgaaacataggagctgccctcctggatttggagtggtgcaagctggatgcaggagaagacccaagccacagatatgtatctgaagaatgaacaagattcttaggcccggcacggtggctcacatctgtaatctcaagagtttgagaggtcaaggcgggcagatcacctgaggtcaggagttcaagaccagcctggccaacatgatgaaaccctgcctctactaaaaatacaaaaattagcagggcatggtggtgcatgcctgcaaccctagctactcaggaggctgagacaggagaatctcttgaaccctggaggcggaggttgtggaaccccagagcgaaatacagtttgcaaaagatgtccagatgggttcttctcaaatgagacgtcatctaaagcaccctgtagaaaacacacaaattgcagtgtctttggtctcctgctaactcagaaaggaaatgcaacacacgacaacatatgttccggaaacagtgaatcaactcaaaaatgtggaatagatgttaccctgtgtgaggaggcattcttcaggtttgctgttcctacaaagtttacgcctaactggcttagtgtcttggtagacaatttgcctggcaccaaagtaaacgcagagagtgtagagaggataaaacggcaacacagctcacaagaacagactttccagctgctgaagttatggaaacatcaaaacaaagaccaagatatagtc

SEQ ID NO: 196287 - DNA, 1033 bp, Homo sapiens
  Payload ID: 18729
  Gene Name: tumor necrosis factor receptor superfamily, member 12A
  Uniprot ID: Q9NP84
  ENST ID: ENST00000326577
  CDS Start-End: 87-476
aaggcgggggcgggggcggggcggcggccgtgggtccctgccggccggcggcgggcgcagacagcggcgggcgcaggacgtgcactatggctcggggctcgctgcgccggttgctgcggctcctcgtgctggggctctggctggcgttgctgcgctccgtggccggggagcaagcgccaggcaccgccccctgctcccgcggcagctcctggagcgcggacctggacaagtgcatggactgcgcgtcttgcagggcgcgaccgcacagcgacttctgcctgggctgcgctgcagcacctcctgcccccttccggctgctttggcccatccttgggggcgctctgagcctgaccttcgtgctggggctgctttctggctttttggtctggagacgatgccgcaggagagagaagttcaccacccccatagaggagaccggcggagagggctgcccagctgtggcgctgatccagtgacaatgtgccccctgccagccggggctcgcccactcatcattcattcatccattctagagccagtctctgcctcccagacgcggcgggagccaagctcctccaaccacaaggggggtggggggcggtgaatcacctctgaggcctgggcccagggttcaggggaaccttccaaggtgtctggttgccctgcctctggctccagaacagaaagggagcctcacgctggctcacacaaaacagctgacactgactaaggaactgcagcatttgcacaggggaggggggtgccctccttcctagaggccctgggggccaggctgacttggggggcagacttgacactaggccccactcactcagatgtcctgaaattccaccacgggggtcaccctggggggttagggacctatttttaacactagggggctggcccactaggagggctggccctaagatacagacccccccaactccccaaagcggggaggagatatttattttggggagagtttggaggggagggagaatttattaataaaagaatctttaactttaaa

SEQ ID NO: 196288 - DNA, 881 bp, Homo sapiens
  Payload ID: 18729
  Gene Name: tumor necrosis factor receptor superfamily, member 12A
  Uniprot ID: Q9NP84
  ENST ID: ENST00000341627
  CDS Start-End: 40-324
gcggcgggcgcagacagcggcgggcgcaggacgtgcactatggctcggggctcgctgcgccggttgctgcggctcctcgtgctggggctctggctggcgttgctgcgctccgtggccggggagcaagcgccaggcgctgcagcacctcctgcccccttccggctgctttggcccatccttgggggcgctctgagcctgaccttcgtgctggggctgctttctggctttttggtctggagacgatgccgcaggagagagaagttcaccacccccatagaggagaccggcggagagggctgcccagctgtggcgctgatccagtgacaatgtgccccctgccagccggggctcgcccactcatcattcattcatccattctagagccagtctctgcctcccagacgcggcgggagccaagctcctccaaccacaaggggggtggggggcggtgaatcacctctgaggcctgggcccagggttcaggggaaccttccaaggtgtctggttgccctgcctctggctccagaacagaaagggagcctcacgctggctcacacaaaacagctgacactgactaaggaactgcagcatttgcacaggggaggggggtgccctccttcctagaggccctgggggccaggctgacttggggggcagacttgacactaggccccactcactcagatgtcctgaaattccaccacgggggtcaccctggggggttagggacctatttttaacactagggggctggcccactaggagggctggccctaagatacagacccccccaactccccaaagcggggaggagatatttattttggggagagtttggaggggagggagaatttattaataaaagaatctttaactttaaa

SEQ ID NO: 196289 - DNA, 583 bp, Homo sapiens
  Payload ID: 18729
  Gene Name: tumor necrosis factor receptor superfamily, member 12A
  ENST ID: ENST00000574699
  CDS Start-End: 31-315
gcagacagcggcgggcgcaggacgtgcactatggctcggggctcgctgcgccggttgctgcggctcctcgtgctggggctctggctggcgttgctgcgctccgtggccggggagcaagcgccagcctctgacccgaggccccctccccaggcaccgccccctgctcccgcggcagctcctggagcgcggacctggacaagtgcatggactgcgcgtcttgcagggcgcgaccgcacagcgacttctgcctgggctgcgctgcagcacctcctgcccccttccggctgctttggcccatccttgggggcgctctgagcctgaccttcgtgctggggctgctttctggctttttggtctggagacgatgccgcaggagagagaagttcaccacccccatagaggagaccggcggagagggctgcccagctgtggcgctgatccagtgacaatgtgccccctgccagccggggctcgcccactcatcattcattcatccattctagagccagtctctgcctcccagacgcggcgggagccaagctcctccaaccacaaggggggtggggggcggtgaatcacctct

SEQ ID NO: 196290 - DNA, 648 bp, Homo sapiens
  Payload ID: 18729
  Gene Name: tumor necrosis factor receptor superfamily, member 12A
  ENST ID: ENST00000573001
  CDS Start-End: 146-388
ggggaactcacctaaccttcccgagccttcgtttcctactctgcaaaatggagataacaagtctgcattttattatgtaactacgtcctaaggcaccgccccctgctcccgcggcagctcctggagcgcggacctggacaagtgcatggactgcgcgtcttgcagggcgcgaccgcacagcgacttctgcctgggctgcgctgcagcacctcctgcccccttccggctgctttggcccatccttgggggcgctctgagcctgaccttcgtgctggggctgctttctggctttttggtctggagacgatgccgcaggagagagaagttcaccacccccatagaggagaccggcggagagggctgcccagctgtggcgctgatccagtgacaatgtgccccctgccagccggggctcgcccactcatcattcattcatccattctagagccagtctctgcctcccagacgcggcgggagccaagctcctccaaccacaaggggggtggggggcggtgaatcacctctgaggcctgggcccagggttcaggggaaccttccaaggtgtctggttgccctgcctctggctccagaacagaaagggagcctcacgctggctcacacaaaacagctgacactgactaaggaact

SEQ ID NO: 196291 - DNA, 1133 bp, Homo sapiens
  Payload ID: 18729
  Gene Name: tumor necrosis factor receptor superfamily, member 12A
  ENST ID: ENST00000575124
  CDS Start-End: 24-704
gcggcgggcgcaggacgtgcactatggctcggggctcgctgcgccggttgctgcggctcctcgtgctggggctctggctggcgttgctgcgctccgtggccggggagcaagcgccaggtacgcgggactccggggtcggggaaccccgggccggggctcgggagccggactgggtgtctggagaacagcgccgaactgggggaacaggcggatgtggggatctggggtcaggtggccttcaaacagctcgctcccggctgtgggaagttccatcactctccaagcttcattcacaatccgggcctcagtttctcccaccgtccaattggggttggggggggtcttcagttccacaagtccgaagtacttcgaatggagagagaaagcgctgcagcacctcctgcccccttccggctgctttggcccatccttgggggcgctctgagcctgaccttcgtgctggggctgctttctggctttttggtctggagacgatgccgcaggagagagaagttcaccacccccatagaggagaccggcggagagggctgcccagctgtggcgctgatccagtgacaatgtgccccctgccagccggggctcgcccactcatcattcattcatccattctagagccagtctctgcctcccagacgcggcgggagccaagctcctccaaccacaaggggggtggggggcggtgaatcacctctgaggcctgggcccagggttcaggggaaccttccaaggtgtctggttgccctgcctctggctccagaacagaaagggagcctcacgctggctcacacaaaacagctgacactgactaaggaactgcagcatttgcacaggggaggggggtgccctccttcctagaggccctgggggccaggctgacttggggggcagacttgacactaggccccactcactcagatgtcctgaaattccaccacgggggtcaccctggggggttagggacctatttttaacactagggggctggcccactaggagggctggccctaagatacagacccccccaactccccaaagcggggaggagatatttattttggggagagtttggaggggagggagaatttattaataaaagaatctttaactttaaa

SEQ ID NO: 196292 - DNA, 161 bp, Homo sapiens
  Payload ID: 18729
  Gene Name: tumor necrosis factor receptor superfamily, member 12A
  ENST ID: ENST00000575836
  CDS Start-End: 20-161
cgggcgcaggacgtgcactatggctcggggctcgctgcgccggttgctgcggctcctcgtgctggggctctggctggcgttgctgcgctccgtggccggggagcaagcgccagaccccagaatagccgagtcccgcccccagcctctgacccgaggccccc

SEQ ID NO: 196293 - DNA, 1357 bp, Homo sapiens
  Payload ID: 18730
  Gene Name: tumor necrosis factor receptor superfamily, member 13B
  Uniprot ID: O14836
  ENST ID: ENST00000261652
  CDS Start-End: 14-895
agcatcctgagtaatgagtggcctgggccggagcaggcgaggtggccggagccgtgtggaccaggaggagcgctttccacagggcctgtggacgggggtggctatgagatcctgccccgaagagcagtactgggatcctctgctgggtacctgcatgtcctgcaaaaccatttgcaaccatcagagccagcgcacctgtgcagccttctgcaggtcactcagctgccgcaaggagcaaggcaagttctatgaccatctcctgagggactgcatcagctgtgcctccatctgtggacagcaccctaagcaatgtgcatacttctgtgagaacaagctcaggagcccagtgaaccttccaccagagctcaggagacagcggagtggagaagttgaaaacaattcagacaactcgggaaggtaccaaggattggagcacagaggctcagaagcaagtccagctctcccggggctgaagctgagtgcagatcaggtggccctggtctacagcacgctggggctctgcctgtgtgccgtcctctgctgcttcctggtggcggtggcctgcttcctcaagaagaggggggatccctgctcctgccagccccgctcaaggccccgtcaaagtccggccaagtcttcccaggatcacgcgatggaagccggcagccctgtgagcacatcccccgagccagtggagacctgcagcttctgcttccctgagtgcagggcgcccacgcaggagagcgcagtcacgcctgggacccccgaccccacttgtgctggaaggtgggggtgccacaccaggaccacagtcctgcagccttgcccacacatcccagacagtggccttggcattgtgtgtgtgcctgcccaggaggggggcccaggtgcataaatgggggtcagggagggaaaggaggagggagagagatggagaggaggggagagagaaagagaggtggggagaggggagagagatatgaggagagagagacagaggaggcagagagggagagaaacagaggagacagagagggagagagagacagagggagagagagacagaggggaagagaggcagagagggaaagaggcagagaaggaaagagacaggcagagaaggagagaggcagagagggagagaggcagagagggagagaggcagagagacagagagggagagagggacagagagagatagagcaggaggtcggggcactctgagtcccagttcccagtgcagctgtaggtcgtcatcacctaaccacacgtgcaataaagtcctcgtgcctgctgctcacagcccccgagagcccctcctcctggagaataaaacctttggcagctgcccttcctc

SEQ ID NO: 196294 - DNA, 859 bp, Homo sapiens
  Payload ID: 18730
  Gene Name: tumor necrosis factor receptor superfamily, member 13B
  Uniprot ID: O14836
  ENST ID: ENST00000583789
  CDS Start-End: 13-756
gcatcctgagtaatgagtggcctgggccggagcaggcgaggtggccggagccgtgtggaccaggaggagcgctggtcactcagctgccgcaaggagcaaggcaagttctatgaccatctcctgagggactgcatcagctgtgcctccatctgtggacagcaccctaagcaatgtgcatacttctgtgagaacaagctcaggagcccagtgaaccttccaccagagctcaggagacagcggagtggagaagttgaaaacaattcagacaactcgggaaggtaccaaggattggagcacagaggctcagaagcaagtccagctctcccggggctgaagctgagtgcagatcaggtggccctggtctacagcacgctggggctctgcctgtgtgccgtcctctgctgcttcctggtggcggtggcctgcttcctcaagaagaggggggatccctgctcctgccagccccgctcaaggccccgtcaaagtccggccaagtcttcccaggatcacgcgatggaagccggcagccctgtgagcacatcccccgagccagtggagacctgcagcttctgcttccctgagtgcagggcgcccacgcaggagagcgcagtcacgcctgggacccccgaccccacttgtgctggaaggtgggggtgccacaccaggaccacagtcctgcagccttgcccacacatcccagacagtggccttggcattgtgtgtgtgcctgcccaggaggggggcccaggtgcataaatgggggtcagggagggaaaggaggagggagagagatggagaggaggggagagagaaagagaggtggggagaggggagagagatatgaggagagagagacaga

SEQ ID NO: 196295 - DNA, 1266 bp, Homo sapiens
  Payload ID: 18730
  Gene Name: tumor necrosis factor receptor superfamily, member 13B
  ENST ID: ENST00000584950
  CDS Start-End: 13-759
gcatcctgagtaatgagtggcctgggccggagcaggcgaggtggccggagccgtgtggaccaggaggagcgctggtcactcagctgccgcaaggagcaaggcaagttctatgaccatctcctgagggactgcatcagctgtgcctccatctgtggacagcaccctaagcaatgtgcatacttctgtgagaacaagctcaggagcccagtgaaccttccaccagagctcaggagacagcggagtggagaagttgaaaacaattcagacaactcgggaaggtaccaaggattggagcacagaggctcagaagcaagtccagctctcccggggctgaagctgagtgcagatcaggtggccctggtctacagcacgctggggctctgcctgtgtgccgtcctctgctgcttcctggtggcggtggcctgcttcctcaagaagaggggggatccctgctcctgccagccccgctcaaggccccgtcaaagtccggccaagtcttcccaggatcacgcgatggaagccggcagccctgtgagcacatcccccgagccagtggagacctgcagcttctgcttccctgagtgcagggcgcccacgcaggagagcgcagtcacgcctgggacccccgaccccacttgtgctggaaggaaaacgaagccccctcctgtattgacagctgggaattgtggagtccaccgtcctccacctgagacgagcacagggtctccacgaggacagaggctgctttggactcaatagaaaactgggcatcttcatggtcctagaaggatcccaggaggctgatcctatagagacgtctggttcctgaccccaactgcctccaggtgcctggaacagcccatcgtgggccctttaccctcagcaggtggacgccgttggtcctgccagggcaagatggagatggatgagcacccggatatcctgcccacccaggggcaaggcaacatcatcattactaagtatgagcagggacgctgagctggggcagcagtggacacagagcatgagcgtgttgacatctggaaattcaccagtcgtctctgggttgtgtgtgagacagagctgcccgtgtcagtgccctggaggtgaagggaagagcctgtgcctgctgcgtgggagactggtccagggacagggaatcaggagtggttgcaaaggtgtcaggaaataaaatgtactgacaagtggctgaagatgcttggagactggccaaaatataagaacagcaagaaggtgacatggcgg

SEQ ID NO: 196296 - DNA, 600 bp, Homo sapiens
  Payload ID: 18730
  Gene Name: tumor necrosis factor receptor superfamily, member 13B
  ENST ID: ENST00000579315
  CDS Start-End: 44-514
aagcactaatcaaatctaagactagtaataagcatcctgagtaatgagtggcctgggccggagcaggcgaggtggccggagccgtgtggaccaggaggagcgctttccacagggcctgtggacgggggtggctatgagatcctgccccgaagagcagtactgggatcctctgctgggtacctgcatgtcctgcaaaaccatttgcaaccatcagagccagcgcacctgtgcagccttctgcaggtcactcagctgccgcaaggagcaaggcaagttctatgaccatctcctgagggactgcatcagctgtgcctccatctgtggacagcaccctaagcaatgtgcatacttctgtgagaacaagctcaggagcccagtgaaccttccaccagagctcaggagacagcggagtggagaagttgaaaacaattcagacaactcgggaaggtaccaaggattggagcacagaggctcagaagcaagtccaggaaaacgaagccccctcctgtattgacagctgggaattgtggagtccaccgtcctccacctgagacgagcacagggtctccacgaggacagaggctgctttggactcaatag

SEQ ID NO: 196297 - DNA, 3944 bp, Homo sapiens
  Payload ID: 18731
  Gene Name: tumor necrosis factor receptor superfamily, member 13C
  Uniprot ID: Q96RJ3
  ENST ID: ENST00000291232
  CDS Start-End: 46-600
cagctcagcctcagtccccgcagcttgtgcggcggcgtcggcaccatgaggcgagggccccggagcctgcggggcagggacgcgccagcccccacgccctgcgtcccggccgagtgcttcgacctgctggtccgccactgcgtggcctgcgggctcctgcgcacgccgcggccgaaaccggccggggccagcagccctgcgcccaggacggcgctgcagccgcaggagtcggtgggcgcgggggccggcgaggcggcgctgcccctgcccgggctgctctttggcgcccccgcgctgctgggcctggcactggtcctggcgctggtcctggtgggtctggtgagctggaggcggcgacagcggcggcttcgcggcgcgtcctccgcagaggcccccgacggagacaaggacgccccagagcccctggacaaggtcatcattctgtctccgggaatctctgatgccacagctcctgcctggcctcctcctggggaagacccaggaaccaccccacctggccacagtgtccctgtgccagccacagagctgggctccactgaactggtgaccaccaagacggccggccctgagcaacaatagcagggagccggcaggaggtggcccctgccctccctctggacccccagccaggggcttggaaatcaaattcagctcttcactccagcatgcacatgccctctttctgggaccaggctaactctgcagaagcacagacactacagaccacagcattcagcccccatggagtttggtgtgcttgcctttggcttcagacctcaccatctttgacagcccttgaaggtggtagcccagctcctgttcctgtgccttcaaaaggctggggcactatgagtaaaagaccgcttttaaaatggggaaggcaccattaagccaaaatgaatctgaaaaaagaccaagtgggaggatgcctaatttgtagttgggtggttttttgtgtttgtttgattttttttttttttttttttttttttttttgagacgagtcttgctctgtcgccaggctggagtacagtggcgcgatctcgcctcactgtaacctccgactccttggttcaagtgattctcctgcctcagcctcccgaatagctgggattacaggcacgcaccaccacagccagctaatttttgtatttttagtagagacgggatttcaccatgttggccaggatggtctcgatctcctgacctcgtgatccgccctgctcggcctcccaaagtgctgggattacaggcatgagccaccatgcccggccttgttttgtgttttggttttttttgagacagggtcttgctgtatcacgcaggctggagtgcaacgatgggtccccagctaattgcagcctgggctcaagcaatctttctgcttcagcctcctgagtaggtgggactacaggtgctccaccttgcccagctaattttttttttttttttttttttgagacagagtctcgctctgtcgcctaggctggagtgcagtgacgcaatttcggctcacttcaagctccgcctcctgggttcacaccattctcctgcctgagcctcctgagtagctgggactataggcgcccgccatcacgcccggctaattttttttgtatttttagtagagacggggtgtcaccgtattagccaggatggtctcgatctcctgacctcgtgatccgcccgcctcagcctcccaaagtgctaggattacaggcgtgagccaccgtggctggcctttttttttttttaaagacagggtctcggtatgttgcccaggccagtctcaaactcctggcctcaggcagtcctccccgaagggctgggattataggcaggaggcgccgggcctggcctctatttctttaatacctgccctcagagccgtcctgcttttaaactgatgcaaatggcagcagtgaataatcaattcatgggttcgcttgctttgggatttagtacaagattattttaagaaataacaaaggagaaaagattgagctggattttgctgattctcaggtatctgtaccccagggtcaaccctgagattggcccaatctgccagaacctaagatgccattttgaccccagtggcagcttccagagccacaagcctgcatttgggaggaggtgcgcagcctccagggctggactccaaactcgagctgaaggaacatgctggcaggtagctctctcagggtccacctggggttccagctgctccaagacacagcacatttagccataaacatggaagggctgggacctacaggaggctcctttgtgtagaggccagggcaggcgtgtgaccttgaaccaggtggacatgaggtcccttgaactcccttctctctctggcttgttcccctgaagcactggccccccagtgctgggcttatttggccatcctgtgccagccccctggtcacccaccgtcacagtggaagctgctccctcctcttacaatggtgttccttgctctggggtctggggacaagaccatctctttccactcctggacgacactgtgcactcagtcagccgcctcctacctgccctcctgcacagggtcagaacctcctgacctggacttcgccctgggcagcttccttggaacttgttgcagcttagcatctttggaagggagcactggactaggagtcagaaggtggagttctgggtgctgttttcccactcttgggccctgggcatgttctgttctgtgcatcagatgttttctgcctgcctccccctgagctgccaccagagccacctgtagacccctgcttctcctgcccctcctgtcccttgccaggcctctggactcagtgcttcctgtcccaaggacctgttgtgtgcccagcttggaagacagtggccactcacatccaggtctctgcctggctatttgctccatgaacccatctcagatgcccctgcccccagggagccaggtgacagggtgaggtcaagtgacaagcagtaggtgtgggagaggtttggtggggtcaggcccacatgggcccagccatccactccccttccatctggagttgggggagtctgagctgctcctggccaccccatctgccccaccccatcttttcctggccaccccagctcccaccccatcttctcctggccaccccatctcccaccccatcttctcttgacaccccatctcccaccccatcttctcctggccaccccatctcccaccccatcttctcctggccaccccatcttctcctggccaccccatctcccccaccccatcttctcctggacacccccatctcccaccccatcttttgctacagccagggttagctcagcaggtgaaaaccccgagggtgggtgaaacccctctggggctcagacatgcaaaccttgggcatctctctgtcccagctggccccgccagccggtaggaagtttcccctgagttctcagttttttcttctgaaaaatgaggggttgtatgcaaggttctcctcctggcctgtggtccccagagaagggcaggaaggaaccttagataattctcatatgcatttaacagacgaggaaactgagacccagagccgtcacatcaatacctcatttgatcttcataagagcacctggaggaggggggtggggtgtttgtgtttgtttaaatttttttttgtgaaaaaaatgaagataggcattttgtagacaatctggaagttctggaccggaatccatgatgtagtcagggaagaaatgacccgtgtccagtaaccccaggcctcgagtgtgtggtgtatttttctacataattgtaatcattctatacatacaaattcatgtcttgaccatcatattaatatttggtaagtttctctctctttagagactccacaataaagttttcaacatggtaaggttttcca

SEQ ID NO: 196298 - DNA, 1707 bp, Homo sapiens
  Payload ID: 18732
  Gene Name: tumor necrosis factor receptor superfamily, member 14
  Uniprot ID: Q92956
  ENST ID: ENST00000355716
  CDS Start-End: 300-1151
ccttcataccggcccttcccctcggctttgcctggacagctcctgcctcccgcagggcccacctgtgtcccccagcgccgctccacccagcaggcctgagcccctctctgctgccagacaccccctgctgcccactctcctgctgctcgggttctgaggcacagcttgtcacaccgaggcggattctctttctctttctctttctcttctggcccacagccgcagcaatggcgctgagttcctctgctggagttcatcctgctagctgggttcccgagctgccggtctgagcctgaggcatggagcctcctggagactgggggcctcctccctggagatccacccccaaaaccgacgtcttgaggctggtgctgtatctcaccttcctgggagccccctgctacgccccagctctgccgtcctgcaaggaggacgagtacccagtgggctccgagtgctgccccaagtgcagtccaggttatcgtgtgaaggaggcctgcggggagctgacgggcacagtgtgtgaaccctgccctccaggcacctacattgcccacctcaatggcctaagcaagtgtctgcagtgccaaatgtgtgacccagccatgggcctgcgcgcgagccggaactgctccaggacagagaacgccgtgtgtggctgcagcccaggccacttctgcatcgtccaggacggggaccactgcgccgcgtgccgcgcttacgccacctccagcccgggccagagggtgcagaagggaggcaccgagagtcaggacaccctgtgtcagaactgccccccggggaccttctctcccaatgggaccctggaggaatgtcagcaccagaccaagtgcagctggctggtgacgaaggccggagctgggaccagcagctcccactgggtatggtggtttctctcagggagcctcgtcatcgtcattgtttgctccacagttggcctaatcatatgtgtgaaaagaagaaagccaaggggtgatgtagtcaaggtgatcgtctccgtccagcggaaaagacaggaggcagaaggtgaggccacagtcattgaggccctgcaggcccctccggacgtcaccacggtggccgtggaggagacaataccctcattcacggggaggagcccaaaccactgacccacagactctgcaccccgacgccagagatacctggagcgacggctgctgaaagaggctgtccacctggcggaaccaccggagcccggaggcttgggggctccgccctgggctggcttccgtctcctccagtggagggagaggtggggcccctgctggggtagagctggggacgccacgtgccattcccatgggccagtgagggcctggggcctctgttctgctgtggcctgagctccccagagtcctgaggaggagcgccagttgcccctcgctcacagaccacacacccagccctcctgggccagcccagagggcccttcagaccccagctgtctgcgcgtctgactcttgtggcctcagcaggacaggccccgggcactgcctcacagccaaggctggactgggttggctgcagtgtggtgtttagtggataccacatcggaagtgattttctaaattggatttgaattcggctcctgttttctatttgtcatgaaacagtgtatttggggagatgctgtgggaggatgtaaatatcttgtttctcctcaaa

SEQ ID NO: 196299 - DNA, 896 bp, Homo sapiens
  Payload ID: 18732
  Gene Name: tumor necrosis factor receptor superfamily, member 14
  ENST ID: ENST00000409119
  CDS Start-End: 121-702
ccccggggagcagccgagggtccctgagtgtgtgagtgagccgcagcaatggcgctgagttcctctgctggagttcatcctgctagctgggttcccgagctgccggtctgagcctgaggcatggagcctcctggagactgggggcctcctccctggagatccacccccaaaaccgacgtcttgaggctggtgctgtatctcaccttcctgggagccccctgctacgccccagctctgccgtcctgcaaggaggacgagtacccagtgggctccgagtgctgccccaagtgcagtccaggttatcgtgtgaaggaggcctgcggggagctgacgggcacagtgtgtgaaccctgccctccaggcacctacattgcccacctcaatggcctaagcaagtgtctgcagtgccaaatgtgtgacccagccatgggcctgcgcgcgagccggaactgctccaggacagagaacgccgtgtgtggctgcagcccaggccacttctgcatcgtccaggacggggaccactgcgccgcgtgccgcgcttacgccacctccagcccgggccagagggtgcagaagggaggcaccgagagtcaggacaccctgtgtcagaactgccccccggggaccttctctcccaatgggaccctggaggaatgtcagcaccagaccaaccgagcttggaaaagtcagacagacctctgaggtctcatcctggagctgccaccagcccagcctccctgggacctgtcttcactgcctggggccctgggagccagggaggctccctgaggctgagtgaacactgggcgctgcacctgcctctcccacgtcctcggccccactcccgcaggtgcagctggctggtgacgaaggccggagctgggaccagcagctcc

SEQ ID NO: 196300 - DNA, 1225 bp, Homo sapiens
  Payload ID: 18732
  Gene Name: tumor necrosis factor receptor superfamily, member 14
  ENST ID: ENST00000435221
  CDS Start-End: 532-1225
ctggtgcctgccttggggctccgggactgtgggctgtctccatccggaggtctccctaccaccaggctctgtggggcagggaagcccagtggggtgcagggagccaggaagctggggtggggtcagggcagggtccacagggagaccgggcgaggctggcagccttcccagtccgcgcagcgtctctgcagggggagcaagagctgcccttccacccctcccaggggacgggtaggggcactctgggcttttcccaccccctcacgcagggacacaggcctggtgggtctatgactgaaattggccagaccgcattctggtggttttattcggaagggaagtttaccctgttcagcagaagctgagatgggaacaggaaacccacagggcccctttattcggcaaaaatgtcagtcagcgccccggggagcagccgagggtccctgagtgtccgcagcaatggcgctgagttcctctgctggagttcatcctgctagctgggttcccgagctgccggtctgagcctgaggcatggagcctcctggagactgggggcctcctccctggagatccacccccaaaaccgacgtcttgaggctggtgctgtatctcaccttcctgggagccccctgctacgccccagctctgccgtcctgcaaggaggacgagtacccagtgggctccgagtgctgccccaagtgcagtccaggttatcgtgtgaaggaggcctgcggggagctgacgggcacagtgtgtgaaccctgccctccaggcacctacattgcccacctcaatggcctaagcaagtgtctgcagtgccaaatgtgtgacccagccatgggcctgcgcgcgagccggaactgctccaggacagagaacgccgtgtgtggctgcagcccaggccacttctgcatcgtccaggacggggaccactgcgccgcgtgccgcgcttacgccacctccagcccgggccagagggtgcagaagggaggcaccgagagtcaggacaccctgtgtcagaactgccccccggggaccttctctcccaatgggaccctggaggaatgtcagcaccagaccaagtgcagctggctggtgacgaaggccggagctgggaccagcagctcccactgggtatggtggtttctctcagggagcctcgtcatcgtcattgtttgctccacagttggcctaatcatatgtgtgaaaagaagaaagccaaggg

SEQ ID NO: 196301 - DNA, 827 bp, Homo sapiens
  Payload ID: 18732
  Gene Name: tumor necrosis factor receptor superfamily, member 14
  ENST ID: ENST00000451778
  CDS Start-End: 134-827
agcgtctctgcagggggagcaagagctgcccttccacccctcccaggggacggccgcagcaatggcgctgagttcctctgctggagttcatcctgctagctgggttcccgagctgccggtctgagcctgaggcatggagcctcctggagactgggggcctcctccctggagatccacccccaaaaccgacgtcttgaggctggtgctgtatctcaccttcctgggagccccctgctacgccccagctctgccgtcctgcaaggaggacgagtacccagtgggctccgagtgctgccccaagtgcagtccaggttatcgtgtgaaggaggcctgcggggagctgacgggcacagtgtgtgaaccctgccctccaggcacctacattgcccacctcaatggcctaagcaagtgtctgcagtgccaaatgtgtgacccagccatgggcctgcgcgcgagccggaactgctccaggacagagaacgccgtgtgtggctgcagcccaggccacttctgcatcgtccaggacggggaccactgcgccgcgtgccgcgcttacgccacctccagcccgggccagagggtgcagaagggaggcaccgagagtcaggacaccctgtgtcagaactgccccccggggaccttctctcccaatgggaccctggaggaatgtcagcaccagaccaagtgcagctggctggtgacgaaggccggagctgggaccagcagctcccactgggtatggtggtttctctcagggagcctcgtcatcgtcattgtttgctccacagttggcctaatcatatgtgtgaaaagaagaaagccaaggg

SEQ ID NO: 196302 - DNA, 660 bp, Homo sapiens
  Payload ID: 18732
  Gene Name: tumor necrosis factor receptor superfamily, member 14
  ENST ID: ENST00000426449
  CDS Start-End: 110-660
ctgggacctgctctgggcaagcacaggcgccgcagcaatggcgctgagttcctctgctggagttcatcctgctagctgggttcccgagctgccggtctgagcctgaggcatggagcctcctggagactgggggcctcctccctggagatccacccccaaaaccgacgtcttgaggctggtgctgtatctcaccttcctgggagccccctgctacgccccagctctgccgtcctgcaaggaggacgagtacccagtgggctccgagtgctgccccaagtgcagtccaggttatcgtgtgaaggaggcctgcggggagctgacgggcacagtgtgtgaaccctgccctccaggcacctacattgcccacctcaatggcctaagcaagtgtctgcagtgccaaatgtgtgacccagccatgggcctgcgcgcgagccggaactgctccaggacagagaacgccgtgtgtggctgcagcccaggccacttctgcatcgtccaggacggggaccactgcgccgcgtgccgcgcttacgccacctccagcccgggccagagggtgcagaagggaggcaccgagagtcaggacaccctgtgtcagaactgccccccggggaccttctctcccaatgggaccctggaggaatgtcagcaccagaccaa

SEQ ID NO: 196303 - DNA, 834 bp, Homo sapiens
  Payload ID: 18732
  Gene Name: tumor necrosis factor receptor superfamily, member 14
  ENST ID: ENST00000434817
  CDS Start-End: 141-834
cgagggactcactggtgcctgccttggggctccgggactgtgggctgtctccatccggagccgcagcaatggcgctgagttcctctgctggagttcatcctgctagctgggttcccgagctgccggtctgagcctgaggcatggagcctcctggagactgggggcctcctccctggagatccacccccaaaaccgacgtcttgaggctggtgctgtatctcaccttcctgggagccccctgctacgccccagctctgccgtcctgcaaggaggacgagtacccagtgggctccgagtgctgccccaagtgcagtccaggttatcgtgtgaaggaggcctgcggggagctgacgggcacagtgtgtgaaccctgccctccaggcacctacattgcccacctcaatggcctaagcaagtgtctgcagtgccaaatgtgtgacccagccatgggcctgcgcgcgagccggaactgctccaggacagagaacgccgtgtgtggctgcagcccaggccacttctgcatcgtccaggacggggaccactgcgccgcgtgccgcgcttacgccacctccagcccgggccagagggtgcagaagggaggcaccgagagtcaggacaccctgtgtcagaactgccccccggggaccttctctcccaatgggaccctggaggaatgtcagcaccagaccaagtgcagctggctggtgacgaaggccggagctgggaccagcagctcccactgggtatggtggtttctctcagggagcctcgtcatcgtcattgtttgctccacagttggcctaatcatatgtgtgaaaagaagaaagccaaggg

SEQ ID NO: 196304 - DNA, 1707 bp, Homo sapiens; identical to SEQ ID NO: 196298
  Payload ID: 18732
  Gene Name: tumor necrosis factor receptor superfamily, member 14
  Uniprot ID: Q92956
  ENST ID: ENST00000621877
  CDS Start-End: 300-1151

SEQ ID NO: 196305 - DNA, 896 bp, Homo sapiens; identical to SEQ ID NO: 196299
  Payload ID: 18732
  Gene Name: tumor necrosis factor receptor superfamily, member 14
  ENST ID: ENST00000625695
  CDS Start-End: 121-702

SEQ ID NO: 196306 - DNA, 827 bp, Homo sapiens; identical to SEQ ID NO: 196301
  Payload ID: 18732
  Gene Name: tumor necrosis factor receptor superfamily, member 14
  ENST ID: ENST00000629075
  CDS Start-End: 134-827

SEQ ID NO: 196307 - DNA, 674 bp, Homo sapiens
  Payload ID: 18732
  Gene Name: tumor necrosis factor receptor superfamily, member 14
  ENST ID: ENST00000629209
  CDS Start-End: 1-76
tgggaccctggaggaatgtcagcaccagaccaattggcctaatcatatgtgtgaaaagaagaaagccaaggggtgatgtagtcaaggtgatcgtctccgtccaggccaagtgtggagaaatcaatgatgttgacgatgaggctccctgagagaaatcacacccagcgggagctgctgctcccaggtctggcctcggtcaccagccacctgctgcatccgcgggagtggggccgaggacatgggagtggcaggtgcagcccccggtactcactcagccccagggagtgtccctggctcccagggctctgggaggtgagggcaggtcccgggggaggctgggttagtggcagctccgggatgagacctcagaggtctgtctgacttgtccaagcccggctatggggaggtggggggaaggaaggaagaggagagaaataaggagaggctgggcaaagaagacaggacggcagagggagaggggagagaagtgggaggcagccagcagcgcagggccctgagagtatttcagcggcaccgctgtcctgggccgcccggtgccacatctttgaaaacagttgtttaatttaagcttgtccactcagtagctgttgaatgtgggaggttatcttgttctattcaagttgctataaaaataaaaactaccatagactggg

SEQ ID NO: 196308 - DNA, 660 bp, Homo sapiens; identical to SEQ ID NO: 196302
  Payload ID: 18732
  Gene Name: tumor necrosis factor receptor superfamily, member 14
  ENST ID: ENST00000628337
  CDS Start-End: 110-660

SEQ ID NO: 196309 - DNA, 434 bp, Homo sapiens
  Payload ID: 18732
  Gene Name: tumor necrosis factor receptor superfamily, member 14
  ENST ID: ENST00000482602
  CDS Start-End: 1-76
tgggaccctggaggaatgtcagcaccagaccaattggcctaatcatatgtgtgaaaagaagaaagccaaggggtgatgtagtcaaggtgatcgtctccgtccaggccaagtgtggagaaatcaatgatgttgacgatgaggctccctgagagaaatcacacccagcgggagctgctgctcccaggtctggcctcggtcaccagccacctgctgcatccgcgggagtggggccgaggacatgggagtggcaggtgcagcccccggtactcactcagccccagggagtgtccctggctcccagggctctgggaggtgagggcaggtcccgggggaggctgggttagtggcagctccgggatgagacctcagaggtctgtctgacttgtccaagcccggctatggggaggtggggggaaggaaggaagaggagagaa

SEQ ID NO: 196310 - DNA, 1225 bp, Homo sapiens; identical to SEQ ID NO: 196300
  Payload ID: 18732
  Gene Name: tumor necrosis factor receptor superfamily, member 14
  ENST ID: ENST00000629542
  CDS Start-End: 532-1225

SEQ ID NO: 196311 - DNA, 834 bp, Homo sapiens; identical to SEQ ID NO: 196303
  Payload ID: 18732
  Gene Name: tumor necrosis factor receptor superfamily, member 14
  ENST ID: ENST00000631202
  CDS Start-End: 141-834

SEQ ID NO: 196312 - DNA, 994 bp, Homo sapiens
  Payload ID: 18733
  Gene Name: tumor necrosis factor receptor superfamily, member 17
  Uniprot ID: Q02223
  ENST ID: ENST00000053243
  CDS Start-End: 219-773
aagactcaaacttagaaacttgaattagatgtggtattcaaatccttagctgccgcgaagacacagacagcccccgtaagaacccacgaagcaggcgaagttcattgttctcaacattctagctgctcttgctgcatttgctctggaattcttgtagagatattacttgtccttccaggctgttctttctgtagctcccttgttttctttttgtgatcatgttgcagatggctgggcagtgctcccaaaatgaatattttgacagtttgttgcatgcttgcataccttgtcaacttcgatgttcttctaatactcctcctctaacatgtcagcgttattgtaatgcaagtgtgaccaattcagtgaaaggaacgaatgcgattctctggacctgtttgggactgagcttaataatttctttggcagttttcgtgctaatgtttttgctaaggaagataaactctgaaccattaaaggacgagtttaaaaacacaggatcaggtctcctgggcatggctaacattgacctggaaaagagcaggactggtgatgaaattattcttccgagaggcctcgagtacacggtggaagaatgcacctgtgaagactgcatcaagagcaaaccgaaggtcgactctgaccattgctttccactcccagctatggaggaaggcgcaaccattcttgtcaccacgaaaacgaatgactattgcaagagcctgccagctgctttgagtgctacggagatagagaaatcaatttctgctaggtaattaaccatttcgactcgagcagtgccactttaaaaatcttttgtcagaatagatgatgtgtcagatctctttaggatgactgtatttttcagttgccgatacagctttttgtcctctaactgtggaaactctttatgttagatatatttctctaggttactgttgggagcttaatggtagaaacttccttggtttcatgattaaactcttttttttcctga

SEQ ID NO: 196313 - DNA, 668 bp, Homo sapiens
  Payload ID: 18733
  Gene Name: tumor necrosis factor receptor superfamily, member 17
  Uniprot ID: Q02223
  ENST ID: ENST00000396495
  CDS Start-End: 113-520
gttctcaacattctagctgctcttgctgcatttgctctggaattcttgtagagatattacttgtccttccaggctgttctttctgtagctcccttgttttctttttgtgatcatgttgcagatggctgggcagtgctcccaaaatgaatattttgacagtttgttgcatgcttgcataccttgtcaacttcgatgttcttctaatactcctcctctaacatgtcagcgttattgtaatgcaagatcaggtctcctgggcatggctaacattgacctggaaaagagcaggactggtgatgaaattattcttccgagaggcctcgagtacacggtggaagaatgcacctgtgaagactgcatcaagagcaaaccgaaggtcgactctgaccattgctttccactcccagctatggaggaaggcgcaaccattcttgtcaccacgaaaacgaatgactattgcaagagcctgccagctgctttgagtgctacggagatagagaaatcaatttctgctaggtaattaaccatttcgactcgagcagtgccactttaaaaatcttttgtcagaatagatgatgtgtcagatctctttaggatgactgtatttttcagttgccgatacagctttttgtcctctaactgtggaaactctttatgttagatatatt

SEQ ID NO: 196314 - DNA, 511 bp, Homo sapiens
  Payload ID: 18733
  Gene Name: tumor necrosis factor receptor superfamily, member 17
  ENST ID: ENST00000562385
  CDS Start-End: 1-401
cccaaaatgaatattttgacagtttgttgcatgcttgcataccttgtcaacttcgatgttcttctaatactcctcctctaacatgtcagcgttattgtaatgcaagtgtgaccaattcagtgaaaggaacgaatgcgattctctggacctgtttgggactgagcttaataatttctttggcagttttcgtgctaatgtttttgctaaggaagataaactctgaaccattaaaggacgagtttaaaaacacagagatggagtctcgctctgtggcccaggctggagtgcagtggcgtgatctcaactcactgcagcctctgcctcttgggttcaaacaattctcccatctcagcctcctgagtaactgggactataggatcaggtctcctgggcatggctaacattgacctggaaaagagcaggactggtgatgaaattattcttccgagaggcctcgagtacacggtggaagaatgcacctgtgaagactgcatcaagagcaaaccgaagg

SEQ ID NO: 196315 - DNA, 851 bp, Homo sapiens
  Payload ID: 18734
  Gene Name: tumor necrosis factor receptor superfamily, member 18
  Uniprot ID: Q9Y5U5
  ENST ID: ENST00000328596
  CDS Start-End: 1-768
atggcacagcacggggcgatgggcgcgtttcgggccctgtgcggcctggcgctgctgtgcgcgctcagcctgggtcagcgccccaccgggggtcccgggtgcggccctgggcgcctcctgcttgggacgggaacggacgcgcgctgctgccgggttcacacgacgcgctgctgccgcgattacccgggcgaggagtgctgttccgagtgggactgcatgtgtgtccagcctgaattccactgcggagacccttgctgcacgacctgccggcaccacccttgtcccccaggccagggggtacagtcccaggggaaattcagttttggcttccagtgtatcgactgtgcctcggggaccttctccgggggccacgaaggccactgcaaaccttggacagactgctgctggaggtgccgccgtcgaccgaagacgccagaagctgccagttccccgaggaagagcggggcgagcgatcggcagaggagaaggggcggctgggagacctgtgggtgtgagcctggccgtcctccggggccaccgaccgcagccagcccctccccaggagctccccaggccgcaggggctctgcgttctgctctgggccgggccctgctcccctggcagcagaagtgggtgcaggaaggtggcagtgaccagcgccctggaccatgcagttcggcggccgcggctgggccctgcaggagggagagagagacacagtcatggcccccttcctcccttgctggccctgatggggtggggtcttaggacgggaggctgtgtccgtgggtgtgcagtgcccagcacgggacccggctgcaggggaccttcaataaacacttgtccagtga

SEQ ID NO: 196316 - DNA, 705 bp, Homo sapiens
  Payload ID: 18734
  Gene Name: tumor necrosis factor receptor superfamily, member 18
  Uniprot ID: Q9Y5U5
  ENST ID: ENST00000379265
  CDS Start-End: 1-705
atggcacagcacggggcgatgggcgcgtttcgggccctgtgcggcctggcgctgctgtgcgcgctcagcctgggtcagcgccccaccgggggtcccgggtgcggccctgggcgcctcctgcttgggacgggaacggacgcgcgctgctgccgggttcacacgacgcgctgctgccgcgattacccgggcgaggagtgctgttccgagtgggactgcatgtgtgtccagcctgaattccactgcggagacccttgctgcacgacctgccggcaccacccttgtcccccaggccagggggtacagtcccaggggaaattcagttttggcttccagtgtatcgactgtgcctcggggaccttctccgggggccacgaaggccactgcaaaccttggacagactgcacccagttcgggtttctcactgtgttccctgggaacaagacccacaacgctgtgtgcgtcccagggtccccgccggcagagccgcttgggtggctgaccgtcgtcctcctggccgtggccgcctgcgtcctcctcctgacctcggcccagcttggactgcacatctggcagctgaggaagacccagctgctgctggaggtgccgccgtcgaccgaagacgccagaagctgccagttccccgaggaagagcggggcgagcgatcggcagaggagaaggggcggctgggagacctgtgggtgtga

SEQ ID NO: 196317 - DNA, 1179 bp, Homo sapiens
  Payload ID: 18734
  Gene Name: tumor necrosis factor receptor superfamily, member 18
  Uniprot ID: Q9Y5U5
  ENST ID: ENST00000379268
  CDS Start-End: 121-846
cacgcacttcacctgggtcgggattctcaggtcatgaacggtcccagccacctccgggcagggcgggtgaggacggggacggggcgtgtccaactggctgtgggctcttgaaacccgagcatggcacagcacggggcgatgggcgcgtttcgggccctgtgcggcctggcgctgctgtgcgcgctcagcctgggtcagcgccccaccgggggtcccgggtgcggccctgggcgcctcctgcttgggacgggaacggacgcgcgctgctgccgggttcacacgacgcgctgctgccgcgattacccgggcgaggagtgctgttccgagtgggactgcatgtgtgtccagcctgaattccactgcggagacccttgctgcacgacctgccggcaccacccttgtcccccaggccagggggtacagtcccaggggaaattcagttttggcttccagtgtatcgactgtgcctcggggaccttctccgggggccacgaaggccactgcaaaccttggacagactgcacccagttcgggtttctcactgtgttccctgggaacaagacccacaacgctgtgtgcgtcccagggtccccgccggcagagccgcttgggtggctgaccgtcgtcctcctggccgtggccgcctgcgtcctcctcctgacctcggcccagcttggactgcacatctggcagctgaggagtcagtgcatgtggccccgagagacccagctgctgctggaggtgccgccgtcgaccgaagacgccagaagctgccagttccccgaggaagagcggggcgagcgatcggcagaggagaaggggcggctgggagacctgtgggtgtgagcctggccgtcctccggggccaccgaccgcagccagcccctccccaggagctccccaggccgcaggggctctgcgttctgctctgggccgggccctgctcccctggcagcagaagtgggtgcaggaaggtggcagtgaccagcgccctggaccatgcagttcggcggccgcggctgggccctgcaggagggagagagagacacagtcatggcccccttcctcccttgctggccctgatggggtggggtcttaggacgggaggctgtgtccgtgggtgtgcagtgcccagcacgggacccggctgcaggggaccttcaataaacacttgtccag

SEQ ID NO: 196318 - DNA, 727 bp, Homo sapiens
  Payload ID: 18734
  Gene Name: tumor necrosis factor receptor superfamily, member 18
  ENST ID: ENST00000486728
  CDS Start-End: 218-727
atggccccaggagaaagagacagctggataaacccagggtccagactcccagccaggagccctctgctccctggagccaactgtgggtggagaacggacaacctcactcccctggagggccgaggggaggcctggggaggagggggcctcagcccagctgctggggggctggcctgtctcctgcccaggcgaggagtgctgttccgagtgggactgcatgtgtgtccagcctgaattccactgcggagacccttgctgcacgacctgccggcaccacccttgtcccccaggccagggggtacagtcccaggggaaattcagttttggcttccagtgtatcgactgtgcctcggggaccttctccgggggccacgaaggccactgcaaaccttggacagactgcacccagttcgggtttctcactgtgttccctgggaacaagacccacaacgctgtgtgcgtcccagggtccccgccggcagagccgcttgggtggctgaccgtcgtcctcctggccgtggccgcctgcgtcctcctcctgacctcggcccagcttggactgcacatctggcagctgaggagtcagtgcatgtggccccgagagacccagctgctgctggaggtgccgccgtcgaccgaagacgccagaagctgccagttccccgaggaagagcggggcgagcgatcggcagaggagaaggggcggctgggagacctgtgggtgtga

SEQ ID NO: 196319 - DNA, 3276 bp, Homo sapiens
  Payload ID: 18735
  Gene Name: tumor necrosis factor receptor superfamily, member 19
  Uniprot ID: Q9NS68
  ENST ID: ENST00000248484
  CDS Start-End: 514-1767
gcagttcagcgagatgaaagggataaagcagaacccgctggcactaggaaaagcttccaacacacagtccacaacacagcttgggaaccaaaaaagctacagatccagccactcagcccaagcatgggagaactaccagcattgcctcattgcaaaaaagaggaggaaaacaacgtgatccatgtttaacaaaagagtctgtggactaggaggtgggagggtaactacctgctgaaagtgaactttctttgatatccatgcatatatataaactcagccctgcctttgatgttcagcaactgattcactgatcagattacaggcatttcatctccctgctcgtctgcctttgatctgcatggttaattttattttcctggatttgaagtttcgtctgggcttgtgctgacatacatttttgggaaggtagaagcatttggcacagaagtgctgccaggagaaactaagttgctgaacggaactctccaacaataaatacatttgataagaaagatggctttaaaagtgctactagaacaagagaaaacgtttttcactcttttagtattactaggctatttgtcatgtaaagtgacttgtgaatcaggagactgtagacagcaagaattcagggatcggtctggaaactgtgttccctgcaaccagtgtgggccaggcatggagttgtctaaggaatgtggcttcggctatggggaggatgcacagtgtgtgacgtgccggctgcacaggttcaaggaggactggggcttccagaaatgcaagccctgtctggactgcgcagtggtgaaccgctttcagaaggcaaattgttcagccaccagtgatgccatctgcggggactgcttgccaggattttataggaagacgaaacttgtcggctttcaagacatggagtgtgtgccttgtggagaccctcctcctccttacgaaccgcactgtgccagcaaggtcaacctcgtgaagatcgcgtccacggcctccagcccacgggacacggcgctggctgccgttatctgcagcgctctggccaccgtcctgctggccctgctcatcctctgtgtcatctattgtaagagacagtttatggagaagaaacccagctggtctctgcggtcacaggacattcagtacaacggctctgagctgtcgtgttttgacagacctcagctccacgaatatgcccacagagcctgctgccagtgccgccgtgactcagtgcagacctgcgggccggtgcgcttgctcccatccatgtgctgtgaggaggcctgcagccccaacccggcgactcttggttgtggggtgcattctgcagccagtcttcaggcaagaaacgcaggcccagccggggagatggtgccgactttcttcggatccctcacgcagtccatctgtggcgagttttcagatgcctggcctctgatgcagaatcccatgggtggtgacaacatctctttttgtgactcttatcctgaactcactggagaagacattcattctctcaatccagaacttgaaagctcaacgtctttggattcaaatagcagtcaagatttggttggtggggctgttccagtccagtctcattctgaaaactttacagcagctactgatttatctagatataacaacacactggtagaatcagcatcaactcaggatgcactaactatgagaagccagctagatcaggagagtggtgctgtcatccacccagccactcagacgtccctccaggaagcttaaagaacctgcttctttctgcagtagaagcgtgtgctggaacccaaagagtactcctttgttaggcttatggactgagcagtctggaccttgcatggcttctggggcaaaaataaatctgaaccaaactgacggcatttgaagcctttcagccagttgcttctgagccagaccagctgtaagctgaaacctcaatgaataacaagaaaagactccaggccgactcatgatactctgcatctttcctacatgagaagcttctctgccacaaaagtgacttcaaagacggatgggttgagctggcagcctatgagattgtggacatataacaagaaacagaaatgccctcatgcttattttcatggtgattgtggttttacaagactgaagacccagagtatactttttctttccagaaataatttcataccgcctatgaaatatcagataaattaccttagcttttatgtagaatgggttcaaaagtgagtgtttctatttgagaaggacactttttcatcatctaaactgattcgcataggtggttagaatggccctcatattgcctgcctaaatcttgggtttattagatgaagtttactgaatcagaggaatcagacagaggaggatagctctttccagaatccacacttctgacctcagcctcggtctcatgaacacccgctgatctcaggagaacacctgggctagggaatgtggtcgagaaagggcagcccattgcccagaattaacacatattgtagagacttgtatgcaaaggttggcatatttatatgaaaattagttgctatagaaacatttgttgcatctgtccctctgcctgagcttagaaggttatagaaaaagggtatttataaacataaatgaccttttacttgcattgtatcttatactaaaggctttagaaattacaacatatcaggttcccctactactgaagtagccttccgtgagaacacaccacatgttaggactagaagaaaatgcacaatttgtaggggtttggatgaagcagctgtaactgccctagtgtagtttgaccaggacattgtcgtgctccttccaattgtgtaagattagttagcacatcatctcctactttagccatccggtgttggatttaagaggacggtgcttctttctattaaagtgctccatcccctaccatctacacattagcattgtctctagagctaagacagaaattaaccccgttcagtcacaaagcagggaatggttcatttactcttaatctttatgccctggagaagacctacttgaacagggcatattttttagacttctgaacatcagtatgttcgagggtactatgatattttggtttggaattgccctgcccaagtcactgtcttttaacttttaaactgaatattaaaatgtatctgtctttcctagtatgtttttatcttctcatgtattatccatggttttctctgtttgtgacagattagtaaaatttaatgagccctc

SEQ ID NO: 196320 - DNA, 1625 bp, Homo sapiens
  Payload ID: 18735
  Gene Name: tumor necrosis factor receptor superfamily, member 19
  Uniprot ID: Q9NS68
  ENST ID: ENST00000382258
  CDS Start-End: 205-1476
gttgccgggctacgggagagcgcggagccctgcgctgggaggtgcacggtgtgcacgctggactggacccccatgcaaccccgcgccctgcgccttaaccaggactgctccgcgcgcccctgagcctcgggctccggcccggacctgcagcctcccaggtggctgggaagaactctccaacaataaatacatttgataagaaagatggctttaaaagtgctactagaacaagagaaaacgtttttcactcttttagtattactaggctatttgtcatgtaaagtgacttgtgaatcaggagactgtagacagcaagaattcagggatcggtctggaaactgtgttccctgcaaccagtgtgggccaggcatggagttgtctaaggaatgtggcttcggctatggggaggatgcacagtgtgtgacgtgccggctgcacaggttcaaggaggactggggcttccagaaatgcaagccctgtctggactgcgcagtggtgaaccgctttcagaaggcaaattgttcagccaccagtgatgccatctgcggggactgcttgccaggattttataggaagacgaaacttgtcggctttcaagacatggagtgtgtgccttgtggagaccctcctcctccttacgaaccgcactgtgccagcaaggtcaacctcgtgaagatcgcgtccacggcctccagcccacgggacacggcgctggctgccgttatctgcagcgctctggccaccgtcctgctggccctgctcatcctctgtgtcatctattgtaagagacagtttatggagaagaaacccagctggtctctgcggtcacaggacattcagtacaacggctctgagctgtcgtgttttgacagacctcagctccacgaatatgcccacagagcctgctgccagtgccgccgtgactcagtgcagacctgcgggccggtgcgcttgctcccatccatgtgctgtgaggaggcctgcagccccaacccggcgactcttggttgtggggtgcattctgcagccagtcttcaggcaagaaacgcaggcccagccggggagatggtgccgactttcttcggatccctcacgcagtccatctgtggcgagttttcagatgcctggcctctgatgcagaatcccatgggtggtgacaacatctctttttgtgactcttatcctgaactcactggagaagacattcattctctcaatccagaacttgaaagctcaacgtctttggattcaaatagcagtcaagatttggttggtggggctgttccagtccagtctcattctgaaaactttacagcagctactgatttatctagatataacaacacactggtagaatcagcatcaactcaggatgcactaactatgagaagccagctagatcaggagagtggtgctgtcatccacccagccactcagacgtccctccaggtaaggcagcgactgggttccctgtgaacacagcactgacttacagtagatcagaactctgttcccagcataagatttgggggaacctgatgagttttttttttgcatctttaataatttcttgtatgttgtagagtatgttttaaaataaatttcaagtatttttttaaaaaact

SEQ ID NO: 196321 - DNA, 4151 bp, Homo sapiens
  Payload ID: 18735
  Gene Name: tumor necrosis factor receptor superfamily, member 19
  Uniprot ID: Q9NS68
  ENST ID: ENST00000382263
  CDS Start-End: 185-1438
cgcggagccctgcgctgggaggtgcacggtgtgcacgctggactggacccccatgcaaccccgcgccctgcgccttaaccaggactgctccgcgcgcccctgagcctcgggctccggcccggacctgcagcctcccaggtggctgggaagaactctccaacaataaatacatttgataagaaagatggctttaaaagtgctactagaacaagagaaaacgtttttcactcttttagtattactaggctatttgtcatgtaaagtgacttgtgaatcaggagactgtagacagcaagaattcagggatcggtctggaaactgtgttccctgcaaccagtgtgggccaggcatggagttgtctaaggaatgtggcttcggctatggggaggatgcacagtgtgtgacgtgccggctgcacaggttcaaggaggactggggcttccagaaatgcaagccctgtctggactgcgcagtggtgaaccgctttcagaaggcaaattgttcagccaccagtgatgccatctgcggggactgcttgccaggattttataggaagacgaaacttgtcggctttcaagacatggagtgtgtgccttgtggagaccctcctcctccttacgaaccgcactgtgccagcaaggtcaacctcgtgaagatcgcgtccacggcctccagcccacgggacacggcgctggctgccgttatctgcagcgctctggccaccgtcctgctggccctgctcatcctctgtgtcatctattgtaagagacagtttatggagaagaaacccagctggtctctgcggtcacaggacattcagtacaacggctctgagctgtcgtgttttgacagacctcagctccacgaatatgcccacagagcctgctgccagtgccgccgtgactcagtgcagacctgcgggccggtgcgcttgctcccatccatgtgctgtgaggaggcctgcagccccaacccggcgactcttggttgtggggtgcattctgcagccagtcttcaggcaagaaacgcaggcccagccggggagatggtgccgactttcttcggatccctcacgcagtccatctgtggcgagttttcagatgcctggcctctgatgcagaatcccatgggtggtgacaacatctctttttgtgactcttatcctgaactcactggagaagacattcattctctcaatccagaacttgaaagctcaacgtctttggattcaaatagcagtcaagatttggttggtggggctgttccagtccagtctcattctgaaaactttacagcagctactgatttatctagatataacaacacactggtagaatcagcatcaactcaggatgcactaactatgagaagccagctagatcaggagagtggtgctgtcatccacccagccactcagacgtccctccaggaagcttaaagaacctgcttctttctgcagtagaagcgtgtgctggaacccaaagagtactcctttgttaggcttatggactgagcagtctggaccttgcatggcttctggggcaaaaataaatctgaaccaaactgacggcatttgaagcctttcagccagttgcttctgagccagaccagctgtaagctgaaacctcaatgaataacaagaaaagactccaggccgactcatgatactctgcatctttcctacatgagaagcttctctgccacaaaagtgacttcaaagacggatgggttgagctggcagcctatgagattgtggacatataacaagaaacagaaatgccctcatgcttattttcatggtgattgtggttttacaagactgaagacccagagtatactttttctttccagaaataatttcataccgcctatgaaatatcagataaattaccttagcttttatgtagaatgggttcaaaagtgagtgtttctatttgagaaggacactttttcatcatctaaactgattcgcataggtggttagaatggccctcatattgcctgcctaaatcttgggtttattagatgaagtttactgaatcagaggaatcagacagaggaggatagctctttccagaatccacacttctgacctcagcctcggtctcatgaacacccgctgatctcaggagaacacctgggctagggaatgtggtcgagaaagggcagcccattgcccagaattaacacatattgtagagacttgtatgcaaaggttggcatatttatatgaaaattagttgctatagaaacatttgttgcatctgtccctctgcctgagcttagaaggttatagaaaaagggtatttataaacataaatgaccttttacttgcattgtatcttatactaaaggctttagaaattacaacatatcaggttcccctactactgaagtagccttccgtgagaacacaccacatgttaggactagaagaaaatgcacaatttgtaggggtttggatgaagcagctgtaactgccctagtgtagtttgaccaggacattgtcgtgctccttccaattgtgtaagattagttagcacatcatctcctactttagccatccggtgttggatttaagaggacggtgcttctttctattaaagtgctccatcccctaccatctacacattagcattgtctctagagctaagacagaaattaaccccgttcagtcacaaagcagggaatggttcatttactcttaatctttatgccctggagaagacctacttgaacagggcatattttttagacttctgaacatcagtatgttcgagggtactatgatattttggtttggaattgccctgcccaagtcactgtcttttaacttttaaactgaatattaaaatgtatctgtctttcctagtatgtttttatcttctcatgtattatccatggttttctctgtttgtgacagattagtaaaatttaatgagccctctttcttgtggccgtttctccatagttttaggttttgatatgtgtttactagcttgcctgtgtctggtacatctcatgacctcaattccctcacctgaaataggaaatgagaatgtttcattgtagccccaagcggtcatgtcaacctagtgcctagtcataattaattgacttttcctgtattacttctttttttaagtataaaccaatgatcctttggtagtcaagaactcttaggaacattgccttttggacatgtaaaatatttaggatttgaccacacaatggctatgaaaatgcaagtagtttcctcgcgtgacctcaccatgattcacatacgtgccactgtttgaaatctggtctgtttgcatttctgttatgacagagagatgatgtttgcatttctgttatgacagagagatgatgaaagtaggcagggctgtgttcctttgtgtagcctgtatatattttccatatgtagagccctgattaacttcaaggacaaacactggctggagaaagccagactgatgggaatgagactttggccaaaaatcccaaaacatcattttcaatcagtagagaagtgcttagggttgaaaattgatttcatttgctactgaatttggtaaatcctgggtaacttttatcaagatgaagacattttaccctacctactctagaaatatacaacaatgttatattttacactccttggaaacatttgaggaaaaaaatgcaatttgcacttcactttgttggaatatcccatagcactcaataaactcagctgctagagtgccgatgtcaggagggctgtgtcgggtaatgcgtgtggctgaatgggcataaccactgtggcttcttgtgctgcagaagctcgttgacaagactgaggaggatttcaagagcaaccaagtaaagtcatgaattttctaattttgtgtatatggaatatatttttaaatagagatttttctactttagataatgtgttaatattgctattacctaggttaagcactattgtctgtgctagtaagaaaaagaaaggaaaaccatcattgctttatagtagcttatatcaatttagatttcatcattactattttgcatactggaatttataaatgtgtaaattatcattttcttagttttgtaataccttttttatttgtgaataaaattatcacctggtattctta

SEQ ID NO: 196322 - DNA, 4277 bp, Homo sapiens
  Payload ID: 18735
  Gene Name: tumor necrosis factor receptor superfamily, member 19
  Uniprot ID: Q9NS68
  ENST ID: ENST00000403372
  CDS Start-End: 696-1553
gcagttcagcgagatgaaagggataaagcagaacccgctggcactaggaaaagcttccaacacacagtccacaacacagcttgggaaccaaaaaagctacagatccagccactcagcccaagcatgggagaactaccagcattgcctcattgcaaaaaagaggaggaaaacaacgtgatccatgtttaacaaaagagtctgtggactaggaggtgggagggtaactacctgctgaaagtgaactttctttgatatccatgcatatatataaactcagccctgcctttgatgttcagcaactgattcactgatcagattacaggcatttcatctccctgctcgtctgcctttgatctgcatggttaattttattttcctggatttgaagtttcgtctgggcttgtgctgacatacatttttgggaaggtagaagcatttggcacagaagtgctgccaggagaaactaagttgctgaacgggaatgtggcttcggctatggggaggatgcacagtgtgtgacgtgccggctgcacaggttcaaggaggactggggcttccagaaatgcaagccctgtctggactgcgcagtggtgaaccgctttcagaaggcaaattgttcagccaccagtgatgccatctgcggggactgcttgccaggattttataggaagacgaaacttgtcggctttcaagacatggagtgtgtgccttgtggagaccctcctcctccttacgaaccgcactgtgccagcaaggtcaacctcgtgaagatcgcgtccacggcctccagcccacgggacacggcgctggctgccgttatctgcagcgctctggccaccgtcctgctggccctgctcatcctctgtgtcatctattgtaagagacagtttatggagaagaaacccagctggtctctgcggtcacaggacattcagtacaacggctctgagctgtcgtgttttgacagacctcagctccacgaatatgcccacagagcctgctgccagtgccgccgtgactcagtgcagacctgcgggccggtgcgcttgctcccatccatgtgctgtgaggaggcctgcagccccaacccggcgactcttggttgtggggtgcattctgcagccagtcttcaggcaagaaacgcaggcccagccggggagatggtgccgactttcttcggatccctcacgcagtccatctgtggcgagttttcagatgcctggcctctgatgcagaatcccatgggtggtgacaacatctctttttgtgactcttatcctgaactcactggagaagacattcattctctcaatccagaacttgaaagctcaacgtctttggattcaaatagcagtcaagatttggttggtggggctgttccagtccagtctcattctgaaaactttacagcagctactgatttatctagatataacaacacactggtagaatcagcatcaactcaggatgcactaactatgagaagccagctagatcaggagagtggtgctgtcatccacccagccactcagacgtccctccaggaagcttaaagaacctgcttctttctgcagtagaagcgtgtgctggaacccaaagagtactcctttgttaggcttatggactgagcagtctggaccttgcatggcttctggggcaaaaataaatctgaaccaaactgacggcatttgaagcctttcagccagttgcttctgagccagaccagctgtaagctgaaacctcaatgaataacaagaaaagactccaggccgactcatgatactctgcatctttcctacatgagaagcttctctgccacaaaagtgacttcaaagacggatgggttgagctggcagcctatgagattgtggacatataacaagaaacagaaatgccctcatgcttattttcatggtgattgtggttttacaagactgaagacccagagtatactttttctttccagaaataatttcataccgcctatgaaatatcagataaattaccttagcttttatgtagaatgggttcaaaagtgagtgtttctatttgagaaggacactttttcatcatctaaactgattcgcataggtggttagaatggccctcatattgcctgcctaaatcttgggtttattagatgaagtttactgaatcagaggaatcagacagaggaggatagctctttccagaatccacacttctgacctcagcctcggtctcatgaacacccgctgatctcaggagaacacctgggctagggaatgtggtcgagaaagggcagcccattgcccagaattaacacatattgtagagacttgtatgcaaaggttggcatatttatatgaaaattagttgctatagaaacatttgttgcatctgtccctctgcctgagcttagaaggttatagaaaaagggtatttataaacataaatgaccttttacttgcattgtatcttatactaaaggctttagaaattacaacatatcaggttcccctactactgaagtagccttccgtgagaacacaccacatgttaggactagaagaaaatgcacaatttgtaggggtttggatgaagcagctgtaactgccctagtgtagtttgaccaggacattgtcgtgctccttccaattgtgtaagattagttagcacatcatctcctactttagccatccggtgttggatttaagaggacggtgcttctttctattaaagtgctccatcccctaccatctacacattagcattgtctctagagctaagacagaaattaaccccgttcagtcacaaagcagggaatggttcatttactcttaatctttatgccctggagaagacctacttgaacagggcatattttttagacttctgaacatcagtatgttcgagggtactatgatattttggtttggaattgccctgcccaagtcactgtcttttaacttttaaactgaatattaaaatgtatctgtctttcctagtatgtttttatcttctcatgtattatccatggttttctctgtttgtgacagattagtaaaatttaatgagccctctttcttgtggccgtttctccatagttttaggttttgatatgtgtttactagcttgcctgtgtctggtacatctcatgacctcaattccctcacctgaaataggaaatgagaatgtttcattgtagccccaagcggtcatgtcaacctagtgcctagtcataattaattgacttttcctgtattacttctttttttaagtataaaccaatgatcctttggtagtcaagaactcttaggaacattgccttttggacatgtaaaatatttaggatttgaccacacaatggctatgaaaatgcaagtagtttcctcgcgtgacctcaccatgattcacatacgtgccactgtttgaaatctggtctgtttgcatttctgttatgacagagagatgatgtttgcatttctgttatgacagagagatgatgaaagtaggcagggctgtgttcctttgtgtagcctgtatatattttccatatgtagagccctgattaacttcaaggacaaacactggctggagaaagccagactgatgggaatgagactttggccaaaaatcccaaaacatcattttcaatcagtagagaagtgcttagggttgaaaattgatttcatttgctactgaatttggtaaatcctgggtaacttttatcaagatgaagacattttaccctacctactctagaaatatacaacaatgttatattttacactccttggaaacatttgaggaaaaaaatgcaatttgcacttcactttgttggaatatcccatagcactcaataaactcagctgctagagtgccgatgtcaggagggctgtgtcgggtaatgcgtgtggctgaatgggcataaccactgtggcttcttgtgctgcagaagctcgttgacaagactgaggaggatttcaagagcaaccaagtaaagtcatgaattttctaattttgtgtatatggaatatatttttaaatagagatttttctactttagataatgtgttaatattgctattacctaggttaagcactattgtctgtgctagtaagaaaaagaaaggaaaaccatcattgctttatagtagcttatatcaatttagatttcatcattactattttgcatactggaatttataaatgtgtaaattatcattttcttagttttgtaataccttttttatttgtgaataaaattatcacctggtattcttatttatgtgttc

SEQ ID NO: 196323 - DNA, 2223 bp, Homo sapiens
  Payload ID: 18736
  Gene Name: tumor necrosis factor receptor superfamily, member 1A
  Uniprot ID: P19438
  ENST ID: ENST00000162749
  CDS Start-End: 301-1668
ctccagctcttcctgtcccgctgttgcaacactgcctcactcttcccctcccaccttctctcccctcctctctgctttaattttctcagaattctctggactgaggctccagttctggcctttggggttcaagatcactgggaccaggccgtgatctctatgcccgagtctcaaccctcaactgtcaccccaaggcacttgggacgtcctggacagaccgagtcccgggaagccccagcactgccgctgccacactgccctgagcccaaatgggggagtgagaggccatagctgtctggcatgggcctctccaccgtgcctgacctgctgctgccactggtgctcctggagctgttggtgggaatatacccctcaggggttattggactggtccctcacctaggggacagggagaagagagatagtgtgtgtccccaaggaaaatatatccaccctcaaaataattcgatttgctgtaccaagtgccacaaaggaacctacttgtacaatgactgtccaggcccggggcaggatacggactgcagggagtgtgagagcggctccttcaccgcttcagaaaaccacctcagacactgcctcagctgctccaaatgccgaaaggaaatgggtcaggtggagatctcttcttgcacagtggaccgggacaccgtgtgtggctgcaggaagaaccagtaccggcattattggagtgaaaaccttttccagtgcttcaattgcagcctctgcctcaatgggaccgtgcacctctcctgccaggagaaacagaacaccgtgtgcacctgccatgcaggtttctttctaagagaaaacgagtgtgtctcctgtagtaactgtaagaaaagcctggagtgcacgaagttgtgcctaccccagattgagaatgttaagggcactgaggactcaggcaccacagtgctgttgcccctggtcattttctttggtctttgccttttatccctcctcttcattggtttaatgtatcgctaccaacggtggaagtccaagctctactccattgtttgtgggaaatcgacacctgaaaaagagggggagcttgaaggaactactactaagcccctggccccaaacccaagcttcagtcccactccaggcttcacccccaccctgggcttcagtcccgtgcccagttccaccttcacctccagctccacctatacccccggtgactgtcccaactttgcggctccccgcagagaggtggcaccaccctatcagggggctgaccccatccttgcgacagccctcgcctccgaccccatccccaacccccttcagaagtgggaggacagcgcccacaagccacagagcctagacactgatgaccccgcgacgctgtacgccgtggtggagaacgtgcccccgttgcgctggaaggaattcgtgcggcgcctagggctgagcgaccacgagatcgatcggctggagctgcagaacgggcgctgcctgcgcgaggcgcaatacagcatgctggcgacctggaggcggcgcacgccgcggcgcgaggccacgctggagctgctgggacgcgtgctccgcgacatggacctgctgggctgcctggaggacatcgaggaggcgctttgcggccccgccgccctcccgcccgcgcccagtcttctcagatgaggctgcgcccctgcgggcagctctaaggaccgtcctgcgagatcgccttccaaccccacttttttctggaaaggaggggtcctgcaggggcaagcaggagctagcagccgcctacttggtgctaacccctcgatgtacatagcttttctcagctgcctgcgcgccgccgacagtcagcgctgtgcgcgcggagagaggtgcgccgtgggctcaagagcctgagtgggtggtttgcgaggatgagggacgctatgcctcatgcccgttttgggtgtcctcaccagcaaggctgctcgggggcccctggttcgtccctgagcctttttcacagtgcataagcagttttttttgtttttgttttgttttgttttgtttttaaatcaatcatgttacactaatagaaacttggcactcctgtgccctctgcctggacaagcacatagcaagctgaactgtcctaaggcaggggcgagcacggaacaatggggccttcagctggagctgtggacttttgtacatacactaaaattctgaagttaaagctctgctcttgga

SEQ ID NO: 196324 - DNA, 1339 bp, Homo sapiens
  Payload ID: 18736
  Gene Name: tumor necrosis factor receptor superfamily, member 1A
  Uniprot ID: P19438
  ENST ID: ENST00000366159
  CDS Start-End: 35-691
caaatgggggagtgagaggccatagctgtctggcatgggcctctccaccgtgcctgacctgctgctgccactggtgctcctggagctgttggtgggaatatacccctcaggggttattggactggtccctcacctaggggacagggagaagagagatagtgtgtgtccccaaggaaaatatatccaccctcaaaataattcgatttgctgtaccaagtgccacaaaggaacctacttgtacaatgactgtccaggcccggggcaggatacggactgcagggagtgtgagagcggctccttcaccgcttcagaaaaccacctcagacactgcctcagctgctccaaatgccgaaaggaaatgggtcaggtggagatctcttcttgcacagtggaccgggacaccgtgtgtggctgcaggaagaaccagtaccggcattattggagtgaaaaccttttccagtgcttcaattgcagcctctgcctcaatgggaccgtgcacctctcctgccaggagaaacagaacaccgtgtgcacctgccatgcaggtttctttctaagagaaaacgagtgtgtctcctgtagtaaagtcctgctctgtcgcccaggctggaatgcagtggcgcgatctcggctcactgcaacctctgcctcccagattcaagcaattctcctgcttcagcctcccaagtagctgggattacaggcacgtgccaccatgcctggctaatttttgtatttttagtagagatggggtttcaccatcttggtcaggctggtctcaaactcctggtgatccacctgcctctgcctcccaaagtgctgggattacagccgtgagccactgcacccagccggcttcatctcttcttgaaatcacttttataccattctatgtggttctcaccatgagcttgagtggtgggctaaagtgcctctccctgctttcagcttcctgctgggaactcactctctcaagttccttccagcaccaccccatagagttcccatcactccacactgtccagtgacaactcccaacatggaagatctgctagttctacagggtgctctctggctgccccagtaacatgtgtttttaaatttttcacatgcatgtttgaccccgactccccgaagtcaggtactgtaactagcagtgtcatttaagaaaaagccctttaacctctctttgccaaaggattcttatcagcaaaacagtgatgaaacaacaatcccataacagctagctggctaccttctcaagcacttattaaatgaggcataatgattttgcttaatcctcaatcctgagaggtgggcgatccctgtggtgatgagg

SEQ ID NO: 196325 - DNA, 1034 bp, Homo sapiens
  Payload ID: 18736
  Gene Name: tumor necrosis factor receptor superfamily, member 1A
  ENST ID: ENST00000440083
  CDS Start-End: 272-1034
cactgcctcactcttcccctcccaccttctctcccctcctctctgctttaattttctcagaattctctggactgaggctccagttctggcctttggggttcaagatcactgggaccaggccgtgatctctatgcccgagtctcaaccctcaactgtcaccccaaggcacttgggacgtcctggacagaccgagtcccgggaagccccagcactgccgctgccacactgccctgagcccaaatgggggagtgagaggccatagctgtctggcatgggcctctccaccgtgcctgacctgctgctgccactggtgctcctggagctgttggtgggaatatacccctcaggggttattggactggtccctcacctaggggacagggagaagagagatagtgtgtgtccccaaggaaaatatatccaccctcaaaataattcgatttgctgtaccaagtgccacaaaggaacctacttgtacaatgactgtccaggcccggggcaggatacggactgcagggagtgtgagagcggctccttcaccgcttcagaaaaccacctcagacactgcctcagctgctccaaatgccgaaaggaaatgggtcaggtggagatctcttcttgcacagtggaccgggacaccgtgtgtggctgcaggaagaaccagtaccggcattattggagtgaaaaccttttccagtgcttcaattgcagcctctgcctcaatgggaccgtgcacctctcctgtgagcgcagctctcctgaggccaagccctctccccaccccaggggttggccccttccccatgcggtggcacttcctttccttccccctcctgtattctgtgggtctgacaaccaactcctctctggccgcccccaccctgtccctcgtcacttcctctgtcctgtggggtgggggtgcaggcgcttctcctttagctgtgccgcacttctccctacaggccaggagaaacagaacaccgtgtgcacctgccatgcaggtttctttctaagagaaaacgagtgtgtctcct

SEQ ID NO: 196326 - DNA, 1527 bp, Homo sapiens
  Payload ID: 18736
  Gene Name: tumor necrosis factor receptor superfamily, member 1A
  ENST ID: ENST00000540022
  CDS Start-End: 214-1452
agaattctctggactgaggctccagttctggcctttggggttcaagatcactgggaccaggccgtgatctctatgcccgagtctcaaccctcaactgtcaccccaaggcacttgggacgtcctggacagaccgagtcccgggaagccccagcactgccgctgccacactgccctgagcccaaatgggggagtgagaggccatagctgtctggcatgggcctctccaccgtgcctgacctgctgctgccactggtgctcctggagctgttggtgggaatatacccctcaggggttattggactggtccctcacctaggggacagggagaagagagatagtgtgtgtccccaaggaaaatatatccaccctcaaaataattcgatttgctgtaccaagtgccacaaagaaatgggtcaggtggagatctcttcttgcacagtggaccgggacaccgtgtgtggctgcaggaagaaccagtaccggcattattggagtgaaaaccttttccagtgcttcaattgcagcctctgcctcaatgggaccgtgcacctctcctgccaggagaaacagaacaccgtgtgcacctgccatgcaggtttctttctaagagaaaacgagtgtgtctcctgtagtaactgtaagaaaagcctggagtgcacgaagttgtgcctaccccagattgagaatgttaagggcactgaggactcaggcaccacagtgctgttgcccctggtcattttctttggtctttgccttttatccctcctcttcattggtttaatgtatcgctaccaacggtggaagtccaagctctactccattgtttgtgggaaatcgacacctgaaaaagagggggagcttgaaggaactactactaagcccctggccccaaacccaagcttcagtcccactccaggcttcacccccaccctgggcttcagtcccgtgcccagttccaccttcacctccagctccacctatacccccggtgactgtcccaactttgcggctccccgcagagaggtggcaccaccctatcagggggctgaccccatccttgcgacagccctcgcctccgaccccatccccaacccccttcagaagtgggaggacagcgcccacaagccacagagcctagacactgatgaccccgcgacgctgtacgccgtggtggagaacgtgcccccgttgcgctggaaggaattcgtgcggcgcctagggctgagcgaccacgagatcgatcggctggagctgcagaacgggcgctgcctgcgcgaggcgcaatacagcatgctggcgacctggaggcggcgcacgccgcggcgcgaggccacgctggagctgctgggacgcgtgctccgcgacatggacctgctgggctgcctggaggacatcgaggaggcgctttgcggccccgccgccctcccgcccgcgcccagtcttctcagatgaggctgcgcccctgcgggcagctctaaggaccgtcctgcgagatcgccttccaaccccacttttttctggaaagga

SEQ ID NO: 196327 - DNA, 571 bp, Homo sapiens
  Payload ID: 18736
  Gene Name: tumor necrosis factor receptor superfamily, member 1A
  ENST ID: ENST00000543048
  CDS Start-End: 191-406
agttctggcctttggggttcaagatcactgggaccaggccgtgatctctatgcccgagtctcaaccctcaactgtcaccccaaggcacttgggacgtcctggacagaccgagtcccgggaagccccagcactgccgctgccacactgccctgagcccaaatgggggagtgagaggccatagctgtctggcatgggcctctccaccgtgcctgacctgctgctgccactggtgctcctggagctgttggtgggaatatacccctcaggggttattggactggtccctcacctaggggacagggagaagagagatagtgtgtgtccccaaggaaaatatatccaccctcaaaataattcgatttgctgtaccaagtgccacaaaggaacctacttgtacaatgactaaccagtaccggcattattggagtgaaaaccttttccagtgcttcaattgcagcctctgcctcaatgggaccgtgcacctctcctgccaggagaaacagaacaccgtgtgcacctgccatgcaggtttctttctaagagaaaacgagtgtgtctcctgtagtaagtg

SEQ ID NO: 196328 - DNA, 2069 bp, Homo sapiens
  Payload ID: 18736
  Gene Name: tumor necrosis factor receptor superfamily, member 1A
  ENST ID: ENST00000534885
  CDS Start-End: 301-669
ctccagctcttcctgtcccgctgttgcaacactgcctcactcttcccctcccaccttctctcccctcctctctgctttaattttctcagaattctctggactgaggctccagttctggcctttggggttcaagatcactgggaccaggccgtgatctctatgcccgagtctcaaccctcaactgtcaccccaaggcacttgggacgtcctggacagaccgagtcccgggaagccccagcactgccgctgccacactgccctgagcccaaatgggggagtgagaggccatagctgtctggcatgggcctctccaccgtgcctgacctgctgctgccactggaacctacttgtacaatgactgtccaggcccggggcaggatacggactgcagggagtgtgagagcggctccttcaccgcttcagaaaaccacctcagacactgcctcagctgctccaaatgccgaaaggaaatgggtcaggtggagatctcttcttgcacagtggaccgggacaccgtgtgtggctgcaggaagaaccagtaccggcattattggagtgaaaaccttttccagtgcttcaattgcagcctctgcctcaatgggaccgtgcacctctcctgccaggagaaacagaacaccgtgtgcacctgccatgcaggtttctttctaagagaaaacgagtgtgtctcctgtagtaactgtaagaaaagcctggagtgcacgaagttgtgcctaccccagattgagaatgttaagggcactgaggactcaggcaccacagtgctgttgcccctggtcattttctttggtctttgccttttatccctcctcttcattggtttaatgtatcgctaccaacggtggaagtccaagctctactccattgtttgtgggaaatcgacacctgaaaaagagggggagcttgaaggaactactactaagcccctggccccaaacccaagcttcagtcccactccaggcttcacccccaccctgggcttcagtcccgtgcccagttccaccttcacctccagctccacctatacccccggtgactgtcccaactttgcggctccccgcagagaggtggcaccaccctatcagggggctgaccccatccttgcgacagccctcgcctccgaccccatccccaacccccttcagaagtgggaggacagcgcccacaagccacagagcctagacactgatgaccccgcgacgctgtacgccgtggtggagaacgtgcccccgttgcgctggaaggaattcgtgcggcgcctagggctgagcgaccacgagatcgatcggctggagctgcagaacgggcgctgcctgcgcgaggcgcaatacagcatgctggcgacctggaggcggcgcacgccgcggcgcgaggccacgctggagctgctgggacgcgtgctccgcgacatggacctgctgggctgcctggaggacatcgaggaggcgctttgcggccccgccgccctcccgcccgcgcccagtcttctcagatgaggctgcgcccctgcgggcagctctaaggaccgtcctgcgagatcgccttccaaccccacttttttctggaaaggaggggtcctgcaggggcaagcaggagctagcagccgcctacttggtgctaacccctcgatgtacatagcttttctcagctgcctgcgcgccgccgacagtcagcgctgtgcgcgcggagagaggtgcgccgtgggctcaagagcctgagtgggtggtttgcgaggatgagggacgctatgcctcatgcccgttttgggtgtcctcaccagcaaggctgctcgggggcccctggttcgtccctgagcctttttcacagtgcataagcagttttttttgtttttgttttgttttgttttgtttttaaatcaatcatgttacactaatagaaacttggcactcctgtgccctctgcctggacaagcacatagcaagctgaactgtcctaaggcaggggcgagcacggaacaatggggccttcagctggagctgtggacttttgtacatacactaaaattctgaagttaaagctctgctcttgga

SEQ ID NO: 196329 - DNA, 1063 bp, Homo sapiens
  Payload ID: 18736
  Gene Name: tumor necrosis factor receptor superfamily, member 1A
  ENST ID: ENST00000539372
  CDS Start-End: 169-1063
gatcactgggaccaggccgtgatctctatgcccgagtctcaaccctcaactgtcaccccaaggcacttgggacgtcctggacagaccgagtcccgggaagccccagcactgccgctgccacactgccctgagcccaaatgggggagtgagaggccatagctgtctggcatgggcctctccaccgtgcctgacctgctgctgccactggtgctcctggagctgttggtgggaatatacccctcaggggttattggactggtccctcacctaggggacagggagaagagagatagtgtgtgtccccaaggaaaatatatccaccctcaaaataattcgatttgctgtaccaagtgccacaaaggaacctacttgtacaatgactgtccaggcccggggcaggatacggactgcagggagtgtgagagcggctccttcaccgcttcagaaaaccacctcagacactgcctcagctgctccaaatgccgaaaggaaatgggtcaggtggagatctcttcttgcacagtggaccgggacaccgtgtgtggctgcaggaagaaccagtaccggcattattggagtgaaaaccttttccagtgcttcaattgcagcctctgcctcaatgggaccgtgcacctctcctgccaggagaaacagaacaccgtgtgcacctgccatgcaggtttctttctaagagaaaacgagtgtgtctcctgtagtaactgtaagaaaagcctggagtgcacgaagttgtgcctaccccagattgagaatgttaagggcactgaggactcaggcaccacagtgctgttgcccctggtcattttctttggtctttgccttttatccctcctcttcattggtttaatgtatcgctaccaacggtggaagtccaagctctactccattggtgagtgggggctttgggagggagagggagctggtgggggtgagggaggacatgggtgggtgcgatggacatgtgtggagggaggtgaggagtgtcccctcagttcataccgctggggactctgggcagaaggtggccctggatggctggggagat

SEQ ID NO: 196330 - DNA, 1531 bp, Homo sapiens
  Payload ID: 18736
  Gene Name: tumor necrosis factor receptor superfamily, member 1A
  ENST ID: ENST00000543995
  CDS Start-End: 191-409
agttctggcctttggggttcaagatcactgggaccaggccgtgatctctatgcccgagtctcaaccctcaactgtcaccccaaggcacttgggacgtcctggacagaccgagtcccgggaagccccagcactgccgctgccacactgccctgagcccaaatgggggagtgagaggccatagctgtctggcatgggcctctccaccgtgcctgacctgctgctgccactggtgctcctggagctgttggtgggaatatacccctcaggggttattggactggtccctcacctaggggacagggagaagagagatagtgtgtgtccccaaggaaaatatatccaccctcaaaataattcgatttgctgtaccaagtgccacaaagaaccagtaccggcattattggagtgaaaaccttttccagtgcttcaattgcagcctctgcctcaatgggaccgtgcacctctcctgccaggagaaacagaacaccgtgtgcacctgccatgcaggtttctttctaagagaaaacgagtgtgtctcctgtagtaactgtaagaaaagcctggagtgcacgaagttgtgcctaccccagattgagaatgttaagggcactgaggactcaggcaccacagtgctgttgcccctggtcattttctttggtctttgccttttatccctcctcttcattggtttaatgtatcgctaccaacggtggaagtccaagctctactccattgtttgtgggaaatcgacacctgaaaaagagggggagcttgaaggaactactactaagcccctggccccaaacccaagcttcagtcccactccaggcttcacccccaccctgggcttcagtcccgtgcccagttccaccttcacctccagctccacctatacccccggtgactgtcccaactttgcggctccccgcagagaggtggcaccaccctatcagggggctgaccccatccttgcgacagccctcgcctccgaccccatccccaacccccttcagaagtgggaggacagcgcccacaagccacagagcctagacactgatgaccccgcgacgctgtacgccgtggtggagaacgtgcccccgttgcgctggaaggaattcgtgcggcgcctagggctgagcgaccacgagatcgatcggctggagctgcagaacgggcgctgcctgcgcgaggcgcaatacagcatgctggcgacctggaggcggcgcacgccgcggcgcgaggccacgctggagctgctgggacgcgtgctccgcgacatggacctgctgggctgcctggaggacatcgaggaggcgctttgcggccccgccgccctcccgcccgcgcccagtcttctcagatgaggctgcgcccctgcgggcagctctaaggaccgtcctgcgagatcgccttccaaccccacttttttctggaaaggaggggtcctgcaggggcaagcaggagctagcagccgcctacttggtgctaacccctcgatgtacatagcttttctcagctgcctgcgcgccgc

SEQ ID NO: 196331 - DNA, 581 bp, Homo sapiens
  Payload ID: 18736
  Gene Name: tumor necrosis factor receptor superfamily, member 1A
  ENST ID: ENST00000536194
  CDS Start-End: 228-581
gctttaattttctcagaattctctggactgaggctccagttctggcctttggggttcaagatcactgggaccaggccgtgatctctatgcccgagtctcaaccctcaactgtcaccccaaggcacttgggacgtcctggacagaccgagtcccgggaagccccagcactgccgctgccacactgccctgagcccaaatgggggagtgagaggccatagctgtctggcatgggcctctccaccgtgcctgacctgctgctgccactggtgctcctggagctgttggtgggaatatacccctcaggggttattggactggtccctcacctaggggacagggagaagagagatagtgtgtgtccccaaggaaaatatatccaccctcaaaataattcgatttgctgtaccaagtgccacaaaggcccggggcaggatacggactgcagggagtgtgagagcggctccttcaccgcttcagaaaaccacctcagacactgcctcagctgctccaaatgccgaaaggaaatgggtcaggtggagatctcttcttgcacagtggaccgggacaccgtgtgtggctgc

SEQ ID NO: 196332 - DNA, 3683 bp, Homo sapiens
  Payload ID: 18737
  Gene Name: tumor necrosis factor receptor superfamily, member 1B
  Uniprot ID: P20333
  ENST ID: ENST00000376259
  CDS Start-End: 90-1475
gcgagcgcagcggagcctggagagaaggcgctgggctgcgagggcgcgagggcgcgagggcagggggcaaccggaccccgcccgcacccatggcgcccgtcgccgtctgggccgcgctggccgtcggactggagctctgggctgcggcgcacgccttgcccgcccaggtggcatttacaccctacgccccggagcccgggagcacatgccggctcagagaatactatgaccagacagctcagatgtgctgcagcaaatgctcgccgggccaacatgcaaaagtcttctgtaccaagacctcggacaccgtgtgtgactcctgtgaggacagcacatacacccagctctggaactgggttcccgagtgcttgagctgtggctcccgctgtagctctgaccaggtggaaactcaagcctgcactcgggaacagaaccgcatctgcacctgcaggcccggctggtactgcgcgctgagcaagcaggaggggtgccggctgtgcgcgccgctgcgcaagtgccgcccgggcttcggcgtggccagaccaggaactgaaacatcagacgtggtgtgcaagccctgtgccccggggacgttctccaacacgacttcatccacggatatttgcaggccccaccagatctgtaacgtggtggccatccctgggaatgcaagcatggatgcagtctgcacgtccacgtcccccacccggagtatggccccaggggcagtacacttaccccagccagtgtccacacgatcccaacacacgcagccaactccagaacccagcactgctccaagcacctccttcctgctcccaatgggccccagccccccagctgaagggagcactggcgacttcgctcttccagttggactgattgtgggtgtgacagccttgggtctactaataataggagtggtgaactgtgtcatcatgacccaggtgaaaaagaagcccttgtgcctgcagagagaagccaaggtgcctcacttgcctgccgataaggcccggggtacacagggccccgagcagcagcacctgctgatcacagcgccgagctccagcagcagctccctggagagctcggccagtgcgttggacagaagggcgcccactcggaaccagccacaggcaccaggcgtggaggccagtggggccggggaggcccgggccagcaccgggagctcagattcttcccctggtggccatgggacccaggtcaatgtcacctgcatcgtgaacgtctgtagcagctctgaccacagctcacagtgctcctcccaagccagctccacaatgggagacacagattccagcccctcggagtccccgaaggacgagcaggtccccttctccaaggaggaatgtgcctttcggtcacagctggagacgccagagaccctgctggggagcaccgaagagaagcccctgccccttggagtgcctgatgctgggatgaagcccagttaaccaggccggtgtgggctgtgtcgtagccaaggtgggctgagccctggcaggatgaccctgcgaaggggccctggtccttccaggcccccaccactaggactctgaggctctttctgggccaagttcctctagtgccctccacagccgcagcctccctctgacctgcaggccaagagcagaggcagcgagttgtggaaagcctctgctgccatggcgtgtccctctcggaaggctggctgggcatggacgttcggggcatgctggggcaagtccctgactctctgtgacctgccccgcccagctgcacctgccagcctggcttctggagcccttgggttttttgtttgtttgtttgtttgtttgtttgtttctccccctgggctctgccccagctctggcttccagaaaaccccagcatccttttctgcagaggggctttctggagaggagggatgctgcctgagtcacccatgaagacaggacagtgcttcagcctgaggctgagactgcgggatggtcctggggctctgtgcagggaggaggtggcagccctgtagggaacggggtccttcaagttagctcaggaggcttggaaagcatcacctcaggccaggtgcagtggctcacgcctatgatcccagcactttgggaggctgaggcgggtggatcacctgaggttaggagttcgagaccagcctggccaacatggtaaaaccccatctctactaaaaatacagaaattagccgggcgtggtggcgggcacctatagtcccagctactcagaagcctgaggctgggaaatcgtttgaacccgggaagcggaggttgcagggagccgagatcacgccactgcactccagcctgggcgacagagcgagagtctgtctcaaaagaaaaaaaaaagcaccgcctccaaatgccaacttgtccttttgtaccatggtgtgaaagtcagatgcccagagggcccaggcaggccaccatattcagtgctgtggcctgggcaagataacgcacttctaactagaaatctgccaattttttaaaaaagtaagtaccactcaggccaacaagccaacgacaaagccaaactctgccagccacatccaaccccccacctgccatttgcaccctccgccttcactccggtgtgcctgcagccccgcgcctccttccttgctgtcctaggccacaccatctcctttcagggaatttcaggaactagagatgactgagtcctcgtagccatctctctactcctacctcagcctagaccctcctcctcccccagaggggtgggttcctcttccccactccccaccttcaattcctgggccccaaacgggctgccctgccactttggtacatggccagtgtgatcccaagtgccagtcttgtgtctgcgtctgtgttgcgtgtcgtgggtgtgtgtagccaaggtcggtaagttgaatggcctgccttgaagccactgaagctgggattcctccccattagagtcagccttccccctcccagggccagggccctgcagaggggaaaccagtgtagccttgcccggattctgggaggaagcaggttgaggggctcctggaaaggctcagtctcaggagcatggggataaaggagaaggcatgaaattgtctagcagagcaggggcagggtgataaattgttgataaattccactggacttgagcttggcagctgaactattggagggtgggagagcccagccattaccatggagacaagaagggttttccaccctggaatcaagatgtcagactggctggctgcagtgacgtgcacctgtactcaggaggctgaggggaggatcactggagcccaggagtttgaggctgcagcgagctatgatcgcgccactacactccagcctgagcaacagagtgagaccctgtctcttaaagaaaaaaaaagtcagactgctgggactggccaggtttctgcccacattggacccacatgaggacatgatggagcgcacctgccccctggtggacagtcctgggagaacctcaggcttccttggcatcacagggcagagccgggaagcgatgaatttggagactctgtggggccttggttcccttgtgtgtgtgtgttgatcccaagacaatgaaagtttgcactgtatgctggacggcattcctgcttatcaataaacctgtttgttttacacgtcga

SEQ ID NO: 196333 - DNA, 557 bp, Homo sapiens
  Payload ID: 18737
  Gene Name: tumor necrosis factor receptor superfamily, member 1B
  ENST ID: ENST00000536782
  CDS Start-End: 90-557
gcgagcgcagcggagcctggagagaaggcgctgggctgcgagggcgcgagggcgcgagggcagggggcaaccggaccccgcccgcacccatggcgcccgtcgccgtctgggccgcgctggccgtcggactggagctctgggctgcggcgcacgccttgcccgcccaggtggcatttacaccctacgccccggagcccgggagcacatgccggctcagagaatactatgaccagacagctcagatgtgctgcagcaaatgctcgccgggccaacatgcaaaagtcttctgtaccaagacctcggacaccgtgtgtgactcctgtgaggacagcacatacacccagctctggaactgggttcccgagtgcttgagctgtggctcccgctgtagctctgaccaggtggaaactcaagcctgcactcgggaacagaaccgcatctgcacctgcaggcccggctggtactgcgcgctgagcaagcaggaggggtgccggctgtgcgcgccgctgcgcaagtgccgcccgggcttcggcgtggccagaccagacctctcctag

SEQ ID NO: 196334 - DNA, 3595 bp, Homo sapiens
  Payload ID: 18738
  Gene Name: tumor necrosis factor receptor superfamily, member 21
  Uniprot ID: O75509
  ENST ID: ENST00000296861
  CDS Start-End: 395-2362
agtccctcgccgaccagtctgggcagcggaggagggtggttggcagtggctggaagcttcgctatgggaagtcgttcctttgctctctcgcgcccagtcctcctccctggttctcctcagccgctgtcggaggagagcacccggagacgcgggctgcagtcgcggcggcttctccccgcctgggcggccgcgccgctgggcaggtgctgagcgcccctagagcctcccttgccgcctccctcctctgcccggccgcagcagtgcacatggggtgttggaggtagatgggctcccggcccgggaggcggcggtggatgcggcgctgggcagaagcagccgccgattccagctgccccgcgcgccccgggcgcccctgcgagtccccggttcagccatggggacctctccgagcagcagcaccgccctcgcctcctgcagccgcatcgcccgccgagccacagccacgatgatcgcgggctcccttctcctgcttggattccttagcaccaccacagctcagccagaacagaaggcctcgaatctcattggcacataccgccatgttgaccgtgccaccggccaggtgctaacctgtgacaagtgtccagcaggaacctatgtctctgagcattgtaccaacacaagcctgcgcgtctgcagcagttgccctgtggggacctttaccaggcatgagaatggcatagagaaatgccatgactgtagtcagccatgcccatggccaatgattgagaaattaccttgtgctgccttgactgaccgagaatgcacttgcccacctggcatgttccagtctaacgctacctgtgccccccatacggtgtgtcctgtgggttggggtgtgcggaagaaagggacagagactgaggatgtgcggtgtaagcagtgtgctcggggtaccttctcagatgtgccttctagtgtgatgaaatgcaaagcatacacagactgtctgagtcagaacctggtggtgatcaagccggggaccaaggagacagacaacgtctgtggcacactcccgtccttctccagctccacctcaccttcccctggcacagccatctttccacgccctgagcacatggaaacccatgaagtcccttcctccacttatgttcccaaaggcatgaactcaacagaatccaactcttctgcctctgttagaccaaaggtactgagtagcatccaggaagggacagtccctgacaacacaagctcagcaagggggaaggaagacgtgaacaagaccctcccaaaccttcaggtagtcaaccaccagcaaggcccccaccacagacacatcctgaagctgctgccgtccatggaggccactgggggcgagaagtccagcacgcccatcaagggccccaagaggggacatcctagacagaacctacacaagcattttgacatcaatgagcatttgccctggatgattgtgcttttcctgctgctggtgcttgtggtgattgtggtgtgcagtatccggaaaagctcgaggactctgaaaaaggggccccggcaggatcccagtgccattgtggaaaaggcagggctgaagaaatccatgactccaacccagaaccgggagaaatggatctactactgcaatggccatggtatcgatatcctgaagcttgtagcagcccaagtgggaagccagtggaaagatatctatcagtttctttgcaatgccagtgagagggaggttgctgctttctccaatgggtacacagccgaccacgagcgggcctacgcagctctgcagcactggaccatccggggccccgaggccagcctcgcccagctaattagcgccctgcgccagcaccggagaaacgatgttgtggagaagattcgtgggctgatggaagacaccacccagctggaaactgacaaactagctctcccgatgagccccagcccgcttagcccgagccccatccccagccccaacgcgaaacttgagaattccgctctcctgacggtggagccttccccacaggacaagaacaagggcttcttcgtggatgagtcggagccccttctccgctgtgactctacatccagcggctcctccgcgctgagcaggaacggttcctttattaccaaagaaaagaaggacacagtgttgcggcaggtacgcctggacccctgtgacttgcagcctatctttgatgacatgctccactttctaaatcctgaggagctgcgggtgattgaagagattccccaggctgaggacaaactagaccggctattcgaaattattggagtcaagagccaggaagccagccagaccctcctggactctgtttatagccatcttcctgacctgctgtagaacatagggatactgcattctggaaattactcaatttagtggcagggtggttttttaattttcttctgtttctgatttttgttgtttggggtgtgtgtgtgtgtttgtgtgtgtgtgtgtgtgtgtgtgtgtgtgtgtgtttaacagagaatatggccagtgcttgagttctttctccttctctctctctcttttttttttaaataactcttctgggaagttggtttataagcctttgccaggtgtaactgttgtgaaatacccaccactaaagttttttaagttccatattttctccattttgccttcttatgtattttcaagattattctgtgcactttaaatttacttaacttaccataaatgcagtgtgacttttcccacacactggattgtgaggctcttaacttcttaaaagtataatggcatcttgtgaatcctataagcagtctttatgtctcttaacattcacacctactttttaaaaacaaatattattactatttttattattgtttgtcctttataaattttcttaaagattaagaaaatttaagaccccattgagttactgtaatgcaattcaactttgagttatcttttaaatatgtcttgtatagttcatattcatggctgaaacttgaccacactattgctgattgtatggttttcacctggacaccgtgtagaatgcttgattacttgtactcttcttatgctaatatgctctgggctggagaaatgaaatcctcaagccatcaggatttgctatttaagtggcttgacaactgggccaccaaagaacttgaacttcaccttttaggatttgagctgttctggaacacattgctgcactttggaaagtcaaaatcaagtgccagtggcgccctttccatagagaatttgcccagctttgctttaaaagatgtcttgttttttatatacacataatcaataggtccaatctgctctcaaggccttggtcctggtgggattccttcaccaattactttaattaaaaatggctgcaactgtaagaacccttgtctgatatatttgcaactatgctcccatttacaaatgtaccttctaatgctcagttgccaggttccaatgcaaaggtggcgtggactccctttgtgtgggtggggtttgtgggtagtggtgaaggaccgatatcagaaaaatgccttcaagtgtactaatttattaataaacattaggtgtttgtta

SEQ ID NO: 196335 - DNA, 1119 bp, Homo sapiens
  Payload ID: 18739
  Gene Name: tumor necrosis factor receptor superfamily, member 25
  Uniprot ID: Q93038
  ENST ID: ENST00000348333
  CDS Start-End: 1-1119
atggagcagcggccgcggggctgcgcggcggtggcggcggcgctcctcctggtgctgctgggggcccgggcccagggcggcactcgtagccccaggtgtgactgtgccggtgacttccacaagaagattggtctgttttgttgcagaggctgcccagcggcctcccaggtggcgctggagaactgttcagcagtggccgacacccgctgtggctgtaagccaggctggtttgtggagtgccaggtcagccaatgtgtcagcagttcacccttctactgccaaccatgcctagactgcggggccctgcaccgccacacacggctactctgttcccgcagagatactgactgtgggacctgcctgcctggcttctatgaacatggcgatggctgcgtgtcctgccccacgagcaccctggggagctgtccagagcgctgtgccgctgtctgtggctggaggcagatgttctgggtccaggtgctcctggctggccttgtggtccccctcctgcttggggccaccctgacctacacataccgccactgctggcctcacaagcccctggttactgcagatgaagctgggatggaggctctgaccccaccaccggccacccatctgtcacccttggacagcgcccacacccttctagcacctcctgacagcagtgagaagatctgcaccgtccagttggtgggtaacagctggacccctggctaccccgagacccaggaggcgctctgcccgcaggtgacatggtcctgggaccagttgcccagcagagctcttggccccgctgctgcgcccacactctcgccagagtccccagccggctcgccagccatgatgctgcagccgggcccgcagctctacgacgtgatggacgcggtcccagcgcggcgctggaaggagttcgtgcgcacgctggggctgcgcgaggcagagatcgaagccgtggaggtggagatcggccgcttccgagaccagcagtacgagatgctcaagcgctggcgccagcagcagcccgcgggcctcggagccgtttacgcggccctggagcgcatggggctggacggctgcgtggaagacttgcgcagccgcctgcagcgcggcccgtga

SEQ ID NO: 196336 - DNA, 705 bp, Homo sapiens
  Payload ID: 18739
  Gene Name: tumor necrosis factor receptor superfamily, member 25
  Uniprot ID: Q93038
  ENST ID: ENST00000351748
  CDS Start-End: 1-705
atggagcagcggccgcggggctgcgcggcggtggcggcggcgctcctcctggtgctgctgggggcccgggcccagggcggcactcgtagccccaggtgtgactgtgccggtgacttccacaagaagattggtctgttttgttgcagaggctgcccagcggatgaagctgggatggaggctctgaccccaccaccggccacccatctgtcacccttggacagcgcccacacccttctagcacctcctgacagcagtgagaagatctgcaccgtccagttggtgggtaacagctggacccctggctaccccgagacccaggaggcgctctgcccgcaggtgacatggtcctgggaccagttgcccagcagagctcttggccccgctgctgcgcccacactctcgccagagtccccagccggctcgccagccatgatgctgcagccgggcccgcagctctacgacgtgatggacgcggtcccagcgcggcgctggaaggagttcgtgcgcacgctggggctgcgcgaggcagagatcgaagccgtggaggtggagatcggccgcttccgagaccagcagtacgagatgctcaagcgctggcgccagcagcagcccgcgggcctcggagccgtttacgcggccctggagcgcatggggctggacggctgcgtggaagacttgcgcagccgcctgcagcgcggcccgtga

SEQ ID NO: 196337 - DNA, 1441 bp, Homo sapiens
  Payload ID: 18739
  Gene Name: tumor necrosis factor receptor superfamily, member 25
  Uniprot ID: Q93038
  ENST ID: ENST00000351959
  CDS Start-End: 69-1211
ctgaaggcggaaccacgacgggcagagagcacggagccgggaagcccctgggcgcccgtcggagggctatggagcagcggccgcggggctgcgcggcggtggcggcggcgctcctcctggtgctgctgggggcccgggcccagggcggcactcgtagccccaggtgtgactgtgccggtgacttccacaagaagattggtctgttttgttgcagaggctgcccagcggggcactacctgaaggccccttgcacggagccctgcggcaactccacctgccttgtgtgtccccaagacaccttcttggcctgggagaaccaccataattctgaatgtgcccgctgccaggcctgtgatgagcaggcctcccaggtggcgctggagaactgttcagcagtggccgacacccgctgtggctgtaagccaggctggtttgtggagtgccaggtcagccaatgtgtcagcagttcacccttctactgccaaccatgcctagactgcggggccctgcaccgccacacacggctactctgttcccgcagagatactgactgtgggacctgcctgcctggcttctatgaacatggcgatggctgcgtgtcctgccccacgagcaccctggggagctgtccagagcgctgtgccgctgtctgtggctggaggcagaatgaagctgggatggaggctctgaccccaccaccggccacccatctgtcacccttggacagcgcccacacccttctagcacctcctgacagcagtgagaagatctgcaccgtccagttggtgggtaacagctggacccctggctaccccgagacccaggaggcgctctgcccgcaggtgacatggtcctgggaccagttgcccagcagagctcttggccccgctgctgcgcccacactctcgccagagtccccagccggctcgccagccatgatgctgcagccgggcccgcagctctacgacgtgatggacgcggtcccagcgcggcgctggaaggagttcgtgcgcacgctggggctgcgcgaggcagagatcgaagccgtggaggtggagatcggccgcttccgagaccagcagtacgagatgctcaagcgctggcgccagcagcagcccgcgggcctcggagccgtttacgcggccctggagcgcatggggctggacggctgcgtggaagacttgcgcagccgcctgcagcgcggcccgtgacacggcgcccacttgccacctaggcgctctggtggcccttgcagaagccctaagtacggttacttatgcgtgtagacattttatgtcacttattaagccgctggcacggccctgcgtagcagcaccagccggccccacccctgctcgcccctatcgctccagccaaggcgaagaagcacgaacgaatgtcgagagggggtgaagacatttctcaacttctcggccggagt

SEQ ID NO: 196338 - DNA, 1625 bp, Homo sapiens
  Payload ID: 18739
  Gene Name: tumor necrosis factor receptor superfamily, member 25
  Uniprot ID: Q93038
  ENST ID: ENST00000356876
  CDS Start-End: 89-1342
cgggccctgcgggcgcggggctgaaggcggaaccacgacgggcagagagcacggagccgggaagcccctgggcgcccgtcggagggctatggagcagcggccgcggggctgcgcggcggtggcggcggcgctcctcctggtgctgctgggggcccgggcccagggcggcactcgtagccccaggtgtgactgtgccggtgacttccacaagaagattggtctgttttgttgcagaggctgcccagcggggcactacctgaaggccccttgcacggagccctgcggcaactccacctgccttgtgtgtccccaagacaccttcttggcctgggagaaccaccataattctgaatgtgcccgctgccaggcctgtgatgagcaggcctcccaggtggcgctggagaactgttcagcagtggccgacacccgctgtggctgtaagccaggctggtttgtggagtgccaggtcagccaatgtgtcagcagttcacccttctactgccaaccatgcctagactgcggggccctgcaccgccacacacggctactctgttcccgcagagatactgactgtgggacctgcctgcctggcttctatgaacatggcgatggctgcgtgtcctgccccacgagcaccctggggagctgtccagagcgctgtgccgctgtctgtggctggaggcagatgttctgggtccaggtgctcctggctggccttgtggtccccctcctgcttggggccaccctgacctacacataccgccactgctggcctcacaagcccctggttactgcagatgaagctgggatggaggctctgaccccaccaccggccacccatctgtcacccttggacagcgcccacacccttctagcacctcctgacagcagtgagaagatctgcaccgtccagttggtgggtaacagctggacccctggctaccccgagacccaggaggcgctctgcccgcaggtgacatggtcctgggaccagttgcccagcagagctcttggccccgctgctgcgcccacactctcgccagagtccccagccggctcgccagccatgatgctgcagccgggcccgcagctctacgacgtgatggacgcggtcccagcgcggcgctggaaggagttcgtgcgcacgctggggctgcgcgaggcagagatcgaagccgtggaggtggagatcggccgcttccgagaccagcagtacgagatgctcaagcgctggcgccagcagcagcccgcgggcctcggagccgtttacgcggccctggagcgcatggggctggacggctgcgtggaagacttgcgcagccgcctgcagcgcggcccgtgacacggcgcccacttgccacctaggcgctctggtggcccttgcagaagccctaagtacggttacttatgcgtgtagacattttatgtcacttattaagccgctggcacggccctgcgtagcagcaccagccggccccacccctgctcgcccctatcgctccagccaaggcgaagaagcacgaacgaatgtcgagagggggtgaagacatttctcaacttctcggccggagtttggctgagatcgcggtattaaatctgtgaaagaaaacaaaacaaaacaaaaa

SEQ ID NO: 196339 - DNA, 1632 bp, Homo sapiens
  Payload ID: 18739
  Gene Name: tumor necrosis factor receptor superfamily, member 25
  Uniprot ID: Q93038
  ENST ID: ENST00000377782
  CDS Start-End: 69-1349
ctgaaggcggaaccacgacgggcagagagcacggagccgggaagcccctgggcgcccgtcggagggctatggagcagcggccgcggggctgcgcggcggtggcggcggcgctcctcctggtgctgctgggggcccgggcccagggcggcactcgtagccccaggtgtgactgtgccggtgacttccacaagaagattggtctgttttgttgcagaggctgcccagcggggcactacctgaaggccccttgcacggagccctgcggcaactccacctgccttgtgtgtccccaagacaccttcttggcctgggagaaccaccataattctgaatgtgcccgctgccaggcctgtgatgagcaggcctcccaggtggcgctggagaactgttcagcagtggccgacacccgctgtggctgtaagccaggctggtttgtggagtgccaggtcagccaatgtgtcagcagttcacccttctactgccaaccatgcctagactgcggggccctgcaccgccacacacggctactctgttcccgcagagatactgactgtgggacctgcctgcctggcttctatgaacatggcgatggctgcgtgtcctgccccacgccacccccgtcccttgcaggagcaccctggggagctgtccagagcgctgtgccgctgtctgtggctggaggcagagtaggtgtgttctgggtccaggtgctcctggctggccttgtggtccccctcctgcttggggccaccctgacctacacataccgccactgctggcctcacaagcccctggttactgcagatgaagctgggatggaggctctgaccccaccaccggccacccatctgtcacccttggacagcgcccacacccttctagcacctcctgacagcagtgagaagatctgcaccgtccagttggtgggtaacagctggacccctggctaccccgagacccaggaggcgctctgcccgcaggtgacatggtcctgggaccagttgcccagcagagctcttggccccgctgctgcgcccacactctcgccagagtccccagccggctcgccagccatgatgctgcagccgggcccgcagctctacgacgtgatggacgcggtcccagcgcggcgctggaaggagttcgtgcgcacgctggggctgcgcgaggcagagatcgaagccgtggaggtggagatcggccgcttccgagaccagcagtacgagatgctcaagcgctggcgccagcagcagcccgcgggcctcggagccgtttacgcggccctggagcgcatggggctggacggctgcgtggaagacttgcgcagccgcctgcagcgcggcccgtgacacggcgcccacttgccacctaggcgctctggtggcccttgcagaagccctaagtacggttacttatgcgtgtagacattttatgtcacttattaagccgctggcacggccctgcgtagcagcaccagccggccccacccctgctcgcccctatcgctccagccaaggcgaagaagcacgaacgaatgtcgagagggggtgaagacatttctcaacttctcggccggagtttggctgagatcgcggtattaaatctgtgaaagaaaacaaaacaaaacaaaaa

SEQ ID NO: 196340 - DNA, 1198 bp, Homo sapiens
  Payload ID: 18739
  Gene Name: tumor necrosis factor receptor superfamily, member 25
  Uniprot ID: Q93038
  ENST ID: ENST00000414040
  CDS Start-End: 1-657
atggagcagcggccgcggggctgcgcggcggtggcggcggcgctcctcctggtgctgctgggggcccgggcccagggcggcactcgtagccccaggtgtgactgtgccggtgacttccacaagaagattggtctgttttgttgcagaggctgcccagcggggcactacctgaaggccccttgcacggagccctgcggcaactccacctgccttgtgtgtccccaagacaccttcttggcctgggagaaccaccataattctgaatgtgcccgctgccaggcctgtgatgagcaggcctcccaggtggcgctggagaactgttcagcagtggccgacacccgctgtggctgtaagccaggctggtttgtggagtgccaggtcagccaatgtgtcagcagttcacccttctactgccaaccatgcctagactgcggggccctgcaccgccacacacggctactctgttcccgcagagatactgactgtgggacctgcctgcctggcttctatgaacatggcgatggctgcgtgtcctgccccactgttctgggtccaggtgctcctggctggccttgtggtccccctcctgcttggggccaccctgacctacacataccgccactgctggcctcacaagcccctggttactgcagatgaagctgggatggaggctctgaccccaccaccggccacccatctgtcacccttggacagcgcccacacccttctagcacctcctgacagcagtgagaagatctgcaccgtccagttggtgggtaacagctggacccctggctaccccgagacccaggaggcgctctgcccgcaggtgacatggtcctgggaccagttgcccagcagagctcttggccccgctgctgcgcccacactctcgccagagtccccagccggctcgccagccatgatgctgcagccgggcccgcagctctacgacgtgatggacgcggtcccagcgcggcgctggaaggagttcgtgcgcacgctggggctgcgcgaggcagagatcgaagccgtggaggtggagatcggccgcttccgagaccagcagtacgagatgctcaagcgctggcgccagcagcagcccgcgggcctcggagccgtttacgcggccctggagcgcatggggctggacggctgcgtggaagacttgcgcagccgcctgcagcgcggcccgtga

SEQ ID NO: 196341 - DNA, 838 bp, Homo sapiens
  Payload ID: 18739
  Gene Name: tumor necrosis factor receptor superfamily, member 25
  Uniprot ID: Q93038
  ENST ID: ENST00000502730
  CDS Start-End: 1-381
atggagcagcggccgcggggctgcgcggcggtggcggcggcgctcctcctggtgctgctgggggcccgggcccagggcggcactcgtagccccaggtgtgactgtgccggtgacttccacaagaagattggtctgttttgttgcagaggctgcccagcggcctcccaggtggcgctggagaactgttcagcagtggccgacacccgctgtggctgtaagccaggctggtttgtggagtgccaggtcagccaatgtgtcagcagttcacccttctactgccaaccatgcctagactgcggggccctgcaccgccacacacggctactctgccacccatctgtcacccttggacagcgcccacacccttctagcacctcctgacagcagtgagaagatctgcaccgtccagttggtgggtaacagctggacccctggctaccccgagacccaggaggcgctctgcccgcaggtgacatggtcctgggaccagttgcccagcagagctcttggccccgctgctgcgcccacactctcgccagagtccccagccggctcgccagccatgatgctgcagccgggcccgcagctctacgacgtgatggacgcggtcccagcgcggcgctggaaggagttcgtgcgcacgctggggctgcgcgaggcagagatcgaagccgtggaggtggagatcggccgcttccgagaccagcagtacgagatgctcaagcgctggcgccagcagcagcccgcgggcctcggagccgtttacgcggccctggagcgcatggggctggacggctgcgtggaagacttgcgcagccgcctgcagcgcggcccgtga

SEQ ID NO: 196342 - DNA, 952 bp, Homo sapiens
  Payload ID: 18739
  Gene Name: tumor necrosis factor receptor superfamily, member 25
  Uniprot ID: Q93038
  ENST ID: ENST00000502588
  CDS Start-End: 1-411
atggagcagcggccgcggggctgcgcggcggtggcggcggcgctcctcctggtgctgctgggggcccgggcccagggcggcactcgtagccccaggtgtgactgtgccggtgacttccacaagaagattggtctgttttgttgcagaggctgcccagcggcctcccaggtggcgctggagaactgttcagcagtggccgacacccgctgtggctgtaagccaggctggtttgtggagtgccaggtcagccaatgtgtcagcagttcacccttctactgccaaccatgcctagactgcggggccctgcaccgccacacacggctactctgttcccgcagagatactgactgtgggacctgcctgcctggcttctatgaacatggcgatggctgcgtgtcctgccccacatgaagctgggatggaggctctgaccccaccaccggccacccatctgtcacccttggacagcgcccacacccttctagcacctcctgacagcagtgagaagatctgcaccgtccagttggtgggtaacagctggacccctggctaccccgagacccaggaggcgctctgcccgcaggtgacatggtcctgggaccagttgcccagcagagctcttggccccgctgctgcgcccacactctcgccagagtccccagccggctcgccagccatgatgctgcagccgggcccgcagctctacgacgtgatggacgcggtcccagcgcggcgctggaaggagttcgtgcgcacgctggggctgcgcgaggcagagatcgaagccgtggaggtggagatcggccgcttccgagaccagcagtacgagatgctcaagcgctggcgccagcagcagcccgcgggcctcggagccgtttacgcggccctggagcgcatggggctggacggctgcgtggaagacttgcgcagccgcctgcagcgcggcccgtga

SEQ ID NO: 196343 - DNA, 1087 bp, Homo sapiens
  Payload ID: 18739
  Gene Name: tumor necrosis factor receptor superfamily, member 25
  Uniprot ID: Q93038
  ENST ID: ENST00000510563
  CDS Start-End: 1-546
atggagcagcggccgcggggctgcgcggcggtggcggcggcgctcctcctggtgctgctgggggcccgggcccagggcggcactcgtagccccaggtgtgactgtgccggtgacttccacaagaagattggtctgttttgttgcagaggctgcccagcggggcactacctgaaggccccttgcacggagccctgcggcaactccacctgccttgtgtgtccccaagacaccttcttggcctgggagaaccaccataattctgaatgtgcccgctgccaggcctgtgatgagcaggcctcccaggtggcgctggagaactgttcagcagtggccgacacccgctgtggctgtaagccaggctggtttgtggagtgccaggtcagccaatgtgtcagcagttcacccttctactgccaaccatgcctagactgcggggccctgcaccgccacacacggctactctgttcccgcagagatactgactgtgggacctgcctgcctggcttctatgaacatggcgatggctgcgtgtcctgccccacatgaagctgggatggaggctctgaccccaccaccggccacccatctgtcacccttggacagcgcccacacccttctagcacctcctgacagcagtgagaagatctgcaccgtccagttggtgggtaacagctggacccctggctaccccgagacccaggaggcgctctgcccgcaggtgacatggtcctgggaccagttgcccagcagagctcttggccccgctgctgcgcccacactctcgccagagtccccagccggctcgccagccatgatgctgcagccgggcccgcagctctacgacgtgatggacgcggtcccagcgcggcgctggaaggagttcgtgcgcacgctggggctgcgcgaggcagagatcgaagccgtggaggtggagatcggccgcttccgagaccagcagtacgagatgctcaagcgctggcgccagcagcagcccgcgggcctcggagccgtttacgcggccctggagcgcatggggctggacggctgcgtggaagacttgcgcagccgcctgcagcgcggcccgtga

SEQ ID NO: 196344 - DNA, 1726 bp, Homo sapiens
  Payload ID: 18739
  Gene Name: tumor necrosis factor receptor superfamily, member 25
  Uniprot ID: Q93038
  ENST ID: ENST00000485036
  CDS Start-End: 69-902
ctgaaggcggaaccacgacgggcagagagcacggagccgggaagcccctgggcgcccgtcggagggctatggagcagcggccgcggggctgcgcggcggtggcggcggcgctcctcctggtgctgctgggggcccgggcccagggcggcactcgtagccccaggtgtgactgtgccggtgacttccacaagaagattggtctgttttgttgcagaggctgcccagcggggcactacctgaaggccccttgcacggagccctgcggcaactccacctgccttgtgtgtccccaagacaccttcttggcctgggagaaccaccataattctgaatgtgcccgctgccaggcctgtgatgagcaggcctcccaggtggcgctggagaactgttcagcagtggccgacacccgctgtggctgtaagccaggctggtttgtggagtgccaggtcagccaatgtgtcagcagttcacccttctactgccaaccatgcctagactgcggggccctgcaccgccacacacggctactctgttcccgcagagatactgactgtgggacctgcctgcctggcttctatgaacatggcgatggctgcgtgtcctgccccacgccacccccgtcccttgcaggagcaccctggggagctgtccagagcgctgtgccgctgtctgtggctggaggcagagtaggtggtgtgctgggaatgcgagtgggagaactgggatggaccgaggggaggcgggtgaggaggggggcaaccacccaacacccaccagctgctttcagtgttctgggtccaggtgctcctggctggccttgtggtccccctcctgcttggggccaccctgacctacacataccgccactgctggcctcacaagcccctggttactgcagatgaagctgggatggaggctctgaccccaccaccggccacccatctgtcacccttggacagcgcccacacccttctagcacctcctgacagcagtgagaagatctgcaccgtccagttggtgggtaacagctggacccctggctaccccgagacccaggaggcgctctgcccgcaggtgacatggtcctgggaccagttgcccagcagagctcttggccccgctgctgcgcccacactctcgccagagtccccagccggctcgccagccatgatgctgcagccgggcccgcagctctacgacgtgatggacgcggtcccagcgcggcgctggaaggagttcgtgcgcacgctggggctgcgcgaggcagagatcgaagccgtggaggtggagatcggccgcttccgagaccagcagtacgagatgctcaagcgctggcgccagcagcagcccgcgggcctcggagccgtttacgcggccctggagcgcatggggctggacggctgcgtggaagacttgcgcagccgcctgcagcgcggcccgtgacacggcgcccacttgccacctaggcgctctggtggcccttgcagaagccctaagtacggttacttatgcgtgtagacattttatgtcacttattaagccgctggcacggccctgcgtagcagcaccagccggccccacccctgctcgcccctatcgctccagccaaggcgaagaagcacgaacgaatgtcgagagggggtgaagacatttctcaacttctcggccggagtttggctgagatcgcggtattaaatctgtgaaagaaaacaaaacaaaacaaaaa

SEQ ID NO: 196345 - DNA, 1706 bp, Homo sapiens
  Payload ID: 18739
  Gene Name: tumor necrosis factor receptor superfamily, member 25
  ENST ID: ENST00000480393
  CDS Start-End: 69-830
ctgaaggcggaaccacgacgggcagagagcacggagccgggaagcccctgggcgcccgtcggagggctatggagcagcggccgcggggctgcgcggcggtggcggcggcgctcctcctggtgctgctgggggcccgggcccagggcggcactcgtagccccaggtgtgactgtgccggtgacttccacaagaagattggtctgttttgttgcagaggctgcccagcggggcactacctgaaggccccttgcacggagccctgcggcaactccacctgccttgtgtgtccccaagacaccttcttggcctgggagaaccaccataattctgaatgtgcccgctgccaggcctgtgatgagcaggcctcccaggtggcgctggagaactgttcagcagtggccgacacccgctgtggctgtaagccaggctggtttgtggagtgccaggtcagccaatgtgtcagcagttcacccttctactgccaaccatgcctagactgcggggccctgcaccgccacacacggctactctgttcccgcagagatactgactgtgggacctgcctgcctggcttctatgaacatggcgatggctgcgtgtcctgccccacgagcaccctggggagctgtccagagcgctgtgccgctgtctgtggctggaggcagagtaggtggtgtgctgggaatgcgagtgggagaactgggatggaccgaggggaggcgggtgaggaggggggcaaccacccaacacccaccagctgctttcagtgttctgggtccaggtgctcctggctggccttgtggtccccctcctgcttggggccaccctgacctacacataccgccactgctggcctcacaagcccctggttactgcagatgaagctgggatggaggctctgaccccaccaccggccacccatctgtcacccttggacagcgcccacacccttctagcacctcctgacagcagtgagaagatctgcaccgtccagttggtgggtaacagctggacccctggctaccccgagacccaggaggcgctctgcccgcaggtgacatggtcctgggaccagttgcccagcagagctcttggccccgctgctgcgcccacactctcgccagagtccccagccggctcgccagccatgatgctgcagccgggcccgcagctctacgacgtgatggacgcggtcccagcgcggcgctggaaggagttcgtgcgcacgctggggctgcgcgaggcagagatcgaagccgtggaggtggagatcggccgcttccgagaccagcagtacgagatgctcaagcgctggcgccagcagcagcccgcgggcctcggagccgtttacgcggccctggagcgcatggggctggacggctgcgtggaagacttgcgcagccgcctgcagcgcggcccgtgacacggcgcccacttgccacctaggcgctctggtggcccttgcagaagccctaagtacggttacttatgcgtgtagacattttatgtcacttattaagccgctggcacggccctgcgtagcagcaccagccggccccacccctgctcgcccctatcgctccagccaaggcgaagaagcacgaacgaatgtcgagagggggtgaagacatttctcaacttctcggccggagtttggctgagatcgcggtattaaatctgtgaaagaaaacaaaacaaaacaaaaa

SEQ ID NO: 196346 - DNA, 764 bp, Homo sapiens
  Payload ID: 18739
  Gene Name: tumor necrosis factor receptor superfamily, member 25
  ENST ID: ENST00000481401
  CDS Start-End: 629-764
ggaggagacgcagcagggagaggccccacgtgggcagctgcgctgagagtcagcagcacctgtcccccaggcgctcctcctggtgctgctgggggcccgggcccagggcggcactcgtagccccaggtgtgactgtgccggtgacttccacaagaagattggtctgttttgttgcagaggctgcccagcggggcactacctgaaggccccttgcacggagccctgcggcaactccacctgccttgtgtgtccccaagacaccttcttggcctgggagaaccaccataattctgaatgtgcccgctgccaggcctgtgatgagcaggcctcccaggtggcgctggagaactgttcagcagtggccgacacccgctgtggctgtaagccaggctggtttgtggagtgccaggtcagccaatgtgtcagcagttcacccttctactgccaaccatgcctagactgcggggccctgcaccgccacacacggctactctgttcccgcagagatactgactgtgggacctgcctgcctggcttctatgaacatggcgatggctgcgtgtcctgccccacgagcaccctggggagctgtccagagcgctgtgccgctgtctgtggctggaggcagatgttctgggtccaggtgctcctggctggccttgtggtccccctcctgcttggggccaccctgacctacacataccgccactgctggcctcacaagcccctggttactgatgaagctgggatggaggctctgaccc

SEQ ID NO: 196347 - DNA, 1068 bp, Homo sapiens
  Payload ID: 18740
  Gene Name: tumor necrosis factor receptor superfamily, member 4
  Uniprot ID: P43489
  ENST ID: ENST00000379236
  CDS Start-End: 6-839
cgaggatgtgcgtgggggctcggcggctgggccgcgggccgtgtgcggctctgctcctcctgggcctggggctgagcaccgtgacggggctccactgtgtcggggacacctaccccagcaacgaccggtgctgccacgagtgcaggccaggcaacgggatggtgagccgctgcagccgctcccagaacacggtgtgccgtccgtgcgggccgggcttctacaacgacgtggtcagctccaagccgtgcaagccctgcacgtggtgtaacctcagaagtgggagtgagcggaagcagctgtgcacggccacacaggacacagtctgccgctgccgggcgggcacccagcccctggacagctacaagcctggagttgactgtgccccctgccctccagggcacttctccccaggcgacaaccaggcctgcaagccctggaccaactgcaccttggctgggaagcacaccctgcagccggccagcaatagctcggacgcaatctgtgaggacagggaccccccagccacgcagccccaggagacccagggccccccggccaggcccatcactgtccagcccactgaagcctggcccagaacctcacagggaccctccacccggcccgtggaggtccccgggggccgtgcggttgccgccatcctgggcctgggcctggtgctggggctgctgggccccctggccatcctgctggccctgtacctgctccggagggaccagaggctgccccccgatgcccacaagccccctgggggaggcagtttccggacccccatccaagaggagcaggccgacgcccactccaccctggccaagatctgacctgggcccaccaaggtggacgctgggccccgccaggctggagcccggagggtctgctgggcgagcagggcaggtgcaggccgcctgccccgccacgctcctgggccaactctgcaccgttctaggtgccgatggctgcctccggctctctgcttacgtatgccatgcatacctcctgccccgcgggaccacaataaaaaccttggcagacgggagtctccgaccggca

SEQ ID NO: 196348 - DNA, 1124 bp, Homo sapiens
  Payload ID: 18741
  Gene Name: tumor necrosis factor receptor superfamily, member 6b, decoy
  Uniprot ID: O95407
  ENST ID: ENST00000369996
  CDS Start-End: 101-1003
tccgcaggcggaccgggggcaaaggaggtggcatgtcggtcaggcacagcagggtcctgtgtccgcgctgagccgcgctctccctgctccagcaaggaccatgagggcgctggaggggccaggcctgtcgctgctgtgcctggtgttggcgctgcctgccctgctgccggtgccggctgtacgcggagtggcagaaacacccacctacccctggcgggacgcagagacaggggagcggctggtgtgcgcccagtgccccccaggcacctttgtgcagcggccgtgccgccgagacagccccacgacgtgtggcccgtgtccaccgcgccactacacgcagttctggaactacctagagcgctgccgctactgcaacgtcctctgcggggagcgtgaggaggaggcacgggcttgccacgccacccacaaccgtgcctgccgctgccgcaccggcttcttcgcgcacgctggtttctgcttggagcacgcatcgtgtccacctggtgccggcgtgattgccccgggcacccccagccagaacacgcagtgccagccgtgccccccaggcaccttctcagccagcagctccagctcagagcagtgccagccccaccgcaactgcacggccctgggcctggccctcaatgtgccaggctcttcctcccatgacaccctgtgcaccagctgcactggcttccccctcagcaccagggtaccaggagctgaggagtgtgagcgtgccgtcatcgactttgtggctttccaggacatctccatcaagaggctgcagcggctgctgcaggccctcgaggccccggagggctggggtccgacaccaagggcgggccgcgcggccttgcagctgaagctgcgtcggcggctcacggagctcctgggggcgcaggacggggcgctgctggtgcggctgctgcaggcgctgcgcgtggccaggatgcccgggctggagcggagcgtccgtgagcgcttcctccctgtgcactgatcctggccccctcttatttattctacatccttggcaccccacttgcactgaaagaggcttttttttaaatagaagaaatgaggtttcttaaagcttatttttataaagctttttcataaaa

SEQ ID NO: 196349 - DNA, 3686 bp, Homo sapiens
  Payload ID: 18742
  Gene Name: tumor necrosis factor receptor superfamily, member 8
  Uniprot ID: P28908
  ENST ID: ENST00000263932
  CDS Start-End: 223-2010
atacgggagaactaaggctgaaacctcggaggaacaaccacttttgaagtgacttcgcggcgtgcgttgggtgcggactaggtggccgcggcgggagtgtgctggagcctgaagtccacgcgcgcggctgagaaccgccgggaccgcacgtgggcgccgcgcgcttcccccgcttcccaggtgggcgccggccgccaggccacctcacgtccggccccggggatgcgcgtcctcctcgccgcgctgggactgctgttcctgggggcgctacgagccttcccacaggatcgacccttcgaggacacctgtcatggaaaccccagccactactatgacaaggctgtcaggaggtgctgttaccgctgccccatggggctgttcccgacacagcagtgcccacagaggcctactgactgcaggaagcagtgtgagcctgactactacctggatgaggccgaccgctgtacagcctgcgtgacttgttctcgagacgacctcgtggagaagacgccgtgtgcatggaactcctcccgtgtctgcgaatgtcgacccggcatgttctgttccacgtctgccgtcaactcctgtgcccgctgcttcttccattctgtctgtccggcagggatgattgtcaagttcccaggcacggcgcagaagaacacggtctgtgagccggcttccccaggggtcagccctgcctgtgccagcccagagaactgcaaggaaccctccagtggcaccatcccccaggccaagcccaccccggtgtccccagcaacctccagtgccagcaccatgcctgtaagagggggcacccgcctcgcccaggaagctgcttctaaactgacgagggctcccgactctccctcctctgtgggaaggcctagttcagatccaggtctgtccccaacacagccatgcccagaggggtctggtgattgcagaaagcagtgtgagcccgactactacctggacgaggccggccgctgcacggcctgcgtgagctgttctcgagatgaccttgtggagaagacgccatgtgcatggaactcctcccgcacctgcgaatgtcgacctggcatgatctgtgccacatcagccaccaactcctgtgcccgctgtgtcccctacccaatctgtgcagcagagacggtcaccaagccccaggatatggctgagaaggacaccacctttgaggcgccacccctggggacccagccggactgcaaccccaccccagagaatggcgaggcgcctgccagcaccagccccactcagagcttgctggtggactcccaggccagtaagacgctgcccatcccaaccagcgctcccgtcgctctctcctccacggggaagcccgttctggatgcagggccagtgctcttctgggtgatcctggtgttggttgtggtggtcggctccagcgccttcctcctgtgccaccggagggcctgcaggaagcgaattcggcagaagctccacctgtgctacccggtccagacctcccagcccaagctagagcttgtggattccagacccaggaggagctcaacgcagctgaggagtggtgcgtcggtgacagaacccgtcgcggaagagcgagggttaatgagccagccactgatggagacctgccacagcgtgggggcagcctacctggagagcctgccgctgcaggatgccagcccggccgggggcccctcgtcccccagggaccttcctgagccccgggtgtccacggagcacaccaataacaagattgagaaaatctacatcatgaaggctgacaccgtgatcgtggggaccgtgaaggctgagctgccggagggccggggcctggcggggccagcagagcccgagttggaggaggagctggaggcggaccataccccccactaccccgagcaggagacagaaccgcctctgggcagctgcagcgatgtcatgctctcagtggaagaggaagggaaagaagaccccttgcccacagctgcctctggaaagtgaggcctgggctgggctggggctaggagggcagcagggtggcctctgggaggccaggatggcactgttggcaccgaggttgggggcagaggcccatctggcctgaactgaggctccagcatctagtggtggaccggccggtcactgcaggggtctggtggtctctgcttgcatccccaacttagctgtcccctgacccagagcctaggggatccggggcttgtacagaagagacagtccaaggggactggatcccagcagtgatgttggttgaggcagcaaacagatggcaggatgggcactgccgagaacagcattggtcccagagccctgggcatcagaccttaaccaccaggcccacagcccagcgagggagaggtcgtgaggccagctcccggggcccctgtaaccctactctcctctctccctggacctcagaggtgacacccattgggcccttccggcatgcccccagttactgtaaatgtggcccccagtgggcatggagccagtgcctgtggttgtttctccagagtcaaaagggaagtcgagggatggggcgtcgtcagctggcactgtctctgctgcagcggccacactgtactctgcactggtgtgagggcccctgcctggactgtgggaccctcctggtgctgcccaccttccctgtcctgtagccccctcggtgggcccagggcctagggcccaggatcaagtcactcatctcagaatgtccccaccaatccccgccacagcaggcgcctcgggtcccagatgtctgcagccctcagcagctgcagaccgcccctcaccaacccagagaacctgctttactttgcccagggacttcctccccatgtgaacatggggaacttcgggccctgcctggagtccttgaccgctctctgtgggccccacccactctgtcctgggaaatgaagaagcatcttccttaggtctgccctgcttgcaaatccactagcaccgaccccaccacctggttccggctctgcacgctttggggtgtggatgtcgagaggcaccacggcctcacccaggcatctgctttactctggaccataggaaacaagaccgtttggaggtttcatcaggattttgggtttttcacatttcacgctaaggagtagtggccctgacttccggtcggctggccagctgactccctagggccttcagacgtgtatgcaaatgagtgatggataaggatgagtcttggagttgcgggcagcctggagactcgtggacttaccgcctggaggcaggcccgggaaggctgctgtttactcatcgggcagccacgtgctctctggaggaagtgatagtttctgaaaccgctcagatgttttggggaaagttggagaagccgtggccttgcgagaggtggttacaccagaacctggacattggccagaagaagcttaagtgggcagacactgtttgcccagtgtttgtgcaaggatggagtgggtgtctctgcatcacccacagccgcagctgtaaggcacgctggaaggcacacgcctgccaggcagggcagtctggcgcccatgatgggagggattgacatgtttcaacaaaataatgcacttccttacctagtggcccttcacacaacttttgaatctctaaaaatccataaaatccttaaagaactgtaa

SEQ ID NO: 196350 - DNA, 3593 bp, Homo sapiens
  Payload ID: 18742
  Gene Name: tumor necrosis factor receptor superfamily, member 8
  Uniprot ID: P28908
  ENST ID: ENST00000417814
  CDS Start-End: 468-1919
atacgggagaactaaggctgaaacctcggaggaacaaccacttttgaagtgacttcgcggcgtgcgttgggtgcggactaggtggccgcggcgggagtgtgctggagcctgaagtccacgcgcgcggctgagaaccgccgggaccgcacgtgggcgccgcgcgcttcccccgcttcccaggtgggcgccggccgccaggccacctcacgtccggccccggggatgcgcgtcctcctcgccgcgctgggactgctgttcctgggggcgctacgagccttcccacagggctgttcccgacacagcagtgcccacagaggcctactgactgcaggaagcagtgtgagcctgactactacctggatgaggccgaccgctgtacagcctgcgtgacttgttctcgagacgacctcgtggagaagacgccgtgtgcatggaactcctcccgtgtctgcgaatgtcgacccggcatgttctgttccacgtctgccgtcaactcctgtgcccgctgcttcttccattctgtctgtccggcagggatgattgtcaagttcccaggcacggcgcagaagaacacggtctgtgagccggcttccccaggggtcagccctgcctgtgccagcccagagaactgcaaggaaccctccagtggcaccatcccccaggccaagcccaccccggtgtccccagcaacctccagtgccagcaccatgcctgtaagagggggcacccgcctcgcccaggaagctgcttctaaactgacgagggctcccgactctccctcctctgtgggaaggcctagttcagatccaggtctgtccccaacacagccatgcccagaggggtctggtgattgcagaaagcagtgtgagcccgactactacctggacgaggccggccgctgcacggcctgcgtgagctgttctcgagatgaccttgtggagaagacgccatgtgcatggaactcctcccgcacctgcgaatgtcgacctggcatgatctgtgccacatcagccaccaactcctgtgcccgctgtgtcccctacccaatctgtgcagcagagacggtcaccaagccccaggatatggctgagaaggacaccacctttgaggcgccacccctggggacccagccggactgcaaccccaccccagagaatggcgaggcgcctgccagcaccagccccactcagagcttgctggtggactcccaggccagtaagacgctgcccatcccaaccagcgctcccgtcgctctctcctccacggggaagcccgttctggatgcagggccagtgctcttctgggtgatcctggtgttggttgtggtggtcggctccagcgccttcctcctgtgccaccggagggcctgcaggaagcgaattcggcagaagctccacctgtgctacccggtccagacctcccagcccaagctagagcttgtggattccagacccaggaggagctcaacgctgaggagtggtgcgtcggtgacagaacccgtcgcggaagagcgagggttaatgagccagccactgatggagacctgccacagcgtgggggcagcctacctggagagcctgccgctgcaggatgccagcccggccgggggcccctcgtcccccagggaccttcctgagccccgggtgtccacggagcacaccaataacaagattgagaaaatctacatcatgaaggctgacaccgtgatcgtggggaccgtgaaggctgagctgccggagggccggggcctggcggggccagcagagcccgagttggaggaggagctggaggcggaccataccccccactaccccgagcaggagacagaaccgcctctgggcagctgcagcgatgtcatgctctcagtggaagaggaagggaaagaagaccccttgcccacagctgcctctggaaagtgaggcctgggctgggctggggctaggagggcagcagggtggcctctgggaggccaggatggcactgttggcaccgaggttgggggcagaggcccatctggcctgaactgaggctccagcatctagtggtggaccggccggtcactgcaggggtctggtggtctctgcttgcatccccaacttagctgtcccctgacccagagcctaggggatccggggcttgtacagaagagacagtccaaggggactggatcccagcagtgatgttggttgaggcagcaaacagatggcaggatgggcactgccgagaacagcattggtcccagagccctgggcatcagaccttaaccaccaggcccacagcccagcgagggagaggtcgtgaggccagctcccggggcccctgtaaccctactctcctctctccctggacctcagaggtgacacccattgggcccttccggcatgcccccagttactgtaaatgtggcccccagtgggcatggagccagtgcctgtggttgtttctccagagtcaaaagggaagtcgagggatggggcgtcgtcagctggcactgtctctgctgcagcggccacactgtactctgcactggtgtgagggcccctgcctggactgtgggaccctcctggtgctgcccaccttccctgtcctgtagccccctcggtgggcccagggcctagggcccaggatcaagtcactcatctcagaatgtccccaccaatccccgccacagcaggcgcctcgggtcccagatgtctgcagccctcagcagctgcagaccgcccctcaccaacccagagaacctgctttactttgcccagggacttcctccccatgtgaacatggggaacttcgggccctgcctggagtccttgaccgctctctgtgggccccacccactctgtcctgggaaatgaagaagcatcttccttaggtctgccctgcttgcaaatccactagcaccgaccccaccacctggttccggctctgcacgctttggggtgtggatgtcgagaggcaccacggcctcacccaggcatctgctttactctggaccataggaaacaagaccgtttggaggtttcatcaggattttgggtttttcacatttcacgctaaggagtagtggccctgacttccggtcggctggccagctgactccctagggccttcagacgtgtatgcaaatgagtgatggataaggatgagtcttggagttgcgggcagcctggagactcgtggacttaccgcctggaggcaggcccgggaaggctgctgtttactcatcgggcagccacgtgctctctggaggaagtgatagtttctgaaaccgctcagatgttttggggaaagttggagaagccgtggccttgcgagaggtggttacaccagaacctggacattggccagaagaagcttaagtgggcagacactgtttgcccagtgtttgtgcaaggatggagtgggtgtctctgcatcacccacagccgcagctgtaaggcacgctggaaggcacacgcctgccaggcagggcagtctggcgcccatgatgggagggattgacatgtttcaacaaaataatgcacttccttacctagtggcccttcacacaacttttgaatctctaaaaatccataaaatccttaaagaactgt

SEQ ID NO: 196351 - DNA, 2363 bp, Homo sapiens
  Payload ID: 18742
  Gene Name: tumor necrosis factor receptor superfamily, member 8
  Uniprot ID: P28908
  ENST ID: ENST00000413146
  CDS Start-End: 289-687
gtcttgtgtggttgcagcaaggcaaagagtgtggggcgtctctgtgttccagggccagtgctcttctgggtgatcctggtgttggttgtggtggtcggctccagcgccttcctcctgtgccaccggagggcctgcaggaagcgaattcggcagaagctccacctgtgctacccggtccagacctcccagcccaagctagagcttgtggattccagacccaggaggagctcaacgcagctgaggagtggtgcgtcggtgacagaacccgtcgcggaagagcgagggttaatgagccagccactgatggagacctgccacagcgtgggggcagcctacctggagagcctgccgctgcaggatgccagcccggccgggggcccctcgtcccccagggaccttcctgagccccgggtgtccacggagcacaccaataacaagattgagaaaatctacatcatgaaggctgacaccgtgatcgtggggaccgtgaaggctgagctgccggagggccggggcctggcggggccagcagagcccgagttggaggaggagctggaggcggaccataccccccactaccccgagcaggagacagaaccgcctctgggcagctgcagcgatgtcatgctctcagtggaagaggaagggaaagaagaccccttgcccacagctgcctctggaaagtgaggcctgggctgggctggggctaggagggcagcagggtggcctctgggaggccaggatggcactgttggcaccgaggttgggggcagaggcccatctggcctgaactgaggctccagcatctagtggtggaccggccggtcactgcaggggtctggtggtctctgcttgcatccccaacttagctgtcccctgacccagagcctaggggatccggggcttgtacagaagagacagtccaaggggactggatcccagcagtgatgttggttgaggcagcaaacagatggcaggatgggcactgccgagaacagcattggtcccagagccctgggcatcagaccttaaccaccaggcccacagcccagcgagggagaggtcgtgaggccagctcccggggcccctgtaaccctactctcctctctccctggacctcagaggtgacacccattgggcccttccggcatgcccccagttactgtaaatgtggcccccagtgggcatggagccagtgcctgtggttgtttctccagagtcaaaagggaagtcgagggatggggcgtcgtcagctggcactgtctctgctgcagcggccacactgtactctgcactggtgtgagggcccctgcctggactgtgggaccctcctggtgctgcccaccttccctgtcctgtagccccctcggtgggcccagggcctagggcccaggatcaagtcactcatctcagaatgtccccaccaatccccgccacagcaggcgcctcgggtcccagatgtctgcagccctcagcagctgcagaccgcccctcaccaacccagagaacctgctttactttgcccagggacttcctccccatgtgaacatggggaacttcgggccctgcctggagtccttgaccgctctctgtgggccccacccactctgtcctgggaaatgaagaagcatcttccttaggtctgccctgcttgcaaatccactagcaccgaccccaccacctggttccggctctgcacgctttggggtgtggatgtcgagaggcaccacggcctcacccaggcatctgctttactctggaccataggaaacaagaccgtttggaggtttcatcaggattttgggtttttcacatttcacgctaaggagtagtggccctgacttccggtcggctggccagctgactccctagggccttcagacgtgtatgcaaatgagtgatggataaggatgagtcttggagttgcgggcagcctggagactcgtggacttaccgcctggaggcaggcccgggaaggctgctgtttactcatcgggcagccacgtgctctctggaggaagtgatagtttctgaaaccgctcagatgttttggggaaagttggagaagccgtggccttgcgagaggtggttacaccagaacctggacattggccagaagaagcttaagtgggcagacactgtttgcccagtgtttgtgcaaggatggagtgggtgtctctgcatcacccacagccgcagctgtaaggcacgctggaaggcacacgcctgccaggcagggcagtctggcgcccatgatgggagggattgacatgtttcaacaaaataatgcacttccttacctagtggcccttcacacaacttttgaatctctaaaaatccataaaatccttaaagaactgtaa

SEQ ID NO: 196352 - DNA, 2412 bp, Homo sapiens
  Payload ID: 18742
  Gene Name: tumor necrosis factor receptor superfamily, member 8
  ENST ID: ENST00000514649
  CDS Start-End: 130-297
ggagtgtgctggagcctgaagtccacgcgcgcggctgagaaccgccgggaccgcacgtgggcgccgcgcgcttcccccgcttcccaggtgggcgccggccgccaggccacctcacgtccggccccggggatgcgcgtcctcctcgccgcgctgggactgctgttcctgggggcgctacgagccttcccacagggctgttcccgacacagcagtgcccacagaggcctactgactgcaggaagcagtgtgagcctgactactacctggatgaggccgaccgctgtacagcctgcgtgacttgttctcgagacgacctcgtggagaagacgccgtgtgcatggaactcctcccgtgtctgcgaatgtcgacccggcatgttctgttccacgtctgccgtcaactcctgtgcccgctgcttcttccattctgtctgtccggcagggatgattgtcaagttcccaggcacggcgcagaagaacacggtctgtgagccggcttccccaggggtcagccctgcctgtgccagcccagagaactgcaaggaaccctccagtggcaccatcccccaggccaagcccaccccggtgtccccagcaacctccagtgccagcaccatgcctgtaagagggggcacccgcctcgcccaggaagctgcttctaaactgacgagggctcccgactctccctcctctgtgggaaggcctagttcagatccaggtctgtccccaacacagccatgcccagaggggtctggtgattgcagaaagcagtgtgagcccgactactacctggacgaggccggccgctgcacggcctgcgtgagctgttctcgagatgaccttgtggagaagacgccatgtgcatggaactcctcccgcacctgcgaatgtcgacctggcatgatctgtgccacatcagccaccaactcctgtgcccgctgtgtcccctacccaatctgtgcagcagagacggtcaccaagccccaggatatggctgagaaggacaccacctttgaggcgccacccctggggacccagccggactgcaaccccaccccagagaatggcgaggcgcctgccagcaccagccccactcagagcttgctggtggactcccaggccagtaagacgctgcccatcccaaccagcgctcccgtcgctctctcctccacggggaagcccgttctggatgcagggccagtgctcttctgggtgatcctggtgttggttgtggtggtcggctccagcgccttcctcctgtgccaccggagggcctgcaggaagcgaattcggcagaagctccacctgtgctacccggtccagacctcccagcccaagctagagcttgtggattccagacccaggaggagctcaacgctgaggagtggtgcgtcggtgacagaacccgtcgcggaagagcgagggttaatgagccagccactgatggagacctgccacagcgtgggggcagcctacctggagagcctgccgctgcaggatgccagcccggccgggggcccctcgtcccccagggaccttcctgagccccgggtgtccacggagcacaccaataacaagattgagaaaatctacatcatgaaggctgacaccgtgatcgtggggaccgtgaaggctgagctgccggagggccggggcctggcggggccagcagagcccgagttggaggaggagctggaggcggaccataccccccactaccccgagcaggagacagaaccgcctctgggcagctgcagcgatgtcatgctctcagtggaagaggaagggaaagaagaccccttgcccacagctgcctctggaaagtgaggcctgggctgggctggggctaggagggcagcagggtggcctctgggaggccaggatggcactgttggcaccgaggttgggggcagaggcccatctggcctgaactgaggctccagcatctagtggtggaccggccggtcactgcaggggtctggtggtctctgcttgcatccccaacttagctgtcccctgacccagagcctaggggatccggggcttgtacagaagagacagtccaaggggactggatcccagcagtgatgttggttgaggcagcaaacagatggcaggatgggcactgccgagaacagcattggtcccagagccctgggcatcagaccttaaccaccaggcccacagcccagcgagggagaggtcgtgaggccagctcccggggcccctgtaaccctactctcctctctccctggacctcagaggtgacacccattgggcccttccggcatgcccccagttactgtaaatgtggcccccagtgggcatggagccagtgcctgtggttgtttctccagagtcaaaagggaagtcgagggatggggcgtcgtcagctggcactgtctctgctgca

SEQ ID NO: 196353 - DNA, 1923 bp, Homo sapiens
  Payload ID: 18743
  Gene Name: tumor necrosis factor receptor superfamily, member 9
  Uniprot ID: Q07011
  ENST ID: ENST00000377507
  CDS Start-End: 168-935
gtgtttgacctgaagtcctctcgagctgcagaagcctgaagaccaaggagtggaaagttctccggcagccctgagatctcaagagtgacatttgtgagaccagctaatttgattaaaattctcttggaatcagctttgctagtatcatacctgtgccagatttcatcatgggaaacagctgttacaacatagtagccactctgttgctggtcctcaactttgagaggacaagatcattgcaggatccttgtagtaactgcccagctggtacattctgtgataataacaggaatcagatttgcagtccctgtcctccaaatagtttctccagcgcaggtggacaaaggacctgtgacatatgcaggcagtgtaaaggtgttttcaggaccaggaaggagtgttcctccaccagcaatgcagagtgtgactgcactccagggtttcactgcctgggggcaggatgcagcatgtgtgaacaggattgtaaacaaggtcaagaactgacaaaaaaaggttgtaaagactgttgctttgggacatttaacgatcagaaacgtggcatctgtcgaccctggacaaactgttctttggatggaaagtctgtgcttgtgaatgggacgaaggagagggacgtggtctgtggaccatctccagccgacctctctccgggagcatcctctgtgaccccgcctgcccctgcgagagagccaggacactctccgcagatcatctccttctttcttgcgctgacgtcgactgcgttgctcttcctgctgttcttcctcacgctccgtttctctgttgttaaacggggcagaaagaaactcctgtatatattcaaacaaccatttatgagaccagtacaaactactcaagaggaagatggctgtagctgccgatttccagaagaagaagaaggaggatgtgaactgtgaaatggaagtcaatagggctgttgggactttcttgaaaagaagcaaggaaatatgagtcatccgctatcacagctttcaaaagcaagaacaccatcctacataatacccaggattcccccaacacacgttcttttctaaatgccaatgagttggcctttaaaaatgcaccactttttttttttttttgacagggtctcactctgtcacccaggctggagtgcagtggcaccaccatggctctctgcagccttgacctctgggagctcaagtgatcctcctgcctcagtctcctgagtagctggaactacaaggaagggccaccacacctgactaacttttttgttttttgtttggtaaagatggcatttcaccatgttgtacaggctggtctcaaactcctaggttcactttggcctcccaaagtgctgggattacagacatgaactgccaggcccggccaaaataatgcaccacttttaacagaacagacagatgaggacagagctggtgataaaaaaaaaaaaaaaaaagcattttctagataccacttaacaggtttgagctagtttttttgaaatccaaagaaaattatagtttaaattcaattacatagtccagtggtccaactataattataatcaaaatcaatgcaggtttgttttttggtgctaatatgacatatgacaataagccacgaggtgcagtaagtacccgactaaagtttccgtgggttctgtcatgtaacacgacatgctccaccgtcaggggggagtatgagcagagtgcctgagtttagggtcaaggacaaaaaacctcaggcctggaggaagttttggaaagagttcaagtgtctgtatatcctatggtcttctccatcctcacaccttctgcctttgtcctgctcccttttaagccaggttacattctaaaaattcttaacttttaacataatattttataccaaagccaataaatgaactgcatatga

SEQ ID NO: 196354 - DNA, 584 bp, Homo sapiens
  Payload ID: 18743
  Gene Name: tumor necrosis factor receptor superfamily, member 9
  ENST ID: ENST00000492571
  CDS Start-End: 1-228
tcctccaccagcaatgcagagtgtgactgcactccagggtttcactgcctgggggcaggatgcagcatgtgtgaacaggattgtaaacaaggtcaagaactgacaaaaaaaggttgtaaagactgttgctttgggacatttaacgatcagaaacgtggcatctgtcgaccctggacaaacatcagagtggctgacgaatggaatcatgattcacaagaaaagtattgactattttctcggacttagctgaattctgtctttggaaagtggcttttttaaaaagctgttctttggatggaaagtctgtgcttgtgaatgggacgaaggagagggacgtggtctgtggaccatctccagccgacctctctccgggagcatcctctgtgaccccgcctgcccctgcgagagagccaggacactctccgcagatcatctccttctttcttgcgctgacgtcgactgcgttgctcttcctgctgttcttcctcacgctccgtttctctgttgttaaacggggcagaaagaaactcctgtatatattcaaacaacgtaagattaacataatcatattacagctctggcaa

SEQ ID NO: 196355 - DNA, 445 bp, Homo sapiens
  Payload ID: 18743
  Gene Name: tumor necrosis factor receptor superfamily, member 9
  ENST ID: ENST00000474475
  CDS Start-End: 1-264
gagagggacgtggtctgtggaccatctccagccgacctctctccgggagcatcctctgtgaccccgcctgcccctgcgagagagccaggacactctccgcagatcatctccttctttcttgcgctgacgtcgactgcgttgctcttcctgctgttcttcctcacgctccgtttctctgttgttaaacggggcagaaagaaactcctgtatatattcaaacaacatggaagcagtggggataccttcacaatcctggagtcataacactgcattccaaggaaaccatcggatctcgaatctcagtaaccctcaagacgaaaataagtgctgctgaattgaaactagagctatgattgggatatggctaatattttatggtttagtgattcatgcttaagattcatgcttttttagctaatgtagaaaataaagaaaatagttctta

SEQ ID NO: 196356 - DNA, 5970 bp, Homo sapiens
  Payload ID: 18743
  Gene Name: tumor necrosis factor receptor superfamily, member 9
  Uniprot ID: Q07011
  ENST ID: ENST00000615230
  CDS Start-End: 262-1029
caaggagggatcccacagatgtcacagggctgtcacagagctgtggtgggaatttcccatgagaccccgcccctggctgagtcaccgcactcctgtgtttgacctgaagtcctctcgagctgcagaagcctgaagaccaaggagtggaaagttctccggcagccctgagatctcaagagtgacatttgtgagaccagctaatttgattaaaattctcttggaatcagctttgctagtatcatacctgtgccagatttcatcatgggaaacagctgttacaacatagtagccactctgttgctggtcctcaactttgagaggacaagatcattgcaggatccttgtagtaactgcccagctggtacattctgtgataataacaggaatcagatttgcagtccctgtcctccaaatagtttctccagcgcaggtggacaaaggacctgtgacatatgcaggcagtgtaaaggtgttttcaggaccaggaaggagtgttcctccaccagcaatgcagagtgtgactgcactccagggtttcactgcctgggggcaggatgcagcatgtgtgaacaggattgtaaacaaggtcaagaactgacaaaaaaaggttgtaaagactgttgctttgggacatttaacgatcagaaacgtggcatctgtcgaccctggacaaactgttctttggatggaaagtctgtgcttgtgaatgggacgaaggagagggacgtggtctgtggaccatctccagccgacctctctccgggagcatcctctgtgaccccgcctgcccctgcgagagagccaggacactctccgcagatcatctccttctttcttgcgctgacgtcgactgcgttgctcttcctgctgttcttcctcacgctccgtttctctgttgttaaacggggcagaaagaaactcctgtatatattcaaacaaccatttatgagaccagtacaaactactcaagaggaagatggctgtagctgccgatttccagaagaagaagaaggaggatgtgaactgtgaaatggaagtcaatagggctgttgggactttcttgaaaagaagcaaggaaatatgagtcatccgctatcacagctttcaaaagcaagaacaccatcctacataatacccaggattcccccaacacacgttcttttctaaatgccaatgagttggcctttaaaaatgcaccactttttttttttttttgacagggtctcactctgtcacccaggctggagtgcagtggcaccaccatggctctctgcagccttgacctctgggagctcaagtgatcctcctgcctcagtctcctgagtagctggaactacaaggaagggccaccacacctgactaacttttttgttttttgtttggtaaagatggcatttcaccatgttgtacaggctggtctcaaactcctaggttcactttggcctcccaaagtgctgggattacagacatgaactgccaggcccggccaaaataatgcaccacttttaacagaacagacagatgaggacagagctggtgataaaaaaaaaaaaaaaaaagcattttctagataccacttaacaggtttgagctagtttttttgaaatccaaagaaaattatagtttaaattcaattacatagtccagtggtccaactataattataatcaaaatcaatgcaggtttgttttttggtgctaatatgacatatgacaataagccacgaggtgcagtaagtacccgactaaagtttccgtgggttctgtcatgtaacacgacatgctccaccgtcaggggggagtatgagcagagtgcctgagtttagggtcaaggacaaaaaacctcaggcctggaggaagttttggaaagagttcaagtgtctgtatatcctatggtcttctccatcctcacaccttctgcctttgtcctgctcccttttaagccaggttacattctaaaaattcttaacttttaacataatattttataccaaagccaataaatgaactgcatatgataggtatgaagtacagtgagaaaattaacacctgtgagctcattgtcctaccacagcactagagtgggggccgccaaactcccatggccaaacctggtgcaccatttgcctttgtttgtctgttggtttgcttgagacagtcttgctctgttgcccaggctggaatggagtggctattcacaggcacaatcatagcacactttagccttaaactcctgggctcaagtgatccacccgcctcagtctcccaagtagctgggattacaggtgcaaacctggcatgcctgccattgtttggcttatgatctaaggatagctttttaaattttattcattttatttttttttgagacagtgtctcactctgtctcccaggctggagtacagtggtacaatcttggatcaccgcctcccagtttcaagtgatctccctgcctcagcctcctaagtagctgggactacaggtatgtgccaccacgcctggctaatttttatatttttagtagagacggggtttcaccatgttgtccaggctggtctcaaactcctgacctcaggtgatctgcccacctctgcctcccaaagtgctgggattacaggcatgagccaccatgcctggccatttcttacacttttgtatgacatgcctattgcaagcttgcgtgcctctgtcccatgttattttactctgggatttaggtggagggagcagcttctatttggaacattggccatcgcatggcaaatgggtatctgtcacttctgctcctatttagttggttctactataacctttagagcaaatcctgcagccaagccaggcatcaatagggcagaaaagtatattctgtaaataggggtgaggagaagatatttctgaacaatagtctactgcagtaccaaattgcttttcaaagtggctgttctaatgtactcccgtcagtcatataagtgtcatgtaagtatcccattgatccacatccttgctaccctctggtactatcaggtgcccttaattttgccaagccagtgggtatagaatgagatctcactgtggtcttagtttgcatttgcttggttactgatgagcaccttgtcaaatatttatataccatttgtgtttatttttttaaataaaatgcttgctcatgcttttttgcccatttgcaaaaaaacttggggccgggtgcagtggctcatgcctgtagtcccagctctttgggaggccaaggtgggcagatcgcttgagcccaggagttcgagaccagccttggcaacatggcgaaaccctgtctttacaaaaaatacaaaaattagccgggtgtggtggtgtgcacctgaagtcccagctactcagtaggttcgctttgagcctgggaggcagaggttgcagtgagctgggaccgcatcactacacttcagcctgggcaacagagaaaaaccttttctcagaaacaaacaaacccaaatgtggttgtttgtcctgattcctaaaaggtctttatgtattctagataataatctttggtcagttatatgtgttaaaaaatatcttctttgtggccaggcacggtagctcacacctgtaatcccagcactttgcggggctgaggtgggtggatcatctgaggtcaagagttcaagatcagcctggccaacacagtgaaaccccatctctactaaacatgtacaaaacttagctgggtatggtggcgggtgcctgtaaccccagctgctccagaggctgtggcagaagaatcgcttgaacccaggaggcagaggttgcagcgagccaagattgtgccattgcactccagactgggtgacaagagtgaaattctgcctatctatctatctatctatctatatctatatatatatatatatatatcctttgtaatttatttttccctttttaaaattttttataaaattcttttttatttttatttttagcagaggtgaggtttctgaggtttcattatgttgcccaggctggtcttgaactcctgagctcaagtgatcctcccacctcagccttccaaagtgctggaattgcagacatgagccaccgcgcccctcctgtttttctctaattaatggtgtctttctttgtctttctggtaataagcaaaaagttcttcatttgatttggttaaatttataactgttttctcatatggttaacattttttcttgcctggctaaagaaatccttttctgcccaatactataaagaggtttgcccacattttattccaaaagttttaagttttgtctttcatcttgaagtctaatgtatcaggaactggcttttgtgcctgttgggaggtagtgatccaattccatgtcttgcatgtaggtaaccactggtccctgcgccatgtattcaatacgtcgtctttctcctgcgggtctgcaatctcacctaccatccatcaagtttccatagggccatgggtctgcttctgggctccctgttctgttccattgtcaatttgtctatcctgtgccagtatcacactgtgtttattacaatagctttgtaacagctctcgatatccggtaggacatctccctccaccttctttttctacttcagaagtgtcttagctaggtcaggcacggtggctcacgcctgtaatcccagcactttgggaggccgacgcggatggatcacctgaggtcaggagttttgagacagcctggccaacatggtgaaaccccatctctactaaaaaatacaaaaattagtcaggcatggtggcatgtgcctgtaatcccagctatttgggaggctgaggccggagaattgcttgaacccggggggcggaggttgcagtgagccgagatcgtaccattgcactccagcctgggtgacagagcgaaactctgtctcaggaaaaaaaagaaaagagatgtcttggttattcttggttctttattattcaatataaattttagaagctgaatttgaaaagatttggattggaatttcattaaatctacaggtcaatttagggagagttgataattttacagaattgagtcatctggtgttccaataagaataagagaacaattattggctgtacaattcttgccaaatagtaggcaaagcaaagcttaggaagtatactggtgccatttcaggaacaaagctaggtgcgaatatttttgtctttctgaatcatgatgctgtaagttctaaagtgatttctcctcttggctttggacacatggtgtttaattacctactgctgactatccacaaacagaaagagactggtcatgccccacagggttggggtatccaagataatggagcgaggctctcatgtgtcctaggttacacaccgaaaatccacagtttattctgtgaagaaaggaggctatgtttatgatacagactgtgatatttttatcatagcctattctggtatcatgtgcaaaagctataaatgaaaaacacaggaacttggcatgtgagtcattgctccccctaaatgacaattaataaggaaggaacattgagacagaataaaatgatccccttctgggtttaatttagaaagttccataattaggtttaatagaaataaatgtaaatttctatgattaaaaataaattagcacatttagggatacacaaattataaatcattttctaaatgctaaaaacaagctcaggtttttttcagaagaaagttttaattttttttctttagtggaagatatcactctgacggaaagttttgatgtgaggggcggatgactataaagtgggcatcttcccccacaggaagatgtttccatctgtgggtgagaggtgcccaccgcagctagggcaggttacatgtgccctgtgtgtggtaggacttggagagtgatctttatcaacgtttttatttaaaagactatctaataaaacacaaaactatgatgttcacagg

SEQ ID NO: 196357 - DNA, 3627 bp, Homo sapiens
  Payload ID: 18744
  Gene Name: tumor necrosis factor, alpha-induced protein 1 (endothelial)
  Uniprot ID: Q13829
  ENST ID: ENST00000226225
  CDS Start-End: 268-1218
agccggctgggctgggcagcactccgggcggagtcgacgagcgcaggatgtgagctcacagcttgggactgctgaggggcaggcggctgcaggctaggggcggctcggagtccgctggccacccagctgagaggagaggcgcccccggggacgcactgagattatgaggctctggcctccactggccactcactcgtgaccctttccaccacggcggagccttccaagcctacctcctgccgtgtggtgatctacctgcagcgggagatgtcgggggacacctgcctgtgcccagcctcaggggccaagcccaagctcagtggcttcaagggaggagggttgggcaacaagtatgtccagctcaacgtgggcggctctctgtactacaccactgtgcgggccctgacccgccacgacaccatgctcaaggccatgttcagtgggcgcatggaggtgctgaccgacaaagaaggctggatcctcatagaccgttgtggaaagcactttggcaccattttgaattacctccgagatgacaccatcaccctccctcagaaccggcaagaaatcaaggaattgatggctgaagcaaagtattacctcatccaggggctggtgaatatgtgccagagtgccctgcaggacaagaaggactcctaccagcctgtgtgcaacatccccatcatcacatccctaaaggaggaggagcggctcatcgaatcctccaccaagcccgtggtgaagctgctgtacaacagaagcaacaacaagtattcctacaccagcaactctgacgaccacctgctgaaaaacatcgagctgtttgacaagctctccctgcgcttcaacggccgcgtgctcttcatcaaggatgtcattggtgacgagatctgctgctggtccttttatggccagggccgtaagctggcagaggtgtgctgtacctccatcgtgtatgccacggagaagaagcagaccaaggtggaattcccagaggcccgaatctatgaggagacactcaacgtcctactctatgagactccccgcgtccccgacaactccttgttggaggccacaagccgtagccgcagccaggcttcccccagtgaagatgaggagacctttgaactgcgggaccgtgtccgccgcatccacgtcaagcgctacagcacttacgatgaccggcagctcggccaccagtctacccatcgcgactgaccagaccctcagggagtcagggcacgggaggccctatctcccatcctgtggaacccgccccattggccaccccatgctgctgctgcctgggtctctgctctagcacccagaggcatgacaggccctgctcagaggtcagagggtctgggcagaggagggaccacattcccctgccttgcccctgagcacttctggagactgcgtcctgtcctatctgctcaccatcacccttcctgcccgacggagctgcttctgctccctggggcatatggactgacccacctcctgctgagaaccttcccctaggccctgtgcagaaggctactgccccttaggcctcagctgggggaaaggcagttctggtgctgtagaggccctggtgcagaaagtgggacgtcttttttcctaaggtgtttaagcacaggcttgataagtttggtttttaaaaaataatctaggaaatgaataattctaaatctagtaatgaggaaactgagcatttcttttgccctccagggtgccaagaccctacatatgacagaacccttggcccttctccatgcctgtgggatctgtttctttaaagcactttgtactgttattcaggaggttgataatctccttgacccatgtctttctaccctaatccccacttccctgcagaatcaatctgagggaggggataaagaggaagcaataaaaaaaaaacatccgacagagcagctctggctttgcagcctggccagcagctcagagtgcaccgaggagggaaggatggctaagctgggaccggcagtcctcacagggtgcctgtgagaaaggacattttacccccacatcatagtcacatcactgactcctaggtctagcacgactgctctttgtgattctcttgagtacccttggcttccagccatgctgtcctcacatacggtaaagccaaagagctgtcacatgggccagaaacatgagccacggcaggaagaccgtggagcccgtgggcactgcatggtgttggctggcatgcccatcagctgaggacagcaaactcccagcagcccctacagaggtggcacatgcttggccacacatctactccctgcccacaccatctatgctcttggttggtgctggctgggatggcggttctgcccagtggtgtctctgagcgcgggatgacaggagcaaccgaagcaccctgaaggccttcactccttgttgggtaactcagccatggagatgccaagcactagccaggaggtgagttcctctttagggctttggttttcattcctttttgtttggcttggccaaaccagaattcagcttatctgaattattttccaaaggaatgctgtcagggagggactgttctgccagcctaacaaagcaacgtagccacgtatagtacccactttctgctctttggagagaacacaggttatcaagttcatctctcttgactactcttatgatagctgatgccacagagcctatgggcaaatgccagacccagggttagacacaaggacctgaagtgacatgacggcgggacaggggaaatgtgactttctaattaggcattttatgttagtcacagtcttgaatgtataaacagcactaagactctcaggtcaggtaccttggtgatcagctactagttcttccagccctcattgaggtaacaagataaagacaaatccacttctttggccaaattcaggctttggctttatgactttcccacagagactggaatgcgtcagcctgagaccactggcctattttctcagctgccctcttgaggtcctttaacactcaaattcccagctccccactgaggtgttgtgatgcttgccttttgacctccccatcccctttagtccctgcttactactttgacattcacatcctcagtgtctcagtcttttttgccgagaaagcacagtagtctgggactgggcatttatcttctctgactgaaaatctctccttggtcttaaggaaaatactaacattgaactcactgacatgatcttagcttctttaatcagactttgtgacttaaaagtttgggggttttctttgaaagtttccagccctattcagaaagcaactcttggctgtgtgcatttttcaactccaagcagcccaggggtaagtaaacaaagtatggatgaaggtcagattttcttgtcagtttctgagaaacctggcagcctgctgttaacaacacaggccagtattgggttttattgaatttggtatgtgaccaaggtcggcctaaaggatggcgcaggtcctgggcaggaaagaatttttcctttatcacataactgtaatatttggttgctcagcataagtgatggaagcaaacactaatttctaataaaattgtgttaaactcaa

SEQ ID NO: 196358 - DNA, 1656 bp, Homo sapiens
  Payload ID: 18744
  Gene Name: tumor necrosis factor, alpha-induced protein 1 (endothelial)
  Uniprot ID: Q13829
  ENST ID: ENST00000544907
  CDS Start-End: 363-1001
aagtagctctgctctctccgcgaagaccctcgggggattccgcctccaccctttcccggatagagcgctatgcatgcagggacttgtagtctcaggctccccagccggctgggctgggcagcactccgggcggagtcgacgagcgcaggatgtgagctcacagcttgggactgctgaggggcaggcggctgcaggctaggggcggctcggagtccgctggccacccagctgagaggagaggcgcccccggggacggctggatcctcatagaccgttgtggaaagcactttggcaccattttgaattacctccgagatgacaccatcaccctccctcagaaccggcaagaaatcaaggaattgatggctgaagcaaagtattacctcatccaggggctggtgaatatgtgccagagtgccctgcaggacaagaaggactcctaccagcctgtgtgcaacatccccatcatcacatccctaaaggaggaggagcggctcatcgaatcctccaccaagcccgtggtgaagctgctgtacaacagaagcaacaacaagtattcctacaccagcaactctgacgaccacctgctgaaaaacatcgagctgtttgacaagctctccctgcgcttcaacggccgcgtgctcttcatcaaggatgtcattggtgacgagatctgctgctggtccttttatggccagggccgtaagctggcagaggtgtgctgtacctccatcgtgtatgccacggagaagaagcagaccaaggtggaattcccagaggcccgaatctatgaggagacactcaacgtcctactctatgagactccccgcgtccccgacaactccttgttggaggccacaagccgtagccgcagccaggcttcccccagtgaagatgaggagacctttgaactgcgggaccgtgtccgccgcatccacgtcaagcgctacagcacttacgatgaccggcagctcggccaccagtctacccatcgcgactgaccagaccctcagggagtcagggcacgggaggccctatctcccatcctgtggaacccgccccattggccaccccatgctgctgctgcctgggtctctgctctagcacccagaggcatgacaggccctgctcagaggtcagagggtctgggcagaggagggaccacattcccctgccttgcccctgagcacttctggagactgcgtcctgtcctatctgctcaccatcacccttcctgcccgacggagctgcttctgctccctggggcatatggactgacccacctcctgctgagaaccttcccctaggccctgtgcagaaggctactgccccttaggcctcagctgggggaaaggcagttctggtgctgtagaggccctggtgcagaaagtgggacgtcttttttcctaaggtgtttaagcacaggcttgataagtttggtttttaaaaaataatctaggaaatgaataattctaaatctagtaatgaggaaactgagcatttcttttgccctccagggtgccaagaccctacatatgacagaacccttggcccttctccatgcctgtgggatctgtttctttaaagcactttgtactgttattcaggaggttgataatctccttgacccatgtctttctaccctaatccccactt

SEQ ID NO: 196359 - DNA, 579 bp, Homo sapiens
  Payload ID: 18744
  Gene Name: tumor necrosis factor, alpha-induced protein 1 (endothelial)
  ENST ID: ENST00000582302
  CDS Start-End: 205-579
tgctttgtaggaaaggaagagattagctctggatccgccgacctctcttggcaggcctatcctttgagctcctttgcattggcagaacatcactgagattatgaggctctggcctccactggccactcactcgtgaccctttccaccacggcggagccttccaagcctacctcctgccgtgtggtgatctacctgcagcgggagatgtcgggggacacctgcctgtgcccagcctcaggggccaagcccaagctcagtggcttcaagggaggagggttgggcaacaagtatgtccagctcaacgtgggcggctctctgtactacaccactgtgcgggccctgacccgccacgacaccatgctcaaggccatgttcagtgggcgcatggaggtgctgaccgacaaagaaggctggatcctcatagaccgttgtggaaagcactttggcaccattttgaattacctccgagatgacaccatcaccctccctcagaaccggcaagaaatcaaggaattgatggctgaagcaaagtattacctcatccaggggctggtgaatatgtgccagagtgccctgcag

SEQ ID NO: 196360 - DNA, 536 bp, Homo sapiens
  Payload ID: 18744
  Gene Name: tumor necrosis factor, alpha-induced protein 1 (endothelial)
  ENST ID: ENST00000578158
  CDS Start-End: 215-536
tttcccggatagagcgctatgcatgcagggacttgtagtctcaggctccccagccggctgggctgggcagcactccgggcggagtcgacgagcgcaggatcactgagattatgaggctctggcctccactggccactcactcgtgaccctttccaccacggcggagccttccaagcctacctcctgccgtgtggtgatctacctgcagcgggagatgtcgggggacacctgcctgtgcccagcctcaggggccaagcccaagctcagtggcttcaagggaggagggttgggcaacaagtatgtccagctcaacgtgggcggctctctgtactacaccactgtgcgggccctgacccgccacgacaccatgctcaaggccatgttcagtgggcgcatggaggtgctgaccgacaaagaaggctggatcctcatagaccgttgtggaaagcactttggcaccattttgaattacctccgagatgacaccatcaccctccctcagaaccggcaagaaatcaaggaattgatggctgaag

SEQ ID NO: 196361 - DNA, 482 bp, Homo sapiens
  Payload ID: 18744
  Gene Name: tumor necrosis factor, alpha-induced protein 1 (endothelial)
  ENST ID: ENST00000577535
  CDS Start-End: 11-482
caaggaattgatggctgaagcaaagtattacctcatccaggggctggtgaatatgtgccagagtgccctgcaggacaagaaggactcctaccagcctgtgtgcaacatccccatcatcacatccctaaaggaggaggagcggctcatcgaatcctccaccaagcccgtggtgaagctgctgtacaacagaagcaacaacaagtattcctacaccagcaactctgacgaccacctgctgaaaaacatcgagctgtttgacaagctctccctgcgcttcaacggccgcgtgctcttcatcaaggatgtcattggtgacgagatctgctgctggtccttttatggccagggccgtaagctggcagaggtgtgctgtacctccatcgtgtatgccacggagaagaagcagaccaaggtgtgggggattgcccctgcctgggtaggggaggacacacacccactgtgcgggggacgtggtcgggctg

SEQ ID NO: 196362 - DNA, 4175 bp, Homo sapiens
  Payload ID: 18745
  Gene Name: tumor necrosis factor, alpha-induced protein 2
  Uniprot ID: Q03169
  ENST ID: ENST00000333007
  CDS Start-End: 132-2096
ccagggtgatgctgaagatgatgaccttcttccaaggcctctagagccatcagcctgtgccaggcaccctcgacttgcctagaggcccccaaaagttgcagtccacatcagaggcagagtcagaggcctccatgtcggaggcctcctctgaggacctggtgccacccctggaggctggggcagccccatatagggaggaggaagaggcggcgaagaagaagaaggagaagaagaagaagtccaaaggcctggccaatgtgttctgcgtcttcaccaaagggaagaagaagaagggtcagcccagctcagcggagcccgaggacgcagccgggtccaggcaggggctggatggcccgccccccacagtggaggagctgaaggcggcgctggagcgcgggcagctggaggcggcgcggccgctgctggcgctggagcgggagctggcggcggcggcggcggcgggcggtgtgagcgaggaggagctggtgcggcgccagagcaaggtggaggcgctgtacgagctgctgcgcgaccaggtgctgggcgtgctgcggcggccgctggaggcgccgcccgagcggctgcgccaggcgctggccgtggtggcggagcaggagcgcgaggaccgccaggcggcggcggcggggccggggacctcggggctggcggccacgcgcccgcggcgctggctgcagctgtggcggcgcggcgtggcggaggcggccgaggagcgcatgggccagcggccggccgcgggcgccgaggtccccgagagcgtctttctgcacttgggccgcaccatgaaggaggacctggaggccgtggtggagcggctgaagccgctgttccccgccgagttcggcgtcgtggcggcctacgccgagagctaccaccagcacttcgcggcccacctggccgccgtggcgcagttcgagctgtgcgagcgcgacacctacatgctgctgctctgggtgcagaacctctaccccaatgacatcatcaacagccccaagctggtgggtgagctgcagggtatggggctcgggagcctcctgccccccaggcagatccgactgctggaggccacattcctgtccagtgaggcggccaatgtgagggagttgatggaccgagctctggagctagaggcacggcgctgggctgaggatgtgcctccccagaggctggacggccactgccacagcgagctggccatcgacatcatccagatcacctcccaggcccaggccaaggccgagagcatcacgctggacttgggctcacagataaagcgggtgctgctggtggagctgcctgcgttcctgaggagctaccagcgcgcctttaatgaatttctggagagaggcaagcagctgacgaattacagggccaatgttattgccaacatcaacaactgcctgtccttccggatgtccatggagcagaattggcaggtaccccaggacaccctgagcctcctgctgggccccctgggtgagctcaagagccacggctttgacaccctgctccagaacctgcatgaggacctgaagccactgttcaagaggttcacgcacacccgctgggcggcccctgtggagaccctggaaaacatcatcgccactgtagacacgaggctgcctgagttctcagagctgcagggctgtttccgggaggagctcatggaggccttgcacctgcacctggtgaaggagtacatcatccaactcagcaaggggcgcctggtcctcaagacggccgagcagcagcagcagctggctgggtacatcctggccaatgctgacaccatccagcacttctgcacccagcacggctccccggcgacctggctgcagcctgctctccctacgctggccgagatcattcgcctgcaggaccccagtgccatcaagattgaggtggccacttatgccacctgctaccctgacttcagcaaaggccacctgagcgctatcctggccatcaaggggaacctatccaacagtgaggtcaagcgcatccggagcatcttggacgtcagcatgggggcgcaggagccctcccggcccctattttcccttataaaggttggttagcttttcctgtggcctgacctgcctgtgagtgcccagcaagccttgggcacaccccgctgggagctgttaagagcagcgctggttctcggttcctcccgggtctcctgtgctctgatgctacttctgcctagccctggcggaggtgcaggccctgtcagctggaactggacagaccttggtttgtttacatgtccgatgggggcaggagctcccatcctgggcagccaaccaggcaacaccaaggactctttgtaaacgatagctgatcgtgtgcacgcaaggaaagaaccaggagggagagtgcagccaggctcagggatccccggacacctctgtccagagcccctccacagtcggcctcatgactgtcctcctcgtgggtggggccgagggccctcttcagctctctggagacaggggccgagcctcacccatctgccctctgcagcccagggccgccgtgagcgggattcagcaatggtggaatggaagacagaactggaagagaaagaaggaaaagatgagctctcgtctggcaggggcttttagggtcctgtggcgagctgtgagcaccgccagcattagacgtcacatccaggtggccccacggcccctacaggctggccctgcaatggggccctgagccctccctcttcatcccccaaggcctcaactagagggtggtcccccgagggcttggtgtctactaccgaagggcccaagacctcctgggtcctctcaggctcccccttccccaaggcagggacaggccctgggggtgccaccgtgggccctgccacccagaagtctggctgaggtctgggcaggggcagggcaagcttgacctctcactgttgaccctttggcctctgtatttgtttcctattgccgtgacaggtttccacaaacttcgtggatcaaaacgaggtcttccagttctgcgggtcagaaggctgacccggggctcaaatctgggtgtcggcagtcctgcactccttctggaggctctaggggagaattcatttctggccttttcatttttagaggctgaccgtaattcttgacttcaggctcctccatcttcagagccagctgtgggtagttgaatctttttcccgtcacctcattgaggcctcccctctcctgcctccctccaccacttttttttttttttttttgagacagggtcttgctgtgttgcccaggctggagtgcagtggcctggtcatggcatcaaggctcactgcagcctggacctcctggttcaagtgatcctcttgtctcagtcccctgagacaatcccccacgcccagctacatattttttgtggatacagggtctcattctgttgcctaggcttgtctggaactcctgggctcaagggatcttgtagccttagcctcctaaagtgctgggattataggcatgagtcactgtacccggcctgctctaccgcttttaaggacgcttatgatcacattgcgcctacccagagaacccaggtcgtctttctattttcaggtcagctgattagccaccttagttccatctgcaactttagttcccactggctgtgtaacctaacatagtcacaggctctggggactgtcacgtggacatctttgggaggccgttattctgcccaccgcaccctccgttcatcccctgccctgccgggcacctcgctctaccccaggaaaatgtgagctcgttttcctgctcggcatgtgctccccctaaggctctgctcctccctgggcctgaaagttccttctcagcctgagagggggcccttcggactcaggcatgactcagcccggctgatgcctctgcagtgctgagtcaggatttggggccggctctcttgggtccgtccccttttcccaggtactgccttacaaagctgtggccaggaagtggccggtataaaggatgcccaaggtctttgtacgtgtgtaggagttagcgtgtttgatattgttaatataataataattattttttagagtactgcttttgtatgtatgttgaacaggatccaggtttttatagcttgatataaaacagaattcaaaagtg

SEQ ID NO: 196363 - DNA, 4683 bp, Homo sapiens
  Payload ID: 18745
  Gene Name: tumor necrosis factor, alpha-induced protein 2
  Uniprot ID: Q03169
  ENST ID: ENST00000560869
  CDS Start-End: 640-2604
agtggcggccaggccgggacacggtaagtgacctccgcttccacacgtccattccccgccgctccgcgcggcttctcgcccgcccctaccccgaggccaggccggattccccgaggaaagagcctgtcgccgcggcggggacaggagggggctggacgcttccagggaaactgaggccctggcgcgcccagcgtccgcgcgtccgggcgcagaggggccaaggctggctgagggcccgggcctgccagaggcagggagggcggggctggggcaggcgcaggggtctcccctccattacagcagaaaggccccaggtccggcgtgactccccggccgggcgacacaggccgagtcacttcctcgcccgtgcccgggtgtcctcatcgggggatgggtgcgccttccacatcctgcccaggactgaaggagccgggcccagcgagctcccgggaggtgtgtggacatcagccctgacggggaaggcgagccaggagcctgcaggcctgaaccagggtgatgctgaagatgatgaccttcttccaaggcctctagagccatcagcctgtgccaggcaccctcgacttgcctagaggcccccaaaagttgcagtccacatcagaggcagagtcagaggcctccatgtcggaggcctcctctgaggacctggtgccacccctggaggctggggcagccccatatagggaggaggaagaggcggcgaagaagaagaaggagaagaagaagaagtccaaaggcctggccaatgtgttctgcgtcttcaccaaagggaagaagaagaagggtcagcccagctcagcggagcccgaggacgcagccgggtccaggcaggggctggatggcccgccccccacagtggaggagctgaaggcggcgctggagcgcgggcagctggaggcggcgcggccgctgctggcgctggagcgggagctggcggcggcggcggcggcgggcggtgtgagcgaggaggagctggtgcggcgccagagcaaggtggaggcgctgtacgagctgctgcgcgaccaggtgctgggcgtgctgcggcggccgctggaggcgccgcccgagcggctgcgccaggcgctggccgtggtggcggagcaggagcgcgaggaccgccaggcggcggcggcggggccggggacctcggggctggcggccacgcgcccgcggcgctggctgcagctgtggcggcgcggcgtggcggaggcggccgaggagcgcatgggccagcggccggccgcgggcgccgaggtccccgagagcgtctttctgcacttgggccgcaccatgaaggaggacctggaggccgtggtggagcggctgaagccgctgttccccgccgagttcggcgtcgtggcggcctacgccgagagctaccaccagcacttcgcggcccacctggccgccgtggcgcagttcgagctgtgcgagcgcgacacctacatgctgctgctctgggtgcagaacctctaccccaatgacatcatcaacagccccaagctggtgggtgagctgcagggtatggggctcgggagcctcctgccccccaggcagatccgactgctggaggccacattcctgtccagtgaggcggccaatgtgagggagttgatggaccgagctctggagctagaggcacggcgctgggctgaggatgtgcctccccagaggctggacggccactgccacagcgagctggccatcgacatcatccagatcacctcccaggcccaggccaaggccgagagcatcacgctggacttgggctcacagataaagcgggtgctgctggtggagctgcctgcgttcctgaggagctaccagcgcgcctttaatgaatttctggagagaggcaagcagctgacgaattacagggccaatgttattgccaacatcaacaactgcctgtccttccggatgtccatggagcagaattggcaggtaccccaggacaccctgagcctcctgctgggccccctgggtgagctcaagagccacggctttgacaccctgctccagaacctgcatgaggacctgaagccactgttcaagaggttcacgcacacccgctgggcggcccctgtggagaccctggaaaacatcatcgccactgtagacacgaggctgcctgagttctcagagctgcagggctgtttccgggaggagctcatggaggccttgcacctgcacctggtgaaggagtacatcatccaactcagcaaggggcgcctggtcctcaagacggccgagcagcagcagcagctggctgggtacatcctggccaatgctgacaccatccagcacttctgcacccagcacggctccccggcgacctggctgcagcctgctctccctacgctggccgagatcattcgcctgcaggaccccagtgccatcaagattgaggtggccacttatgccacctgctaccctgacttcagcaaaggccacctgagcgctatcctggccatcaaggggaacctatccaacagtgaggtcaagcgcatccggagcatcttggacgtcagcatgggggcgcaggagccctcccggcccctattttcccttataaaggttggttagcttttcctgtggcctgacctgcctgtgagtgcccagcaagccttgggcacaccccgctgggagctgttaagagcagcgctggttctcggttcctcccgggtctcctgtgctctgatgctacttctgcctagccctggcggaggtgcaggccctgtcagctggaactggacagaccttggtttgtttacatgtccgatgggggcaggagctcccatcctgggcagccaaccaggcaacaccaaggactctttgtaaacgatagctgatcgtgtgcacgcaaggaaagaaccaggagggagagtgcagccaggctcagggatccccggacacctctgtccagagcccctccacagtcggcctcatgactgtcctcctcgtgggtggggccgagggccctcttcagctctctggagacaggggccgagcctcacccatctgccctctgcagcccagggccgccgtgagcgggattcagcaatggtggaatggaagacagaactggaagagaaagaaggaaaagatgagctctcgtctggcaggggcttttagggtcctgtggcgagctgtgagcaccgccagcattagacgtcacatccaggtggccccacggcccctacaggctggccctgcaatggggccctgagccctccctcttcatcccccaaggcctcaactagagggtggtcccccgagggcttggtgtctactaccgaagggcccaagacctcctgggtcctctcaggctcccccttccccaaggcagggacaggccctgggggtgccaccgtgggccctgccacccagaagtctggctgaggtctgggcaggggcagggcaagcttgacctctcactgttgaccctttggcctctgtatttgtttcctattgccgtgacaggtttccacaaacttcgtggatcaaaacgaggtcttccagttctgcgggtcagaaggctgacccggggctcaaatctgggtgtcggcagtcctgcactccttctggaggctctaggggagaattcatttctggccttttcatttttagaggctgaccgtaattcttgacttcaggctcctccatcttcagagccagctgtgggtagttgaatctttttcccgtcacctcattgaggcctcccctctcctgcctccctccaccacttttttttttttttttttgagacagggtcttgctgtgttgcccaggctggagtgcagtggcctggtcatggcatcaaggctcactgcagcctggacctcctggttcaagtgatcctcttgtctcagtcccctgagacaatcccccacgcccagctacatattttttgtggatacagggtctcattctgttgcctaggcttgtctggaactcctgggctcaagggatcttgtagccttagcctcctaaagtgctgggattataggcatgagtcactgtacccggcctgctctaccgcttttaaggacgcttatgatcacattgcgcctacccagagaacccaggtcgtctttctattttcaggtcagctgattagccaccttagttccatctgcaactttagttcccactggctgtgtaacctaacatagtcacaggctctggggactgtcacgtggacatctttgggaggccgttattctgcccaccgcaccctccgttcatcccctgccctgccgggcacctcgctctaccccaggaaaatgtgagctcgttttcctgctcggcatgtgctccccctaaggctctgctcctccctgggcctgaaagttccttctcagcctgagagggggcccttcggactcaggcatgactcagcccggctgatgcctctgcagtgctgagtcaggatttggggccggctctcttgggtccgtccccttttcccaggtactgccttacaaagctgtggccaggaagtggccggtataaaggatgcccaaggtctttgtacgtgtgtaggagttagcgtgtttgatattgttaatataataataattattttttagagtactgcttttgtatgtatgttgaacaggatccaggtttttatagcttgatataaaacagaattcaaaagtg

SEQ ID NO: 196364 - DNA, 1429 bp, Homo sapiens
  Payload ID: 18745
  Gene Name: tumor necrosis factor, alpha-induced protein 2
  ENST ID: ENST00000560562
  CDS Start-End: 70-363
ggcaccctcgacttgcctagaggcccccaaaagttgcagtccacatcagaggcagagtcagaggcctccatgtcggaggcctcctctgaggacctggtgccacccctggaggctggggcagccccatatagggaggaggaagaggcggcgaagaagaagaaggagaagaagaagaagtccaaaggcctggccaatgtgttctgcgtcttcaccaaagggaagaagaagaagggtcagcccagctcagcggagcccgaggacgcagccgggtccaggcaggggctggatggcccgccccccacaggccaatgtgagggagttgatggaccgagctctggagctagaggcacggcgctgggctgaggatgtgcctccccagaggctggacggccactgccacagcgagctggccatcgacatcatccagatcacctcccaggcccaggccaaggccgagagcatcacgctggacttgggctcacagataaagcgggtgctgctggtggagctgcctgcgttcctgaggagctaccagcgcgcctttaatgaatttctggagagaggcaagcagctgacgaattacagggccaatgttattgccaacatcaacaactgcctgtccttccggatgtccatggagcagaattggcaggtaccccaggacaccctgagcctcctgctgggccccctgggtgagctcaagagccacggctttgacaccctgctccagaacctgcatgaggacctgaagccactgttcaagaggttcacgcacacccgctgggcggcccctgtggagaccctggaaaacatcatcgccactgtagacacgaggctgcctgagttctcagagctgcagggctgtttccgggagggctccccggcgacctggctgcagcctgctctccctacgctggccgagatcattcgcctgcaggaccccagtgccatcaagattgaggtggccacttatgccacctgctaccctgacttcagcaaaggccacctgagcgctatcctggccatcaaggggaacctatccaacagtgaggtcaagcgcatccggagcatcttggacgtcagcatgggggcgcaggagccctcccggcccctattttcccttataaaggttggttagcttttcctgtggcctgacctgcctgtgagtgcccagcaagccttgggcacaccccgctgggagctgttaagagcagcgctggttctcggttcctcccgggtctcctgtgctctgatgctacttctgcctagccctggcggaggtgcaggccctgtcagctggaactggacagaccttggtttgtttacatgtccgatgggggcaggagctcccatcctgggcagccaaccaggcaacaccaaggactctttgtaaacgatagctgatcgtgtgcacgcaaggaaagaacca

SEQ ID NO: 196365 - DNA, 1410 bp, Homo sapiens
  Payload ID: 18745
  Gene Name: tumor necrosis factor, alpha-induced protein 2
  ENST ID: ENST00000559255
  CDS Start-End: 1-731
agccactgttcaagaggttcacgcacacccgctgggcggcccctgtggagaccctggaaaacatcatcgccactgtagacacgaggctgcctgagttctcagagctgcagggctgtttccgggaggagctcatggaggccttgcacctgcacctggtgaaggagtacatcatccaactcagcaaggggcgcctggtcctcaagacggccgagcagcagcagcagctggctgggtacatcctggccaatgctgacaccatccagcacttctgcacccagcacggctccccggcgacctggctgcagcctgctctccctacgctggccgagatcattcgcctgcaggaccccagtgccatcaagattgaggtggccacttatgccacctgctaccctgacttcagcaaaggccacctgagcgctatcctggccatcaaggggaacctatccaacagtgaggtcaagcgcatccggagcatcttggacgtcagcatgggggcgcaggagccctcccggcccctattttcccttataaagcccagggccgccgtgagcgggattcagcaatggtggaatggaagacagaactggaagagaaagaaggaaaagatgagctctcgtctggcaggggcttttagggtcctgtggcgagctgtgagcaccgccagcattagacgtcacatccaggtggccccacggcccctacaggctggccctgcaatggggccctgagccctccctcttcatcccccaaggcctcaactagagggtggtcccccgagggcttggtgtctactaccgaagggcccaagacctcctgggtcctctcaggctcccccttccccaaggcagggacaggccctgggggtgccaccgtgggccctgccacccagaagtctggctgaggtctgggcaggggcagggcaagcttgacctctcactgttgaccctttggcctctgtatttgtttcctattgccgtgacaggtttccacaaacttcgtggatcaaaacgaggtcttccagttctgcgggtcagaaggctgacccggggctcaaatctgggtgtcggcagtcctgcactccttctggaggctctaggggagaattcatttctggccttttcatttttagaggctgaccgtaattcttgacttcaggctcctccatcttcagagccagctgtgggtagttgaatctttttcccgtcacctcattgaggcctcccctctcctgcctccctccaccacttttttttttttttttttgagacagggtcttgctgtgttgcccaggctggagtgcagtggcctggtcatggcatcaaggctcactgcagcctggacctcctggttcaagtgatcctcttgtctcagtcccctgagacaatcccccacgcccagctacatatt

SEQ ID NO: 196366 - DNA, 1799 bp, Homo sapiens
  Payload ID: 18745
  Gene Name: tumor necrosis factor, alpha-induced protein 2
  ENST ID: ENST00000559406
  CDS Start-End: 70-216
ggcaccctcgacttgcctagaggcccccaaaagttgcagtccacatcagaggcagagtcagaggcctccatgtcggaggcctcctctgaggacctggtgccacccctggaggctggggcagccccatatagggaggaggaagaggcggcgaagaagaagaaggagaagaagaagaagtccccgagagcgtctttctgcacttgggccgcaccatgaaggaggacctggaggccgtggtggagcggctgaagccgctgttccccgccgagttcggcgtcgtggcggcctacgccgagagctaccaccagcacttcgcggcccacctggccgccgtggcgcagttcgagctgtgcgagcgcgacacctacatgctgctgctctgggtgcagaacctctaccccaatgacatcatcaacagccccaagctggtgggtgagctgcagggtatggggctcgggagcctcctgccccccaggcagatccgactgctggaggccacattcctgtccagtgaggcggccaatgtgagggagttgatggaccgagctctggagctagaggcacggcgctgggctgaggatgtgcctccccagaggctggacggccactgccacagcgagctggccatcgacatcatccagatcacctcccaggcccaggccaaggccgagagcatcacgctggacttgggctcacagataaagcgggtgctgctggtggagctgcctgcgttcctgaggagctaccagcgcgcctttaatgaatttctggagagaggcaagcagctgacgaattacagggccaatgttattgccaacatcaacaactgcctgtccttccggatgtccatggagcagaattggcaggtaccccaggacaccctgagcctcctgctgggccccctgggtgagctcaagagccacggctttgacaccctgctccagaacctgcatgaggacctgaagccactgttcaagaggttcacgcacacccgctgggcggcccctgtggagaccctggaaaacatcatcgccactgtagacacgaggctgcctgagttctcagagctgcagggctgtttccgggaggagctcatggaggccttgcacctgcacctggtgaaggagtacatcatccaactcagcaaggggcgcctggtcctcaagacggccgagcagcagcagcagctggctgggtacatcctggccaatgctgacaccatccagcacttctgcacccagcacggctccccggcgacctggctgcagcctgctctccctacgctggccgagatcattcgcctgcaggaccccagtgccatcaagattgaggtggccacttatgccacctgctaccctgacttcagcaaaggccacctgagcgctatcctggccatcaaggggaacctatccaacagtgaggtcaagcgcatccggagcatcttggacgtcagcatgggggcgcaggagccctcccggcccctattttcccttataaaggttggttagcttttcctgtggcctgacctgcctgtgagtgcccagcaagccttgggcacaccccgctgggagctgttaagagcagcgctggttctcggttcctcccgggtctcctgtgctctgatgctacttctgcctagccctggcggaggtgcaggccctgtcagctggaactggacagaccttggtttgtttacatgtccgatgggggcaggagctcccatcctgggcagccaaccaggcaacaccaaggactctttgtaaacgatagctgatcgtgtgcacgcaaggaaagaacca

SEQ ID NO: 196367 - DNA, 421 bp, Homo sapiens
  Payload ID: 18745
  Gene Name: tumor necrosis factor, alpha-induced protein 2
  ENST ID: ENST00000558056
  CDS Start-End: 304-421
agtggcggccaggccgggacacgctgcctcggagagcggagacctggggcgaggcccagggggctgcagcaggaccttcaggcgctctgggtttcgtgtcacagaggggagaaggcggtgatgctgtgggggtcctgcgggagctgtgcctggaggagcctgcaggcctgaaccagggtgatgctgaagatgatgaccttcttccaaggcctctagagccatcagcctgtgccaggcaccctcgacttgcctagaggcccccaaaagttgcagtccacatcagaggcagagtcagaggcctccatgtcggaggcctcctctgaggacctggtgccacccctggaggctggggcagccccatatagggaggaggaagaggcggcgaagaagaagaaggagaagaagaagaagtccaaaggcc

SEQ ID NO: 196368 - DNA, 1334 bp, Homo sapiens
  Payload ID: 18745
  Gene Name: tumor necrosis factor, alpha-induced protein 2
  ENST ID: ENST00000560670
  CDS Start-End: 1-1044
gtgcgagcgcgacacctacatgctgctgctctgggtgcagaacctctaccccaagccaatgtgagggagttgatggaccgagctctggagctagaggcacggcgctgggctgaggatgtgcctccccagaggctggacggccactgccacagcgagctggccatcgacatcatccagatcacctcccaggcccaggccaaggccgagagcatcacgctggacttgggctcacagataaagcgggtgctgctggtggagctgcctgcgttcctgaggagctaccagcgcgcctttaatgaatttctggagagaggcaagcagctgacgaattacagggccaatgttattgccaacatcaacaactgcctgtccttccggatgtccatggagcagaattggcaggtaccccaggacaccctgagcctcctgctgggccccctgggtgagctcaagagccacggctttgacaccctgctccagaacctgcatgaggacctgaagccactgttcaagaggttcacgcacacccgctgggcggcccctgtggagaccctggaaaacatcatcgccactgtagacacgaggctgcctgagttctcagagctgcagggctgtttccgggaggagctcatggaggccttgcacctgcacctggtgaaggagtacatcatccaactcagcaaggggcgcctggtcctcaagacggccgagcagcagcagcagctggctgggtacatcctggccaatgctgacaccatccagcacttctgcacccagcacggctccccggcgacctggctgcagcctgctctccctacgctggccgagatcattcgcctgcaggaccccagtgccatcaagattgaggtggccacttatgccacctgctaccctgacttcagcaaaggccacctgagcgctatcctggccatcaaggggaacctatccaacagtgaggtcaagcgcatccggagcatcttggacgtcagcatgggggcgcaggagccctcccggcccctattttcccttataaaggttggttagcttttcctgtggcctgacctgcctgtgagtgcccagcaagccttgggcacaccccgctgggagctgttaagagcagcgctggttctcggttcctcccgggtctcctgtgctctgatgctacttctgcctagccctggcggaggtgcaggccctgtcagctggaactggacagaccttggtttgtttacatgtccgatgggggcaggagctcccatcctgggcagccaaccaggcaacaccaaggactctttgtaaacgatagctgatcgtgtgcacgcaaggaaagaacc

SEQ ID NO: 196369 - DNA, 590 bp, Homo sapiens
  Payload ID: 18745
  Gene Name: tumor necrosis factor, alpha-induced protein 2
  ENST ID: ENST00000561156
  CDS Start-End: 1-200
tgacgaattacagggccaatgttattgccaacatcaacaactgcctgtccttccggatgtccatggagcagaattggcaggtaccccaggacaccctgagcctcctgctgggccccctgggtgagctcaagagccacggctttgacaccctgctccagaacctgcatgaggacctgaagcccttcctctccagggcgtgactagacatcctgcctctcctgtctcagccactgttcaagaggttcacgcacacccgctgggcggcccctgtggagaccctggaaaacatcatcgccactgtagacacgaggctgcctgagttctcagagctgcagggctgtttccgggaggagctcatggaggccttgcacctgcacctggtgaaggagtacatcatccaactcagcaaggggcgcctggtcctcaagacggccgagcagcagcagcagctggctgggtacatcctggccaatgctgacaccatccagcacttctgcacccagcacggctccccggcgacctggctgcagcctgctctccctacgctggccgagatcattcgcctgcaggaccccagtgccatcaagatt

SEQ ID NO: 196370 - DNA, 4432 bp, Homo sapiens
  Payload ID: 18746
  Gene Name: tumor necrosis factor, alpha-induced protein 3
  Uniprot ID: P21580
  ENST ID: ENST00000237289
  CDS Start-End: 67-2439
tgccttgaccaggacttgggactttgcgaaaggatcgcggggcccggagaggtgttggagagcacaatggctgaacaagtccttcctcaggctttgtatttgagcaatatgcggaaagctgtgaagatacgggagagaactccagaagacatttttaaacctactaatgggatcattcatcattttaaaaccatgcaccgatacacactggaaatgttcagaacttgccagttttgtcctcagtttcgggagatcatccacaaagccctcatcgacagaaacatccaggccaccctggaaagccagaagaaactcaactggtgtcgagaagtccggaagcttgtggcgctgaaaacgaacggtgacggcaattgcctcatgcatgccacttctcagtacatgtggggcgttcaggacacagacttggtactgaggaaggcgctgttcagcacgctcaaggaaacagacacacgcaactttaaattccgctggcaactggagtctctcaaatctcaggaatttgttgaaacggggctttgctatgatactcggaactggaatgatgaatgggacaatcttatcaaaatggcttccacagacacacccatggcccgaagtggacttcagtacaactcactggaagaaatacacatatttgtcctttgcaacatcctcagaaggccaatcattgtcatttcagacaaaatgctaagaagtttggaatcaggttccaatttcgcccctttgaaagtgggtggaatttacttgcctctccactggcctgcccaggaatgctacagataccccattgttctcggctatgacagccatcattttgtacccttggtgaccctgaaggacagtgggcctgaaatccgagctgttccacttgttaacagagaccggggaagatttgaagacttaaaagttcactttttgacagatcctgaaaatgagatgaaggagaagctcttaaaagagtacttaatggtgatagaaatccccgtccaaggctgggaccatggcacaactcatctcatcaatgccgcaaagttggatgaagctaacttaccaaaagaaatcaatctggtagatgattactttgaacttgttcagcatgagtacaagaaatggcaggaaaacagcgagcaggggaggagagaggggcacgcccagaatcccatggaaccttccgtgccccagctttctctcatggatgtaaaatgtgaaacgcccaactgccccttcttcatgtctgtgaacacccagcctttatgccatgagtgctcagagaggcggcaaaagaatcaaaacaaactcccaaagctgaactccaagccgggccctgaggggctccctggcatggcgctcggggcctctcggggagaagcctatgagcccttggcgtggaaccctgaggagtccactggggggcctcattcggccccaccgacagcacccagcccttttctgttcagtgagaccactgccatgaagtgcaggagccccggctgccccttcacactgaatgtgcagcacaacggattttgtgaacgttgccacaacgcccggcaacttcacgccagccacgccccagaccacacaaggcacttggatcccgggaagtgccaagcctgcctccaggatgttaccaggacatttaatgggatctgcagtacttgcttcaaaaggactacagcagaggcctcctccagcctcagcaccagcctccctccttcctgtcaccagcgttccaagtcagatccctcgcggctcgtccggagcccctccccgcattcttgccacagagctggaaacgacgcccctgctggctgcctgtctcaagctgcacggactcctggggacaggacggggacgagcaagtgcagaaaagccggctgcgtgtattttgggactccagaaaacaagggcttttgcacactgtgtttcatcgagtacagagaaaacaaacattttgctgctgcctcagggaaagtcagtcccacagcgtccaggttccagaacaccattccgtgcctggggagggaatgcggcacccttggaagcaccatgtttgaaggatactgccagaagtgtttcattgaagctcagaatcagagatttcatgaggccaaaaggacagaagagcaactgagatcgagccagcgcagagatgtgcctcgaaccacacaaagcacctcaaggcccaagtgcgcccgggcctcctgcaagaacatcctggcctgccgcagcgaggagctctgcatggagtgtcagcatcccaaccagaggatgggccctggggcccaccggggtgagcctgcccccgaagacccccccaagcagcgttgccgggcccccgcctgtgatcattttggcaatgccaagtgcaacggctactgcaacgaatgctttcagttcaagcagatgtatggctaaccggaaacaggtgggtcacctcctgcaagaagtggggcctcgagctgtcagtcatcatggtgctatcctctgaacccctcagctgccactgcaacagtgggcttaagggtgtctgagcaggagaggaaagataagctcttcgtggtgcccacgatgctcaggtttggtaacccgggagtgttcccaggtggccttagaaagcaaagcttgtaactggcaagggatgatgtcagattcagcccaaggttcctcctctcctaccaagcaggaggccaggaacttctttggacttggaaggtgtgcggggactggccgaggcccctgcaccctgcgcatcaggactgcttcatcgtcttggctgagaaagggaaaagacacacaagtcgcgtgggttggagaagccagagccattccacctcccctcccccagcatctctcagagatgtgaagccagatcctcatggcagcgaggccctctgcaagaagctcaaggaagctcagggaaaatggacgtattcagagagtgtttgtagttcatggtttttccctacctgcccggttcctttcctgaggacccggcagaaatgcagaaccatccatggactgtgattctgaggctgctgagactgaacatgttcacattgacagaaaaacaagctgctctttataatatgcaccttttaaaaaattagaatattttactgggaagacgtgtaactctttgggttattactgtctttacttctaaagaagttagcttgaactgaggagtaaaagtgtgtacatatataatatacccttacattatgtatgagggatttttttaaattatattgaaatgctgccctagaagtacaataggaaggctaaataataataacctgttttctggttgttgttggggcatgagcttgtgtatacactgcttgcataaactcaaccagctgcctttttaaagggagctctagtcctttttgtgtaattcactttatttattttattacaaacttcaagattatttaagtgaagatatttcttcagctctggggaaaatgccacagtgttctcctgagagaacatccttgctttgagtcaggctgtgggcaagttcctgaccacagggagtaaattggcctctttgatacacttttgcttgcctccccaggaaagaaggaattgcatccaaggtatacatacatattcatcgatgtttcgtgcttctccttatgaaactccagctatgtaataaaaaactatactctgtgttctgttaatgcctctgagtgtcctacctccttggagatgagatagggaaggagcagggatgagactggcaatggtcacagggaaagatgtggccttttgtgatggttttattttctgttaacactgtgtcctgggggggctgggaagtcccctgcatcccatggtaccctggtattgggacagcaaaagccagtaaccatgagtatgaggaaatctctttctgttgctggcttacagtttctctgtgtgctttgtggttgctgtcatatttgctctagaagaaaaaaaaaaaaggaggggaaatgcattttccccagagataaaggctgccattttgggggtctgtacttatggcctgaaaatatttgtgatccataactctacacagcctttactcatactattaggcacactttccccttagagccccctaagtttttcccagacgaatctttataatttctttccaaagataccaaataaacttcagtgttttcatctaattctcttaaagttgatatcttaatattttgtgttgatcattatttccattcttaatgtgaaaaaaagtaattatttatacttattataaaaagtatttgaaatttgcacatttaattgtccctaatagaaagccacctattctttgttggatttcttcaagtttttctaaataaatgtaacttttcacaagagtcaacattaaaaaataaattatttaagaaca

SEQ ID NO: 196371 - DNA, 421 bp, Homo sapiens
  Payload ID: 18746
  Gene Name: tumor necrosis factor, alpha-induced protein 3
  ENST ID: ENST00000421450
  CDS Start-End: 345-421
gggcctacaacccgcatacaactgaaacggggcaaagcagactgcgcagtctgcagtcttcgtggcgggccaagcgagcttggagcccgcgggggcggagcggtgagagcggccgccaagagagatcacacccccagccgaccctgccagcgagcgagcccgaccccaggcgtccatggagcgtcgcctccgcccggtccctgccccgacccccgcctgcggcgcgctcctgccttgaccaggacttgggactttgcgaaaggatcgcggggcccggagaggtaaccgccgcgcctcccggagaggtaaccgccgcgcctcccggagaggtgttggagagcacaatggctgaacaagtccttcctcaggctttgtatttgagcaatatgcggaaagctgtgaagatacgggagagaactcc

SEQ ID NO: 196372 - DNA, 698 bp, Homo sapiens
  Payload ID: 18746
  Gene Name: tumor necrosis factor, alpha-induced protein 3
  ENST ID: ENST00000420009
  CDS Start-End: 213-698
gcggccgccaagagagatcacacccccagccgaccctgccagcgagcgagcccgaccccaggcgtccatggagcgtcgcctccgcccggtccctgccccgacccccgcctgcggcgcgctcctgccttgaccaggacttgggactttgcgaaaggatcgcggggcccggagaggtaaccgccgcgcctcccggagaggtgttggagagcacaatggctgaacaagtccttcctcaggctttgtatttgagcaatatgcggaaagctgtgaagatacgggagagaactccagaagacatttttaaacctactaatgggatcattcatcattttaaaaccatgcaccgatacacactggaaatgttcagaacttgccagttttgtcctcagtttcgggagatcatccacaaagccctcatcgacagaaacatccaggccaccctggaaagccagaagaaactcaactggtgtcgagaagtccggaagcttgtggcgctgaaaacgaacggtgacggcaattgcctcatgcatgccacttctcagtacatgtggggcgttcaggacacagacttggtactgaggaaggcgctgttcagcacgctcaaggaaacagacacacgcaactttaaattccgctggcaactggagtctctcaaatctcaggaatttgttgaaacggggctttgctatgatactcgg

SEQ ID NO: 196373 - DNA, 465 bp, Homo sapiens
  Payload ID: 18746
  Gene Name: tumor necrosis factor, alpha-induced protein 3
  ENST ID: ENST00000433680
  CDS Start-End: 171-465
accgcagtcaagggctgcgggtgcatgttgggcagcgacccccgggctggcaccgtctacctggcgttggttttgcagcgctcctggactgggagtttgttggacgtttctgtctgggttttgaagtgctgggagttgaggtcactgctgcagaggtgttggagagcacaatggctgaacaagtccttcctcaggctttgtatttgagcaatatgcggaaagctgtgaagatacgggagagaactccagaagacatttttaaacctactaatgggatcattcatcattttaaaaccatgcaccgatacacactggaaatgttcagaacttgccagttttgtcctcagtttcgggagatcatccacaaagccctcatcgacagaaacatccaggccaccctggaaagccagaagaaactcaactggtgtcgagaagtccggaagcttgtggcgctgaaaacgaacg

SEQ ID NO: 196374 - DNA, 2267 bp, Homo sapiens
  Payload ID: 18746
  Gene Name: tumor necrosis factor, alpha-induced protein 3
  ENST ID: ENST00000619035
  CDS Start-End: 18-2267
aggtgttggagagcacaatggctgaacaagtccttcctcaggctttgtatttgagcaatatgcggaaagctgtgaagatacgggagagaactccagaagacatttttaaacctactaatgggatcattcatcattttaaaaccatgcaccgatacacactggaaatgttcagaacttgccagttttgtcctcagtttcgggagatcatccacaaagccctcatcgacagaaacatccaggccaccctggaaagccagaagaaactcaactggtgtcgagaagtccggaagcttgtggcgctgaaaacgaacggtgacggcaattgcctcatgcatgccacttctcagtacatgtggggcgttcaggacacagacttggtactgaggaaggcgctgttcagcacgctcaaggaaacagacacacgcaactttaaattccgctggcaactggagtctctcaaatctcaggaatttgttgaaacggggctttgctatgatactcggaactggaatgatgaatgggacaatcttatcaaaatggcttccacagacacacccatggcccgaagtggacttcagtacaactcactggaagaaatacacatatttgtcctttgcaacatcctcagaaggccaatcattgtcatttcagacaaaatgctaagaagtttggaatcaggttccaatttcgcccctttgaaagtgggtggaatttacttgcctctccactggcctgcccaggaatgctacagataccccattgttctcggctatgacagccatcattttgtacccttggtgaccctgaaggacagtgggcctgaaatccgagctgttccacttgttaacagagaccggggaagatttgaagacttaaaagttcactttttgacagatcctgaaaatgagatgaaggagaagctcttaaaagagtacttaatggtgatagaaatccccgtccaaggctgggaccatggcacaactcatctcatcaatgccgcaaagttggatgaagctaacttaccaaaagaaatcaatctggtagatgattactttgaacttgttcagcatgagtacaagaaatggcaggaaaacagcgagcaggggaggagagaggggcacgcccagaatcccatggaaccttccgtgccccagctttctctcatggatgtaaaatgtgaaacgcccaactgccccttcttcatgtctgtgaacacccagcctttatgccatgagtgctcagagaggcggcaaaagaatcaaaacaaactcccaaagctgaactccaagccgggccctgaggggctccctggcatggcgctcggggcctctcggggagaagcctatgagcccttggcgtggaaccctgaggagtccactggggggcctcattcggccccaccgacagcacccagcccttttctgttcagtgagaccactgccatgaagtgcaggagccccggctgccccttcacactgaatgtgcagcacaacggattttgtgaacgttgccacaacgcccggcaacttcacgccagccacgccccagaccacacaaggcacttggatcccgggaagtgccaagcctgcctccaggatgttaccaggacatttaatgggatctgcagtacttgcttcaaaaggactacagcagaggcctcctccagcctcagcaccagcctccctccttcctgtcaccagcgttccaagtcagatccctcgcggctcgtccggagcccctccccgcattcttgccacagagctggaaacgacgcccctgctggctgcctgtctcaagctgcacggactcctggggacaggacggggacgagcaagtgcagaaaagccggctgcgtgtattttgggactccagaaaacaagggcttttgcacactgtgtttcatcgagtacagagaaaacaaacattttgctgctgcctcagggaaagtcagtcccacagcgtccaggttccagaacaccattccgtgcctggggagggaatgcggcacccttggaagcaccatgtttgaaggatactgccagaagtgtttcattgaagctcagaatcagagatttcatgaggccaaaaggacagaagagcaactgagatcgagccagcgcagagatgtgcctcgaaccacacaaagcacctcaaggcccaagtgcgcccgggcctcctgcaagaacatcctggcctgccgcagcgaggagctctgcatggagtgtcagcatcaaccagaggatgggccctggggcccaccggggtga

SEQ ID NO: 196375 - DNA, 3818 bp, Homo sapiens
  Payload ID: 18746
  Gene Name: tumor necrosis factor, alpha-induced protein 3
  ENST ID: ENST00000615468
  CDS Start-End: 18-662
aggtgttggagagcacaatggctgaacaagtccttcctcaggctttgtatttgagcaatatgcggaaagctgtgaagatacgggagagaactccagaagacatttttaaacctactaatgggatcattcatcattttaaaaccatgcaccgatacacactggaaatgttcagaacttgccagttttgtcctcagtttcgggagatcatccacaaagccctcatcgacagaaacatccaggccaccctggaaagccagaagaaactcaactggtgtcgagaagtccggaagcttgtggcgctgaaaacgaacggtgacggcaattgcctcatgcatgccacttctcagtacatgtggggcgttcaggacacagacttggtactgaggaaggcgctgttcagcacgctcaaggaaacagacacacgcaactttaaattccgctggcaactggagtctctcaaatctcaggaatttgttgaaacggggctttgctatgatactcggaactggaatgatgaatgggacaatcttatcaaatggcttccacagacacacccatggcccgaagtggacttcagtacaactcactggaagaaatacacatatttgtcctttgcaacatcctcagaaggccaatcattgtcatttcagacaaaatgctaagaagtttggaatcaggttccaatttcgcccctttgaaagtgggtggaatttacttgcctctccactggcctgcccaggaatgctacagataccccattgttctcggctatgacagccatcattttgtacccttggtgaccctgaaggacagtgggcctgaaatccgagctgttccacttgttaacagagaccggggaagatttgaagacttaaaagttcactttttgacagatcctgaaaatgagatgaaggagaagctcttaaaagagtacttaatggtgatagaaatccccgtccaaggctgggaccatggcacaactcatctcatcaatgccgcaaagttggatgaagctaacttaccaaaagaaatcaatctggtagatgattactttgaacttgttcagcatgagtacaagaaatggcaggaaaacagcgagcaggggaggagagaggggcacgcccagaatcccatggaaccttccgtgccccagctttctctcatggatgtaaaatgtgaaacgcccaactgccccttcttcatgtctgtgaacacccagcctttatgccatgagtgctcagagaggcggcaaaagaatcaaaacaaactcccaaagctgaactccaagccgggccctgaggggctccctggcatggcgctcggggcctctcggggagaagcctatgagcccttggcgtggaaccctgaggagtccactggggggcctcattcggccccaccgacagcacccagcccttttctgttcagtgagaccactgccatgaagtgcaggagccccggctgccccttcacactgaatgtgcagcacaacggattttgtgaacgttgccacaacgcccggcaacttcacgccagccacgccccagaccacacaaggcacttggatcccgggaagtgccaagcctgcctccaggatgttaccaggacatttaatgggatctgcagtacttgcttcaaaaggactacagcagaggcctcctccagcctcagcaccagcctccctccttcctgtcaccagcgttccaagtcagatccctcgcggctcgtccggagcccctccccgcattcttgccacagagctggaaacgacgcccctgctggctgcctgtctcaagctgcacggactcctggggacaggacggggacgagcaagtgcagaaaagccggctgcgtgtattttgggactccagaaaacaagggcttttgcacactgtgtttcatcgagtacagagaaaacaaacattttgctgctgcctcagggaaagtcagtcccacagcgtccaggttccagaacaccattccgtgcctggggagggaatgcggcacccttggaagcaccatgtttgaaggatactgccagaagtgtttcattgaagctcagaatcagagatttcatgaggccaaaaggacagaagagcaactgagatcgagccagcgcagagatgtgcctcgaaccacacaaagcacctcaaggcccaagtgcgcccgggcctcctgcaagaacatcctggcctgccgcagcgaggagctctgcatggagtgtcagcatcccaaccagaggatgggccctggggcccaccggggtgagcctgcccccgaagacccccccaagcagcgttgccgggcccccgcctgtgatcattttggcaatgccaagtgcaacggctactgcaacgaatgctttcagttcaagcagatgtatggctaaccggaaacaggtgggtcacctcctgcaagaagtggggcctcgagctgtcagtcatcatggtgctatcctctgaacccctcagctgccactgcaacagtgggcttaagggtgtctgagcaggagaggaaagataagctcttcgtggtgcccacgatgctcaggtttggtaacccgggagtgttcccaggtggccttagaaagcaaagcttgtaactggcaagggatgatgtcagattcagcccaaggttcctcctctcctaccaagcaggaggccaggaacttctttggacttggaaggtgtgcggggactggccgaggcccctgcaccctgcgcatcaggactgcttcatcgtcttggctgagaaagggaaaagacacacaagtcgcgtgggttggagaagccagagccattccacctcccctcccccagcatctctcagagatgtgaagccagatcctcatggcagcgaggccctctgcaagaagctcaaggaagctcagggaaaatggacgtattcagagagtgtttgtagttcatggtttttccctacctgcccggttcctttcctgaggacccggcagaaatgcagaaccatccatggactgtgattctgaggctgctgagactgaacatgttcacattgacagaaaaacaagctgctctttataatatgcaccttttaaaaaattagaatattttactgggaagacgtgtaactctttgggttattactgtctttacttctaaagaagttagcttgaactgaggagtaaaagtgtgtacatatataatatacccttacattatgtatgagggatttttttaaattatattgaaatgctgccctagaagtacaataggaaggctaaataataataacctgttttctggttgttgttggggcatgagcttgtgtatacactgcttgcataaactcaaccagctgcctttttaaagggagctctagtcctttttgtgtaattcactttatttattttattacaaacttcaagattatttaagtgaagatatttcttcagctctggggaaaatgccacagtgttctcctgagagaacatccttgctttgagtcaggctgtgggcaagttcctgaccacagggagtaaattggcctctttgatacacttttgcttgcctccccaggaaagaaggaattgcatccaaggtatacatacatattcatcgatgtttcgtgcttctccttatgaaactccagctatgtaataaaaaactatactctgtgttctgttaatgcctctgagtgtcctacctccttggagatgagatagggaaggagcagggatgagactggcaatggtcacagggaaagatgtggccttttgtgatggttttattttctgttaacactgtgtcctgggggggctgggaagtcccctgcatcccatg

SEQ ID NO: 196376 - DNA, 1430 bp, Homo sapiens
  Payload ID: 18746
  Gene Name: tumor necrosis factor, alpha-induced protein 3
  ENST ID: ENST00000614035
  CDS Start-End: 18-1430
aggtgttggagagcacaatggctgaacaagtccttcctcaggctttgtatttgagcaatatgcggaaagctgtgaagatacgggagagaactccagaagacatttttaaacctactaatgggatcattcatcattttaaaaccatgcaccgatacacactggaaatgttcagaacttgccagttttgtcctcagtttcgggagatcatccacaaagccctcatcgacagaaacatccaggccaccctggaaagccagaagaaactcaactggtgtcgagaagtccggaagcttgtggcgctgaaaacgaacggtgacggcaattgcctcatgcatgccacttctcagtacatgtggggcgttcaggacacagacttggtactgaggaaggcgctgttcagcacgctcaaggaaacagacacacgcaactttaaattccgctggcaactggagtctctcaaatctcaggaatttgttgaaacggggctttgctatgatactcggaactggaatgatgaatgggacaatcttatcaaaatggcttccacagacacacccatggcccgaagtggacttcagtacaactcactggaagaaatacacatatttgtcctttgcaacatcctcagaaggccaatcattgtcatttcagacaaaatgctaagaagtttggaatcaggttccaatttcgcccctttgaaagtgggtggaatttacttgcctctccactggcctgcccaggaatgctacagataccccattgttctcggctatgacagccatcattttgtacccttggtgaccctgaaggacagtgggcctgaaatccgagctgttccacttgttaacagagaccggggaagatttgaagacttaaaagttcactttttgacagatcctgaaaatgagatgaaggagaagctcttaaaagagtacttaatggtgatagaaatccccgtccaaggctgggaccatggcacaactcatctcatcaatgccgcaaagttggatgaagctaacttaccaaaagaaatcaatctggtagatgattactttgaacttgttcagcatgagtacaagaaatggcaggaaaacagcgagcaggggaggagagaggggcacgcccagaatcccatggaaccttccgtgccccagctttctctcatggatgtaaaatgtgaaacgcccaactgccccttcttcatgtctgtgaacacccagcctttatgccatgagtgctcagagaggcggcaaaagaatcaaaacaaactcccaaagctgaactccaagccgggccctgaggggctccctggcatggcgctcggggcctctcggggagaagcctatgagcccttggcgtggaaccctgaggagtccactggggggtcattcggccccaccgacagcacccagcccttttctgttcagtga

SEQ ID NO: 196377 - DNA, 3817 bp, Homo sapiens
  Payload ID: 18746
  Gene Name: tumor necrosis factor, alpha-induced protein 3
  ENST ID: ENST00000620204
  CDS Start-End: 18-2027
aggtgttggagagcacaatggctgaacaagtccttcctcaggctttgtatttgagcaatatgcggaaagctgtgaagatacgggagagaactccagaagacatttttaaacctactaatgggatcattcatcattttaaaaccatgcaccgatacacactggaaatgttcagaacttgccagttttgtcctcagtttcgggagatcatccacaaagccctcatcgacagaaacatccaggccaccctggaaagccagaagaaactcaactggtgtcgagaagtccggaagcttgtggcgctgaaaacgaacggtgacggcaattgcctcatgcatgccacttctcagtacatgtggggcgttcaggacacagacttggtactgaggaaggcgctgttcagcacgctcaaggaaacagacacacgcaactttaaattccgctggcaactggagtctctcaaatctcaggaatttgttgaaacggggctttgctatgatactcggaactggaatgatgaatgggacaatcttatcaaaatggcttccacagacacacccatggcccgaagtggacttcagtacaactcactggaagaaatacacatatttgtcctttgcaacatcctcagaaggccaatcattgtcatttcagacaaaatgctaagaagtttggaatcaggttccaatttcgcccctttgaaagtgggtggaatttacttgcctctccactggcctgcccaggaatgctacagataccccattgttctcggctatgacagccatcattttgtacccttggtgaccctgaaggacagtgggcctgaaatccgagctgttccacttgttaacagagaccggggaagatttgaagacttaaaagttcactttttgacagatcctgaaaatgagatgaaggagaagctcttaaaagagtacttaatggtgatagaaatccccgtccaaggctgggaccatggcacaactcatctcatcaatgccgcaaagttggatgaagctaacttaccaaaagaaatcaatctggtagatgattactttgaacttgttcagcatgagtacaagaaatggcaggaaaacagcgagcaggggaggagagaggggcacgcccagaatcccatggaaccttccgtgccccagctttctctcatggatgtaaaatgtgaaacgcccaactgccccttcttcatgtctgtgaacacccagcctttatgccatgagtgctcagagaggcggcaaaagaatcaaaacaaactcccaaagctgaactccaagccgggccctgaggggctccctggcatggcgctcggggcctctcggggagaagcctatgagcccttggcgtggaaccctgaggagtccactggggggcctcattcggccccaccgacagcacccagcccttttctgttcagtgagaccactgccatgaagtgcaggagccccggctgccccttcacactgaatgtgcagcacaacggattttgtgaacgttgccacaacgcccggcaacttcacgccagccacgccccagaccacacaaggcacttggatcccgggaagtgccaagcctgcctccaggatgttaccaggacatttaatgggatctgcagtacttgcttcaaaaggactacagcagaggcctcctccagcctcagcaccagcctccctccttcctgtcaccagcgttccaagtcagatccctcgcggctcgtccggagcccctccccgcattcttgccacagagctggaaacgacgcccctgctggctgcctgtctcaagctgcacggactcctggggacaggacggggacgagcaagtgcagaaaagccggctgcgtgtattttgggactccagaaaacaagggcttttgcacactgtttcatcgagtacagagaaaacaaacattttgctgctgcctcagggaaagtcagtcccacagcgtccaggttccagaacaccattccgtgcctggggagggaatgcggcacccttggaagcaccatgtttgaaggatactgccagaagtgtttcattgaagctcagaatcagagatttcatgaggccaaaaggacagaagagcaactgagatcgagccagcgcagagatgtgcctcgaaccacacaaagcacctcaaggcccaagtgcgcccgggcctcctgcaagaacatcctggcctgccgcagcgaggagctctgcatggagtgtcagcatcccaaccagaggatgggccctggggcccaccggggtgagcctgcccccgaagacccccccaagcagcgttgccgggcccccgcctgtgatcattttggcaatgccaagtgcaacggctactgcaacgaatgctttcagttcaagcagatgtatggctaaccggaaacaggtgggtcacctcctgcaagaagtggggcctcgagctgtcagtcatcatggtgctatcctctgaacccctcagctgccactgcaacagtgggcttaagggtgtctgagcaggagaggaaagataagctcttcgtggtgcccacgatgctcaggtttggtaacccgggagtgttcccaggtggccttagaaagcaaagcttgtaactggcaagggatgatgtcagattcagcccaaggttcctcctctcctaccaagcaggaggccaggaacttctttggacttggaaggtgtgcggggactggccgaggcccctgcaccctgcgcatcaggactgcttcatcgtcttggctgagaaagggaaaagacacacaagtcgcgtgggttggagaagccagagccattccacctcccctcccccagcatctctcagagatgtgaagccagatcctcatggcagcgaggccctctgcaagaagctcaaggaagctcagggaaaatggacgtattcagagagtgtttgtagttcatggtttttccctacctgcccggttcctttcctgaggacccggcagaaatgcagaaccatccatggactgtgattctgaggctgctgagactgaacatgttcacattgacagaaaaacaagctgctctttataatatgcaccttttaaaaaattagaatattttactgggaagacgtgtaactctttgggttattactgtctttacttctaaagaagttagcttgaactgaggagtaaaagtgtgtacatatataatatacccttacattatgtatgagggatttttttaaattatattgaaatgctgccctagaagtacaataggaaggctaaataataataacctgttttctggttgttgttggggcatgagcttgtgtatacactgcttgcataaactcaaccagctgcctttttaaagggagctctagtcctttttgtgtaattcactttatttattttattacaaacttcaagattatttaagtgaagatatttcttcagctctggggaaaatgccacagtgttctcctgagagaacatccttgctttgagtcaggctgtgggcaagttcctgaccacagggagtaaattggcctctttgatacacttttgcttgcctccccaggaaagaaggaattgcatccaaggtatacatacatattcatcgatgtttcgtgcttctccttatgaaactccagctatgtaataaaaaactatactctgtgttctgttaatgcctctgagtgtcctacctccttggagatgagatagggaaggagcagggatgagactggcaatggtcacagggaaagatgtggccttttgtgatggttttattttctgttaacactgtgtcctgggggggctgggaagtcccctgcatcccatg

SEQ ID NO: 196378 - DNA, 4735 bp, Homo sapiens
  Payload ID: 18746
  Gene Name: tumor necrosis factor, alpha-induced protein 3
  Uniprot ID: P21580
  ENST ID: ENST00000612899
  CDS Start-End: 371-2743
ctttggaaagtcccgtggaaatccccgggcctacaacccgcatacaactgaaacggggcaaagcagactgcgcagtctgcagtcttcgtggcgggccaagcgagcttggagcccgcgggggcggagcggtgagagcggccgccaagagagatcacacccccagccgaccctgccagcgagcgagcccgaccccaggcgtccatggagcgtcgcctccgcccggtccctgccccgacccccgcctgcggcgcgctcctgccttgaccaggacttgggactttgcgaaaggatcgcggggcccggagaggtaaccgccgcgcctcccggagaggtaaccgccgcgcctcccggagaggtgttggagagcacaatggctgaacaagtccttcctcaggctttgtatttgagcaatatgcggaaagctgtgaagatacgggagagaactccagaagacatttttaaacctactaatgggatcattcatcattttaaaaccatgcaccgatacacactggaaatgttcagaacttgccagttttgtcctcagtttcgggagatcatccacaaagccctcatcgacagaaacatccaggccaccctggaaagccagaagaaactcaactggtgtcgagaagtccggaagcttgtggcgctgaaaacgaacggtgacggcaattgcctcatgcatgccacttctcagtacatgtggggcgttcaggacacagacttggtactgaggaaggcgctgttcagcacgctcaaggaaacagacacacgcaactttaaattccgctggcaactggagtctctcaaatctcaggaatttgttgaaacggggctttgctatgatactcggaactggaatgatgaatgggacaatcttatcaaaatggcttccacagacacacccatggcccgaagtggacttcagtacaactcactggaagaaatacacatatttgtcctttgcaacatcctcagaaggccaatcattgtcatttcagacaaaatgctaagaagtttggaatcaggttccaatttcgcccctttgaaagtgggtggaatttacttgcctctccactggcctgcccaggaatgctacagataccccattgttctcggctatgacagccatcattttgtacccttggtgaccctgaaggacagtgggcctgaaatccgagctgttccacttgttaacagagaccggggaagatttgaagacttaaaagttcactttttgacagatcctgaaaatgagatgaaggagaagctcttaaaagagtacttaatggtgatagaaatccccgtccaaggctgggaccatggcacaactcatctcatcaatgccgcaaagttggatgaagctaacttaccaaaagaaatcaatctggtagatgattactttgaacttgttcagcatgagtacaagaaatggcaggaaaacagcgagcaggggaggagagaggggcacgcccagaatcccatggaaccttccgtgccccagctttctctcatggatgtaaaatgtgaaacgcccaactgccccttcttcatgtctgtgaacacccagcctttatgccatgagtgctcagagaggcggcaaaagaatcaaaacaaactcccaaagctgaactccaagccgggccctgaggggctccctggcatggcgctcggggcctctcggggagaagcctatgagcccttggcgtggaaccctgaggagtccactggggggcctcattcggccccaccgacagcacccagcccttttctgttcagtgagaccactgccatgaagtgcaggagccccggctgccccttcacactgaatgtgcagcacaacggattttgtgaacgttgccacaacgcccggcaacttcacgccagccacgccccagaccacacaaggcacttggatcccgggaagtgccaagcctgcctccaggatgttaccaggacatttaatgggatctgcagtacttgcttcaaaaggactacagcagaggcctcctccagcctcagcaccagcctccctccttcctgtcaccagcgttccaagtcagatccctcgcggctcgtccggagcccctccccgcattcttgccacagagctggaaacgacgcccctgctggctgcctgtctcaagctgcacggactcctggggacaggacggggacgagcaagtgcagaaaagccggctgcgtgtattttgggactccagaaaacaagggcttttgcacactgtgtttcatcgagtacagagaaaacaaacattttgctgctgcctcagggaaagtcagtcccacagcgtccaggttccagaacaccattccgtgcctggggagggaatgcggcacccttggaagcaccatgtttgaaggatactgccagaagtgtttcattgaagctcagaatcagagatttcatgaggccaaaaggacagaagagcaactgagatcgagccagcgcagagatgtgcctcgaaccacacaaagcacctcaaggcccaagtgcgcccgggcctcctgcaagaacatcctggcctgccgcagcgaggagctctgcatggagtgtcagcatcccaaccagaggatgggccctggggcccaccggggtgagcctgcccccgaagacccccccaagcagcgttgccgggcccccgcctgtgatcattttggcaatgccaagtgcaacggctactgcaacgaatgctttcagttcaagcagatgtatggctaaccggaaacaggtgggtcacctcctgcaagaagtggggcctcgagctgtcagtcatcatggtgctatcctctgaacccctcagctgccactgcaacagtgggcttaagggtgtctgagcaggagaggaaagataagctcttcgtggtgcccacgatgctcaggtttggtaacccgggagtgttcccaggtggccttagaaagcaaagcttgtaactggcaagggatgatgtcagattcagcccaaggttcctcctctcctaccaagcaggaggccaggaacttctttggacttggaaggtgtgcggggactggccgaggcccctgcaccctgcgcatcaggactgcttcatcgtcttggctgagaaagggaaaagacacacaagtcgcgtgggttggagaagccagagccattccacctcccctcccccagcatctctcagagatgtgaagccagatcctcatggcagcgaggccctctgcaagaagctcaaggaagctcagggaaaatggacgtattcagagagtgtttgtagttcatggtttttccctacctgcccggttcctttcctgaggacccggcagaaatgcagaaccatccatggactgtgattctgaggctgctgagactgaacatgttcacattgacagaaaaacaagctgctctttataatatgcaccttttaaaaaattagaatattttactgggaagacgtgtaactctttgggttattactgtctttacttctaaagaagttagcttgaactgaggagtaaaagtgtgtacatatataatatacccttacattatgtatgagggatttttttaaattatattgaaatgctgccctagaagtacaataggaaggctaaataataataacctgttttctggttgttgttggggcatgagcttgtgtatacactgcttgcataaactcaaccagctgcctttttaaagggagctctagtcctttttgtgtaattcactttatttattttattacaaacttcaagattatttaagtgaagatatttcttcagctctggggaaaatgccacagtgttctcctgagagaacatccttgctttgagtcaggctgtgggcaagttcctgaccacagggagtaaattggcctctttgatacacttttgcttgcctccccaggaaagaaggaattgcatccaaggtatacatacatattcatcgatgtttcgtgcttctccttatgaaactccagctatgtaataaaaaactatactctgtgttctgttaatgcctctgagtgtcctacctccttggagatgagatagggaaggagcagggatgagactggcaatggtcacagggaaagatgtggccttttgtgatggttttattttctgttaacactgtgtcctgggggggctgggaagtcccctgcatcccatggtaccctggtattgggacagcaaaagccagtaaccatgagtatgaggaaatctctttctgttgctggcttacagtttctctgtgtgctttgtggttgctgtcatatttgctctagaagaaaaaaaaaaaaggaggggaaatgcattttccccagagataaaggctgccattttgggggtctgtacttatggcctgaaaatatttgtgatccataactctacacagcctttactcatactattaggcacactttccccttagagccccctaagtttttcccagacgaatctttataatttctttccaaagataccaaataaacttcagtgttttcatctaattctcttaaagttgatatcttaatattttgtgttgatcattatttccattcttaatgtgaaaaaaagtaattatttatacttattataaaaagtatttgaaatttgcacatttaattgtccctaatagaaagccacctattctttgttggatttcttcaagtttttctaaataaatgtaacttttcacaagagtcaacattaaaaaataaattatttaagaac

SEQ ID NO: 196379 - DNA, 1613 bp, Homo sapiens
  Payload ID: 18746
  Gene Name: tumor necrosis factor, alpha-induced protein 3
  ENST ID: ENST00000621150
  CDS Start-End: 18-1613
aggtgttggagagcacaatggctgaacaagtccttcctcaggctttgtatttgagcaatatgcggaaagctgtgaagatacgggagagaactccagaagacatttttaaacctactaatgggatcattcatcattttaaaaccatgcaccgatacacactggaaatgttcagaacttgccagttttgtcctcagtttcgggagatcatccacaaagccctcatcgacagaaacatccaggccaccctggaaagccagaagaaactcaactggtgtcgagaagtccggaagcttgtggcgctgaaaacgaacggtgacggcaattgcctcatgcatgccacttctcagtacatgtggggcgttcaggacacagacttggtactgaggaaggcgctgttcagcacgctcaaggaaacagacacacgcaactttaaattccgctggcaactggagtctctcaaatctcaggaatttgttgaaacggggctttgctatgatactcggaactggaatgatgaatgggacaatcttatcaaaatggcttccacagacacacccatggcccgaagtggacttcagtacaactcactggaagaaatacacatatttgtcctttgcaacatcctcagaaggccaatcattgtcatttcagacaaaatgctaagaagtttggaatcaggttccaatttcgcccctttgaaagtgggtggaatttacttgcctctccactggcctgcccaggaatgctacagataccccattgttctcggctatgacagccatcattttgtacccttggtgaccctgaaggacagtgggcctgaaatccgagctgttccacttgttaacagagaccggggaagatttgaagacttaaaagttcactttttgacagatcctgaaaatgagatgaaggagaagctcttaaaagagtacttaatggtgatagaaatccccgtccaaggctgggaccatggcacaactcatctcatcaatgccgcaaagttggatgaagctaacttaccaaaagaaatcaatctggtagatgattactttgaacttgttcagcatgagtacaagaaatggcaggaaaacagcgagcaggggaggagagaggggcacgcccagaatcccatggaaccttccgtgccccagctttctctcatggatgtaaaatgtgaaacgcccaactgccccttcttcatgtctgtgaacacccagcctttatgccatgagtgctcagagaggcggcaaaagaatcaaaacaaactcccaaagctgaactccaagccgggccctgaggggctccctggcatggcgctcggggcctctcggggagaagcctatgagcccttggcgtggaaccctgaggagtccactggggggcctcattcggccccaccgacagcacccagcccttttctgttcagtgagaccactgccatgaagtgcaggagccccggctgccccttcacactgaatgtgcagcacaacggattttgtgaacgttgccacaacgcccggcaacttcgccagccacgccccagaccacacaaggcacttggatcccgggaagtgccaagcctgcctccaggatgttaccaggacatttaa

SEQ ID NO: 196380 - DNA, 1424 bp, Homo sapiens
  Payload ID: 18747
  Gene Name: tumor necrosis factor, alpha-induced protein 6
  Uniprot ID: P98066
  ENST ID: ENST00000243347
  CDS Start-End: 76-909
agtcacatttcagccactgctctgagaatttgtgagcagcccctaacaggctgttacttcactacaactgacgatatgatcatcttaatttacttatttctcttgctatgggaagacactcaaggatggggattcaaggatggaatttttcataactccatatggcttgaacgagcagccggtgtgtaccacagagaagcacggtctggcaaatacaagctcacctacgcagaagctaaggcggtgtgtgaatttgaaggcggccatctcgcaacttacaagcagctagaggcagccagaaaaattggatttcatgtctgtgctgctggatggatggctaagggcagagttggataccccattgtgaagccagggcccaactgtggatttggaaaaactggcattattgattatggaatccgtctcaataggagtgaaagatgggatgcctattgctacaacccacacgcaaaggagtgtggtggcgtctttacagatccaaagcaaatttttaaatctccaggcttcccaaatgagtacgaagataaccaaatctgctactggcacattagactcaagtatggtcagcgtattcacctgagttttttagattttgaccttgaagatgacccaggttgcttggctgattatgttgaaatatatgacagttacgatgatgtccatggctttgtgggaagatactgtggagatgagcttccagatgacatcatcagtacaggaaatgtcatgaccttgaagtttctaagtgatgcttcagtgacagctggaggtttccaaatcaaatatgttgcaatggatcctgtatccaaatccagtcaaggaaaaaatacaagtactacttctactggaaataaaaactttttagctggaagatttagccacttataaaaaaaaaaaaaaggatgatcaaaacacacagtgtttatgttggaatcttttggaactcctttgatctcactgttattattaacatttatttattatttttctaaatgtgaaagcaatacataatttagggaaaattggaaaatataggaaactttaaacgagaaaatgaaacctctcataatcccactgcatagaaataacaagcgttaacattttcatatttttttctttcagtcatttttctatttgtggtatatgtatatatgtacctatatgtatttgcatttgaaattttggaatcctgctctatgtacagttttgtattatactttttaaatcttgaactttataaacattttctgaaatcattgattattctacaaaaacatgattttaaacagctgtaaaatattctatgatatgaatgttttatgcattatttaagcctgtctctattgttggaatttcaggtcattttcataaatattgttgcaataaatatccttgaacacaca

SEQ ID NO: 196381 - DNA, 795 bp, Homo sapiens
  Payload ID: 18748
  Gene Name: tumor necrosis factor, alpha-induced protein 8
  Uniprot ID: O95379
  ENST ID: ENST00000274456
  CDS Start-End: 216-782
gacctcccggctcctccccggcctgcccgccacacccttggtccctcctgcaagttccgcccctggcctctgcctccttttctcccgccggctctaacccgcgcttggctaaggtccgcgggaacccgtgagccaccgagagagcagagaactcggcgccgccaaacagcccagctcgcgcttcagcgtcccggcgccgtcgcgccactcctccgatggccacagatgtctttaattccaaaaacctggccgttcaggcacaaaagaagatcttgggtaaaatggtgtccaaatccatcgccaccaccttaatagacgacacaagtagtgaggtgctggatgagctctacagagtgaccagggagtacacccaaaacaagaaggaggcagagaagatcatcaagaacctcatcaagacagtcatcaagctggccattctttataggaataatcagtttaatcaagatgagctagcattgatggagaaatttaagaagaaagttcatcagcttgctatgaccgtggtcagtttccatcaggtggattatacctttgaccggaatgtgttatccaggctgttaaatgaatgcagagagatgctgcaccaaatcattcagcgccacctcactgccaagtcacatggacgggttaataatgtgtttgatcatttttcagattgtgaatttttggctgccttgtataatccttttgggaattttaaaccccacttacaaaaactatgtgatggtatcaacaaaatgttggatgaagagaacatatgagcacatgagttaa

SEQ ID NO: 196382 - DNA, 1990 bp, Homo sapiens
  Payload ID: 18748
  Gene Name: tumor necrosis factor, alpha-induced protein 8
  ENST ID: ENST00000415806
  CDS Start-End: 57-176
gctcgtccgagtacatgtgagcggtaatcgcccctgcagctggttatcctgacattatgcactccgaagcagaagaatccaaggaaggcctaggcttaaacactggcatatatggagagaacagttgccactcgactcagagattgagtagacacccaaagaactgcagttcttaagccttaggagaagcgagagaaatgggccagtggccacagatgtctttaattccaaaaacctggccgttcaggcacaaaagaagatcttgggtaaaatggtgtccaaatccatcgccaccaccttaatagacgacacaagtagtgaggtgctggatgagctctacagagtgaccagggagtacacccaaaacaagaaggaggcagagaagatcatcaagaacctcatcaagacagtcatcaagctggccattctttataggaataatcagtttaatcaagatgagctagcattgatggagaaatttaagaagaaagttcatcagcttgctatgaccgtggtcagtttccatcaggtggattatacctttgaccggaatgtgttatccaggctgttaaatgaatgcagagagatgctgcaccaaatcattcagcgccacctcactgccaagtcacatggacgggttaataatgtgtttgatcatttttcagattgtgaatttttggctgccttgtataatccttttgggaattttaaaccccacttacaaaaactatgtgatggtatcaacaaaatgttggatgaagagaacatatgagcacatgagttaagattgtgactgatcatgatttatttgaagatggagcactgctgatttatgaaggaaaaaagaagaattttctaaagattacacatatttcagaaagactttacccaattcagttgtcagacataatgatttatttgaaggcttgttttatttgaagaaaagcatattgccaaaaattctggttaaaagcttcctaacgggtaacagaccatgggagagatatgtggttgggtaatgcaaatgtagttatacaaagaaaaatacagatgtctccagacctgaggactttttaatagggcagttgttgtgttggtggcacattggatatttctaacatgtacaaagctatgtattttgatttactttcatttcttgctatgtatatgtacttttcttaaaatgccaagaactttctcttgctatcattgctccttttgaaacaattcaattttcatgtctacagctgactgttttgttaagattgagtcatcgacattcaggatttaagtctgaggtagtcaaccctcaggaaaaaaaaaatggcttatctgaaatcagtactgtggaaatgaactatattagctattatgaataatgtccagtataagaatatgcttctggaattgagttctccttttaagtaccaatgatacttaaatttctcagaaatgtaatggtgtgtcattgccttgaaatgcttgcttagggcttcttttatgttatcttaaaaagtgctggtgaattttccattttttacatccatttcacatgtaagagacaaaaaagtctagattggtcttgatattgagataataaaaagtaagtagcattaagaaaggtaacaatcttcattctacagatgaactcattgaaacaatttaggggaatgaggggcaaaaggggagaaatactgctaaagaacatgagcataaaaatgcgtgcgtttcagtgtttaagaaggcttgataaagaatgtcacttttttatttaactgataagatttttgttattttttactttgataagtaaaccaaagaatatttgtatttcaagcagtttgtgtggtgtttctatataattttctgtgtataaataataaagtaggcatttgtttattttgtaaaaaagaaatgaaaatctgctggccagctatgtcctctaggaaatgacagacccaaccaccagcaataaacatttccattgtca

SEQ ID NO: 196383 - DNA, 2502 bp, Homo sapiens
  Payload ID: 18748
  Gene Name: tumor necrosis factor, alpha-induced protein 8
  Uniprot ID: O95379
  ENST ID: ENST00000503646
  CDS Start-End: 689-1285
agactccttaaatccatgtcttttgtacgttcttttcactaaatttgccatagtgtttctattggtttttgcctatataaaatcggaaacgaagaaaaagaaacgaactggaaaataaatttgtcaaaagagtatatttttttctcataatttccaagcggatctttcagatatgttatttgaggactttttgcctcagactggcgataaaacaagtgttctacaaaatacctccgtaagacaggcctatcagtggcagctcttgtccccgctttgcagaagggaaaaccaaggctccacagagctaaggggacttcctctcagccaatttgtaggggcctgtgggccagacccgggggcagaattgagatctgttgtgaaggctgtccggcttctttattctatcagcatttcaaatcctgaaaacctcccctttggcattttgaaggaattcatccccagtttttgctggtagccgggagggaaccgtgctctccccctgaggaaggccctttggagtaactgcagcaatgagtgcccgggctgtgcttggagtaccagtgctcgcccggggctatactgaatgagtaagcagccccgtctgcttttgctgtgcaaagagcgaacttgcggctcgtccgagtacatgtgagcggtaatcgcccctgcagctggttatcctgacattatgcactccgaagcagaagaatccaaggaagtggccacagatgtctttaattccaaaaacctggccgttcaggcacaaaagaagatcttgggtaaaatggtgtccaaatccatcgccaccaccttaatagacgacacaagtagtgaggtgctggatgagctctacagagtgaccagggagtacacccaaaacaagaaggaggcagagaagatcatcaagaacctcatcaagacagtcatcaagctggccattctttataggaataatcagtttaatcaagatgagctagcattgatggagaaatttaagaagaaagttcatcagcttgctatgaccgtggtcagtttccatcaggtggattatacctttgaccggaatgtgttatccaggctgttaaatgaatgcagagagatgctgcaccaaatcattcagcgccacctcactgccaagtcacatggacgggttaataatgtgtttgatcatttttcagattgtgaatttttggctgccttgtataatccttttgggaattttaaaccccacttacaaaaactatgtgatggtatcaacaaaatgttggatgaagagaacatatgagcacatgagttaagattgtgactgatcatgatttatttgaagatggagcactgctgatttatgaaggaaaaaagaagaattttctaaagattacacatatttcagaaagactttacccaattcagttgtcagacataatgatttatttgaaggcttgttttatttgaagaaaagcatattgccaaaaattctggttaaaagcttcctaacgggtaacagaccatgggagagatatgtggttgggtaatgcaaatgtagttatacaaagaaaaatacagatgtctccagacctgaggactttttaatagggcagttgttgtgttggtggcacattggatatttctaacatgtacaaagctatgtattttgatttactttcatttcttgctatgtatatgtacttttcttaaaatgccaagaactttctcttgctatcattgctccttttgaaacaattcaattttcatgtctacagctgactgttttgttaagattgagtcatcgacattcaggatttaagtctgaggtagtcaaccctcaggaaaaaaaaaatggcttatctgaaatcagtactgtggaaatgaactatattagctattatgaataatgtccagtataagaatatgcttctggaattgagttctccttttaagtaccaatgatacttaaatttctcagaaatgtaatggtgtgtcattgccttgaaatgcttgcttagggcttcttttatgttatcttaaaaagtgctggtgaattttccattttttacatccatttcacatgtaagagacaaaaaagtctagattggtcttgatattgagataataaaaagtaagtagcattaagaaaggtaacaatcttcattctacagatgaactcattgaaacaatttaggggaatgaggggcaaaaggggagaaatactgctaaagaacatgagcataaaaatgcgtgcgtttcagtgtttaagaaggcttgataaagaatgtcacttttttatttaactgataagatttttgttattttttactttgataagtaaaccaaagaatatttgtatttcaagcagtttgtgtggtgtttctatataattttctgtgtataaataataaagtaggcatttgtttattttgtaaaaaagaaatgaaaatctgctggccagctatgtcctctaggaaatgacagacccaaccaccagcaataaacatttccattgtc

SEQ ID NO: 196384 - DNA, 8681 bp, Homo sapiens
  Payload ID: 18748
  Gene Name: tumor necrosis factor, alpha-induced protein 8
  Uniprot ID: O95379
  ENST ID: ENST00000504771
  CDS Start-End: 1778-2374
ttctcctcttctcccttctctggctggctatatcttcctcccttcatcctgctctttcagtgaaattgagataacatgttagaatcttaggcaggttagaatctctcagcagtaggatgtgatttaatatctagacctcttacattaatatttataatagccttcactgcttgtgaatagcataagcactcttttctgttcaaagtcaatactgaaataaaacccaagagtatgttttataaaaatttacttttaatggtgcaatggtaataatctatgtagtccttatggttttcaaatccctttgtgcttatattaccttatttaatacagacataaatctgtgaagtaaataatactatttttatcttcattttacaaatgaggaactggaggctcagagaggttaatttgcataaggtcatacaaatgatagatggcagaactggatttaagttcagactccttaaatccatgtcttttgtacgttcttttcactaaatttgccatagtgtttctattggtttttgcctatataaaatcggaaacgaagaaaaagaaacgaactggaaaataaatttgtcaaaagagtatatttttttctcataatttccaagcggatctttcagatatgttatttgaggactttttgcctcagactggcgataaaacaagtgttctacaaaatacctccgtaagacaggcctatcagtggcagctcttgtccccgctttgcagaagggaaaaccaaggctccacagagctaaggggacttcctctcagccaatttgtaggggcctgtgggccagacccgggggcagaattgagatctgttgtgaaggctgtccggcttctttattctatcagcatttcaaatcctgaaaacctcccctttggcattttgaaggaattcatccccagtttttgctggtagccgggagggaaccgtgctctccccctgaggaaggccctttggagtaactgcagcaatgagtgcccgggctgtgcttggagtaccagtgctcgcccggggctatactgaatgagtaagcagccccgtctgcttttgctgtgcaaaggtaagggtggaggccgctccactttcttcaaaaggccccgctctgggacttgtgaaattgtgctctcttaagctggtccttgcaaccccatggacgatatccatgcgactttcctacaaaaataacataccaaagccgctttaaaatccgtaatttttgggttgcaagactccaagacaaagtcaaatgggcatcaaaaaatgtaatccaaaaatacagaggcattggttctaccctatatgcatttgctatttatgtaaaactacagtgtgctctgagatgagactttttttttctttttatacctttttttccgcccgtctggtgcgtttgccgacggttcttctcggccctgtgtctcgggagagtcggctgccgtctgggcctgtgccccacctgcgtgcgcccgggccgagccagccccgccaggtcgcctccgcccggctgccggcccgagcgcgcggctccgggggcggactcccgccgcccagctgacacgcgattcgtcactcttgcagaactttccccctgaaaatccctgcaccagaacccgctctcccgccccggggaggttttgattttagtggctttcttccttttattttccgtcgtgtgcggatttcgctgcagagcgaacttgcggctcgtccgagtacatgtgagcggtaatcgcccctgcagctggttatcctgacattatgcactccgaagcagaagaatccaaggaagtggccacagatgtctttaattccaaaaacctggccgttcaggcacaaaagaagatcttgggtaaaatggtgtccaaatccatcgccaccaccttaatagacgacacaagtagtgaggtgctggatgagctctacagagtgaccagggagtacacccaaaacaagaaggaggcagagaagatcatcaagaacctcatcaagacagtcatcaagctggccattctttataggaataatcagtttaatcaagatgagctagcattgatggagaaatttaagaagaaagttcatcagcttgctatgaccgtggtcagtttccatcaggtggattatacctttgaccggaatgtgttatccaggctgttaaatgaatgcagagagatgctgcaccaaatcattcagcgccacctcactgccaagtcacatggacgggttaataatgtgtttgatcatttttcagattgtgaatttttggctgccttgtataatccttttgggaattttaaaccccacttacaaaaactatgtgatggtatcaacaaaatgttggatgaagagaacatatgagcacatgagttaagattgtgactgatcatgatttatttgaagatggagcactgctgatttatgaaggaaaaaagaagaattttctaaagattacacatatttcagaaagactttacccaattcagttgtcagacataatgatttatttgaaggcttgttttatttgaagaaaagcatattgccaaaaattctggttaaaagcttcctaacgggtaacagaccatgggagagatatgtggttgggtaatgcaaatgtagttatacaaagaaaaatacagatgtctccagacctgaggactttttaatagggcagttgttgtgttggtggcacattggatatttctaacatgtacaaagctatgtattttgatttactttcatttcttgctatgtatatgtacttttcttaaaatgccaagaactttctcttgctatcattgctccttttgaaacaattcaattttcatgtctacagctgactgttttgttaagattgagtcatcgacattcaggatttaagtctgaggtagtcaaccctcaggaaaaaaaaaatggcttatctgaaatcagtactgtggaaatgaactatattagctattatgaataatgtccagtataagaatatgcttctggaattgagttctccttttaagtaccaatgatacttaaatttctcagaaatgtaatggtgtgtcattgccttgaaatgcttgcttagggcttcttttatgttatcttaaaaagtgctggtgaattttccattttttacatccatttcacatgtaagagacaaaaaagtctagattggtcttgatattgagataataaaaagtaagtagcattaagaaaggtaacaatcttcattctacagatgaactcattgaaacaatttaggggaatgaggggcaaaaggggagaaatactgctaaagaacatgagcataaaaatgcgtgcgtttcagtgtttaagaaggcttgataaagaatgtcacttttttatttaactgataagatttttgttattttttactttgataagtaaaccaaagaatatttgtatttcaagcagtttgtgtggtgtttctatataattttctgtgtataaataataaagtaggcatttgtttattttgtaaaaaagaaatgaaaatctgctggccagctatgtcctctaggaaatgacagacccaaccaccagcaataaacatttccattgtcactgtgtctatgatttttttttttttttttttgagtctcgctctgttgtttaggctagaatgcagtggcatgattttggctcactgcaacctctgcctcccaggttcaagtgattctcctgcctctgcctcccaagtagctgggattacaggcatgcaccaccacacccagctaatttttgtatttttagtcgagatggggtttcaccatgttgcccaggctggtcttgaactcctgacttcaaatgatctgcctgcctcggcctccgaaagtgttgggattacaggtgtgagccactgtgcctatgatttagtgtactctcttgccttaaatttgcctgcctcccagaatattgacattaaaataatagtttaccaggaaaggttccacaactaaaaattccagaagttgagatctgctctaacccatttcagcctagagagggtggtcagtttctctgacaccctcatttgcttggctaagacaagcagcaaaggtgtagagtttcttcctgtttgatattaaatcctgacactaagatttgaactgaaagtatcattctcacttcctagagccagtaggtgatcagtatatgctgtaacaataacacagtgactacagaaatgacccttctagcttcataacttgctaagtggcttataaatggaattcagcagccttccttgaccagctgttttcctcacatgtgaaggctgagaatgtgatggggggtgtgagctactgactggatgtgttctgttctccagatctcaaacagcagaggtatgggaaacgaaagccctgggcagtccatggatgcttcttgctcatctgtagctatagacaggaccaaccagagagagaaaacgtacggagggagaaatctggatctctctggacacactggatcatagggttgtgccagcaggctagcaatcaaatgtgcatgggattgggggagcaatgcttcatctcccacagagggaaggcagtgaggagtagaccgaaggagggaatcctgtttgctaccatttctcagcattttctggaggggacccatctccttaccagtgctgtgcctgaaaagcatgtcttggatcaggtccaaagtcgtgattagcaagttcatttctaatacaataggactccccttgagcatttagggtggcaaggagcgtgggagctgggaagaatccccacgtgcttagggtagataaatctgagccgagttaatactaatttggggatcctatgaacctttttataaaatagtatctgttcacgttttgaaaaaaattgtgttgtaattgattttattttgtgctggtggcttctctgcaaaaattatgagtggatatgataagtggatgataatactaatggacaactaacgcagagtagtttgtattatgtgtcgggcacattaactcatttaattctgccacaatcttcaccatcttatagataaggaaactaggggaatagaagttaaggaatttcctgaggtcacatgtgctcgaggtgtcccagccggaatatgtataaaatcttattttcacttaaagatgatatggctaaaggcagtgctaggaacatctttggctcagagaagcgtgggcagtatgctgctgaaatggttcctcatatagtgacattttaggcagtacctaagtcagcacaggtctggcctgttctctaaagatctgtgtagatgttgtacaaagacatttttcaaagttttcaacatgactcctactttgggggcatcttgtggctcagttttctgtctcgtggaacttcacttctaggtgctcacaatgacttttaacgttgacttctgaggtgcagtgagctgctcccccacagctgtccctagcagtggtgggttcagagcatgacaaggcactcaatgtgcattcaccaagagaagcaaggaagcagcagttcagtactgtgctccctagagtaggcacggcatcagtttcaaacttcaacattattttccagatttggaggctcaaaatatttgagcaagttaagttaagaaatagcctttttctgattattaggcctttcatatacaactcaaaattagtttaagagtaaagcatggggtgggtgcggtggcttatgcttgtaagcccagaactttgggaggcggaggtgggaggatcacttgaggtgaggagttcgagaccagcctggccaacgtggtgaaaccccactgctactaaaaatacacaagattagccagatgtggtggcaggcacctgtaatcccagctacttgggaggctaaggcaggagaatcgctggaacctgggaggcagaggttgcagtgagctgagattgtaccactgcactgcagcctgggcaacaagaacgaaaccccgtctcaaaaaaaaaaaaaaaaaaaaaaagcatgagttaagaactttgatcgtacagaaatattgcgttttaaactcttatataatagtatgccattcacaattatctggaaagttctttttctcccaccatgtgaatacacacacacacacacacacacacacaatttttaagcccccaaaggcttaaaatagtactttttgtggtctgtaccggtcagttggatttttactaagaattttaatttatccttgagatacttgatgagtgtatataagcagttgcaatttagcatacaaaacctgacaaatggtaaataaaagaatatgtttatccaaatgatgaaatatttgtagtaaaaagtgctattcaattgccaggaaattaaaatactccagtaaaatgaattaaattagcatgttaataagagtgataatatttaaaagttttagtcaatcttgcatttccatacttgcattatctaaactagttgaacttttcagtgttttacttgatatattgcattcttgagcattaggcttctaggtgatttgttaaactcatagcaggttttagtacacagtgctgtttatgacagaaaaaattttatcctacctctgaaataattgtactttctgtgattcagataaaaactttatagaaactccctaatgaaaatattgaagcattaaccagaaaatgagtcagctttttgtttccaaaatgatgcaacaggaaaacctttaactacttataatcccgtatagtcaccatcaccacgaagtattgaaaatctgttttctcttttactaagtgtctgcacggtcacttatgtatacccaaagccagaaagatatttttatctcagggaaattccagaaatggaaacatttttgtgtaatattgattcatttctgtctcaccaaagatgtgttttccacgtagcaaagaacatcagccccacgttatagggaacaagcgagtcccaaatcgtaccatctgctgagcactgagaaaggatatggacaagtcagtcagcattcacaattaagagaaaaacatctgtgctttggaaaatgttcttcaaggatagagaattgtgccctatgtccaccaaatttgcatgagatctttataagattagacagccagtggataaggccccttatctttcttcatggatggctgaggaaattctccgccttccctgacatcagctgcataactgtatttctgcctcgtggaaataaagtagatgatcaggcacttgcggtttgttcttaatacaagaaagacaatttgatttttaaaagttttgatttgtagaataatgtaagacaatatgtttctttctactttggtttttccattcaaaagcttacagatgaattcattcgtttaaaactgccaggctgagtgcggtggctcatgcctgtaatcccaacacttcgggagactgaggtgggcggatcacctgaggtccagagttcaagaccagcctgaccaacatggtgaaaccccatctctactaaaaatacaaaattagccgggtgcagtgccacatgcctgtaatcccagctacttgggaggctgaggcaggagaaccacttgaacccaggaggcagaggttgcagtgagccaagattacaccactgcactccagcctgggcaacaagagtgagactttgtctcaaaaaaaaaaaaagaaactctgtctcgaagtaaataaataaatttttaaaaaccaacctgatgtgaagttgaaacacaagacgcggaaataaaaactcagagtataaatatctatattgttaccattatctgggataattgatgatttataagaagctgaggtttcgtcttcctagaaatggacttttattaggccagcaagaatgaccacttagccatttaaatgatttgtcagcatcttttgctgctctcttctaagaccattggttttcactaaaggataaatacctgctaagcaaattataaaatactataagacatttaatctcctggaagaggacttgctgataattggatcaaagttccagcattattgctcttttcgaatcatatggacttagtgttctcatgaccgaggagtcacatttttagcttgctaaaatattcactggagaacatggtgaaatccacgagtggaaacgttccatggtattttcaaacgccacgtgtcaggaatttggcatgccttcctctgggagaggcactggagtgtggccagatggaacccagcagggtacagagggcatttgtgggagcagttaggaaaccaggacgtccagcttctgcctgccagggagctcgctcatgttgtctctgaaatttgcataagagcaattacctcatattctaattttaaagatacaatttttaaagacatggaaggctctgagacctcctgaaggctattcctatgtgaggtattgtttacgggtggcctttcactatttccaaatcagcgatgaaaagaagactgagtctaaaataaatgaagcaacagacttcagcagcctgagagaattttgttcaattccagtctccttaaaaaaaaatcggtttttgctttcaatttaggaaaattgttttgggttgcattgttgaaagtaatgatttctagcagctacttatgtataatctcttaaccaattaaattctgaatctcttaaatca

SEQ ID NO: 196385 - DNA, 711 bp, Homo sapiens
  Payload ID: 18748
  Gene Name: tumor necrosis factor, alpha-induced protein 8
  ENST ID: ENST00000504642
  CDS Start-End: 44-646
gggctgtgcttggagtaccagtgctcgcccggggctatactgaatgagtaagcagccccgtctgcttttgctgtgcaaagtggccacagatgtctttaattccaaaaacctggccgttcaggcacaaaagaagatcttgggtaaaatggtgtccaaatccatcgccaccaccttaatagacgacacaagtagtgaggtgctggatgagctctacagagtgaccagggagtacacccaaaacaagaaggaggcagagaagatcatcaagaacctcatcaagacagtcatcaagctggccattctttataggaataatcagtttaatcaagatgagctagcattgatggagaaatttaagaagaaagttcatcagcttgctatgaccgtggtcagtttccatcaggtggattatacctttgaccggaatgtgttatccaggctgttaaatgaatgcagagagatgctgcaccaaatcattcagcgccacctcactgccaagtcacatggacgggttaataatgtgtttgatcatttttcagattgtgaatttttggctgccttgtataatccttttgggaattttaaaccccacttacaaaaactatgtgatggtatcaacaaaatgttggatgaagagaacatatgagcacatgagttaagattgtgactgatcatgatttatttgaagatggagcactgctgatttatgaa

SEQ ID NO: 196386 - DNA, 1385 bp, Homo sapiens
  Payload ID: 18748
  Gene Name: tumor necrosis factor, alpha-induced protein 8
  Uniprot ID: O95379
  ENST ID: ENST00000513374
  CDS Start-End: 391-1023
gattttgaatatactcctgtttgcttgtcacaggtaatcttgcatttctatgtagttgtagtttacagggagcaagtgcaggcagcaaccagtccatccctgttgtgaatgtggagacctctctggactcacaattaaaggctacctaatgcattccactacaagtgacgaaacctagctcccagaataacaagcaagacaactttcaaagtgactgtagttgaccagtgccttctgtgcatttatgtggtaagcttatggtagatttttcaaaagaatagtataaattattttgaattattcttgagaaggactgagtctccccgagggtgatgcaggttccatagtgtacacgtcaacagggtggttgcatgcattcctcaagtctgtatgactctaccaagatactgtgaagttgtccttctgattgcacacggggagaaaatgctgaaactagtggccacagatgtctttaattccaaaaacctggccgttcaggcacaaaagaagatcttgggtaaaatggtgtccaaatccatcgccaccaccttaatagacgacacaagtagtgaggtgctggatgagctctacagagtgaccagggagtacacccaaaacaagaaggaggcagagaagatcatcaagaacctcatcaagacagtcatcaagctggccattctttataggaataatcagtttaatcaagatgagctagcattgatggagaaatttaagaagaaagttcatcagcttgctatgaccgtggtcagtttccatcaggtggattatacctttgaccggaatgtgttatccaggctgttaaatgaatgcagagagatgctgcaccaaatcattcagcgccacctcactgccaagtcacatggacgggttaataatgtgtttgatcatttttcagattgtgaatttttggctgccttgtataatccttttgggaattttaaaccccacttacaaaaactatgtgatggtatcaacaaaatgttggatgaagagaacatatgagcacatgagttaagattgtgactgatcatgatttatttgaagatggagcactgctgatttatgaaggaaaaaagaagaattttctaaagattacacatatttcagaaagactttacccaattcagttgtcagacataatgatttatttgaaggcttgttttatttgaagaaaagcatattgccaaaaattctggttaaaagcttcctaacgggtaacagaccatgggagagatatgtggttgggtaatgcaaatgtagttatacaaagaaaaatacagatgtctccagacctgaggactttttaatagggcagttgttgtgttggtggcacattggatatttctaacatgtacaaagctatg

SEQ ID NO: 196387 - DNA, 541 bp, Homo sapiens
  Payload ID: 18748
  Gene Name: tumor necrosis factor, alpha-induced protein 8
  ENST ID: ENST00000388882
  CDS Start-End: 338-541
ctggcctctgcctccttttctcccgccggctctaacccgcgcttggctaaggtccgcgggaacccgtgagccaccgagagagcagagaactcggcgccgccaaacagcccagctcgcgcttcagcgtcccggcgccgtcgcgccactcctccgagatcttcctgtgtcacccaggctgaagtgcagtggtgagatcatagctcactgcagcctctaactcctgggctcaagcgatcctcccacctcagtctcctgagtagctggaaccacagtggccacagatgtctttaattccaaaaacctggccgttcaggcacaaaagaagatcttgggtaaaatggtgtccaaatccatcgccaccaccttaatagacgacacaagtagtgaggtgctggatgagctctacagagtgaccagggagtacacccaaaacaagaaggaggcagagaagatcatcaagaacctcatcaagacagtcatcaagctggccattctttataggaataatcagtttaatcaagatgagctagcattgatggag

SEQ ID NO: 196388 - DNA, 3814 bp, Homo sapiens
  Payload ID: 18749
  Gene Name: tumor necrosis factor, alpha-induced protein 8-like 1
  Uniprot ID: Q8WVP5
  ENST ID: ENST00000327473
  CDS Start-End: 116-676
ccccggccccggctccggcgctgctcccaccgccgcggcaacggccccggcccacggaggcggctggacggacccccgacggttggacgtacggactctgcttcgagagtaggccatggacaccttcagcaccaagagcctggctctgcaggcgcagaagaagctcctgagtaagatggcgtccaaggcagtggtggccgtgctggtggatgacaccagcagtgaggtgctggatgagctgtaccgcgccaccagggagttcacgcgcagccgcaaggaggcccagaagatgctcaagaacctggtcaaggtggccctgaagctgggactgctgctgcgtggggaccagctgggcggtgaggagctggcgctgctgcggcgcttccgccaccgggcgcgctgcctggccatgacggccgtcagcttccaccaggtggacttcaccttcgaccggcgcgtgctggccgccgggctgctcgagtgccgcgacctgctgcaccaggccgtgggtccccacctgaccgccaagtcccacggccgcatcaaccacgtgttcggccacctagccgactgcgacttcctggctgcgctctacggccccgccgagccctaccgctcccacctgcgcaggatctgcgagggcctgggccggatgctggacgagggcagcctctgaaccccggcgccgcccaaccgcgcccctcgcgccttttggggctctcctgctgggcgcgggtggggtttgtgggtttttttccacctcttttctcccaatcggactccggccaaactcccctagacagatgggtgacctgtctcctttgagaggatgctgaggcatctgtagcagctgtttcaaacaccaatgtcacctctcctcctggcccccgcccaatggggagaggaatttggggccctactctggggaccacctttcacccgtttgtactttctgggccacgccgacccctgggtcgcttgatgtaaaagccaaaagctgctgcctcccacttggatcatgtcgcctgggattttcatccctcgcacaaggactacgggttcacacggtgaactgggggaagggaagtgttagggggcaagtcgcggcacccccccttccataaactcacgtcctaacccccaggacctcagaagatgatctgatttggaaataggatcattacagatggaattagttcagatgatctcatcttggagtagggtgggccccaattcaaggactggggtccttaaaaaaagggggcctggggcagggcgcggtggctcacgcctgtaatcccagcactttgagaggctgaggcgggcggatcacgaggtcaggagatcgagaccatcctggctaacacggtgaaaccccatctctactgaaaatacaaaaaattagctgggcatggtggcacatgcctgtagtcccagctactcgggaggctgaggcaggataatcacttgaaccaggaggaggaggttgcagtgagccgagattgtgccactgcactccagcctgggtgacagagcaagactctgtctcaaaaaaagaagcgggggagtgggggattgaggccacgtgcagtggctcactactctaattccagcactttgggaggccgaggcaggaagattgcttgaactcagaagttcaagaccagtctgggcaacatggtgagaccctcgtctctacaaaaaaaaaattatcgtggtgggccgggcgtggtggctcacacctgtaatcccagcactttgggaggctgaggcgggcagatcacaaggtcaagagatcgagaccatcctggccaacatggtgaaaccccgtctctactaaaaatacaaaaattagccgggcatggtgttgcgtgcctgtagtcccagctacttgggaggctgaggcaggagaatcgcttgaacctgggaggcgcaggttgcagggaggcggaggttgcagtgagccgagattgcaccactgcacttcagcctggtgacagagcgagactcgtctcaaaaaaaaaaaaaaaaaaaaaaaaaaaagtgactgtggtggtgcacacgtataatcccagctacttgagagatgacgagggaagatcacttgagcccaggagttaagaggctgcagtgaccgatgatcatgccactgcactccagcttgggtgagagtgggactctgtcttagaaagaaaaaaaaaagtatttggacacagacatgcatgcaaggaaggccaatgatgccggccaccaccaggagctgggagaggcccagggcagatccccttcagccttggagggacctagccctggccacaccttcatctcagacttgcggcccagagaactgaatgagaataaatgtgcgtgaagcccctcagtccacaggatgtggtactggaagcccccactcaagaaggctccagtgaatgctggcacgttcagccaggatgcctccgtgaagctggagacctctgccctgggtcgggaggggaaactgctccaatccagggactgccacatgggaggggacggagcgtgcccacctcccaggggtgaggggggacccacctgagatgtgtgcacattttatttatttattgttttgagacaaagtctcgctgtgtcacccaggctggagtgcagtggtgaaatctcggctcattgcagccccttccttccaggctcaagtgatcctcccacctcagccccgggtagctgggactacaggtgtgcacgagcacacccggctaatctttgtattttttgtagacagaaggtctcaccatgttgcccaggatggtctcgaactcctgggctcaagcgacctacctacctcggcctcacaaagtgtgcacattgtaatatcgtgatttcatatttggagaatcagcaaccaaccagccaaccatgttgcttttataagacagagctgagaaagcaaagcttggctgtcgtcttggctctggtaccacccacgagatgcgggcgattctcagctcagggcgtggaggcgtggtgtgggggagtctatttgccatttttgtttgtcagcagggggcaggggttctcaaagattgcaaaatgctgctgcaggtcaggaaggttattttgggtgcctgtgggggaggtgaaacaaggtcccatgactgttttgcagaaccttgtctgtggagggtagaggttgcggcaggggcctgtgggccttacttggtgagaaggtaggtctagctggctccattcagtatttgagacatttggaatttgtctgcatttaaaaccaagagatcacacacacctgtctggatttggagtttctcttgaaaactcgccagtccggccgtctgagcctgcactgacgcctggtgaagctgtgcaggggccgcccctctccctttcaccacagtcctctccactccctttcgcctctccctggcctgctgcactcactgataggaaattctgaccccagactcggagcagccttcccgtggttcggtttttgcttccgcgaaaaagccaaaggccttggccagagagccagctgttcctacctctaccccacgcttccaaggcaaccttctccacttatcttaggccgagagacagctcttcaagaacgtacatggatcctgattttctcacgaagtcccgatggaaccctgtgctgttgagacatcagtgtgtaaaactctctgtgtccctgttgggctgtccagacagtctggactcttgtaaatttgagatttaattaaaggaaacaaaccaaataggactgcggaacaatttaaataaaagcacacaccagcctggg

SEQ ID NO: 196389 - DNA, 3845 bp, Homo sapiens
  Payload ID: 18749
  Gene Name: tumor necrosis factor, alpha-induced protein 8-like 1
  Uniprot ID: Q8WVP5
  ENST ID: ENST00000536716
  CDS Start-End: 147-707
gcatcggtccaggcatcggtggcggggagccaggcctaggccagcccgggcccacccagactggcccctaatgagctcccaagtggcctgtggggacttggcctcagttttgccagctgtgaactgggaccgtcgctgctaaggccatggacaccttcagcaccaagagcctggctctgcaggcgcagaagaagctcctgagtaagatggcgtccaaggcagtggtggccgtgctggtggatgacaccagcagtgaggtgctggatgagctgtaccgcgccaccagggagttcacgcgcagccgcaaggaggcccagaagatgctcaagaacctggtcaaggtggccctgaagctgggactgctgctgcgtggggaccagctgggcggtgaggagctggcgctgctgcggcgcttccgccaccgggcgcgctgcctggccatgacggccgtcagcttccaccaggtggacttcaccttcgaccggcgcgtgctggccgccgggctgctcgagtgccgcgacctgctgcaccaggccgtgggtccccacctgaccgccaagtcccacggccgcatcaaccacgtgttcggccacctagccgactgcgacttcctggctgcgctctacggccccgccgagccctaccgctcccacctgcgcaggatctgcgagggcctgggccggatgctggacgagggcagcctctgaaccccggcgccgcccaaccgcgcccctcgcgccttttggggctctcctgctgggcgcgggtggggtttgtgggtttttttccacctcttttctcccaatcggactccggccaaactcccctagacagatgggtgacctgtctcctttgagaggatgctgaggcatctgtagcagctgtttcaaacaccaatgtcacctctcctcctggcccccgcccaatggggagaggaatttggggccctactctggggaccacctttcacccgtttgtactttctgggccacgccgacccctgggtcgcttgatgtaaaagccaaaagctgctgcctcccacttggatcatgtcgcctgggattttcatccctcgcacaaggactacgggttcacacggtgaactgggggaagggaagtgttagggggcaagtcgcggcacccccccttccataaactcacgtcctaacccccaggacctcagaagatgatctgatttggaaataggatcattacagatggaattagttcagatgatctcatcttggagtagggtgggccccaattcaaggactggggtccttaaaaaaagggggcctggggcagggcgcggtggctcacgcctgtaatcccagcactttgagaggctgaggcgggcggatcacgaggtcaggagatcgagaccatcctggctaacacggtgaaaccccatctctactgaaaatacaaaaaattagctgggcatggtggcacatgcctgtagtcccagctactcgggaggctgaggcaggataatcacttgaaccaggaggaggaggttgcagtgagccgagattgtgccactgcactccagcctgggtgacagagcaagactctgtctcaaaaaaagaagcgggggagtgggggattgaggccacgtgcagtggctcactactctaattccagcactttgggaggccgaggcaggaagattgcttgaactcagaagttcaagaccagtctgggcaacatggtgagaccctcgtctctacaaaaaaaaaattatcgtggtgggccgggcgtggtggctcacacctgtaatcccagcactttgggaggctgaggcgggcagatcacaaggtcaagagatcgagaccatcctggccaacatggtgaaaccccgtctctactaaaaatacaaaaattagccgggcatggtgttgcgtgcctgtagtcccagctacttgggaggctgaggcaggagaatcgcttgaacctgggaggcgcaggttgcagggaggcggaggttgcagtgagccgagattgcaccactgcacttcagcctggtgacagagcgagactcgtctcaaaaaaaaaaaaaaaaaaaaaaaaaaaagtgactgtggtggtgcacacgtataatcccagctacttgagagatgacgagggaagatcacttgagcccaggagttaagaggctgcagtgaccgatgatcatgccactgcactccagcttgggtgagagtgggactctgtcttagaaagaaaaaaaaaagtatttggacacagacatgcatgcaaggaaggccaatgatgccggccaccaccaggagctgggagaggcccagggcagatccccttcagccttggagggacctagccctggccacaccttcatctcagacttgcggcccagagaactgaatgagaataaatgtgcgtgaagcccctcagtccacaggatgtggtactggaagcccccactcaagaaggctccagtgaatgctggcacgttcagccaggatgcctccgtgaagctggagacctctgccctgggtcgggaggggaaactgctccaatccagggactgccacatgggaggggacggagcgtgcccacctcccaggggtgaggggggacccacctgagatgtgtgcacattttatttatttattgttttgagacaaagtctcgctgtgtcacccaggctggagtgcagtggtgaaatctcggctcattgcagccccttccttccaggctcaagtgatcctcccacctcagccccgggtagctgggactacaggtgtgcacgagcacacccggctaatctttgtattttttgtagacagaaggtctcaccatgttgcccaggatggtctcgaactcctgggctcaagcgacctacctacctcggcctcacaaagtgtgcacattgtaatatcgtgatttcatatttggagaatcagcaaccaaccagccaaccatgttgcttttataagacagagctgagaaagcaaagcttggctgtcgtcttggctctggtaccacccacgagatgcgggcgattctcagctcagggcgtggaggcgtggtgtgggggagtctatttgccatttttgtttgtcagcagggggcaggggttctcaaagattgcaaaatgctgctgcaggtcaggaaggttattttgggtgcctgtgggggaggtgaaacaaggtcccatgactgttttgcagaaccttgtctgtggagggtagaggttgcggcaggggcctgtgggccttacttggtgagaaggtaggtctagctggctccattcagtatttgagacatttggaatttgtctgcatttaaaaccaagagatcacacacacctgtctggatttggagtttctcttgaaaactcgccagtccggccgtctgagcctgcactgacgcctggtgaagctgtgcaggggccgcccctctccctttcaccacagtcctctccactccctttcgcctctccctggcctgctgcactcactgataggaaattctgaccccagactcggagcagccttcccgtggttcggtttttgcttccgcgaaaaagccaaaggccttggccagagagccagctgttcctacctctaccccacgcttccaaggcaaccttctccacttatcttaggccgagagacagctcttcaagaacgtacatggatcctgattttctcacgaagtcccgatggaaccctgtgctgttgagacatcagtgtgtaaaactctctgtgtccctgttgggctgtccagacagtctggactcttgtaaatttgagatttaattaaaggaaacaaaccaaataggactgcggaacaatttaaataaaagcacacaccagcctggg

SEQ ID NO: 196390 - DNA, 1178 bp, Homo sapiens
  Payload ID: 18750
  Gene Name: tumor necrosis factor, alpha-induced protein 8-like 2
  Uniprot ID: Q6P589
  ENST ID: ENST00000368910
  CDS Start-End: 127-681
ggccaagccaaagggctctcacactaagtgaagcttctccattctgtaagctttccgggaacatccaaggcaagactggcacccagcacagcagtgactgaccacataccccactctccaggacccatggagtccttcagctcaaagagcctggcactgcaagcagagaagaagctactgagtaagatggcgggtcgctctgtggctcatctcttcatagatgagacaagcagtgaggtgctagatgagctctaccgtgtgtccaaggagtacacgcacagccggccccaggcccagcgcgtgatcaaggacctgatcaaagtggccatcaaggtggctgtgctgcaccgcaatggctcctttggccccagtgagctggccctggctacccgctttcgccagaagctgcggcagggtgccatgacggcacttagctttggtgaggtagacttcaccttcgaggctgctgttctggctggcctgctgaccgagtgccgggatgtgctgctagagttggtggaacaccacctcacgcccaagtcacatggccgcatccgccacgtgtttgatcacttctctgacccaggtctgctcacggccctctatgggcctgacttcactcagcaccttggcaagatctgtgacggactcaggaagctgctagacgaagggaagctctgagagccctgagcctagcacattccaccttgacaaaatggttgactgagaaaacacagataatgggcttcctaaccctgctcacctggcactaacacttttcaatcttcaggcttcattccttcccaagagtgcttttgactctgagaccagcccacccccaaacagctagtggagaaggagcaatgctgaggggtgaggcctctctcccactccagccccaggacaggaaacagaactgcctgaaaaaggtgaagtgaaacttggatctctatttctcccataagggacttctgaaacagggaagccccctcccatgtgaaccaaggaaaggaggcacagcccagagaacccctttggggatactaaagacagaagaggggaaggtggcccttagagacagagcttggacagatgccagaggctctgttccagagtgcaggaagaaggggctagggcaggggagattctcataggggaaataaaactactaaaatatg

SEQ ID NO: 196391 - DNA, 2262 bp, Homo sapiens
  Payload ID: 18751
  Gene Name: tumor necrosis factor, alpha-induced protein 8-like 3
  Uniprot ID: Q5GJ75
  ENST ID: ENST00000327536
  CDS Start-End: 101-979
acttgctagtcttacctcaagtaatgggaaacgaccagacctcctaaagagtcagtgtgcaagttagggctactgtcccaagaaggacacctgagtccaaatggggaaaccacggcaaaacccaagcacactggtttccacactctgtgaggcagagccaaaggggaaactgtgggtcaacggatatgcagggacccaaggcacaagggatgccacgttacaaacaagactcatccccttatcttttcatcttcagaggggaaagggacttgccgccccgctgtccgccctgagtgcgccgcggctgcccgagcgccccgcagacgggcgggtggccgtggacgcccagccagcagcccgcagcatggattcggattccggggagcagagcgagggcgagcccgtgaccgccgcaggtcctgatgtttttagttcaaagagtcttgcgcttcaagcccagaagaagattctgagcaaaatagccagcaaaactgtggccaacatgttgattgatgacaccagcagcgagatctttgatgagctctacaaagtcaccaaagagcacacacacaacaagaaggaagcccacaagatcatgaaagacttaatcaaggtggcgatcaaaatcgggatcctctaccggaacaaccagtttagccaagaggagctggttattgtggagaagttccggaagaagctgaaccagaccgccatgaccattgtcagcttctatgaggtggaatacaccttcgataggaacgtgctctccaatctcctgcatgagtgcaaggacctggtgcatgaactggtgcagcggcacctgacgcccaggacccacgggcgcatcaaccacgtctttaaccactttgccgatgtggagttcctctccaccctctatagtctggatggagactgtaggcccaacctcaagaggatttgtgaaggaatcaataagttgctagatgagaaagtcctttaaatgccttccctcctactggactttgctgctttaaagttacagcactcaaccatgatctgggtgagaatcaagaacataagcagaaacccttgtcaaagatgtccatgttctttcctgttcatccctctgatgctgattctgatgctgaactgagctcaggtgtgtttttcttccaagctttctagcaaggtttctacttaaaatcacctgtgtgcaagcccaaaggacatttcatctattctaagcagaaaggctgttttgttcattacagtgagtgctgttcatctcatggagtgggaggagcactaaaccaggagacagaggacatggatttggtttccagcttaaccagttaggactctgtcctctgcattctggaaccatgatgcctgcctgcctgcctcacagggctgttgtgaggaccagatgagatgatgtatgttcatacttttggaatctctaatttaaagtcttaatattttgtcttctgagtgtgaggggataaacctggatgtagactattaagcagcataggagaaaagaacaatagaatctaatggactgggtttgcaatctctctctaaatgcactgcttcagacaaagtgaaatccaaaggtgtgaaaaagtatagctgcaaattggaaaaatgtgtttcaagagtcgtctttttggccaggcatggtggctcacacctgtaatcccagcactttgggaggccgaggtgggcagattgcctgaggtccggagttcaagatcagcctggccaacatgatgaaaccctatctctactaaaattacaaaaattagccaggcgtggtggtacacgcctgtaatcccagctactcaggaggctgaggcaggagaattgtttgaacctgggagatggaggctgcagtgagctgagatcacgccactgtactccagcctgggcaacagagcaagactctgtctctaaaaaataataataataataataatttttttaaaaagaggtgtttttgaggtcttagatgttcaggttgatgatcctgcagagggaaactttccatgggggggtggggagagagagttttccatccacaatatagaaacagagaagcactgtgctccctctgcaggaccagccttcccttatctaaggggcatggagctcagggaggctttattccatatgcacgggagaatcaggcagaatgaacccctacccatctttcttggcttttcagtcattttgtgctgttttctctggttcattaataaattgaaactgccctccaaacaa

SEQ ID NO: 196392 - DNA, 4041 bp, Homo sapiens
  Payload ID: 18752
  Gene Name: tumor protein D52
  Uniprot ID: P55327
  ENST ID: ENST00000379096
  CDS Start-End: 116-670
gcgggagtcgccggcggaggcgaggaggagctctgcgcggcgcggcgggcgatccgagccgggacgggctgcaggcgggggtgctgcagaggacacgaggcggcgggctggagacatggaccgcggcgagcaaggtctgctgagaacagacccagtccctgaggaaggagaagatgttgctgccacgatcagtgccacagagaccctctcggaagaggagcaggaagagctaagaagagaacttgcaaaggtagaagaagaaatccagactctgtctcaagtgttagcagcaaaagagaagcatctagcagagatcaagcggaaacttggaatcaattctctacaggaactaaaacagaacattgccaaagggtggcaagacgtgacagcaacatctgcttacaagaagacatctgaaaccttatcccaggctggacagaaggcctcagctgctttttcgtctgttggctcagtcatcaccaaaaagctggaagatgtaaaaaactccccaacttttaaatcatttgaagaaaaggtcgaaaacttaaagtctaaagtagggggaaccaagcctgctggtggtgattttggagaagtcttgaattcggctgcaaatgctagtgccaccaccacggagcctcttccagaaaagacacaggagagcctgtgagattcctacctttgttctgctacccactgccagatgctgcaagcgaggtccaagcacatcttgtcaacatgcattgccatgaatttctaccagatgtgcttttatttagctttacatattcctttgaccaaatagtttgtgggttaaacaaaatgaaaatatcttcacctctattcttgggaaacaccctttagtgtacatttatgttcctttatttaggaaacaccattataaaaacacttatagtaaatggggacattcactataatgatctaagaagctacagattgtcatagttgttttcctgctttacaaaattgctccagatctggaatgccagtttgacctttgtcttctataatatttcctttttttcccctctttgaatctctgtatatttgattcttaactaaaattgttctcttaaatattctgaatcctggtaattaaaagtttgggtgtattttctttacctccaaggaaagaactactagctacaaaaaatattttggaataagcattgttttggtataaggtacatattttggttgaagacaccagactgaagtaaacagctgtgcatccaatttattatagttttgtaagtaacaatatgtaatcaaacttctaggtgacttgagagtggaacctcctatatcattatttagcaccgtttgtgacagtaaccatttcagtgtattgtttattataccacttatatcaacttatttttcaccaggttaaaattttaatttctacaaaataacattctgaatcaagcacactgtatgttcagtaggttgaactatgaacactgtcatcaatgttcagttcaaaagcctgaaagtttagatctagaagctggtaaaaatgacaatatcaatcacattaggggaaccattgttgtcttcacttaatccatttagcactatttaaaataagcacaccaagttatatgactaatataacttgaaaattttttatactgaggggttggtgataactcttgaggatgtaatgcattaataaaaatcaactcatcattttctacttgttttcaatgtgttggaaactgtaaaatgatactgtagaacctgtctcctactttgaaaactgaatgtcagggctgagtgaatcaaagtgtctagacatatttgcatagaggccaaggtattctattctaataactgcttactcaacactaccaccttttccttatactgtatatgattatggcctacaatgttgtatttgttatttattaaattgtgattgttttattattgtttatgccaaatgttaactgccaagcttggagtgacctaaagcattttttaaaagcatggctagatttacttcagtataaattatcttatgaaaaccaaattttaaaagccacaggtgttgattgttataaaataacatgctgccattcttgattgctagagtttttgttagtactttggatgcaattaaaactatgtgctatcacatgtgaaaagcttaataaattccatctatcagtagtataggtctcaatatttattatgagaccagtggtctggaaacagcttgttgtaccgaatcaactggagtctatgcttaaaaaaaaaaaatttttttttaaccatccttaaattattgcttaatggtatcatattaacatattctaaataagggctttaaggcacaggctgttgaagcattttctcagaggagtggatctgtagaagtctgtctttctatagaaatattgtgcttactcaagtgttaaattattttttctatgaactagtctacttcttaaaattcaaacatattcttttgatcacattgtttcttgagcatcctgccctgctactaacttttcaacaaggcaaaatggagtaaagtggcaatttctttagatgagtgaaataccctcaagtctcttttctgcccaaaaagggaaaagtgatagaaatgggggtggcaagtggggtgagtggatgaaggtgggtattgggggtggctgtgaaagaaaataatggagaatcacttttctagacatctacctatacttaatctaagaaacaaagtaatctactgtaaagtactctgccccttgaaagaagtattaaaaagagtgaggatggatttagaaaaaaacatgaatttagaaatattcaaaatggtttttgtggcagattcaatattatgaattcacagatatttaaagaatgagaaacatagtaattagtagaaatgccagaaacagttcctggttcctcttgtgtttgacactaagaaaatagcaagagtgtgaaatctcagatacttatgaaatctcacagatgtaaggactcaagtgtagaagaaaatatccccttcttacaaaaagaaatgtcaatttatggagtttgtgggaaatagggcaagaattcttatgcttatgagagccaagtagtcagtggaagagagtagagctcaaaactggattatcaccttagcaacttagaatagtttgaaatagaaaaaaagtatttaatttggatctggatctgttaagatatgcacagtctattttttgtatagtattggaaaataaaaatgctataatttgggtatgggttcttttgtatacattacctgcccattgaggaaaggggcaagtccattatgcaacttctctccaaacccttcatattctggatatgatacttaaagagccatgagcagctacattctgcctatcagaaggcatttattaaatgactgcttgctgaagatgtgtccaaagagatcctacattaaggtcatttgtcagaatgatgtttgtgtttgtttagagttggctgacctccaactcctggggtcaaggaatcctactgccttagcttcccaaatagctaggactataggcatgcacccggccatgtgttttatttatagctcttaaagcccagatgaagaaatcacatttttgcccatagtgaagaaacatttggccattgattagtccttattttcagtgactgtcctgttttcattagattagagagaccctgtgtgggccacagttaatataaaccattatcacttttaagtaaacctgcacatcttagatttcataatttccttattgttctgactcaaaatgaactaagagcttttcactttttgtttgtaagttctcagagagtcgggtctgcaagtgcttttgcctgccaggattttgtactcaaataaatgctatttggcaactaaaattcttgccagctctcatgtaattttgatgttactgaggttggttggtagtttattttattaattttgtggttcttctatcatatagaaaaagccaaatacagttttgtttgaatatttgtaaa

SEQ ID NO: 196393 - DNA, 2563 bp, Homo sapiens
  Payload ID: 18752
  Gene Name: tumor protein D52
  Uniprot ID: P55327
  ENST ID: ENST00000379097
  CDS Start-End: 364-1038
gcctgaactgtttgtacctctgggccatattgcagaaccctgcccttctttgttgactgaggaaagctcgctccctgcccaggtttttcattgttgatcgaaattaacaccaggtggtgaatagagcccctcctaaggttgctcaggataaatcatttattaaataggtctgcttatcaggaggggcgtgaaggctcccaaaaggaaatgctggcacctgggcccagaagccagggcctctaactcctggggttgatttcttcagtgaagttgcaccctacaaagggaatatggccaaagcggcactcaactgaaggctgatatcaggcgattagacagccatgcattctgcgtttgtctggaatggattgtagagagatggacttatatgaggactaccagtccccgtttgattttgatgcaggagtgaacaaaagctatctctacttgtctcctagtggaaattcatctccacccggatcacctactcttcagaaatttggtctgctgagaacagacccagtccctgaggaaggagaagatgttgctgccacgatcagtgccacagagaccctctcggaagaggagcaggaagagctaagaagagaacttgcaaaggtagaagaagaaatccagactctgtctcaagtgttagcagcaaaagagaagcatctagcagagatcaagcggaaacttggaatcaattctctacaggaactaaaacagaacattgccaaagggtggcaagacgtgacagcaacatctgcttacaagaagacatctgaaaccttatcccaggctggacagaaggcctcagctgctttttcgtctgttggctcagtcatcaccaaaaagctggaagatgtaaaaaactccccaacttttaaatcatttgaagaaaaggtcgaaaacttaaagtctaaagtagggggaaccaagcctgctggtggtgattttggagaagtcttgaattcggctgcaaatgctagtgccaccaccacggagcctcttccagaaaagacacaggagagcctgtgagattcctacctttgttctgctacccactgccagatgctgcaagcgaggtccaagcacatcttgtcaacatgcattgccatgaatttctaccagatgtgcttttatttagctttacatattcctttgaccaaatagtttgtgggttaaacaaaatgaaaatatcttcacctctattcttgggaaacaccctttagtgtacatttatgttcctttatttaggaaacaccattataaaaacacttatagtaaatggggacattcactataatgatctaagaagctacagattgtcatagttgttttcctgctttacaaaattgctccagatctggaatgccagtttgacctttgtcttctataatatttcctttttttcccctctttgaatctctgtatatttgattcttaactaaaattgttctcttaaatattctgaatcctggtaattaaaagtttgggtgtattttctttacctccaaggaaagaactactagctacaaaaaatattttggaataagcattgttttggtataaggtacatattttggttgaagacaccagactgaagtaaacagctgtgcatccaatttattatagttttgtaagtaacaatatgtaatcaaacttctaggtgacttgagagtggaacctcctatatcattatttagcaccgtttgtgacagtaaccatttcagtgtattgtttattataccacttatatcaacttatttttcaccaggttaaaattttaatttctacaaaataacattctgaatcaagcacactgtatgttcagtaggttgaactatgaacactgtcatcaatgttcagttcaaaagcctgaaagtttagatctagaagctggtaaaaatgacaatatcaatcacattaggggaaccattgttgtcttcacttaatccatttagcactatttaaaataagcacaccaagttatatgactaatataacttgaaaattttttatactgaggggttggtgataactcttgaggatgtaatgcattaataaaaatcaactcatcattttctacttgttttcaatgtgttggaaactgtaaaatgatactgtagaacctgtctcctactttgaaaactgaatgtcagggctgagtgaatcaaagtgtctagacatatttgcatagaggccaaggtattctattctaataactgcttactcaacactaccaccttttccttatactgtatatgattatggcctacaatgttgtatttgttatttattaaattgtgattgttttattattgtttatgccaaatgttaactgccaagcttggagtgacctaaagcattttttaaaagcatggctagatttacttcagtataaattatcttatgaaaaccaaattttaaaagccacaggtgttgattgttataaaataacatgctgccattcttgattgctagagtttttgttagtactttggatgcaattaaaactatgtgctatcacatgtgaaaagcttaataaattccatctatcagt

SEQ ID NO: 196394 - DNA, 4339 bp, Homo sapiens
  Payload ID: 18752
  Gene Name: tumor protein D52
  Uniprot ID: P55327
  ENST ID: ENST00000448733
  CDS Start-End: 379-1095
cagtgtctgatgtttgcctgaactgtttgtacctctgggccatattgcagaaccctgcccttctttgttgactgaggaaagctcgctccctgcccaggtttttcattgttgatcgaaattaacaccaggtggtgaatagagcccctcctaaggttgctcaggataaatcatttattaaataggtctgcttatcaggaggggcgtgaaggctcccaaaaggaaatgctggcacctgggcccagaagccagggcctctaactcctggggttgatttcttcagtgaagttgcaccctacaaagggaatatggccaaagcggcactcaactgaaggctgatatcaggcgattagacagccatgcattctgcgtttgtctggaatggattgtagagagatggacttatatgaggactaccagtccccgtttgattttgatgcaggagtgaacaaaagctatctctacttgtctcctagtggaaattcatctccacccggatcacctactcttcagaaatttggtctgctgagaacagacccagtccctgaggaaggagaagatgttgctgccacgatcagtgccacagagaccctctcggaagaggagcaggaagagctaagaagagaacttgcaaaggtagaagaagaaatccagactctgtctcaagtgttagcagcaaaagagaagcatctagcagagatcaagcggaaacttggaatcaattctctacaggaactaaaacagaacattgccaaagggtggcaagacgtgacagcaacatctgcttacaagaagacatctgaaaccttatcccaggctggacagaaggcctcagctgctttttcgtctgttggctcagtcatcaccaaaaagctggaagatgtaaatatacgttccattcagcattcaattagcatgcctgctatgagaaactccccaacttttaaatcatttgaagaaaaggtcgaaaacttaaagtctaaagtagggggaaccaagcctgctggtggtgattttggagaagtcttgaattcggctgcaaatgctagtgccaccaccacggagcctcttccagaaaagacacaggagagcctgtgagattcctacctttgttctgctacccactgccagatgctgcaagcgaggtccaagcacatcttgtcaacatgcattgccatgaatttctaccagatgtgcttttatttagctttacatattcctttgaccaaatagtttgtgggttaaacaaaatgaaaatatcttcacctctattcttgggaaacaccctttagtgtacatttatgttcctttatttaggaaacaccattataaaaacacttatagtaaatggggacattcactataatgatctaagaagctacagattgtcatagttgttttcctgctttacaaaattgctccagatctggaatgccagtttgacctttgtcttctataatatttcctttttttcccctctttgaatctctgtatatttgattcttaactaaaattgttctcttaaatattctgaatcctggtaattaaaagtttgggtgtattttctttacctccaaggaaagaactactagctacaaaaaatattttggaataagcattgttttggtataaggtacatattttggttgaagacaccagactgaagtaaacagctgtgcatccaatttattatagttttgtaagtaacaatatgtaatcaaacttctaggtgacttgagagtggaacctcctatatcattatttagcaccgtttgtgacagtaaccatttcagtgtattgtttattataccacttatatcaacttatttttcaccaggttaaaattttaatttctacaaaataacattctgaatcaagcacactgtatgttcagtaggttgaactatgaacactgtcatcaatgttcagttcaaaagcctgaaagtttagatctagaagctggtaaaaatgacaatatcaatcacattaggggaaccattgttgtcttcacttaatccatttagcactatttaaaataagcacaccaagttatatgactaatataacttgaaaattttttatactgaggggttggtgataactcttgaggatgtaatgcattaataaaaatcaactcatcattttctacttgttttcaatgtgttggaaactgtaaaatgatactgtagaacctgtctcctactttgaaaactgaatgtcagggctgagtgaatcaaagtgtctagacatatttgcatagaggccaaggtattctattctaataactgcttactcaacactaccaccttttccttatactgtatatgattatggcctacaatgttgtatttgttatttattaaattgtgattgttttattattgtttatgccaaatgttaactgccaagcttggagtgacctaaagcattttttaaaagcatggctagatttacttcagtataaattatcttatgaaaaccaaattttaaaagccacaggtgttgattgttataaaataacatgctgccattcttgattgctagagtttttgttagtactttggatgcaattaaaactatgtgctatcacatgtgaaaagcttaataaattccatctatcagtagtataggtctcaatatttattatgagaccagtggtctggaaacagcttgttgtaccgaatcaactggagtctatgcttaaaaaaaaaaaatttttttttaaccatccttaaattattgcttaatggtatcatattaacatattctaaataagggctttaaggcacaggctgttgaagcattttctcagaggagtggatctgtagaagtctgtctttctatagaaatattgtgcttactcaagtgttaaattattttttctatgaactagtctacttcttaaaattcaaacatattcttttgatcacattgtttcttgagcatcctgccctgctactaacttttcaacaaggcaaaatggagtaaagtggcaatttctttagatgagtgaaataccctcaagtctcttttctgcccaaaaagggaaaagtgatagaaatgggggtggcaagtggggtgagtggatgaaggtgggtattgggggtggctgtgaaagaaaataatggagaatcacttttctagacatctacctatacttaatctaagaaacaaagtaatctactgtaaagtactctgccccttgaaagaagtattaaaaagagtgaggatggatttagaaaaaaacatgaatttagaaatattcaaaatggtttttgtggcagattcaatattatgaattcacagatatttaaagaatgagaaacatagtaattagtagaaatgccagaaacagttcctggttcctcttgtgtttgacactaagaaaatagcaagagtgtgaaatctcagatacttatgaaatctcacagatgtaaggactcaagtgtagaagaaaatatccccttcttacaaaaagaaatgtcaatttatggagtttgtgggaaatagggcaagaattcttatgcttatgagagccaagtagtcagtggaagagagtagagctcaaaactggattatcaccttagcaacttagaatagtttgaaatagaaaaaaagtatttaatttggatctggatctgttaagatatgcacagtctattttttgtatagtattggaaaataaaaatgctataatttgggtatgggttcttttgtatacattacctgcccattgaggaaaggggcaagtccattatgcaacttctctccaaacccttcatattctggatatgatacttaaagagccatgagcagctacattctgcctatcagaaggcatttattaaatgactgcttgctgaagatgtgtccaaagagatcctacattaaggtcatttgtcagaatgatgtttgtgtttgtttagagttggctgacctccaactcctggggtcaaggaatcctactgccttagcttcccaaatagctaggactataggcatgcacccggccatgtgttttatttatagctcttaaagcccagatgaagaaatcacatttttgcccatagtgaagaaacatttggccattgattagtccttattttcagtgactgtcctgttttcattagattagagagaccctgtgtgggccacagttaatataaaccattatcacttttaagtaaacctgcacatcttagatttcataatttccttattgttctgactcaaaatgaactaagagcttttcactttttgtttgtaagttctcagagagtcgggtctgcaagtgcttttgcctgccaggattttgtactcaaataaatgctatttggcaact

SEQ ID NO: 196395 - DNA, 1594 bp, Homo sapiens
  Payload ID: 18752
  Gene Name: tumor protein D52
  ENST ID: ENST00000519303
  CDS Start-End: 603-785
gtgcgtgtgtgggggagagggagagaaggttctgggaggtggcgaaggggctagcgtcaggggctggcggccgtgatgcgctttgggtggaaagccgcgtgaagggagcacggcgcagccagctcctgtaagtgactggaaccaggaacagaggacagtgagtcgctctcgtccctccaggtctgctgagaacagacccagtccctgaggaaggagaagatgttgctgccacgatcagtgccacagagaccctctcggaagaggagcaggaagagctaagaagagaacttgcaaaggtagaagaagaaatccagactctgtctcaagtgttagcagcaaaagagaagcatctagcagagatcaagcggaaacttggaatcaattctctacaggaactaaaacagaacattgccaaagggtggcaagacgtgacagcaacatctgcttacaagaagacatctgaaaccttatcccaggctggacagaaggcctcagctgctttttcgtctgttggctcagtcatcaccaaaaagctggaagatgtaaaattgcaagccttttcacattcctttagtatacgttccattcagcattcaattagcatgcctgctatgagaaactccccaacttttaaatcatttgaagaaaaggtcgaaaacttaaagtctaaagtagggggaaccaagcctgctggtggtgattttggagaagtcttgaattcggctgcaaatgctagtgccaccaccacggagcctcttccagaaaagacacaggagagcctgtgagattcctacctttgttctgctacccactgccagatgctgcaagcgaggtccaagcacatcttgtcaacatgcattgccatgaatttctaccagatgtgcttttatttagctttacatattcctttgaccaaatagtttgtgggttaaacaaaatgaaaatatcttcacctctattcttgggaaacaccctttagtgtacatttatgttcctttatttaggaaacaccattataaaaacacttatagtaaatggggacattcactataatgatctaagaagctacagattgtcatagttgttttcctgctttacaaaattgctccagatctggaatgccagtttgacctttgtcttctataatatttcctttttttcccctctttgaatctctgtatatttgattcttaactaaaattgttctcttaaatattctgaatcctggtaattaaaagtttgggtgtattttctttacctccaaggaaagaactactagctacaaaaaatattttggaataagcattgttttggtataaggtacatattttggttgaagacaccagactgaagtaaacagctgtgcatccaatttattatagttttgtaagtaacaatatgtaatcaaacttctaggtgacttgagagtggaacctcctatatcattatttagcaccgtttgtgacagtaaccatttcagtgtattgtttattataccacttatatcaacttatttttcaccaggttaaaattttaatttctacaaaataacattctgaatcaagcacactgtatgttcagtaggttgaactat

SEQ ID NO: 196396 - DNA, 2638 bp, Homo sapiens
  Payload ID: 18752
  Gene Name: tumor protein D52
  Uniprot ID: P55327
  ENST ID: ENST00000520527
  CDS Start-End: 364-1107
gcctgaactgtttgtacctctgggccatattgcagaaccctgcccttctttgttgactgaggaaagctcgctccctgcccaggtttttcattgttgatcgaaattaacaccaggtggtgaatagagcccctcctaaggttgctcaggataaatcatttattaaataggtctgcttatcaggaggggcgtgaaggctcccaaaaggaaatgctggcacctgggcccagaagccagggcctctaactcctggggttgatttcttcagtgaagttgcaccctacaaagggaatatggccaaagcggcactcaactgaaggctgatatcaggcgattagacagccatgcattctgcgtttgtctggaatggattgtagagagatggacttatatgaggactaccagtccccgtttgattttgatgcaggagtgaacaaaagctatctctacttgtctcctagtggaaattcatctccacccggatcacctactcttcagaaatttggtctgctgagaacagacccagtccctgaggaaggagaagatgttgctgccacgatcagtgccacagagaccctctcggaagaggagcaggaagagctaagaagagaacttgcaaaggtagaagaagaaatccagactctgtctcaagtgttagcagcaaaagagaagcatctagcagagatcaagcggaaacttggaatcaattctctacaggaactaaaacagaacattgccaaagggtggcaagacgtgacagcaacatctgcttacaagaagacatctgaaaccttatcccaggctggacagaaggcctcagctgctttttcgtctgttggctcagtcatcaccaaaaagctggaagatgtaaaattgcaagccttttcacattcctttagtatacgttccattcagcattcaattagcatgcctgctatgagaaactccccaacttttaaatcatttgaagaaaaggtcgaaaacttaaagtctaaagtagggggaaccaagcctgctggtggtgattttggagaagtcttgaattcggctgcaaatgctagtgccaccaccacggagcctcttccagaaaagacacaggagagcctgtgagattcctacctttgttctgctacccactgccagatgctgcaagcgaggtccaagcacatcttgtcaacatgcattgccatgaatttctaccagatgtgcttttatttagctttacatattcctttgaccaaatagtttgtgggttaaacaaaatgaaaatatcttcacctctattcttgggaaacaccctttagtgtacatttatgttcctttatttaggaaacaccattataaaaacacttatagtaaatggggacattcactataatgatctaagaagctacagattgtcatagttgttttcctgctttacaaaattgctccagatctggaatgccagtttgacctttgtcttctataatatttcctttttttcccctctttgaatctctgtatatttgattcttaactaaaattgttctcttaaatattctgaatcctggtaattaaaagtttgggtgtattttctttacctccaaggaaagaactactagctacaaaaaatattttggaataagcattgttttggtataaggtacatattttggttgaagacaccagactgaagtaaacagctgtgcatccaatttattatagttttgtaagtaacaatatgtaatcaaacttctaggtgacttgagagtggaacctcctatatcattatttagcaccgtttgtgacagtaaccatttcagtgtattgtttattataccacttatatcaacttatttttcaccaggttaaaattttaatttctacaaaataacattctgaatcaagcacactgtatgttcagtaggttgaactatgaacactgtcatcaatgttcagttcaaaagcctgaaagtttagatctagaagctggtaaaaatgacaatatcaatcacattaggggaaccattgttgtcttcacttaatccatttagcactatttaaaataagcacaccaagttatatgactaatataacttgaaaattttttatactgaggggttggtgataactcttgaggatgtaatgcattaataaaaatcaactcatcattttctacttgttttcaatgtgttggaaactgtaaaatgatactgtagaacctgtctcctactttgaaaactgaatgtcagggctgagtgaatcaaagtgtctagacatatttgcatagaggccaaggtattctattctaataactgcttactcaacactaccaccttttccttatactgtatatgattatggcctacaatgttgtatttgttatttattaaattgtgattgttttattattgtttatgccaaatgttaactgccaagcttggagtgacctaaagcattttttaaaagcatggctagatttacttcagtataaattatcttatgaaaaccaaattttaaaagccacaggtgttgattgttataaaataacatgctgccattcttgattgctagagtttttgttagtactttggatgcaattaaaactatgtgctatcacatgtgaaaagcttaataaattccatctatcagtagtata

SEQ ID NO: 196397 - DNA, 2596 bp, Homo sapiens
  Payload ID: 18752
  Gene Name: tumor protein D52
  Uniprot ID: P55327
  ENST ID: ENST00000517427
  CDS Start-End: 364-1065
gcctgaactgtttgtacctctgggccatattgcagaaccctgcccttctttgttgactgaggaaagctcgctccctgcccaggtttttcattgttgatcgaaattaacaccaggtggtgaatagagcccctcctaaggttgctcaggataaatcatttattaaataggtctgcttatcaggaggggcgtgaaggctcccaaaaggaaatgctggcacctgggcccagaagccagggcctctaactcctggggttgatttcttcagtgaagttgcaccctacaaagggaatatggccaaagcggcactcaactgaaggctgatatcaggcgattagacagccatgcattctgcgtttgtctggaatggattgtagagagatggacttatatgaggactaccagtccccgtttgattttgatgcaggagtgaacaaaagctatctctacttgtctcctagtggaaattcatctccacccggatcacctactcttcagaaatttggtctgctgagaacagacccagtccctgaggaaggagaagatgttgctgccacgatcagtgccacagagaccctctcggaagaggagcaggaagagctaagaagagaacttgcaaaggtagaagaagaaatccagactctgtctcaagtgttagcagcaaaagagaagcatctagcagagatcaagcggaaacttggaatcaattctctacaggaactaaaacagaacattgccaaagggtggcaagacgtgacagcaacatctgcttacaagaagacatctgaaaccttatcccaggctggacagaaggcctcagctgctttttcgtctgttggctcagtcatcaccaaaaagctggaagatgtaaaattgcaagccttttcacattcctttagaaactccccaacttttaaatcatttgaagaaaaggtcgaaaacttaaagtctaaagtagggggaaccaagcctgctggtggtgattttggagaagtcttgaattcggctgcaaatgctagtgccaccaccacggagcctcttccagaaaagacacaggagagcctgtgagattcctacctttgttctgctacccactgccagatgctgcaagcgaggtccaagcacatcttgtcaacatgcattgccatgaatttctaccagatgtgcttttatttagctttacatattcctttgaccaaatagtttgtgggttaaacaaaatgaaaatatcttcacctctattcttgggaaacaccctttagtgtacatttatgttcctttatttaggaaacaccattataaaaacacttatagtaaatggggacattcactataatgatctaagaagctacagattgtcatagttgttttcctgctttacaaaattgctccagatctggaatgccagtttgacctttgtcttctataatatttcctttttttcccctctttgaatctctgtatatttgattcttaactaaaattgttctcttaaatattctgaatcctggtaattaaaagtttgggtgtattttctttacctccaaggaaagaactactagctacaaaaaatattttggaataagcattgttttggtataaggtacatattttggttgaagacaccagactgaagtaaacagctgtgcatccaatttattatagttttgtaagtaacaatatgtaatcaaacttctaggtgacttgagagtggaacctcctatatcattatttagcaccgtttgtgacagtaaccatttcagtgtattgtttattataccacttatatcaacttatttttcaccaggttaaaattttaatttctacaaaataacattctgaatcaagcacactgtatgttcagtaggttgaactatgaacactgtcatcaatgttcagttcaaaagcctgaaagtttagatctagaagctggtaaaaatgacaatatcaatcacattaggggaaccattgttgtcttcacttaatccatttagcactatttaaaataagcacaccaagttatatgactaatataacttgaaaattttttatactgaggggttggtgataactcttgaggatgtaatgcattaataaaaatcaactcatcattttctacttgttttcaatgtgttggaaactgtaaaatgatactgtagaacctgtctcctactttgaaaactgaatgtcagggctgagtgaatcaaagtgtctagacatatttgcatagaggccaaggtattctattctaataactgcttactcaacactaccaccttttccttatactgtatatgattatggcctacaatgttgtatttgttatttattaaattgtgattgttttattattgtttatgccaaatgttaactgccaagcttggagtgacctaaagcattttttaaaagcatggctagatttacttcagtataaattatcttatgaaaaccaaattttaaaagccacaggtgttgattgttataaaataacatgctgccattcttgattgctagagtttttgttagtactttggatgcaattaaaactatgtgctatcacatgtgaaaagcttaataaattccatctatcagtagtata

SEQ ID NO: 196398 - DNA, 2702 bp, Homo sapiens
  Payload ID: 18752
  Gene Name: tumor protein D52
  Uniprot ID: P55327
  ENST ID: ENST00000517462
  CDS Start-End: 364-819
gcctgaactgtttgtacctctgggccatattgcagaaccctgcccttctttgttgactgaggaaagctcgctccctgcccaggtttttcattgttgatcgaaattaacaccaggtggtgaatagagcccctcctaaggttgctcaggataaatcatttattaaataggtctgcttatcaggaggggcgtgaaggctcccaaaaggaaatgctggcacctgggcccagaagccagggcctctaactcctggggttgatttcttcagtgaagttgcaccctacaaagggaatatggccaaagcggcactcaactgaaggctgatatcaggcgattagacagccatgcattctgcgtttgtctggaatggattgtagagagatggacttatatgaggactaccagtccccgtttgattttgatgcaggagtgaacaaaagctatctctacttgtctcctagtggaaattcatctccacccggatcacctactcttcagaaatttggtctgctgagaacagacccagtccctgaggaaggagaagatgttgctgccacgatcagtgccacagagaccctctcggaagaggagcaggaagagctaagaagagaacttgcaaaggtagaagaagaaatccagactctgtctcaagtgttagcagcaaaagagaagcatctagcagagatcaagcggaaacttggaatcaattctctacaggaactaaaacagaacattgccaaagggtggcaagacgtgacagcaacatctgcgaggagcaagcttctagcagcagaaaccgaactgctctgtcttctgtattgagagccatctgcagagctgttacaagaagacatctgaaaccttatcccaggctggacagaaggcctcagctgctttttcgtctgttggctcagtcatcaccaaaaagctggaagatgtaaaattgcaagccttttcacattcctttagtatacgttccattcagcattcaattagcatgcctgctatgagaaactccccaacttttaaatcatttgaagaaaaggtcgaaaacttaaagtctaaagtagggggaaccaagcctgctggtggtgattttggagaagtcttgaattcggctgcaaatgctagtgccaccaccacggagcctcttccagaaaagacacaggagagcctgtgagattcctacctttgttctgctacccactgccagatgctgcaagcgaggtccaagcacatcttgtcaacatgcattgccatgaatttctaccagatgtgcttttatttagctttacatattcctttgaccaaatagtttgtgggttaaacaaaatgaaaatatcttcacctctattcttgggaaacaccctttagtgtacatttatgttcctttatttaggaaacaccattataaaaacacttatagtaaatggggacattcactataatgatctaagaagctacagattgtcatagttgttttcctgctttacaaaattgctccagatctggaatgccagtttgacctttgtcttctataatatttcctttttttcccctctttgaatctctgtatatttgattcttaactaaaattgttctcttaaatattctgaatcctggtaattaaaagtttgggtgtattttctttacctccaaggaaagaactactagctacaaaaaatattttggaataagcattgttttggtataaggtacatattttggttgaagacaccagactgaagtaaacagctgtgcatccaatttattatagttttgtaagtaacaatatgtaatcaaacttctaggtgacttgagagtggaacctcctatatcattatttagcaccgtttgtgacagtaaccatttcagtgtattgtttattataccacttatatcaacttatttttcaccaggttaaaattttaatttctacaaaataacattctgaatcaagcacactgtatgttcagtaggttgaactatgaacactgtcatcaatgttcagttcaaaagcctgaaagtttagatctagaagctggtaaaaatgacaatatcaatcacattaggggaaccattgttgtcttcacttaatccatttagcactatttaaaataagcacaccaagttatatgactaatataacttgaaaattttttatactgaggggttggtgataactcttgaggatgtaatgcattaataaaaatcaactcatcattttctacttgttttcaatgtgttggaaactgtaaaatgatactgtagaacctgtctcctactttgaaaactgaatgtcagggctgagtgaatcaaagtgtctagacatatttgcatagaggccaaggtattctattctaataactgcttactcaacactaccaccttttccttatactgtatatgattatggcctacaatgttgtatttgttatttattaaattgtgattgttttattattgtttatgccaaatgttaactgccaagcttggagtgacctaaagcattttttaaaagcatggctagatttacttcagtataaattatcttatgaaaaccaaattttaaaagccacaggtgttgattgttataaaataacatgctgccattcttgattgctagagtttttgttagtactttggatgcaattaaaactatgtgctatcacatgtgaaaagcttaataaattccatctatcagt

SEQ ID NO: 196399 - DNA, 2856 bp, Homo sapiens
  Payload ID: 18752
  Gene Name: tumor protein D52
  Uniprot ID: P55327
  ENST ID: ENST00000518937
  CDS Start-End: 217-840
aggtcgaccgggtcaggtggttgggtgacgccccaggaaagcgctccaggccgagggcgggcggcgccgccgcgcccgacgcctctgggggtggggacttcgcgggagtcgccggcggaggcgaggaggagctctgcgcggcgcggcgggcgatccgagccgggacgggctgcaggcgggggtgctgcagaggacacgaggcggcgggctggagacatggaccgcggcgagcaaggtctgctgagaacagacccagtccctgaggaaggagaagatgttgctgccacgatcagtgccacagagaccctctcggaagaggagcaggaagagctaagaagagaacttgcaaaggtagaagaagaaatccagactctgtctcaagtgttagcagcaaaagagaagcatctagcagagatcaagcggaaacttggaatcaattctctacaggaactaaaacagaacattgccaaagggtggcaagacgtgacagcaacatctgcttacaagaagacatctgaaaccttatcccaggctggacagaaggcctcagctgctttttcgtctgttggctcagtcatcaccaaaaagctggaagatgtaaaattgcaagccttttcacattcctttagtatacgttccattcagcattcaattagcatgcctgctatgagaaactccccaacttttaaatcatttgaagaaaaggtcgaaaacttaaagtctaaagtagggggaaccaagcctgctggtggtgattttggagaagtcttgaattcggctgcaaatgctagtgccaccaccacggagcctcttccagaaaagacacaggagagcctgtgagattcctacctttgttctgctacccactgccagatgctgcaagcgaggtccaagcacatcttgtcaacatgcattgccatgaatttctaccagatgtgcttttatttagctttacatattcctttgaccaaatagtttgtgggttaaacaaaatgaaaatatcttcacctctattcttgggaaacaccctttagtgtacatttatgttcctttatttaggaaacaccattataaaaacacttatagtaaatggggacattcactataatgatctaagaagctacagattgtcatagttgttttcctgctttacaaaattgctccagatctggaatgccagtttgacctttgtcttctataatatttcctttttttcccctctttgaatctctgtatatttgattcttaactaaaattgttctcttaaatattctgaatcctggtaattaaaagtttgggtgtattttctttacctccaaggaaagaactactagctacaaaaaatattttggaataagcattgttttggtataaggtacatattttggttgaagacaccagactgaagtaaacagctgtgcatccaatttattatagttttgtaagtaacaatatgtaatcaaacttctaggtgacttgagagtggaacctcctatatcattatttagcaccgtttgtgacagtaaccatttcagtgtattgtttattataccacttatatcaacttatttttcaccaggttaaaattttaatttctacaaaataacattctgaatcaagcacactgtatgttcagtaggttgaactatgaacactgtcatcaatgttcagttcaaaagcctgaaagtttagatctagaagctggtaaaaatgacaatatcaatcacattaggggaaccattgttgtcttcacttaatccatttagcactatttaaaataagcacaccaagttatatgactaatataacttgaaaattttttatactgaggggttggtgataactcttgaggatgtaatgcattaataaaaatcaactcatcattttctacttgttttcaatgtgttggaaactgtaaaatgatactgtagaacctgtctcctactttgaaaactgaatgtcagggctgagtgaatcaaagtgtctagacatatttgcatagaggccaaggtattctattctaataactgcttactcaacactaccaccttttccttatactgtatatgattatggcctacaatgttgtatttgttatttattaaattgtgattgttttattattgtttatgccaaatgttaactgccaagcttggagtgacctaaagcattttttaaaagcatggctagatttacttcagtataaattatcttatgaaaaccaaattttaaaagccacaggtgttgattgttataaaataacatgctgccattcttgattgctagagtttttgttagtactttggatgcaattaaaactatgtgctatcacatgtgaaaagcttaataaattccatctatcagtagtataggtctcaatatttattatgagaccagtggtctggaaacagcttgttgtaccgaatcaactggagtctatgcttaaaaaaaaaaaatttttttttaaccatccttaaattattgcttaatggtatcatattaacatattctaaataagggctttaaggcacaggctgttgaagcattttctcagaggagtggatctgtagaagtctgtctttctatagaaatattgtgcttactcaagtgttaaattattttttctatgaactagtctacttcttaaaattcaaacatattcttttgatcacattgtttcttgagcatcctgccctgctactaacttttcaacaaggcaaaatggagtaaagtggcaatttctttagatgagtgaaataccctcaagtctcttttctgcccaaaaagggaaaagtgatagaaatgggggtggcaagtggggtgagtggatgaaggtgggtattgggggtggctgtg

SEQ ID NO: 196400 - DNA, 587 bp, Homo sapiens
  Payload ID: 18752
  Gene Name: tumor protein D52
  ENST ID: ENST00000523753
  CDS Start-End: 66-182
gatccgagccgggacgggctgcaggcgggggtgctgcagaggacacgaggcggcgggctggagacatggaccgcggcgagcaagctttttatttcatctggaatttctggcttgaattagggaaagatttatcttttctccactcatataaaatgtctgctgagaacagacccagtccctgaggaaggagaagatgttgctgccacgatcagtgccacagagaccctctcggaagaggagcaggaagagctaagaagagaacttgcaaaggtagaagaagaaatccagactctgtctcaagtgttagcagcaaaagagaagcatctagcagagatcaagcggaaacttggaatcaattctctacaggaactaaaacagaacattgccaaagggtggcaagacgtgacagcaacatctgcttacaagaagacatctgaaaccttatcccaggctggacagaaggcctcagctgctttttcgtctgttggctcagtcatcaccaaaaagctggaagatgtaaaattgcaagccttttcacattcctttagtatacgttccattcagcattcaattagcatgcctgctat

SEQ ID NO: 196401 - DNA, 723 bp, Homo sapiens
  Payload ID: 18752
  Gene Name: tumor protein D52
  ENST ID: ENST00000521241
  CDS Start-End: 131-466
gggggtggggacttcgcgggagtcgccggcggaggcgaggaggagctctgcgcggcgcggcgggcgatccgagccgggacgggctgcaggcgggggtgctgcagaggacacgaggcggcgggctggagacatggaccgcggcgagcaaggtctgctgagaacagacccagtccctgaggaaggagaagatgttgctgccacgatcagtgccacagagaccctctcggaagaggagcaggaagagctaagaagagaacttgcaaaggtagaagaagaaatccagactctgtctcaagtgttagcagcaaaagagaagcatctagcagagatcaagcggaaacttggaatcaattctctacaggaactaaaacagaacattgccaaagggtggcaagacgtgacagcaacatctgcgaggagcaagcttctagcagcagaaaccgaactgctctgtcttctgtattgagagccatctgcagagctgttacaagaagacatctgaaaccttatcccaggctggacagaaggcctcagctgctttttcgtctgttggctcagtcatcaccaaaaagctggaagatgtaaaattgcaagccttttcacattcctttagtatacgttccattcagcattcaattagcatgcctgctatgagaaactccccaacttttaaatcatttgaagaaaaggtcgaaaacttaaagtctaaagtagggggaacca

SEQ ID NO: 196402 - DNA, 584 bp, Homo sapiens
  Payload ID: 18752
  Gene Name: tumor protein D52
  ENST ID: ENST00000518517
  CDS Start-End: 29-145
agaggacacgaggcggcgggctggagacatggaccgcggcgagcaagctttttatttcatctggaatttctggcttgaattagggaaagatttatcttttctccactcatataaaatgtctgctgagaacagacccagtccctgaggaaggagaagatgttgctgccacgatcagtgccacagagaccctctcggaagaggagcaggaagagctaagaagagaacttgcaaaggtagaagaagaaatccagactctgtctcaagtgttagcagcaaaagagaagcatctagcagagatcaagcggaaacttggaatcaattctctacaggaactaaaacagaacattgccaaagggtggcaagacgtgacagcaacatctgcttacaagaagacatctgaaaccttatcccaggctggacagaaggcctcagctgctttttcgtctgttggctcagtcatcaccaaaaagctggaagatgtaaaaaactccccaacttttaaatcatttgaagaaaaggtcgaaaacttaaagtctaaagtagggggaaccaagcctgctggtggtgattttggagaagtcttg

SEQ ID NO: 196403 - DNA, 785 bp, Homo sapiens
  Payload ID: 18752
  Gene Name: tumor protein D52
  ENST ID: ENST00000521354
  CDS Start-End: 114-299
gggagtcgccggcggaggcgaggaggagctctgcgcggcgcggcgggcgatccgagccgggacgggctgcaggcgggggtgctgcagaggacacgaggcggcgggctggagacatggaccgcggcgagcaaggtagaagaagaaatccagactctgtctcaagtgttagcagcaaaagagaagcatctagcagagatcaagcggaaacttggaatcaattctctacaggaactaaaacagaacattgccaaagggtggcaagacgtgacagcaacatctgcttacaagaagacatctgaaaccttatcccaggctggacagaaggcctcagctgctttttcgtctgttggctcagtcatcaccaaaaagctggaagatgtaaaaaactccccaacttttaaatcatttgaagaaaaggtcgaaaacttaaagtctaaagtagggggaaccaagcctgctggtggtgattttggagaagtcttgaattcggctgcaaatgctagtgccaccaccacggagcctcttccagaaaagacacaggagagcctgtgagattcctacctttgttctgctacccactgccagatgctgcaagcgaggtccaagcacatcttgtcaacatgcattgccatgaatttctaccagatgtgcttttatttagctttacatattcctttgaccaaatagtttgtgggttaaacaaaatgaaaatatcttcacctctattcttgggaaacaccctttagtgtacatttatgttcctttatttaggaaacaccattata

SEQ ID NO: 196404 - DNA, 445 bp, Homo sapiens
  Payload ID: 18752
  Gene Name: tumor protein D52
  ENST ID: ENST00000520795
  CDS Start-End: 1-445
tcgggcttggactcgggctttggctcggcgcggggctgagcgcggcccggcggctcgagcaggtgccgagcctcctgggccggcgccgcaagttgcatctcccggatccggatctggcatcctggggccctggaaggagcggctctggcgggggcagatgggactgcatgtgtgagtgtctgctgagaacagacccagtccctgaggaaggagaagatgttgctgccacgatcagtgccacagagaccctctcggaagaggagcaggaagagctaagaagagaacttgcaaaggtagaagaagaaatccagactctgtctcaagtgttagcagcaaaagagaagcatctagcagagatcaagcggaaacttggaatcaattctctacaggaactaaaacagaacattgccaaagggtggcaagacgtgacagcaacatctgcgta

SEQ ID NO: 196405 - DNA, 1468 bp, Homo sapiens
  Payload ID: 18753
  Gene Name: tumor protein D52-like 1
  ENST ID: ENST00000304877
  CDS Start-End: 304-933
gcccttatagcgccgggagtgggtgccttccgccggctgtacagagcgccggcaggtggcgcccagcggcgagcttgttccagcttggtttgggccaggtggactggaaggggcggaggtaaccagaagcggctagtggcggctgcctgcgtccccaaccccctccgcgcagcgctcgcgacacgcgtgccaggagtgggagcgagcggcggggccagctgcgttctgagcctgggcgcagctgccatctgctctgggaagcaccagggtgtccccgccgccctcagctcgaagtcagccaccatggaggcgcaggcacaaggtttgttggagactgaaccgttgcaaggaacagacgaagatgcagtagccagtgctgacttctctagcatgctctctgaggaggaaaaggaagagttaaaagcagagttagttcagctagaagacgaaattacaacactacgacaagttttgtcagcgaaagaaaggcatctagttgagataaaacaaaaactcggcatgaacctgatgaatgaattaaaacagaacttcagcaaaagctggcatgacatgcagactaccactgcctacaagaaaacacatgaaaccctgagtcacgcagggcaaaaggcaactgcagctttcagcaacgttggaacggccatcagcaagaagttcggagacatgaggtctcactccatcggttactccattcgccattccataagtatgcctgctatgaggaattctcctactttcaaatcatttgaggagagggttgagacaactgtcacaagcctcaagacgaaagtaggcggtacgaaccctaatggaggcagttttgaggaggtcctcagctccacggcccatgccagtgcccagagcttggcaggaggctcccggcggaccaaggaggaggagctgcagtgctaagtccagccagcgtgcagctgcatccagaaaccggccactacccagcccatctctgcctgtgcttatccagataagaagaccaaaatcccgctgggaaaaacccaggccttgacattgttattcaaatggcccctccagaaagtttaatgatttccatttgtatttgtgttgatgatggaccacttgaccatcacatttcagtattcatagatgactgtcacattttaaaatgttcccacttgagcaggtacacaactggtcataattcctgtctgtgtaattcgatgtatatttttccaaacatgtagctattgtttgctttgatttttgcttggcctcctttatgatgtgcatgtccttgaaggctgaatgaacagtccctttcagttcagcagatcaacaggatggagctcttcatgactgtctccagcaataggatgatttactataaatttcatccaactacttgtgatctctctcacctacatcaattatgtatgttaatttcagcaattaaaagaattgattttaatga

SEQ ID NO: 196406 - DNA, 2147 bp, Homo sapiens
  Payload ID: 18753
  Gene Name: tumor protein D52-like 1
  Uniprot ID: Q16890
  ENST ID: ENST00000368388
  CDS Start-End: 188-583
aggtaaccagaagcggctagtggcggctgcctgcgtccccaaccccctccgcgcagcgctcgcgacacgcgtgccaggagtgggagcgagcggcggggccagctgcgttctgagcctgggcgcagctgccatctgctctgggaagcaccagggtgtccccgccgccctcagctcgaagtcagccaccatggaggcgcaggcacaaggtttgttggagactgaaccgttgcaaggaacagacgaagatgcagtagccagtgctgacttctctagcatgctctctgaggaggaaaaggaagagttaaaagcagagttagttcagctagaagacgaaattacaacactacgacaagttttgtcagcgaaagaaaggcatctagttgagataaaacaaaaactcggcatgaacctgatgaatgaattaaaacagaacttcagcaaaagctggcatgacatgcagactaccactgcctacaagaaaacacatgaaaccctgagtcacgcagggcaaaaggcaactgcagctttcagcaacgttggaacggccatcagcaagaagttcggagacatgagacgaaagtaggcggtacgaaccctaatggaggcagttttgaggaggtcctcagctccacggcccatgccagtgcccagagcttggcaggaggctcccggcggaccaaggaggaggagctgcagtgctaagtccagccagcgtgcagctgcatccagaaaccggccactacccagcccatctctgcctgtgcttatccagataagaagaccaaaatcccgctgggaaaaacccaggccttgacattgttattcaaatggcccctccagaaagtttaatgatttccatttgtatttgtgttgatgatggaccacttgaccatcacatttcagtattcatagatgactgtcacattttaaaatgttcccacttgagcaggtacacaactggtcataattcctgtctgtgtaattcgatgtatatttttccaaacatgtagctattgtttgctttgatttttgcttggcctcctttatgatgtgcatgtccttgaaggctgaatgaacagtccctttcagttcagcagatcaacaggatggagctcttcatgactgtctccagcaataggatgatttactataaatttcatccaactacttgtgatctctctcacctacatcaattatgtatgttaatttcagcaattaaaagaattgattttaatgactttgaattcttaatttctttgtcttaaaagttgctagttatgattttacagatgcaattttaaatcaacttttagccaggtgcggcggctcacacctgtaatcccaactattttggatgccaaggtgagaggattgcttgaggccaggagttaaagatcagcctgggcaacacagaccctgtctctacaaaaaaagaaaaaaattagccagacatagtgttgcttgcctgtagtcccagctactctagaggctgaggcaggaggattgcatgagcctaggagttcgaaactgcagtgagctatgattgcaccactgcactactccagcctgggtgacagagtgggacactgtctccaaaaatagtaataataagtagtcaacttttactgctaatttggtgaacatgagagaggatatgaaaataaatattacctcagctatcctaggatgttaaaataatctccaattttaaaattctctccaatctacatacagtagtagttagtcagataaaggatatccaaaaaagagatagctagaaaatgggagaagcagagttctgcaacccctttcagtttgtaaattgttcacatgtatgaaaataactggtatttatcaatccactcagatttctgcactaacttttatcttatatatcatatgtatctcttttctttttctaaatgggaacatatatttgttattaggtggcagagatatagccttaagatatatttgtaaaatgcacactgaatagacatccaacctaaaaaaaatcactatttaaaaagcccatataatatatacatatttgttagcatgctaattgttcatgttttgtgtttattaaatagaagtgatatatatgacattttgaagtaaagcacatctgaaaaattctactcaaa

SEQ ID NO: 196407 - DNA, 1308 bp, Homo sapiens
  Payload ID: 18753
  Gene Name: tumor protein D52-like 1
  Uniprot ID: Q16890
  ENST ID: ENST00000368402
  CDS Start-End: 220-654
ttggtttgggccaggtggactggaaggggcggaggtaaccagaagcggctagtggcggctgcctgcgtccccaaccccctccgcgcagcgctcgcgacacgcgtgccaggagtgggagcgagcggcggggccagctgcgttctgagcctgggcgcagctgccatctgctctgggaagcaccagggtgtccccgccgccctcagctcgaagtcagccaccatggaggcgcaggcacaaggtttgttggagactgaaccgttgcaaggaacagacgaagatgcagtagccagtgctgacttctctagcatgctctctgaggaggaaaaggaagagttaaaagcagagttagttcagctagaagacgaaattacaacactacgacaagttttgtcagcgaaagaaaggcatctagttgagataaaacaaaaactcggcatgaacctgatgaatgaattaaaacagaacttcagcaaaagctggcatgacatgcagactaccactgcctacaagaaaacacatgaaaccctgagtcacgcagggcaaaaggcaactgcagctttcagcaacgttggaacggccatcagcaagaagttcggagacatgagttactccattcgccattccataagtatgcctgctatgagacgaaagtaggcggtacgaaccctaatggaggcagttttgaggaggtcctcagctccacggcccatgccagtgcccagagcttggcaggaggctcccggcggaccaaggaggaggagctgcagtgctaagtccagccagcgtgcagctgcatccagaaaccggccactacccagcccatctctgcctgtgcttatccagataagaagaccaaaatcccgctgggaaaaacccaggccttgacattgttattcaaatggcccctccagaaagtttaatgatttccatttgtatttgtgttgatgatggaccacttgaccatcacatttcagtattcatagatgactgtcacattttaaaatgttcccacttgagcaggtacacaactggtcataattcctgtctgtgtaattcgatgtatatttttccaaacatgtagctattgtttgctttgatttttgcttggcctcctttatgatgtgcatgtccttgaaggctgaatgaacagtccctttcagttcagcagatcaacaggatggagctcttcatgactgtctccagcaataggatgatttactataaatttcatccaactacttgtgatctctctcacctacatcaattatgtatgttaatttcagcaattaaaagaattgattttaatga

SEQ ID NO: 196408 - DNA, 1165 bp, Homo sapiens
  Payload ID: 18753
  Gene Name: tumor protein D52-like 1
  Uniprot ID: Q16890
  ENST ID: ENST00000392482
  CDS Start-End: 208-516
ccttggtgtgtgcataaggccacatgacctcaggtcaggaataaaagcttagggctgagcagctcactctttggttgagaatccagttggctcccctggagtgaagttctacacagaccctggaggaaccaccccatctgtttgttggagactgaaccgttgcaaggaacagacgaagatgcagtagccagtgctgacttctctagcatgctctctgaggaggaaaaggaagagttaaaagcagagttagttcagctagaagacgaaattacaacactacgacaagttttgtcagcgaaagaaaggcatctagttgagataaaacaaaaactcggcatgaacctgatgaatgaattaaaacagaacttcagcaaaagctggcatgacatgcagactaccactgcctacaagaaaacacatgaaaccctgagtcacgcagggcaaaaggcaactgcagctttcagcaacgttggaacggccatcagcaagaagttcggagacatgagacgaaagtaggcggtacgaaccctaatggaggcagttttgaggaggtcctcagctccacggcccatgccagtgcccagagcttggcaggaggctcccggcggaccaaggaggaggagctgcagtgctaagtccagccagcgtgcagctgcatccagaaaccggccactacccagcccatctctgcctgtgcttatccagataagaagaccaaaatcccgctgggaaaaacccaggccttgacattgttattcaaatggcccctccagaaagtttaatgatttccatttgtatttgtgttgatgatggaccacttgaccatcacatttcagtattcatagatgactgtcacattttaaaatgttcccacttgagcaggtacacaactggtcataattcctgtctgtgtaattcgatgtatatttttccaaacatgtagctattgtttgctttgatttttgcttggcctcctttatgatgtgcatgtccttgaaggctgaatgaacagtccctttcagttcagcagatcaacaggatggagctcttcatgactgtctccagcaataggatgatttactataaatttcatccaactacttgtgatctctctcacctacatcaattatgtatgttaatttcagcaattaaaagaattgatttt

SEQ ID NO: 196409 - DNA, 811 bp, Homo sapiens
  Payload ID: 18753
  Gene Name: tumor protein D52-like 1
  Uniprot ID: Q16890
  ENST ID: ENST00000534199
  CDS Start-End: 221-529
gcggcttgtggctcccaagttagggagtgagaggatcgcccgccgagggggtggctccgcagcccggctgcgcgagacgcttcccgctcggggacccgccttccgaggccaggtgaacgttaccggccccctgacctccagcagatccacacgtttgttggagactgaaccgttgcaaggaacagacgaagatgcagtagccagtgctgacttctctagcatgctctctgaggaggaaaaggaagagttaaaagcagagttagttcagctagaagacgaaattacaacactacgacaagttttgtcagcgaaagaaaggcatctagttgagataaaacaaaaactcggcatgaacctgatgaatgaattaaaacagaacttcagcaaaagctggcatgacatgcagactaccactgcctacaagaaaacacatgaaaccctgagtcacgcagggcaaaaggcaactgcagctttcagcaacgttggaacggccatcagcaagaagttcggagacatgagacgaaagtaggcggtacgaaccctaatggaggcagttttgaggaggtcctcagctccacggcccatgccagtgcccagagcttggcaggaggctcccggcggaccaaggaggaggagctgcagtgctaagtccagccagcgtgcagctgcatccagaaaccggccactacccagcccatctctgcctgtgcttatccagataagaagaccaaaatcccgctgggaaaaacccaggccttgacattgttattcaaatggcccctccagaaagtttaatgatttccatttgtat

SEQ ID NO: 196410 - DNA, 915 bp, Homo sapiens
  Payload ID: 18753
  Gene Name: tumor protein D52-like 1
  Uniprot ID: Q16890
  ENST ID: ENST00000524679
  CDS Start-End: 302-610
acatctctgccttctcattttctcttaatttttttctttttttggcttcttggtattctttgctttcttggagctcgtcacacatttaggaggatttttgtcttttctggaatttttagttgttttttggtgggagggtctgtcagtgcatctagtcctccacactatggaagcagaagttggtttaaattcactttaaaaattgccttctgttttatcaattctgcctaaaggtttgttggagactgaaccgttgcaaggaacagacgaagatgcagtagccagtgctgacttctctagcatgctctctgaggaggaaaaggaagagttaaaagcagagttagttcagctagaagacgaaattacaacactacgacaagttttgtcagcgaaagaaaggcatctagttgagataaaacaaaaactcggcatgaacctgatgaatgaattaaaacagaacttcagcaaaagctggcatgacatgcagactaccactgcctacaagaaaacacatgaaaccctgagtcacgcagggcaaaaggcaactgcagctttcagcaacgttggaacggccatcagcaagaagttcggagacatgagacgaaagtaggcggtacgaaccctaatggaggcagttttgaggaggtcctcagctccacggcccatgccagtgcccagagcttggcaggaggctcccggcggaccaaggaggaggagctgcagtgctaagtccagccagcgtgcagctgcatccagaaaccggccactacccagcccatctctgcctgtgcttatccagataagaagaccaaaatcccgctgggaaaaacccaggccttgacattgttattcaaatggcccctccagaaagtttaatgatttccatttgtatttgtgttgatgatggaccacttg

SEQ ID NO: 196411 - DNA, 684 bp, Homo sapiens
  Payload ID: 18753
  Gene Name: tumor protein D52-like 1
  ENST ID: ENST00000534368
  CDS Start-End: 409-684
gccattctcctgcctcagcctcctgagtagctgggactacaggtgcccgccaccaggcccggctaattttttgtatttttagtagaggcggggttttgcagtgttaaccaggatggtctcgatctcctgaccttgtgatcagcccaccttggcctcccaaagtgctgggattacaggcttgagccaccgcgcctggcccagcttttcttttattagatagcaatgaggatgggatccgaagtagagcttccaacgaccctcaggagcgctgagcgaccaagtgaagtacctacaggacccatttgtgttcactgatctattggagcagctggggattgtggtttgttggagactgaaccgttgcaaggaacagacgaagatgcagtagccagtgctgacttctctagcatgctctctgaggaggaaaaggaagagttaaaagcagagttagttcagctagaagacgaaattacaacactacgacaagttttgtcagcgaaagaaaggcatctagttgagataaaacaaaaactcggcatgaacctgatgaatgaattaaaacagaacttcagcaaaagctggcatgacatgcagactaccactgcctacaagaaaacacatgaaaccctgagtcacgcagggcaaaaggcaactgcagctttcagcaacgttggaacggccatc

SEQ ID NO: 196412 - DNA, 2356 bp, Homo sapiens
  Payload ID: 18753
  Gene Name: tumor protein D52-like 1
  Uniprot ID: Q16890
  ENST ID: ENST00000534000
  CDS Start-End: 297-911
tagcgccgggagtgggtgccttccgccggctgtacagagcgccggcaggtggcgcccagcggcgagcttgttccagcttggtttgggccaggtggactggaaggggcggaggtaaccagaagcggctagtggcggctgcctgcgtccccaaccccctccgcgcagcgctcgcgacacgcgtgccaggagtgggagcgagcggcggggccagctgcgttctgagcctgggcgcagctgccatctgctctgggaagcaccagggtgtccccgccgccctcagctcgaagtcagccaccatggaggcgcaggcacaaggtttgttggagactgaaccgttgcaaggaacagacgaagatgcagtagccagtgctgacttctctagcatgctctctgaggaggaaaaggaagagttaaaagcagagttagttcagctagaagacgaaattacaacactacgacaagttttgtcagcgaaagaaaggcatctagttgagataaaacaaaaactcggcatgaacctgatgaatgaattaaaacagaacttcagcaaaagctggcatgacatgcagactaccactgcctacaagaaaacacatgaaaccctgagtcacgcagggcaaaaggcaactgcagctttcagcaacgttggaacggccatcagcaagaagttcggagacatgagttactccattcgccattccataagtatgcctgctatgaggaattctcctactttcaaatcatttgaggagagggttgagacaactgtcacaagcctcaagacgaaagtaggcggtacgaaccctaatggaggcagttttgaggaggtcctcagctccacggcccatgccagtgcccagagcttggcaggaggctcccggcggaccaaggaggaggagctgcagtgctaagtccagccagcgtgcagctgcatccagaaaccggccactacccagcccatctctgcctgtgcttatccagataagaagaccaaaatcccgctgggaaaaacccaggccttgacattgttattcaaatggcccctccagaaagtttaatgatttccatttgtatttgtgttgatgatggaccacttgaccatcacatttcagtattcatagatgactgtcacattttaaaatgttcccacttgagcaggtacacaactggtcataattcctgtctgtgtaattcgatgtatatttttccaaacatgtagctattgtttgctttgatttttgcttggcctcctttatgatgtgcatgtccttgaaggctgaatgaacagtccctttcagttcagcagatcaacaggatggagctcttcatgactgtctccagcaataggatgatttactataaatttcatccaactacttgtgatctctctcacctacatcaattatgtatgttaatttcagcaattaaaagaattgattttaatgactttgaattcttaatttctttgtcttaaaagttgctagttatgattttacagatgcaattttaaatcaacttttagccaggtgcggcggctcacacctgtaatcccaactattttggatgccaaggtgagaggattgcttgaggccaggagttaaagatcagcctgggcaacacagaccctgtctctacaaaaaaagaaaaaaattagccagacatagtgttgcttgcctgtagtcccagctactctagaggctgaggcaggaggattgcatgagcctaggagttcgaaactgcagtgagctatgattgcaccactgcactactccagcctgggtgacagagtgggacactgtctccaaaaatagtaataataagtagtcaacttttactgctaatttggtgaacatgagagaggatatgaaaataaatattacctcagctatcctaggatgttaaaataatctccaattttaaaattctctccaatctacatacagtagtagttagtcagataaaggatatccaaaaaagagatagctagaaaatgggagaagcagagttctgcaacccctttcagtttgtaaattgttcacatgtatgaaaataactggtatttatcaatccactcagatttctgcactaacttttatcttatatatcatatgtatctcttttctttttctaaatgggaacatatatttgttattaggtggcagagatatagccttaagatatatttgtaaaatgcacactgaatagacatccaacctaaaaaaaatcactatttaaaaagcccatataatatatacatatttgttagcatgctaattgttcatgttttgtgtttattaaatagaagtgatatatatgacattttgaagtaaagcacatctgaaaaattctactcaaa

SEQ ID NO: 196413 - DNA, 789 bp, Homo sapiens
  Payload ID: 18753
  Gene Name: tumor protein D52-like 1
  ENST ID: ENST00000528193
  CDS Start-End: 53-553
ctctgggaagcaccagggtgtccccgccgccctcagctcgaagtcagccaccatggaggcgcaggcacaaggtttgttggagactgaaccgttgcaaggaacagacgaagatgcagtagccagtgctgacttctctagcatgctctctgaggaggaaaaggaagagttaaaagcagagttagttcagctagaagacgaaattacaacactacgacaagttttgtcagcgaaagaaaggcatctagttgagataaaacaaaaactcggcatgaacctgatgaatgaattaaaacagaacttcagcaaaagctggcatgacatgcagactaccactgcctacaagaaaacacatgaaaccctgagtcacgcagggcaaaaggcaactgcagctttcagcaacgttggaacggccatcagcaagaagttcggagacatgagttactccattcgccattccataagtatgcctgctatgaggaattctcctactttcaaatcatttgaggagagggttgagacaactgtcacaagcctcaaggtacagatgaagtgaattctgtacgaaagtaggcggtacgaaccctaatggaggcagttttgaggaggtcctcagctccacggcccatgccagtgcccagagcttggcaggaggctcccggcggaccaaggaggaggagctgcagtgctaagtccagccagcgtgcagctgcatccagaaaccggccactacccagcccatctctgcctgtgcttatccagataagaagaccaaaatcccgctgggaaaaa

SEQ ID NO: 196414 - DNA, 1022 bp, Homo sapiens
  Payload ID: 18753
  Gene Name: tumor protein D52-like 1
  Uniprot ID: Q16890
  ENST ID: ENST00000532429
  CDS Start-End: 413-940
ggagaggcccctcctcaggaaatgcgcccgtggaatgctctaccctcttccgcagccagtcgcccctggccttcccaacctcgcggctgcccgaaggacctgttgtgccgggtccggaaagcgtgtttcgctccctttcccttgagggagtggggagggaatgtgactcttttcgcccagcgccgtggactcgcggcttgtggctcccaagttagggagtgagaggatcgcccgccgagggggtggctccgcagcccggctgcgcgagacgcttcccgctcggggacccgccttccgaggccaggtgaacgttaccggccccctgacctccagcagatccacacgtttgttggagactgaaccgttgcaaggaacagacgaagatgcagtagccagtgctgacttctctagcatgctctctgaggaggaaaaggaagagttaaaagcagagttagttcagctagaagacgaaattacaacactacgacaagttttgtcagcgaaagaaaggcatctagttgagataaaacaaaaactcggcatgaacctgatgaatgaattaaaacagaacttcagcaaaagctggcatgacatgcagactaccactgcctacaagaaaacacatgaaaccctgagtcacgcagggcaaaaggcaactgcagctttcagcaacgttggaacggccatcagcaagaagttcggagacatgagttactccattcgccattccataagtatgcctgctatgaggaattctcctactttcaaatcatttgaggagagggttgagacaactgtcacaagcctcaagacgaaagtaggcggtacgaaccctaatggaggcagttttgaggaggtcctcagctccacggcccatgccagtgcccagagcttggcaggaggctcccggcggaccaaggaggaggagctgcagtgctaagtccagccagcgtgcagctgcatccagaaaccggccactacccagcccatctctgcctgtgcttatccagataagaagacca

SEQ ID NO: 196415 - DNA, 999 bp, Homo sapiens
  Payload ID: 18753
  Gene Name: tumor protein D52-like 1
  ENST ID: ENST00000527711
  CDS Start-End: 160-735
gcctgcgtccccaaccccctccgcgcagcgctcgcgacacgcgtgccaggagtgggagcgagcggcggggccagctgcgttctgagcctgggcgcagctgccatctgctctgggaagcaccagggtgtccccgccgccctcagctcgaagtcagccaccatggaggcgcaggcacaaggtttgttggagactgaaccgttgcaaggaacagacgaagatgcagtagccagtgctgacttctctagcatgctctctgaggaggaaaaggaagagttaaaagcagagttagttcagctagaagacgaaattacaacactacgacaagttttgtcagcgaaagaaaggcatctagttgagataaaacaaaaactcggcatgaacctgatgaatgaattaaaacagaacttcagcaaaagctggcatgacatgcagactaccactgcctacaagaaaacacatgaaaccctgagtcacgcagggcaaaaggcaactgcagctttcagcaacgttggaacggccatcagcaagaagttcggagacatgaggaattctcctactttcaaatcatttgaggagagggttgagacaactgtcacaagcctcaagacgaaagtaggcggtacgaaccctaatggaggcagttttgaggaggtcctcagctccacggcccatgccagtgcccagagcttggcaggaggctcccggcggaccaaggaggaggagctgcagtgctaagtccagccagcgtgcagctgcatccagaaaccggccactacccagcccatctctgcctgtgcttatccagataagaagaccaaaatcccgctgggaaaaacccaggccttgacattgttattcaaatggcccctccagaaagtttaatgatttccatttgtatttgtgttgatgatggaccacttgaccatcacatttcagtattcatagatgactgtcacattttaaaatgttcccacttgagcaggtacacaactggtcata

SEQ ID NO: 196416 - DNA, 2362 bp, Homo sapiens
  Payload ID: 18754
  Gene Name: tumor protein D52-like 2
  Uniprot ID: O43399
  ENST ID: ENST00000217121
  CDS Start-End: 73-762
ggcgagcttctcccggcgccgcccgctcggctcccatagcgcccgcgacagcggtccggacgccgcccgaacatggactccgccggccaagatatcaacctgaattctcctaacaaaggtctgctgtctgactccatgacggatgttcctgtcgacacaggtgtggctgcccggactcctgctgttgagggtctgacagaggctgaggaggaggagctcagggctgagcttaccaaggtggaagaggaaattgtcactctgcgccaggtcctggcagccaaggagaggcactgtggagagctcaagaggaggctgggcctctccaccctgggggagctgaaacagaacctgtccaggagctggcatgacgtgcaggtctctagcgcctatgtgaaaacttctgagaaacttggagagtggaatgagaaagtgacccagtcagacctctacaagaagactcaggaaactctttcacaggcaggacagaagacttcagctgccctgtccacagtgggctctgccatcagcaggaagcttggagacatgagggctcatccattttcacactcctttagcagctactccatccgccactcaataagtatgccagccatgaggaactctgcgaccttcaagtcgtttgaggaccgagttgggaccataaagtctaaggttgtgggtgacagagagaacggcagtgacaacctcccttcctcagcggggagtggtgacaagcccctgtcggatcccgcacctttctaagcctgtggttgcttcacccgctgcagagcacacgcaacccagcctcagcatcacagccgcagctctgttcagcggagcagccagccagggcggatgagcagagccggccctgaggacagtcctgcccatccacgcggagatgtggctgccgcgtttgcatgaatttgaagaacacaggcttgtacacagatgttttacactcacgtttgtagatgaaacagatcactgtgctgtccttcctaggggtgcaggaagtggacagggcggagggtttgaaagaatattgagccaaagcccaggctccctttgggaatcatgttagcccatcagaatgttgaaggattgaagagttctaagcataaaataagtggcattttctgacttcttcctcctcctccttccctgactcacagaaggaatgcaatcacccagcaagtcctacctgttacgcaattttttatctcaaaatgccgaacgagaaaactgtccattttctgagacccccagaaaggaaactgaccctcagcagctgcctgattgttacgcgaatctagctttaacggaagcaaattcattattttttaaatgcagtggacttttcaaaaagtttaaattaggcaaagcagctttagcctcatagaatattatttctttggactcaagctgaaatacaagccttacattgccttatgctttatttctttctaatttttatatgtatatagatgagggttccttaatggttgtgagcattgtgtggaattttacacctggcctgcgtggcagcctcttccagttgaggtgttttatgtcacgcacactccatcccagtgtacaaaacctgcttctcttctcaaccgtggcagctcccgctggctcctatgccctgccctaaagggctcttgagcctctgggaatgggaggggccaagagaaggaaaaccctgtctttagcaccctttaaaagaactgtgccccccttctcagtgctgcctttgcatgggcctggcccggctcacattcgtcagtgactccaaccctcctgcttgctgtacttgggatgaaacgaccccacaggtcaggtggagggtggggcgtgggcatcagccaggattgccgttacagtctttttctcaggagctacaaagatctcttcctgttactaaatagtcgcaccccagcagcctctctcgcacaccggggccctgcatgtcagatggcgtggtctgcagggggagctctgtgccttagtggctcttggcaggacactgagggcctgcctgtggtgtgcccggctctgccactcccgggaggggaagggctgctcagctcaaggtgtcctgttcggtagagcaagtgtcctctgacagccgtgtccccggacagttcagacacccttggggatggcactccacacacgacagagatgcaggggccagggaagcccagcgctcggtgcccttcgtccagggttaaaatcggcctgtggggtgtggtgagaaggcaggttgtgcgggtgttgaccgatgtatcttttccttaaagttattataataatgggtaatttgtcaataaagcattcctttgggggaaagtccgcc

SEQ ID NO: 196417 - DNA, 2302 bp, Homo sapiens
  Payload ID: 18754
  Gene Name: tumor protein D52-like 2
  Uniprot ID: O43399
  ENST ID: ENST00000351424
  CDS Start-End: 73-702
ggcgagcttctcccggcgccgcccgctcggctcccatagcgcccgcgacagcggtccggacgccgcccgaacatggactccgccggccaagatatcaacctgaattctcctaacaaaggtctgctgtctgactccatgacggatgttcctgtcgacacaggtgtggctgcccggactcctgctgttgagggtctgacagaggctgaggaggaggagctcagggctgagcttaccaaggtggaagaggaaattgtcactctgcgccaggtcctggcagccaaggagaggcactgtggagagctcaagaggaggctgggcctctccaccctgggggagctgaaacagaacctgtccaggagctggcatgacgtgcaggtctctagcgcctacaagaagactcaggaaactctttcacaggcaggacagaagacttcagctgccctgtccacagtgggctctgccatcagcaggaagcttggagacatgagggctcatccattttcacactcctttagcagctactccatccgccactcaataagtatgccagccatgaggaactctgcgaccttcaagtcgtttgaggaccgagttgggaccataaagtctaaggttgtgggtgacagagagaacggcagtgacaacctcccttcctcagcggggagtggtgacaagcccctgtcggatcccgcacctttctaagcctgtggttgcttcacccgctgcagagcacacgcaacccagcctcagcatcacagccgcagctctgttcagcggagcagccagccagggcggatgagcagagccggccctgaggacagtcctgcccatccacgcggagatgtggctgccgcgtttgcatgaatttgaagaacacaggcttgtacacagatgttttacactcacgtttgtagatgaaacagatcactgtgctgtccttcctaggggtgcaggaagtggacagggcggagggtttgaaagaatattgagccaaagcccaggctccctttgggaatcatgttagcccatcagaatgttgaaggattgaagagttctaagcataaaataagtggcattttctgacttcttcctcctcctccttccctgactcacagaaggaatgcaatcacccagcaagtcctacctgttacgcaattttttatctcaaaatgccgaacgagaaaactgtccattttctgagacccccagaaaggaaactgaccctcagcagctgcctgattgttacgcgaatctagctttaacggaagcaaattcattattttttaaatgcagtggacttttcaaaaagtttaaattaggcaaagcagctttagcctcatagaatattatttctttggactcaagctgaaatacaagccttacattgccttatgctttatttctttctaatttttatatgtatatagatgagggttccttaatggttgtgagcattgtgtggaattttacacctggcctgcgtggcagcctcttccagttgaggtgttttatgtcacgcacactccatcccagtgtacaaaacctgcttctcttctcaaccgtggcagctcccgctggctcctatgccctgccctaaagggctcttgagcctctgggaatgggaggggccaagagaaggaaaaccctgtctttagcaccctttaaaagaactgtgccccccttctcagtgctgcctttgcatgggcctggcccggctcacattcgtcagtgactccaaccctcctgcttgctgtacttgggatgaaacgaccccacaggtcaggtggagggtggggcgtgggcatcagccaggattgccgttacagtctttttctcaggagctacaaagatctcttcctgttactaaatagtcgcaccccagcagcctctctcgcacaccggggccctgcatgtcagatggcgtggtctgcagggggagctctgtgccttagtggctcttggcaggacactgagggcctgcctgtggtgtgcccggctctgccactcccgggaggggaagggctgctcagctcaaggtgtcctgttcggtagagcaagtgtcctctgacagccgtgtccccggacagttcagacacccttggggatggcactccacacacgacagagatgcaggggccagggaagcccagcgctcggtgcccttcgtccagggttaaaatcggcctgtggggtgtggtgagaaggcaggttgtgcgggtgttgaccgatgtatcttttccttaaagttattataataatgggtaatttgtcaataaagcattcctttgggggaaagtccgcc

SEQ ID NO: 196418 - DNA, 2297 bp, Homo sapiens
  Payload ID: 18754
  Gene Name: tumor protein D52-like 2
  Uniprot ID: O43399
  ENST ID: ENST00000346249
  CDS Start-End: 77-697
acgcggcgagcttctcccggcgccgcccgctcggctcccatagcgcccgcgacagcggtccggacgccgcccgaacatggactccgccggccaagatatcaacctgaattctcctaacaaaggtctgctgtctgactccatgacggatgttcctgtcgacacaggtgtggctgcccggactcctgctgttgagggtctgacagaggctgaggaggaggagctcagggctgagcttaccaaggtggaagaggaaattgtcactctgcgccaggtcctggcagccaaggagaggcactgtggagagctcaagaggaggctgggcctctccaccctgggggagctgaaacagaacctgtccaggagctggcatgacgtgcaggtctctagcgcctatgtgaaaacttctgagaaacttggagagtggaatgagaaagtgacccagtcagacctctacaagaagactcaggaaactctttcacaggcaggacagaagacttcagctgccctgtccacagtgggctctgccatcagcaggaagcttggagacatgaggaactctgcgaccttcaagtcgtttgaggaccgagttgggaccataaagtctaaggttgtgggtgacagagagaacggcagtgacaacctcccttcctcagcggggagtggtgacaagcccctgtcggatcccgcacctttctaagcctgtggttgcttcacccgctgcagagcacacgcaacccagcctcagcatcacagccgcagctctgttcagcggagcagccagccagggcggatgagcagagccggccctgaggacagtcctgcccatccacgcggagatgtggctgccgcgtttgcatgaatttgaagaacacaggcttgtacacagatgttttacactcacgtttgtagatgaaacagatcactgtgctgtccttcctaggggtgcaggaagtggacagggcggagggtttgaaagaatattgagccaaagcccaggctccctttgggaatcatgttagcccatcagaatgttgaaggattgaagagttctaagcataaaataagtggcattttctgacttcttcctcctcctccttccctgactcacagaaggaatgcaatcacccagcaagtcctacctgttacgcaattttttatctcaaaatgccgaacgagaaaactgtccattttctgagacccccagaaaggaaactgaccctcagcagctgcctgattgttacgcgaatctagctttaacggaagcaaattcattattttttaaatgcagtggacttttcaaaaagtttaaattaggcaaagcagctttagcctcatagaatattatttctttggactcaagctgaaatacaagccttacattgccttatgctttatttctttctaatttttatatgtatatagatgagggttccttaatggttgtgagcattgtgtggaattttacacctggcctgcgtggcagcctcttccagttgaggtgttttatgtcacgcacactccatcccagtgtacaaaacctgcttctcttctcaaccgtggcagctcccgctggctcctatgccctgccctaaagggctcttgagcctctgggaatgggaggggccaagagaaggaaaaccctgtctttagcaccctttaaaagaactgtgccccccttctcagtgctgcctttgcatgggcctggcccggctcacattcgtcagtgactccaaccctcctgcttgctgtacttgggatgaaacgaccccacaggtcaggtggagggtggggcgtgggcatcagccaggattgccgttacagtctttttctcaggagctacaaagatctcttcctgttactaaatagtcgcaccccagcagcctctctcgcacaccggggccctgcatgtcagatggcgtggtctgcagggggagctctgtgccttagtggctcttggcaggacactgagggcctgcctgtggtgtgcccggctctgccactcccgggaggggaagggctgctcagctcaaggtgtcctgttcggtagagcaagtgtcctctgacagccgtgtccccggacagttcagacacccttggggatggcactccacacacgacagagatgcaggggccagggaagcccagcgctcggtgcccttcgtccagggttaaaatcggcctgtggggtgtggtgagaaggcaggttgtgcgggtgttgaccgatgtatcttttccttaaagttattataataatgggtaatttgtcaataaagcattcctttgggggaaagtccgcc

SEQ ID NO: 196419 - DNA, 2237 bp, Homo sapiens
  Payload ID: 18754
  Gene Name: tumor protein D52-like 2
  Uniprot ID: O43399
  ENST ID: ENST00000348257
  CDS Start-End: 77-637
acgcggcgagcttctcccggcgccgcccgctcggctcccatagcgcccgcgacagcggtccggacgccgcccgaacatggactccgccggccaagatatcaacctgaattctcctaacaaaggtctgctgtctgactccatgacggatgttcctgtcgacacaggtgtggctgcccggactcctgctgttgagggtctgacagaggctgaggaggaggagctcagggctgagcttaccaaggtggaagaggaaattgtcactctgcgccaggtcctggcagccaaggagaggcactgtggagagctcaagaggaggctgggcctctccaccctgggggagctgaaacagaacctgtccaggagctggcatgacgtgcaggtctctagcgcctacaagaagactcaggaaactctttcacaggcaggacagaagacttcagctgccctgtccacagtgggctctgccatcagcaggaagcttggagacatgaggaactctgcgaccttcaagtcgtttgaggaccgagttgggaccataaagtctaaggttgtgggtgacagagagaacggcagtgacaacctcccttcctcagcggggagtggtgacaagcccctgtcggatcccgcacctttctaagcctgtggttgcttcacccgctgcagagcacacgcaacccagcctcagcatcacagccgcagctctgttcagcggagcagccagccagggcggatgagcagagccggccctgaggacagtcctgcccatccacgcggagatgtggctgccgcgtttgcatgaatttgaagaacacaggcttgtacacagatgttttacactcacgtttgtagatgaaacagatcactgtgctgtccttcctaggggtgcaggaagtggacagggcggagggtttgaaagaatattgagccaaagcccaggctccctttgggaatcatgttagcccatcagaatgttgaaggattgaagagttctaagcataaaataagtggcattttctgacttcttcctcctcctccttccctgactcacagaaggaatgcaatcacccagcaagtcctacctgttacgcaattttttatctcaaaatgccgaacgagaaaactgtccattttctgagacccccagaaaggaaactgaccctcagcagctgcctgattgttacgcgaatctagctttaacggaagcaaattcattattttttaaatgcagtggacttttcaaaaagtttaaattaggcaaagcagctttagcctcatagaatattatttctttggactcaagctgaaatacaagccttacattgccttatgctttatttctttctaatttttatatgtatatagatgagggttccttaatggttgtgagcattgtgtggaattttacacctggcctgcgtggcagcctcttccagttgaggtgttttatgtcacgcacactccatcccagtgtacaaaacctgcttctcttctcaaccgtggcagctcccgctggctcctatgccctgccctaaagggctcttgagcctctgggaatgggaggggccaagagaaggaaaaccctgtctttagcaccctttaaaagaactgtgccccccttctcagtgctgcctttgcatgggcctggcccggctcacattcgtcagtgactccaaccctcctgcttgctgtacttgggatgaaacgaccccacaggtcaggtggagggtggggcgtgggcatcagccaggattgccgttacagtctttttctcaggagctacaaagatctcttcctgttactaaatagtcgcaccccagcagcctctctcgcacaccggggccctgcatgtcagatggcgtggtctgcagggggagctctgtgccttagtggctcttggcaggacactgagggcctgcctgtggtgtgcccggctctgccactcccgggaggggaagggctgctcagctcaaggtgtcctgttcggtagagcaagtgtcctctgacagccgtgtccccggacagttcagacacccttggggatggcactccacacacgacagagatgcaggggccagggaagcccagcgctcggtgcccttcgtccagggttaaaatcggcctgtggggtgtggtgagaaggcaggttgtgcgggtgttgaccgatgtatcttttccttaaagttattataataatgggtaatttgtcaataaagcattcctttgggggaaagtccgcc

SEQ ID NO: 196420 - DNA, 2339 bp, Homo sapiens
  Payload ID: 18754
  Gene Name: tumor protein D52-like 2
  Uniprot ID: O43399
  ENST ID: ENST00000352482
  CDS Start-End: 77-739
acgcggcgagcttctcccggcgccgcccgctcggctcccatagcgcccgcgacagcggtccggacgccgcccgaacatggactccgccggccaagatatcaacctgaattctcctaacaaaggtctgctgtctgactccatgacggatgttcctgtcgacacaggtgtggctgcccggactcctgctgttgagggtctgacagaggctgaggaggaggagctcagggctgagcttaccaaggtggaagaggaaattgtcactctgcgccaggtcctggcagccaaggagaggcactgtggagagctcaagaggaggctgggcctctccaccctgggggagctgaaacagaacctgtccaggagctggcatgacgtgcaggtctctagcgcctatgtgaaaacttctgagaaacttggagagtggaatgagaaagtgacccagtcagacctctacaagaagactcaggaaactctttcacaggcaggacagaagacttcagctgccctgtccacagtgggctctgccatcagcaggaagcttggagacatgagcagctactccatccgccactcaataagtatgccagccatgaggaactctgcgaccttcaagtcgtttgaggaccgagttgggaccataaagtctaaggttgtgggtgacagagagaacggcagtgacaacctcccttcctcagcggggagtggtgacaagcccctgtcggatcccgcacctttctaagcctgtggttgcttcacccgctgcagagcacacgcaacccagcctcagcatcacagccgcagctctgttcagcggagcagccagccagggcggatgagcagagccggccctgaggacagtcctgcccatccacgcggagatgtggctgccgcgtttgcatgaatttgaagaacacaggcttgtacacagatgttttacactcacgtttgtagatgaaacagatcactgtgctgtccttcctaggggtgcaggaagtggacagggcggagggtttgaaagaatattgagccaaagcccaggctccctttgggaatcatgttagcccatcagaatgttgaaggattgaagagttctaagcataaaataagtggcattttctgacttcttcctcctcctccttccctgactcacagaaggaatgcaatcacccagcaagtcctacctgttacgcaattttttatctcaaaatgccgaacgagaaaactgtccattttctgagacccccagaaaggaaactgaccctcagcagctgcctgattgttacgcgaatctagctttaacggaagcaaattcattattttttaaatgcagtggacttttcaaaaagtttaaattaggcaaagcagctttagcctcatagaatattatttctttggactcaagctgaaatacaagccttacattgccttatgctttatttctttctaatttttatatgtatatagatgagggttccttaatggttgtgagcattgtgtggaattttacacctggcctgcgtggcagcctcttccagttgaggtgttttatgtcacgcacactccatcccagtgtacaaaacctgcttctcttctcaaccgtggcagctcccgctggctcctatgccctgccctaaagggctcttgagcctctgggaatgggaggggccaagagaaggaaaaccctgtctttagcaccctttaaaagaactgtgccccccttctcagtgctgcctttgcatgggcctggcccggctcacattcgtcagtgactccaaccctcctgcttgctgtacttgggatgaaacgaccccacaggtcaggtggagggtggggcgtgggcatcagccaggattgccgttacagtctttttctcaggagctacaaagatctcttcctgttactaaatagtcgcaccccagcagcctctctcgcacaccggggccctgcatgtcagatggcgtggtctgcagggggagctctgtgccttagtggctcttggcaggacactgagggcctgcctgtggtgtgcccggctctgccactcccgggaggggaagggctgctcagctcaaggtgtcctgttcggtagagcaagtgtcctctgacagccgtgtccccggacagttcagacacccttggggatggcactccacacacgacagagatgcaggggccagggaagcccagcgctcggtgcccttcgtccagggttaaaatcggcctgtggggtgtggtgagaaggcaggttgtgcgggtgttgaccgatgtatcttttccttaaagttattataataatgggtaatttgtcaataaagcattcctttgggggaaagtccgcc

SEQ ID NO: 196421 - DNA, 2275 bp, Homo sapiens
  Payload ID: 18754
  Gene Name: tumor protein D52-like 2
  Uniprot ID: O43399
  ENST ID: ENST00000358548
  CDS Start-End: 73-675
ggcgagcttctcccggcgccgcccgctcggctcccatagcgcccgcgacagcggtccggacgccgcccgaacatggactccgccggccaagatatcaacctgaattctcctaacaaaggtctgctgtctgactccatgacggatgttcctgtcgacacaggtgtggctgcccggactcctgctgttgagggtctgacagaggctgaggaggaggagctcagggctgagcttaccaaggtggaagaggaaattgtcactctgcgccaggtcctggcagccaaggagaggcactgtggagagctcaagaggaggctgggcctctccaccctgggggagctgaaacagaacctgtccaggagctggcatgacgtgcaggtctctagcgcctacaagaagactcaggaaactctttcacaggcaggacagaagacttcagctgccctgtccacagtgggctctgccatcagcaggaagcttggagacatgagcagctactccatccgccactcaataagtatgccagccatgaggaactctgcgaccttcaagtcgtttgaggaccgagttgggaccataaagtctaaggttgtgggtgacagagagaacggcagtgacaacctcccttcctcagcggggagtggtgacaagcccctgtcggatcccgcacctttctaagcctgtggttgcttcacccgctgcagagcacacgcaacccagcctcagcatcacagccgcagctctgttcagcggagcagccagccagggcggatgagcagagccggccctgaggacagtcctgcccatccacgcggagatgtggctgccgcgtttgcatgaatttgaagaacacaggcttgtacacagatgttttacactcacgtttgtagatgaaacagatcactgtgctgtccttcctaggggtgcaggaagtggacagggcggagggtttgaaagaatattgagccaaagcccaggctccctttgggaatcatgttagcccatcagaatgttgaaggattgaagagttctaagcataaaataagtggcattttctgacttcttcctcctcctccttccctgactcacagaaggaatgcaatcacccagcaagtcctacctgttacgcaattttttatctcaaaatgccgaacgagaaaactgtccattttctgagacccccagaaaggaaactgaccctcagcagctgcctgattgttacgcgaatctagctttaacggaagcaaattcattattttttaaatgcagtggacttttcaaaaagtttaaattaggcaaagcagctttagcctcatagaatattatttctttggactcaagctgaaatacaagccttacattgccttatgctttatttctttctaatttttatatgtatatagatgagggttccttaatggttgtgagcattgtgtggaattttacacctggcctgcgtggcagcctcttccagttgaggtgttttatgtcacgcacactccatcccagtgtacaaaacctgcttctcttctcaaccgtggcagctcccgctggctcctatgccctgccctaaagggctcttgagcctctgggaatgggaggggccaagagaaggaaaaccctgtctttagcaccctttaaaagaactgtgccccccttctcagtgctgcctttgcatgggcctggcccggctcacattcgtcagtgactccaaccctcctgcttgctgtacttgggatgaaacgaccccacaggtcaggtggagggtggggcgtgggcatcagccaggattgccgttacagtctttttctcaggagctacaaagatctcttcctgttactaaatagtcgcaccccagcagcctctctcgcacaccggggccctgcatgtcagatggcgtggtctgcagggggagctctgtgccttagtggctcttggcaggacactgagggcctgcctgtggtgtgcccggctctgccactcccgggaggggaagggctgctcagctcaaggtgtcctgttcggtagagcaagtgtcctctgacagccgtgtccccggacagttcagacacccttggggatggcactccacacacgacagagatgcaggggccagggaagcccagcgctcggtgcccttcgtccagggttaaaatcggcctgtggggtgtggtgagaaggcaggttgtgcgggtgttgaccgatgtatcttttccttaaagttattataataatgggtaatttgtcaataaagcattcctttgggggaaagtccgcc

SEQ ID NO: 196422 - DNA, 1094 bp, Homo sapiens
  Payload ID: 18754
  Gene Name: tumor protein D52-like 2
  Uniprot ID: O43399
  ENST ID: ENST00000369927
  CDS Start-End: 124-615
gattacgaaacgccgcggagctgaggcagttccgctggctagtgtgtacgcggcgagcttctcccggcgccgcccgctcggctcccatagcgcccgcgacagcggtccggacgccgcccgaacatggactccgccggccaaggtgtggctgcccggactcctgctgttgagggtctgacagaggctgaggaggaggagctcagggctgagcttaccaaggtggaagaggaaattgtcactctgcgccaggtcctggcagccaaggagaggcactgtggagagctcaagaggaggctgggcctctccaccctgggggagctgaaacagaacctgtccaggagctggcatgacgtgcaggtctctagcgcctacaagaagactcaggaaactctttcacaggcaggacagaagacttcagctgccctgtccacagtgggctctgccatcagcaggaagcttggagacatgaggaactctgcgaccttcaagtcgtttgaggaccgagttgggaccataaagtctaaggttgtgggtgacagagagaacggcagtgacaacctcccttcctcagcggggagtggtgacaagcccctgtcggatcccgcacctttctaagcctgtggttgcttcacccgctgcagagcacacgcaacccagcctcagcatcacagccgcagctctgttcagcggagcagccagccagggcggatgagcagagccggccctgaggacagtcctgcccatccacgcggagatgtggctgccgcgtttgcatgaatttgaagaacacaggcttgtacacagatgttttacactcacgtttgtagatgaaacagatcactgtgctgtccttcctaggggtgcaggaagtggacagggcggagggtttgaaagaatattgagccaaagcccaggctccctttgggaatcatgttagcccatcagaatgttgaaggattgaagagttctaagcataaaataagtggcattttctgacttcttcctcctcctccttccctgactcacagaaggaatgcaatcacccagcaagtcctacctgttacgcaattttttatctcaaaatgccgaacgag

SEQ ID NO: 196423 - DNA, 2310 bp, Homo sapiens
  Payload ID: 18754
  Gene Name: tumor protein D52-like 2
  ENST ID: ENST00000615907
  CDS Start-End: 139-807
agccgtcgcatcgcggattacgaaacgccgcggagctgaggcagttccgctggctagtgtgtacgcggcgagcttctcccggcgccgcccgctcggctcccatagcgcccgcgacagcggtccggacgccgcccgaacatggactccgccggccaagatatcaacctgaattctcctaacaaaggtctgctgtctgactccatgacggatgttcctgtcgacacaggtgtggctgcccggactcctgctgttgagggtctgacagaggctgaggaggaggagctcagggctgagcttaccaaggtggaagaggaaattgtcactctgcgccaggtcctggcagccaaggagaggcactgtggagagctcaagaggaggctgggcctctccaccctgggggagctgaaacagaacctgtccaggagctggcatgacgtgcaggtctctagcgcctatgtgaaaacttctgagaaacttggagagtggaatgagaaagtgacccagtcagacctctacaagaagactcaggaaactctttcacaggcaggacagaagacttcagctgccctgtccacagtgggctctgccatcagcaggaagcttggagacatgagtctaaggttgtgggtgacagagagaacggcagtgacaacctcccttcctcagcggggagtggtgacaagcccctgtcggatcccgcacctttctaagcctgtggttgcttcacccgctgcagagcacacgcaacccagcctcagcatcacagccgcagctctgttcagcggagcagccagccagggcggatgagcagagccggccctgaggacagtcctgcccatccacgcggagatgtggctgccgcgtttgcatgaatttgaagaacacaggcttgtacacagatgttttacactcacgtttgtagatgaaacagatcactgtgctgtccttcctaggggtgcaggaagtggacagggcggagggtttgaaagaatattgagccaaagcccaggctccctttgggaatcatgttagcccatcagaatgttgaaggattgaagagttctaagcataaaataagtggcattttctgacttcttcctcctcctccttccctgactcacagaaggaatgcaatcacccagcaagtcctacctgttacgcaattttttatctcaaaatgccgaacgagaaaactgtccattttctgagacccccagaaaggaaactgaccctcagcagctgcctgattgttacgcgaatctagctttaacggaagcaaattcattattttttaaatgcagtggacttttcaaaaagtttaaattaggcaaagcagctttagcctcatagaatattatttctttggactcaagctgaaatacaagccttacattgccttatgctttatttctttctaatttttatatgtatatagatgagggttccttaatggttgtgagcattgtgtggaattttacacctggcctgcgtggcagcctcttccagttgaggtgttttatgtcacgcacactccatcccagtgtacaaaacctgcttctcttctcaaccgtggcagctcccgctggctcctatgccctgccctaaagggctcttgagcctctgggaatgggaggggccaagagaaggaaaaccctgtctttagcaccctttaaaagaactgtgccccccttctcagtgctgcctttgcatgggcctggcccggctcacattcgtcagtgactccaaccctcctgcttgctgtacttgggatgaaacgaccccacaggtcaggtggagggtggggcgtgggcatcagccaggattgccgttacagtctttttctcaggagctacaaagatctcttcctgttactaaatagtcgcaccccagcagcctctctcgcacaccggggccctgcatgtcagatggcgtggtctgcagggggagctctgtgccttagtggctcttggcaggacactgagggcctgcctgtggtgtgcccggctctgccactcccgggaggggaagggctgctcagctcaaggtgtcctgttcggtagagcaagtgtcctctgacagccgtgtccccggacagttcagacacccttggggatggcactccacacacgacagagatgcaggggccagggaagcccagcgctcggtgcccttcgtccagggttaaaatcggcctgtggggtgtggtgagaaggcaggttgtgcgggtgttgaccgatgtatcttttccttaaagttattataataatgggtaatttgtcaataaagcattcctttgggggaaagtccgcc

SEQ ID NO: 196424 - DNA, 2197 bp, Homo sapiens
  Payload ID: 18754
  Gene Name: tumor protein D52-like 2
  ENST ID: ENST00000611972
  CDS Start-End: 139-597
agccgtcgcatcgcggattacgaaacgccgcggagctgaggcagttccgctggctagtgtgtacgcggcgagcttctcccggcgccgcccgctcggctcccatagcgcccgcgacagcggtccggacgccgcccgaacatggactccgccggccaagatatcaacctgaattctcctaacaaaggtctgctgtctgactccatgacggatgttcctgtcgacacaggtgtggctgcccggactcctgctgttgagggtctgacagaggctgaggaggaggagctcagggctgagcttaccaaggtggaagaggaaattgtcactctgcgccaggtcctggcagccaaggagaggcactgtggagagctcaagaggaggctgggcctctccaccctgggggagctgaaacagaacctgtccaggagctggcatgacgtgcaggtctctagcgcgaactctgcgaccttcaagtcgtttgaggaccgagttgggaccataaagtctaaggttgtgggtgacagagagaacggcagtgacaacctcccttcctcagcggggagtggtgacaagcccctgtcggatcccgcacctttctaagcctgtggttgcttcacccgctgcagagcacacgcaacccagcctcagcatcacagccgcagctctgttcagcggagcagccagccagggcggatgagcagagccggccctgaggacagtcctgcccatccacgcggagatgtggctgccgcgtttgcatgaatttgaagaacacaggcttgtacacagatgttttacactcacgtttgtagatgaaacagatcactgtgctgtccttcctaggggtgcaggaagtggacagggcggagggtttgaaagaatattgagccaaagcccaggctccctttgggaatcatgttagcccatcagaatgttgaaggattgaagagttctaagcataaaataagtggcattttctgacttcttcctcctcctccttccctgactcacagaaggaatgcaatcacccagcaagtcctacctgttacgcaattttttatctcaaaatgccgaacgagaaaactgtccattttctgagacccccagaaaggaaactgaccctcagcagctgcctgattgttacgcgaatctagctttaacggaagcaaattcattattttttaaatgcagtggacttttcaaaaagtttaaattaggcaaagcagctttagcctcatagaatattatttctttggactcaagctgaaatacaagccttacattgccttatgctttatttctttctaatttttatatgtatatagatgagggttccttaatggttgtgagcattgtgtggaattttacacctggcctgcgtggcagcctcttccagttgaggtgttttatgtcacgcacactccatcccagtgtacaaaacctgcttctcttctcaaccgtggcagctcccgctggctcctatgccctgccctaaagggctcttgagcctctgggaatgggaggggccaagagaaggaaaaccctgtctttagcaccctttaaaagaactgtgccccccttctcagtgctgcctttgcatgggcctggcccggctcacattcgtcagtgactccaaccctcctgcttgctgtacttgggatgaaacgaccccacaggtcaggtggagggtggggcgtgggcatcagccaggattgccgttacagtctttttctcaggagctacaaagatctcttcctgttactaaatagtcgcaccccagcagcctctctcgcacaccggggccctgcatgtcagatggcgtggtctgcagggggagctctgtgccttagtggctcttggcaggacactgagggcctgcctgtggtgtgcccggctctgccactcccgggaggggaagggctgctcagctcaaggtgtcctgttcggtagagcaagtgtcctctgacagccgtgtccccggacagttcagacacccttggggatggcactccacacacgacagagatgcaggggccagggaagcccagcgctcggtgcccttcgtccagggttaaaatcggcctgtggggtgtggtgagaaggcaggttgtgcgggtgttgaccgatgtatcttttccttaaagttattataataatgggtaatttgtcaataaagcattcctttgggggaaagtccgcc

SEQ ID NO: 196425 - DNA, 1484 bp, Homo sapiens
  Payload ID: 18755
  Gene Name: tumor protein D52-like 3
  Uniprot ID: Q96J77
  ENST ID: ENST00000314556
  CDS Start-End: 193-603
ggtgtccattgtaccagctgggccatggatccctcccgcctgaaatctgactccacctgccaagagtctgagcctgcaggcctagatttcgactctgctggccaagattatttctctgcagcccaataattcgactctttctaccaagaattggacctggactctcttaacgaagatcttctttcccagtccatgccacatgccaggacagagacctctgtgggcacatatgaatcccactcgacttctgaactggaggatctgacagagcccgagcaaagagagctcaaaaccaaactcactaaattggaggctgaaattgtaaccctacgccacgtactagcagccaaagagagacgctgtggggaactcaagaggaagttaggcctcaccgccttggtagggctgagacagaatctgtccaagagctggcttgatgttcaggtctccaacacctatgtgaaacagaagacatcagctgctctgtccaccatgggcactctcatctgcaggaagcttggaggcgtgaagaagtcggccacattcagatcttttgaaggattgatcttcaataaatacacgttaaatcaaggaaggaattaacatcatatacttcagacatcaaatatggaatccaagagactatcaacaacatgaacttgttcacaagttccttctgcttttaaacaaaaatatcgtgtttattcaaagccaatctgagaccctactctgtatcaagaactgtcccaggttctgaaagcatagaattagacatcgtatgtgccctctagaaacacttagactttcaaatcattataattcaatgagtcctaaaatagagctgtgtgccagagataaaagaagtcctgaggaaggggtgttcaactctgtcttggtaggtcagtaaagactttagagagacagaaagtcttagaggactaggagaagtttgccagacagacaagaatagaacattccagacaacatgcagaggaactgagtcacaaaggaatgtataagaatggcatattctaggaactaacactgtggctagagaggaaggggaaatggtgttacatgagtgagggaggggaaatggtgttacgtgagtaagaaaaaataagcagggggcaaaatcataagtagtcttacatactacattagatatcaatatttaagcctgtaggaaatgggaggcattgaagcacttaagtaaaaaagtaactatcaaatttttgttttagattactctggtcatcagagaaatagattaagtatttaagaggtagaatctctcagacttaggaaccaactgcatgaggcggggcttggggggataaatttgcaagataataaggatgtagaattgaaaaggcctgatattattgaagctggagttgcacattcattttgctttggcttttttgtatcagtggtcatgggcaccaaataaaatgcttccatgaacatttggattctggctc

SEQ ID NO: 196426 - DNA, 2296 bp, Homo sapiens
  Payload ID: 18755
  Gene Name: tumor protein D52-like 3
  Uniprot ID: Q96J77
  ENST ID: ENST00000344545
  CDS Start-End: 222-644
acaggccaggtcgtcaactcaactgtcaaggtgtccattgtaccagctgggccatggatccctcccgcctgaaatctgactccacctgccaagagtctgagcctgcaggcctagatttcgactctgctggccaagattatttctctgcagcccaataattcgactctttctaccaagaattggacctggactctcttaacgaagatcttctttcccagtccatgccacatgccaggacagagacctctgtgggcacatatgaatcccactcgacttctgaactggaggatctgacagagcccgagcaaagagagctcaaaaccaaactcactaaattggaggctgaaattgtaaccctacgccacgtactagcagccaaagagagacgctgtggggaactcaagaggaagttaggcctcaccgccttggtagggctgagacagaatctgtccaagagctggcttgatgttcaggtctccaacacctatgtgaaacagaagacatcagctgctctgtccaccatgggcactctcatctgcaggaagcttggaggcgtgaagaagtcggccacattcagatcttttgaaggtctgatggggacaatcaagtccaaagtctcagggggcaaaagagcttggccctgactgtctttcttctgcggagggtggggttgatctgctctcagttttggggtgtggggaagacccactccagattccggggagtgggaatgagccactcccagttctggagagtgaggatgaccatctccactttctggaaccagaatgagcccccttggtaaccttgcctggtactaaaccagtgcaaggacccccttcccttattacatttgcaactctgcccaacaaaaacaagcaagcaaaccacaatggtaaagtggttaattcaggaaattgacagaatccagttttgagaaaagaacacagatatttgctgcttttaagatagagaacccaaagttttgtacctggttatttttcacttaagtttgtagacgaaatgtgccattatattagctttcctgagactgtatctaatgggcaagtcagtggctccagaggggtcttaggccaaagcccaaactctcttttggaaaactagcttattagaaagccaaagtagagttctgtttaagcttgaaagaggtatgaagtaatctgtagtgtttttttggtttgtttgtttgttttcccttccccatttccttccttccctcagtctcaaagtcaccttgaaagcttcacctggcctacaacttttattttaaaaagatgatcaagaaaacttcatcttctctgagactcagaaaaagaggggaaaatagtggtagtgcactaattgttacattactaatatagcttttgtaaaactcgtttgttttcaaaggtctggactaagcaaaacaacagtgtcagtttaggaaattattactactttgaacacaaactgaaattgcaactttgccttgtgctttgtttataatttctttatatatcaaaatgagtgttttaaagtttaacccttgaagcagcatgtctttgccatagcagcacttcacttaaaaggaagaaattgcctctctggcagcaattcctagttagttaccacctccagctgaggggctggaggaaaacaggtatagccaaattcaagaaagataaacccctgtctcaaggaacattttaaaaagaacgtctgtcccctgtgatgctggctgttatgcctttgaatggacctaactatacatctttgctcttaactccaagtctgcccttctttttaggaaaccctaaaggagaaggaagcagaatataaccctctggagagctcaagacagtaggaacctggacggtgcttgtttgaattttctgatatctgattttcacacgaatatactttttgtttgttttccttttccattttcaaaatgccaagatctgggagcctctttcactcctctagacacactgcctgagatagaagtttgcatcttattggctgtgggcagagactaggacccttatgggtacatttcagtaatctctcactgcctaaaatggtaatccctccagcctaagaggatgattctgttttgttgactcttgaatgctcccccaacattcctttggttttcctataagcaaaaccaaataccactataaatacaaaagcatctggtaaactgtaaagttactcatgtatcccaaccctccacagatttctgaagacaaagttttgcttggattaaaacaagatgttttactattttgca

SEQ ID NO: 196427 - DNA, 1321 bp, Homo sapiens
  Payload ID: 18755
  Gene Name: tumor protein D52-like 3
  Uniprot ID: Q96J77
  ENST ID: ENST00000381428
  CDS Start-End: 222-620
acaggccaggtcgtcaactcaactgtcaaggtgtccattgtaccagctgggccatggatccctcccgcctgaaatctgactccacctgccaagagtctgagcctgcaggcctagatttcgactctgctggccaagattatttctctgcagcccaataattcgactctttctaccaagaattggacctggactctcttaacgaagatcttctttcccagtccatgccacatgccaggacagagacctctgtgggcacatatgaatcccactcgacttctgaactggaggatctgacagagcccgagcaaagagagctcaaaaccaaactcactaaattggaggctgaaattgtaaccctacgccacgtactagcagccaaagagagacgctgtggggaactcaagaggaagttaggcctcaccgccttggtagggctgagacagaatctgtccaagagctggcttgatgttcaggtctccaacacctatgtgaaacagaagacatcagctgctctgtccaccatgggcactctcatctgcaggaagcttggaggcgtgaagaagtcggccacattcagatcttttgaaggaaaccctaaaggagaaggaagcagaatataaccctctggagagctcaagacagtaggaacctggacggtgcttgtttgaattttctgatatctgattttcacacgaatatactttttgtttgttttccttttccattttcaaaatgccaagatctgggagcctctttcactcctctagacacactgcctgagatagaagtttgcatcttattggctgtgggcagagactaggacccttatgggtacatttcagtaatctctcactgcctaaaatggtaatccctccagcctaagaggatgattctgttttgttgactcttgaatgctcccccaacattcctttggttttcctataagcaaaaccaaataccactataaatacaaaagcatctggtaaactgtaaagttactcatgtatcccaaccctccacagatttctgaagacaaagttttgcttggattaaaacaagatgttttactattttgcatgttcgatttttaatttgttgtgtttatcaaccaaaatggctttgtatgctggagaacaagaggtgagcctgcagcatacaagaaatgaaagtagtccaacaggcaaaggctttgacatatttcaggaaggcttgtgttagggacaatctcagactattatcatgggccaaacctgagagatgttatattttatttaataatttctacaacagtagtaagtttccccaataaattctcaactcc

SEQ ID NO: 196428 - DNA, 2579 bp, Homo sapiens
  Payload ID: 18756
  Gene Name: tumor protein p53
  Uniprot ID: P04637
  ENST ID: ENST00000269305
  CDS Start-End: 191-1372
gttttcccctcccatgtgctcaagactggcgctaaaagttttgagcttctcaaaagtctagagccaccgtccagggagcaggtagctgctgggctccggggacactttgcgttcgggctgggagcgtgctttccacgacggtgacacgcttccctggattggcagccagactgccttccgggtcactgccatggaggagccgcagtcagatcctagcgtcgagccccctctgagtcaggaaacattttcagacctatggaaactacttcctgaaaacaacgttctgtcccccttgccgtcccaagcaatggatgatttgatgctgtccccggacgatattgaacaatggttcactgaagacccaggtccagatgaagctcccagaatgccagaggctgctccccccgtggcccctgcaccagcagctcctacaccggcggcccctgcaccagccccctcctggcccctgtcatcttctgtcccttcccagaaaacctaccagggcagctacggtttccgtctgggcttcttgcattctgggacagccaagtctgtgacttgcacgtactcccctgccctcaacaagatgttttgccaactggccaagacctgccctgtgcagctgtgggttgattccacacccccgcccggcacccgcgtccgcgccatggccatctacaagcagtcacagcacatgacggaggttgtgaggcgctgcccccaccatgagcgctgctcagatagcgatggtctggcccctcctcagcatcttatccgagtggaaggaaatttgcgtgtggagtatttggatgacagaaacacttttcgacatagtgtggtggtgccctatgagccgcctgaggttggctctgactgtaccaccatccactacaactacatgtgtaacagttcctgcatgggcggcatgaaccggaggcccatcctcaccatcatcacactggaagactccagtggtaatctactgggacggaacagctttgaggtgcgtgtttgtgcctgtcctgggagagaccggcgcacagaggaagagaatctccgcaagaaaggggagcctcaccacgagctgcccccagggagcactaagcgagcactgcccaacaacaccagctcctctccccagccaaagaagaaaccactggatggagaatatttcacccttcagatccgtgggcgtgagcgcttcgagatgttccgagagctgaatgaggccttggaactcaaggatgcccaggctgggaaggagccaggggggagcagggctcactccagccacctgaagtccaaaaagggtcagtctacctcccgccataaaaaactcatgttcaagacagaagggcctgactcagactgacattctccacttcttgttccccactgacagcctcccacccccatctctccctcccctgccattttgggttttgggtctttgaacccttgcttgcaataggtgtgcgtcagaagcacccaggacttccatttgctttgtcccggggctccactgaacaagttggcctgcactggtgttttgttgtggggaggaggatggggagtaggacataccagcttagattttaaggtttttactgtgagggatgtttgggagatgtaagaaatgttcttgcagttaagggttagtttacaatcagccacattctaggtaggggcccacttcaccgtactaaccagggaagctgtccctcactgttgaattttctctaacttcaaggcccatatctgtgaaatgctggcatttgcacctacctcacagagtgcattgtgagggttaatgaaataatgtacatctggccttgaaaccaccttttattacatggggtctagaacttgacccccttgagggtgcttgttccctctccctgttggtcggtgggttggtagtttctacagttgggcagctggttaggtagagggagttgtcaagtctctgctggcccagccaaaccctgtctgacaacctcttggtgaaccttagtacctaaaaggaaatctcaccccatcccacaccctggaggatttcatctcttgtatatgatgatctggatccaccaagacttgttttatgctcagggtcaatttcttttttcttttttttttttttttttctttttctttgagactgggtctcgctttgttgcccaggctggagtggagtggcgtgatcttggcttactgcagcctttgcctccccggctcgagcagtcctgcctcagcctccggagtagctgggaccacaggttcatgccaccatggccagccaacttttgcatgttttgtagagatggggtctcacagtgttgcccaggctggtctcaaactcctgggctcaggcgatccacctgtctcagcctcccagagtgctgggattacaattgtgagccaccacgtccagctggaagggtcaacatcttttacattctgcaagcacatctgcattttcaccccacccttcccctccttctccctttttatatcccatttttatatcgatctcttattttacaataaaactttgctgccacctgtgtgtctgaggggtg

SEQ ID NO: 196429 - DNA, 1152 bp, Homo sapiens
  Payload ID: 18756
  Gene Name: tumor protein p53
  ENST ID: ENST00000359597
  CDS Start-End: 1-1032
atggaggagccgcagtcagatcctagcgtcgagccccctctgagtcaggaaacattttcagacctatggaaactacttcctgaaaacaacgttctgtcccccttgccgtcccaagcaatggatgatttgatgctgtccccggacgatattgaacaatggttcactgaagacccaggtccagatgaagctcccagaatgccagaggctgctccccccgtggcccctgcaccagcagctcctacaccggcggcccctgcaccagccccctcctggcccctgtcatcttctgtcccttcccagaaaacctaccagggcagctacggtttccgtctgggcttcttgcattctgggacagccaagtctgtgacttgcacgtactcccctgccctcaacaagatgttttgccaactggccaagacctgccctgtgcagctgtgggttgattccacacccccgcccggcacccgcgtccgcgccatggccatctacaagcagtcacagcacatgacggaggttgtgaggcgctgcccccaccatgagcgctgctcagatagcgatggtctggcccctcctcagcatcttatccgagtggaaggaaatttgcgtgtggagtatttggatgacagaaacacttttcgacatagtgtggtggtgccctatgagccgcctgaggttggctctgactgtaccaccatccactacaactacatgtgtaacagttcctgcatgggcggcatgaaccggaggcccatcctcaccatcatcacactggaagactccagtggtaatctactgggacggaacagctttgaggtgcgtgtttgtgcctgtcctgggagagaccggcgcacagaggaagagaatctccgcaagaaaggggagcctcaccacgagctgcccccagggagcactaagcgagcactgcccaacaacaccagctcctctccccagccaaagaagaaaccactggatggagaatatttcacccttcagaaaacatttccggccaggcacggtggatcacacctgtaatcccagctactcgggaggctgaggcaggagaatcgcttgaacccaggaggcagagggttgcagtgagccgagattgcgccattgcactctagcctgggcaacagagcaagactccatctc

SEQ ID NO: 196430 - DNA, 2653 bp, Homo sapiens
  Payload ID: 18756
  Gene Name: tumor protein p53
  Uniprot ID: P04637
  ENST ID: ENST00000420246
  CDS Start-End: 134-1159
ctagagccaccgtccagggagcaggtagctgctgggctccggggacactttgcgttcgggctgggagcgtgctttccacgacggtgacacgcttccctggattggcagccagactgccttccgggtcactgccatggaggagccgcagtcagatcctagcgtcgagccccctctgagtcaggaaacattttcagacctatggaaactacttcctgaaaacaacgttctgtcccccttgccgtcccaagcaatggatgatttgatgctgtccccggacgatattgaacaatggttcactgaagacccaggtccagatgaagctcccagaatgccagaggctgctccccccgtggcccctgcaccagcagctcctacaccggcggcccctgcaccagccccctcctggcccctgtcatcttctgtcccttcccagaaaacctaccagggcagctacggtttccgtctgggcttcttgcattctgggacagccaagtctgtgacttgcacgtactcccctgccctcaacaagatgttttgccaactggccaagacctgccctgtgcagctgtgggttgattccacacccccgcccggcacccgcgtccgcgccatggccatctacaagcagtcacagcacatgacggaggttgtgaggcgctgcccccaccatgagcgctgctcagatagcgatggtctggcccctcctcagcatcttatccgagtggaaggaaatttgcgtgtggagtatttggatgacagaaacacttttcgacatagtgtggtggtgccctatgagccgcctgaggttggctctgactgtaccaccatccactacaactacatgtgtaacagttcctgcatgggcggcatgaaccggaggcccatcctcaccatcatcacactggaagactccagtggtaatctactgggacggaacagctttgaggtgcgtgtttgtgcctgtcctgggagagaccggcgcacagaggaagagaatctccgcaagaaaggggagcctcaccacgagctgcccccagggagcactaagcgagcactgcccaacaacaccagctcctctccccagccaaagaagaaaccactggatggagaatatttcacccttcaggaccagaccagctttcaaaaagaaaattgttaaagagagcatgaaaatggttctatgactttgcctgatacagatgctacttgacttacgatggtgttacttcctgataaactcgtcgtaagttgaaaatattatccgtgggcgtgagcgcttcgagatgttccgagagctgaatgaggccttggaactcaaggatgcccaggctgggaaggagccaggggggagcagggctcactccagccacctgaagtccaaaaagggtcagtctacctcccgccataaaaaactcatgttcaagacagaagggcctgactcagactgacattctccacttcttgttccccactgacagcctcccacccccatctctccctcccctgccattttgggttttgggtctttgaacccttgcttgcaataggtgtgcgtcagaagcacccaggacttccatttgctttgtcccggggctccactgaacaagttggcctgcactggtgttttgttgtggggaggaggatggggagtaggacataccagcttagattttaaggtttttactgtgagggatgtttgggagatgtaagaaatgttcttgcagttaagggttagtttacaatcagccacattctaggtaggggcccacttcaccgtactaaccagggaagctgtccctcactgttgaattttctctaacttcaaggcccatatctgtgaaatgctggcatttgcacctacctcacagagtgcattgtgagggttaatgaaataatgtacatctggccttgaaaccaccttttattacatggggtctagaacttgacccccttgagggtgcttgttccctctccctgttggtcggtgggttggtagtttctacagttgggcagctggttaggtagagggagttgtcaagtctctgctggcccagccaaaccctgtctgacaacctcttggtgaaccttagtacctaaaaggaaatctcaccccatcccacaccctggaggatttcatctcttgtatatgatgatctggatccaccaagacttgttttatgctcagggtcaatttcttttttcttttttttttttttttttctttttctttgagactgggtctcgctttgttgcccaggctggagtggagtggcgtgatcttggcttactgcagcctttgcctccccggctcgagcagtcctgcctcagcctccggagtagctgggaccacaggttcatgccaccatggccagccaacttttgcatgttttgtagagatggggtctcacagtgttgcccaggctggtctcaaactcctgggctcaggcgatccacctgtctcagcctcccagagtgctgggattacaattgtgagccaccacgtccagctggaagggtcaacatcttttacattctgcaagcacatctgcattttcaccccacccttcccctccttctccctttttatatcccatttttatatcgatctcttattttacaataaaactttgctgccacctgtgtgtctgagggg

SEQ ID NO: 196431 - DNA, 2506 bp, Homo sapiens
  Payload ID: 18756
  Gene Name: tumor protein p53
  Uniprot ID: P04637
  ENST ID: ENST00000445888
  CDS Start-End: 137-1318
aaaagtctagagccaccgtccagggagcaggtagctgctgggctccggggacactttgcgttcgggctgggagcgtgctttccacgacggtgacacgcttccctggattggccagactgccttccgggtcactgccatggaggagccgcagtcagatcctagcgtcgagccccctctgagtcaggaaacattttcagacctatggaaactacttcctgaaaacaacgttctgtcccccttgccgtcccaagcaatggatgatttgatgctgtccccggacgatattgaacaatggttcactgaagacccaggtccagatgaagctcccagaatgccagaggctgctccccccgtggcccctgcaccagcagctcctacaccggcggcccctgcaccagccccctcctggcccctgtcatcttctgtcccttcccagaaaacctaccagggcagctacggtttccgtctgggcttcttgcattctgggacagccaagtctgtgacttgcacgtactcccctgccctcaacaagatgttttgccaactggccaagacctgccctgtgcagctgtgggttgattccacacccccgcccggcacccgcgtccgcgccatggccatctacaagcagtcacagcacatgacggaggttgtgaggcgctgcccccaccatgagcgctgctcagatagcgatggtctggcccctcctcagcatcttatccgagtggaaggaaatttgcgtgtggagtatttggatgacagaaacacttttcgacatagtgtggtggtgccctatgagccgcctgaggttggctctgactgtaccaccatccactacaactacatgtgtaacagttcctgcatgggcggcatgaaccggaggcccatcctcaccatcatcacactggaagactccagtggtaatctactgggacggaacagctttgaggtgcgtgtttgtgcctgtcctgggagagaccggcgcacagaggaagagaatctccgcaagaaaggggagcctcaccacgagctgcccccagggagcactaagcgagcactgcccaacaacaccagctcctctccccagccaaagaagaaaccactggatggagaatatttcacccttcagatccgtgggcgtgagcgcttcgagatgttccgagagctgaatgaggccttggaactcaaggatgcccaggctgggaaggagccaggggggagcagggctcactccagccacctgaagtccaaaaagggtcagtctacctcccgccataaaaaactcatgttcaagacagaagggcctgactcagactgacattctccacttcttgttccccactgacagcctcccacccccatctctccctcccctgccattttgggttttgggtctttgaacccttgcttgcaataggtgtgcgtcagaagcacccaggacttccatttgctttgtcccggggctccactgaacaagttggcctgcactggtgttttgttgtggggaggaggatggggagtaggacataccagcttagattttaaggtttttactgtgagggatgtttgggagatgtaagaaatgttcttgcagttaagggttagtttacaatcagccacattctaggtaggggcccacttcaccgtactaaccagggaagctgtccctcactgttgaattttctctaacttcaaggcccatatctgtgaaatgctggcatttgcacctacctcacagagtgcattgtgagggttaatgaaataatgtacatctggccttgaaaccaccttttattacatggggtctagaacttgacccccttgagggtgcttgttccctctccctgttggtcggtgggttggtagtttctacagttgggcagctggttaggtagagggagttgtcaagtctctgctggcccagccaaaccctgtctgacaacctcttggtgaaccttagtacctaaaaggaaatctcaccccatcccacaccctggaggatttcatctcttgtatatgatgatctggatccaccaagacttgttttatgctcagggtcaatttcttttttcttttttttttttttttttctttttctttgagactgggtctcgctttgttgcccaggctggagtggagtggcgtgatcttggcttactgcagcctttgcctccccggctcgagcagtcctgcctcagcctccggagtagctgggaccacaggttcatgccaccatggccagccaacttttgcatgttttgtagagatggggtctcacagtgttgcccaggctggtctcaaactcctgggctcaggcgatccacctgtctcagcctcccagagtgctgggattacaattgtgagccaccacgtccagctggaagggtcaacatcttttacattctgcaagcacatctgcattttcaccccacccttcccctccttctccctttttatatcccatttttatatcgatctcttattttacaataaaactttgctgcca

SEQ ID NO: 196432 - DNA, 2580 bp, Homo sapiens
  Payload ID: 18756
  Gene Name: tumor protein p53
  Uniprot ID: P04637
  ENST ID: ENST00000455263
  CDS Start-End: 134-1174
ctagagccaccgtccagggagcaggtagctgctgggctccggggacactttgcgttcgggctgggagcgtgctttccacgacggtgacacgcttccctggattggcagccagactgccttccgggtcactgccatggaggagccgcagtcagatcctagcgtcgagccccctctgagtcaggaaacattttcagacctatggaaactacttcctgaaaacaacgttctgtcccccttgccgtcccaagcaatggatgatttgatgctgtccccggacgatattgaacaatggttcactgaagacccaggtccagatgaagctcccagaatgccagaggctgctccccccgtggcccctgcaccagcagctcctacaccggcggcccctgcaccagccccctcctggcccctgtcatcttctgtcccttcccagaaaacctaccagggcagctacggtttccgtctgggcttcttgcattctgggacagccaagtctgtgacttgcacgtactcccctgccctcaacaagatgttttgccaactggccaagacctgccctgtgcagctgtgggttgattccacacccccgcccggcacccgcgtccgcgccatggccatctacaagcagtcacagcacatgacggaggttgtgaggcgctgcccccaccatgagcgctgctcagatagcgatggtctggcccctcctcagcatcttatccgagtggaaggaaatttgcgtgtggagtatttggatgacagaaacacttttcgacatagtgtggtggtgccctatgagccgcctgaggttggctctgactgtaccaccatccactacaactacatgtgtaacagttcctgcatgggcggcatgaaccggaggcccatcctcaccatcatcacactggaagactccagtggtaatctactgggacggaacagctttgaggtgcgtgtttgtgcctgtcctgggagagaccggcgcacagaggaagagaatctccgcaagaaaggggagcctcaccacgagctgcccccagggagcactaagcgagcactgcccaacaacaccagctcctctccccagccaaagaagaaaccactggatggagaatatttcacccttcagatgctacttgacttacgatggtgttacttcctgataaactcgtcgtaagttgaaaatattatccgtgggcgtgagcgcttcgagatgttccgagagctgaatgaggccttggaactcaaggatgcccaggctgggaaggagccaggggggagcagggctcactccagccacctgaagtccaaaaagggtcagtctacctcccgccataaaaaactcatgttcaagacagaagggcctgactcagactgacattctccacttcttgttccccactgacagcctcccacccccatctctccctcccctgccattttgggttttgggtctttgaacccttgcttgcaataggtgtgcgtcagaagcacccaggacttccatttgctttgtcccggggctccactgaacaagttggcctgcactggtgttttgttgtggggaggaggatggggagtaggacataccagcttagattttaaggtttttactgtgagggatgtttgggagatgtaagaaatgttcttgcagttaagggttagtttacaatcagccacattctaggtaggggcccacttcaccgtactaaccagggaagctgtccctcactgttgaattttctctaacttcaaggcccatatctgtgaaatgctggcatttgcacctacctcacagagtgcattgtgagggttaatgaaataatgtacatctggccttgaaaccaccttttattacatggggtctagaacttgacccccttgagggtgcttgttccctctccctgttggtcggtgggttggtagtttctacagttgggcagctggttaggtagagggagttgtcaagtctctgctggcccagccaaaccctgtctgacaacctcttggtgaaccttagtacctaaaaggaaatctcaccccatcccacaccctggaggatttcatctcttgtatatgatgatctggatccaccaagacttgttttatgctcagggtcaatttcttttttcttttttttttttttttttctttttctttgagactgggtctcgctttgttgcccaggctggagtggagtggcgtgatcttggcttactgcagcctttgcctccccggctcgagcagtcctgcctcagcctccggagtagctgggaccacaggttcatgccaccatggccagccaacttttgcatgttttgtagagatggggtctcacagtgttgcccaggctggtctcaaactcctgggctcaggcgatccacctgtctcagcctcccagagtgctgggattacaattgtgagccaccacgtccagctggaagggtcaacatcttttacattctgcaagcacatctgcattttcaccccacccttcccctccttctccctttttatatcccatttttatatcgatctcttattttacaataaaactttgctgccacctgtgtgtctgagggg

SEQ ID NO: 196433 - DNA, 1018 bp, Homo sapiens
  Payload ID: 18756
  Gene Name: tumor protein p53
  ENST ID: ENST00000413465
  CDS Start-End: 1-858
atggaggagccgcagtcagatcctagcgtcgagccccctctgagtcaggaaacattttcagacctatggaaactacttcctgaaaacaacgttctgtcccccttgccgtcccaagcaatggatgatttgatgctgtccccggacgatattgaacaatggttcactgaagacccaggtccagatgaagctcccagaatgccagaggctgctccccccgtggcccctgcaccagcagctcctacaccggcggcccctgcaccagccccctcctggcccctgtcatcttctgtcccttcccagaaaacctaccagggcagctacggtttccgtctgggcttcttgcattctgggacagccaagtctgtgacttgcacgtactcccctgccctcaacaagatgttttgccaactggccaagacctgccctgtgcagctgtgggttgattccacacccccgcccggcacccgcgtccgcgccatggccatctacaagcagtcacagcacatgacggaggttgtgaggcgctgcccccaccatgagcgctgctcagatagcgatggtctggcccctcctcagcatcttatccgagtggaaggaaatttgcgtgtggagtatttggatgacagaaacacttttcgacatagtgtggtggtgccctatgagccgcctgaggttggctctgactgtaccaccatccactacaactacatgtgtaacagttcctgcatgggcggcatgaaccggaggcccatcctcaccatcatcacactggaagactccaggccaaggcaggtggatcacctgaggtcaggagttcaagacagcctggccaacatagcgaaatcccatctctactaaaaatacaaaaattagcctggcagtggtggcccacgcctgtaatcccagctactaagggggctgaggcaggaggatctcttaaccagggaggaggaggttgcagtgagcagagattgtgccactgcactccagcctgtgcaacagagtgagactctgtctc

SEQ ID NO: 196434 - DNA, 546 bp, Homo sapiens
  Payload ID: 18756
  Gene Name: tumor protein p53
  ENST ID: ENST00000514944
  CDS Start-End: 80-546
ttcgggctgggagcgtgctttccacgacggtgacacgcttccctggattggcagccagactgccttccgggtcactgccatggaggagccgcagtcagatcctagcgtcgagccccctctgagtcaggaaacattttcagacctatggaaactacttcctgaaaacaacgttctgtactcccctgccctcaacaagatgttttgccaactggccaagacctgccctgtgcagctgtgggttgattccacacccccgcccggcacccgcgtccgcgccatggccatctacaagcagtcacagcacatgacggaggttgtgaggcgctgcccccaccatgagcgctgctcagatagcgatggtctggcccctcctcagcatcttatccgagtggaaggaaatttgcgtgtggagtatttggatgacagaaacacttttcgacatagtgtggtggtgccctatgagccgcctgaggttggctctgactgtaccaccatccactacaactacatgtgtaacagttcctgcatgggcggcatgaaccggag

SEQ ID NO: 196435 - DNA, 634 bp, Homo sapiens
  Payload ID: 18756
  Gene Name: tumor protein p53
  ENST ID: ENST00000508793
  CDS Start-End: 139-634
aatgcagggctgaggagtgtccgaagagaatgggcaggtgagcggtgagacagttgttcttccagaagctttgcagtgaaaggaatcaaagaaatggagccgtgtatcagcagccagactgccttccgggtcactgccatggaggagccgcagtcagatcctagcgtcgagccccctctgagtcaggaaacattttcagacctatggaaactacttcctgaaaacaacgttctgtcccccttgccgtcccaagcaatggatgatttgatgctgtccccggacgatattgaacaatggttcactgaagacccaggtccagatgaagctcccagaatgccagaggctgctccccccgtggcccctgcaccagcagctcctacaccggcggcccctgcaccagccccctcctggcccctgtcatcttctgtcccttcccagaaaacctaccagggcagctacggtttccgtctgggcttcttgcattctgggacagccaagtctgtgacttgcacgtactcccctgccctcaacaagatgttttgccaactggccaagacctgccctgtgcagctgtgggttgattccacacccccgcccggcacccgcgtccgcgccatggccatctacaagcagt

SEQ ID NO: 196436 - DNA, 729 bp, Homo sapiens
  Payload ID: 18756
  Gene Name: tumor protein p53
  ENST ID: ENST00000509690
  CDS Start-End: 133-729
aaaagtctagagccaccgtccagggagcaggtagctgctgggctccggggacactttgcgttcgggctgggagcgtgctttccacgacggtgacacgcttccctggattggtactcccctgccctcaacaagatgttttgccaactggccaagacctgccctgtgcagctgtgggttgattccacacccccgcccggcacccgcgtccgcgccatggccatctacaagcagtcacagcacatgacggaggttgtgaggcgctgcccccaccatgagcgctgctcagatagcgatggtctggcccctcctcagcatcttatccgagtggaaggaaatttgcgtgtggagtatttggatgacagaaacacttttcgacatagtgtggtggtgccctatgagccgcctgaggttggctctgactgtaccaccatccactacaactacatgtgtaacagttcctgcatgggcggcatgaaccggaggcccatcctcaccatcatcacactggaagactccagtggtaatctactgggacggaacagctttgaggtgcgtgtttgtgcctgtcctgggagagaccggcgcacagaggaagagaatctccgcaagaaaggggagcctcaccacgagctgcccccagggagcactaagcgagcactgcccaacaacaccagctcctctccccagccaaagaagaaaccactggatggagaatatttcacccttcag

SEQ ID NO: 196437 - DNA, 565 bp, Homo sapiens
  Payload ID: 18756
  Gene Name: tumor protein p53
  ENST ID: ENST00000503591
  CDS Start-End: 183-565
ttcgggctgggagcgtgctttccacgacggtgacacgcttccctggattggggctgaggagtgtccgaagagaatgggcaggtgagcggtgagacagttgttcttccagaagctttgcagtgaaaggaatcaaagaaatggagccgtgtatcagcagccagactgccttccgggtcactgccatggaggagccgcagtcagatcctagcgtcgagccccctctgagtcaggaaacattttcagacctatggaaactacttcctgaaaacaacgttctgtcccccttgccgtcccaagcaatggatgatttgatgctgtccccggacgatattgaacaatggttcactgaagacccaggtccagatgaagctcccagaatgccagaggctgctccccccgtggcccctgcaccagcagctcctacaccggcggcccctgcaccagccccctcctggcccctgtcatcttctgtcccttcccagaaaacctaccagggcagctacggtttccgtctgggcttcttgcattctgggacagccaagtctgtgacttgcacgtactcccc

SEQ ID NO: 196438 - DNA, 175 bp, Homo sapiens
  Payload ID: 18756
  Gene Name: tumor protein p53
  ENST ID: ENST00000576024
  CDS Start-End: 1-95
cctctccccagccaaagaagaaaccactggatggagaatatttcacccttcagccacctgaagtccaaaaagggtcagtctacctcccgccataaaaaactcatgttcaagacagaagggcctgactcagactgacattctccacttcttgttccccactgacagcctcccaccc

SEQ ID NO: 196439 - DNA, 568 bp, Homo sapiens
  Payload ID: 18756
  Gene Name: tumor protein p53
  ENST ID: ENST00000604348
  CDS Start-End: 140-568
aaaagtctagagccaccgtccagggagcaggtagctgctgggctccggggacactttgcgttcgggctgggagcgtgctttccacgacggtgacacgcttccctggattggcagccagactgccttccgggtcactgccatggaggagccgcagtcagatcctagcgtcgagccccctctgagtcaggaaacattttcagacctatggaaactacttcctgaaaacaacgttctgtcccccttgccgtcccaagcaatggatgatttgatgctgtccccggacgatattgaacaatggttcactgaagacccaggtccagatgaagctcccagaatgccagaggctgctccccccgtggcccctgcaccagcagctcctacaccggcggcccctgcaccagccccctcctggcccctgtcatcttctgtcccttcccagaaaacctaccagggcagctacggtttccgtctgggcttcttgcattctgggacagccaagtctgtgacttgcacgatgttttgccaactggccaagacctgccctgtgcagctgtgggttgattccaca

SEQ ID NO: 196440 - DNA, 2331 bp, Homo sapiens
  Payload ID: 18756
  Gene Name: tumor protein p53
  ENST ID: ENST00000610623
  CDS Start-End: 360-923
tgaggccaggagatggaggctgcagtgagctgtgatcacaccactgtgctccagcctgagtgacagagcaagaccctatctcaaaaaaaaaaaaaaaaaagaaaagctcctgaggtgtagacgccaactctctctagctcgctagtgggttgcaggaggtgcttacgcatgtttgtttctttgctgccgtcttccagttgctttatctgttcacttgtgccctgactttcaactctgtctccttcctcttcctacagtactcccctgccctcaacaagatgttttgccaactggccaagacctgccctgtgcagctgtgggttgattccacacccccgcccggcacccgcgtccgcgccatggccatctacaagcagtcacagcacatgacggaggttgtgaggcgctgcccccaccatgagcgctgctcagatagcgatggtctggcccctcctcagcatcttatccgagtggaaggaaatttgcgtgtggagtatttggatgacagaaacacttttcgacatagtgtggtggtgccctatgagccgcctgaggttggctctgactgtaccaccatccactacaactacatgtgtaacagttcctgcatgggcggcatgaaccggaggcccatcctcaccatcatcacactggaagactccagtggtaatctactgggacggaacagctttgaggtgcgtgtttgtgcctgtcctgggagagaccggcgcacagaggaagagaatctccgcaagaaaggggagcctcaccacgagctgcccccagggagcactaagcgagcactgcccaacaacaccagctcctctccccagccaaagaagaaaccactggatggagaatatttcacccttcagatgctacttgacttacgatggtgttacttcctgataaactcgtcgtaagttgaaaatattatccgtgggcgtgagcgcttcgagatgttccgagagctgaatgaggccttggaactcaaggatgcccaggctgggaaggagccaggggggagcagggctcactccagccacctgaagtccaaaaagggtcagtctacctcccgccataaaaaactcatgttcaagacagaagggcctgactcagactgacattctccacttcttgttccccactgacagcctcccacccccatctctccctcccctgccattttgggttttgggtctttgaacccttgcttgcaataggtgtgcgtcagaagcacccaggacttccatttgctttgtcccggggctccactgaacaagttggcctgcactggtgttttgttgtggggaggaggatggggagtaggacataccagcttagattttaaggtttttactgtgagggatgtttgggagatgtaagaaatgttcttgcagttaagggttagtttacaatcagccacattctaggtaggggcccacttcaccgtactaaccagggaagctgtccctcactgttgaattttctctaacttcaaggcccatatctgtgaaatgctggcatttgcacctacctcacagagtgcattgtgagggttaatgaaataatgtacatctggccttgaaaccaccttttattacatggggtctagaacttgacccccttgagggtgcttgttccctctccctgttggtcggtgggttggtagtttctacagttgggcagctggttaggtagagggagttgtcaagtctctgctggcccagccaaaccctgtctgacaacctcttggtgaaccttagtacctaaaaggaaatctcaccccatcccacaccctggaggatttcatctcttgtatatgatgatctggatccaccaagacttgttttatgctcagggtcaatttcttttttcttttttttttttttttttctttttctttgagactgggtctcgctttgttgcccaggctggagtggagtggcgtgatcttggcttactgcagcctttgcctccccggctcgagcagtcctgcctcagcctccggagtagctgggaccacaggttcatgccaccatggccagccaacttttgcatgttttgtagagatggggtctcacagtgttgcccaggctggtctcaaactcctgggctcaggcgatccacctgtctcagcctcccagagtgctgggattacaattgtgagccaccacgtccagctggaagggtcaacatcttttacattctgcaagcacatctgcattttcaccccacccttcccctccttctccctttttatatcccatttttatatcgatctcttattttacaataaaactttgctgccacctgtgtgtctgaggggtg
